United States Patent 7,745,391 (HUMAN THROMBOSPONDIN POLYPEPTIDE) - sequence listing, part 294

SEQ ID NO: 975773 - protein, 119 aa, Homo sapiens
MAKERPLRSKRQVNFGHLWRLGLKSHAPMWQCQSLGLAKWADLLSSSALLLKNDDCKNHCQPSSRHSPIEGFIFTADHRSRLIGRQPQALGAGTGVRCLAQAQNPLSPLTRGGRRGEVA

SEQ ID NO: 975774 - protein, 80 aa, Homo sapiens
GSSAARGSVSWLSTSVWTEQIGDSLPSLRRPPISSRFEPLGPSSRPSPASGPASNRFVWELLLCQPTMSSQIRQNYPTER

SEQ ID NO: 975775 - protein, 126 aa, Homo sapiens
GDRLLAMPPNETCTVKGITLHDEPVDWAAEAIMLVLLGSGMDIIKIKCGAGMNLVAPKYPLNACTRFRARILIFNIEDSYQLRGFTVCLLHYPKPVSEPAVIKRLISVLNKSTGERHKGKSLKFCD

SEQ ID NO: 975776 - protein, 293 aa, Homo sapiens
LLSPGVLVQVTSSYTLVESLTHRGDAQEDRATWRSNYSLRSSTYVDDNPKCSMCGTQTIVGSKQIAADPNVPSREGCGADVGNNTMMRRAIGGAPEKQPVLTKMLAQYRGETGGLGCPPREGPLKWRIQGNIVLVATEGAHLCWPVVWLHFWPPLFERFTWWQAQENVSRAQRKTSFLPRALSGITTKIPPGHHLNILECCAVDQDWHDTCDEQDATVGLVQISLFLVAGPQEGSAMAALNPEVLFRGTLFPSGVPMSVLLRLYHCVGLSSRTGGFGRTSWRGLAHWGPVTSC

SEQ ID NO: 975777 - protein, 131 aa, Homo sapiens
MSKEVTIGADNNVCCPQNKRCGFPKQERRTTPGGANKNTNNGGARGAISLTPHAENKKNDRPLWGGEDQTPRGGVLHRRHKTFSTKKMGGTHRRERDPQNKRGGGDHTKHNQRSGGQPPHKKKRRTRRQMN

SEQ ID NO: 975778 - protein, 145 aa, Homo sapiens
MEGTGQAPLSVPVENTDAPTSFGPSVRDTQGSIRNKGNTGADPRVWELAVTQGHWRCVQRGLHAINQLLEGGRSTTRGAHTGHYLRIVRLPFAIKERILCQRGYRTQGDVRRLWNYPKHDGLGNPSHKAGTRTRMGGPHTLRGKL

SEQ ID NO: 975779 - protein, 56 aa, Homo sapiens
MPRRVEEKQCLGNYKTRQQDEESKATHRQATNGTTRSTIPRNKSKQMKDQAEKQTS

SEQ ID NO: 975780 - protein, 142 aa, Homo sapiens
AVTKLVTNVSQWFYNPEATSGITASQSSLVSNSSSGSSSSTTITYFLIQCAVTAVVSSTPSVVMSTVAQGVIYISNQNGINQIPSPKSLVSAPNQILCKFPKKSKSPKQQLYQCTQDTATSGPAFSSISSEKLRSSPCATVY

SEQ ID NO: 975781 - protein, 313 aa, Homo sapiens
GSHMLTFLQQLRVAVARASERASSHSLRSHALKNYLCFDGEDIVPVTFLGRLVVNAKLGWREQGRIVGIDPNLTTVLVTEGSPSLVLVEFAEEGSNWDCPEEQATQAWLGPQNWYRAARFGCGPWWVAGEERNVPAKHEVGRCLCRRGGFSERVPSRRETTYILVGPWVKGTGGTWDSGLIALEYTRSSGHPQGCCKGSDFEQHAGNLAKRPRLGKENLVYLFWGAHPCLVCEKAPKSRFPGSGCTRCSRRDQMGLCMIAPVAILEFSFRALFAIPWELATERGGGAPNPWRAEGRPAISGIAEVNTAPCSGG

SEQ ID NO: 975782 - protein, 103 aa, Homo sapiens
TGRGLGSAAGHGSRLCSTRAKMPILGGYLEVPSRQVTEAREVWPCDVGIPPHRVCPLCPRMRMSVGVPHSGRTLSGSRLGESVKELLHRQASCGASLPMRRPW

SEQ ID NO: 975783 - protein, 102 aa, Homo sapiens
MRDTTSEGGPKKEHHPGEPSKTRGRRRRTHTPNKKKTEGAGGMGNNNRRYDGEYMEKQQHYCKKDGREQPRGRHHNSSGGGIKKTNKARGVHQQRARHRLRQ

SEQ ID NO: 975784 - protein, 184 aa, Homo sapiens
VAAAGTLGVWDATGGKLNGPFQAFGVGTVLSRRGRGRTIPIYQADPQCYPKCGLVFIHPFNKGKTPTTFGGKTFLLNLHKFFKKRTPEKGSHNLAAWAIPKSGPPKTPFFGGTRGLHLKSRDCGKNQNAPGELKTCPPEEKGLLKPKAGQYTAGRPLIPRSEVVGTLVVWKGKKQLYAGGWGAN

SEQ ID NO: 975785 - protein, 83 aa, Homo sapiens
PARWSRRVIPALREAKKGKDSGAHGVRDRAWQYTQRPVFLQEKVTQINKAKDGAKKRSKGGKFPPNGESPNLAGVFPKGGFPG

SEQ ID NO: 975786 - protein, 276 aa, Homo sapiens
MAPSRKFFVGGTENERAKQSLGELIGTLNAARCGDTEVVGAPPYAYIDFARKKLRSQDGLWLLQNCYKVTNGALTGEIKPWEGSKTGEPRGWSWGTQREGIVWGESDDADVGTKVGPMLWQEGLGEIAVHGGRRYMTGDGGITEKGLFEQTEVIADNVKELTQGRPAMSCVAHGTGKSATPPNAQEVHEKARGWLRGHVSCWRGTEARIINEAPGGLGTWKEVAAGLMDATGGGLPTSESGDIRPKEAPISNFGTRDNPETERARKAEEDAPRRTK

SEQ ID NO: 975787 - protein, 76 aa, Homo sapiens
PLGRNWHLAVVRPNQECTGKSTAEAPDICPLDLAENVELLVVSTYMQNLYEKVNTSESNEGNVVLFLPNAKCPREC

SEQ ID NO: 975788 - protein, 100 aa, Homo sapiens
VDFELEVSPAQVTFIACSFAFFLPPPLPPSPSWPSALRPLQGHLYTVPIREQGNIYKPKNKAMARRAEREAKCTTRTPREIDLVKPDLKNLNDDVVKDVI

SEQ ID NO: 975789 - protein, 70 aa, Homo sapiens
HPEQQSKEDGVRASGALTTGRAGVHGDWERARSSSSLSPASPSHPTQPEQRCRRSQPTSSSHGCDLRGER

SEQ ID NO: 975790 - protein, 264 aa, Homo sapiens
MADGQVAELLLRRWRRLMAAGQRRVGGELGMEHQAVVGAVKSLQALGEVIEAELRVHQMDYVQRVKRTHSQGGYGSQGYKYNWKLDEARKKTYWNPNQISQRPCASTCCAQKEALHSGSSTFSIDLVFRNETPGRQRTWLSPPDRGAWWRIMVSPVANLMGVCGEFFTSWVSRQLRSRPARNHKRGQHGGCSVTTRGLKKWGGVGKLGGLQSEDAAAMGFRESVGHAGLSWEPTVTIWLPFRLGPKCCVCGALARWTALKGVCP

SEQ ID NO: 975791 - protein, 251 aa, Homo sapiens
MFACSNVVSPLPPWSRAPHMLREPYAIVQMVLKDRRILTDESLSSFGSLMSPFLDWFIAKAFQTSAISGDIDTAAKFLCGAGAATGWAWPGTGGWHRNCVGSLIIWFCQEPFSEATVLLLRHSGLALSEAMALFCLMVAFLILLCHGEGAVSTSHRFSRVLLARVVPFLNTSPGSPEATCWLRAFARRRDHLILSQTAIETEKDVGAASTGKFEHRFGAAQVGRGQRPRTGRNGGPKKPGPVAPRWAWLRP

SEQ ID NO: 975792 - protein, 112 aa, Homo sapiens
MHYEVMKKAFLTRLVAEEKSVLETIAVGARGPPRLCESTVAIGITPRGNPGVVKKWGGSSPYWKYPPRGDHEGEVFATQRSNKRARLEGRAQTGTLRPKEGPMVDLFSFASL

SEQ ID NO: 975793 - protein, 173 aa, Homo sapiens
MTSCKEELPSLLDSGRQQDNQLQRGTAHSRASSLLRTEHSTGRPFPQRGATHCVSPLSYSNTSIKLLLQSVNLSKKKNKQQQRLDTAHNASPRTTTPNQRRPRQTTHNNNEKAVGGAAPQAKIHNTGVGAATPKMNWTTVRTTGAERGGFHPKKPAARLTTHRGGTVFNDSHT

SEQ ID NO: 975794 - protein, 307 aa, Homo sapiens
MERSRGPEGTRALSLSCSPLPLGESCSMPRSWPSVTCKEQAESGALCDRVSTDVTSRESLWGSESLLRYRGRIVSSNDVRRSCLGACPRGKHVRSTSRPVEVGCSLFGKRTGQRFTVECGLTTVAGQENGSVIRGPTGWQDGDISMASSYQEAPGGPPTFTVTVNQDDKTLVWLMPNHACPAGFDSTRMYDTASTFAVPYCPRLSFPLTLPKFDPFFSIITQTFICAHYPYLIGAKPIAGAKLDEELPLQFSRVWCNHCMGVIPTHSLLNTNQRHLHSHSCTPRNRKQKHAARYSGQQTHVAHTAVS

SEQ ID NO: 975795 - protein, 32 aa, Homo sapiens
MTTDLQRLMSSAMESSRIVLRRGKLEMNGRNR

SEQ ID NO: 975796 - protein, 94 aa, Homo sapiens
MKHRGAKNGRSKEHRQHHTRVDITPNRDHVTSEHNIHQNSLQAATPHVSTETAQRWTYCSQTGAQGGHKRETQTWIGDQNRPRTIPNNGVTPTH

SEQ ID NO: 975797 - protein, 269 aa, Homo sapiens
LPVWLLTTGEAGNQVGGMAERALEPEAEAEAEADAGGEAAAEEGAGSERRGAGRSSRSSEPGAGVGPESLERWYDVRRVFPGRGRTGALGGSCGAAAGFGGSQGSAALPQLSFLRGGRASAGKAEPSMEKAFGEKFSVARIKGHKRRVGKMGVGKALVENLVVERTVGRHPWLTEGAQHMHPVWLRKEAGPPRDESIGRPELLLRPWLPKRGPVLGGWRSAGANRALTFPGARGIARSRGRAPYKGCLEPLIGLRTVGVNRRLGWAGGV

SEQ ID NO: 975798 - protein, 238 aa, Homo sapiens
MVSVINTVVVPPHDGHDSRQPRWTTMGTRLGICSSDQVRRNIFDCVAMEWQILIARPSGVMTGPVWHRWPGHHPMCGYILALCSYERKVIIWREVKLAPWEKSHRACGETEFSHVNIVCAWASHVLTGLILACVSSDGAISLLTYTGEGQWEVKKISNAHTSWVQCRQSGDPAVGTRGSLIDHPSGQKPNYIKRFAQVGCDNLIKLWKEEKDGPVEGGSKKLKSAPSDWVRECWPGPL

SEQ ID NO: 975799 - protein, 66 aa, Homo sapiens
MVFTVNTCGAYSVVPLGTTSCRQGTKAVRDSPPNKNARAGHRRVLNQSRGSEGPKGPYTEVKEPII

SEQ ID NO: 975800 - protein, 157 aa, Homo sapiens
MTWRKSRIMDLTYVLRMLVRWLLSVLSVVIYVHIMAFIGNASKYLRNYDRVLDIMIAICALKWTCCIEHLSPLWIFRSWENKEPVNLYTFHYPREVPLEDPGLSVFPTDILDPVSTDSLVNCAKRQDVSGIKIEPGLQHFGVRLKKELKYAKSENLV

SEQ ID NO: 975801 - protein, 187 aa, Homo sapiens
MAMHNKAAPPKIPAHPAELAELREGGSRSCRKLVEIVERQIYAFGGKLPWKDTSDVWQYYSWWDPVSDQPKKIPIAKVIEGTRKLKEAEGVFSKSCGYLSSCSKCMCQESRTSSWKQREPAKVGRKVTLSPDFHNSGNMSPAREDPEDLDGSVQGVNLRGCSSTSSGSHHQQHKSERIKPATGIALS

SEQ ID NO: 975802 - protein, 238 aa, Homo sapiens
GPYAANVHRAIISICCCLFILFLFLSELTGFITTEVVNELYVDDPDKDSGGKIDVSLNISLPNLHCEWVGLTIQDEMGRHEVGPQSTIHEDPVNNGAGCRSRGQFSINKVPGNFHVSTTQCHSPAKNPDMTHVIHKLSFWDTLQVQNIQELSMLSGEQTDSPQTPVGLPTITILKMGGPTVNEDNEWASRGNSITSTTGGQQGIRRYSQTGDSSLKSGSVRTQAHQVKYTERRAGVQI

SEQ ID NO: 975803 - protein, 93 aa, Homo sapiens
QTLTFSASAPAPWRPPGSSSVWGETRKGWNTGAGKGQGSFVAEGKAFNSGDNLPWKSRRGPKKGVWPRGARETNPGKEAVADMLDWPFPPPPY

SEQ ID NO: 975804 - protein, 349 aa, Homo sapiens
MSYPASATYDYCQIRGHEQTRDGAKQTTRGHRRGRRECNERGEQREKGGRAEESREAAGDEGRETLQSGGEREPRGEQWESEGAERGSDESKPERRDGREGERDRAAERRNDREAKREKERGDAEQRRTESDREKKEGAGGQQDKQKRAQRPEDKKREDEKDEEEREAKKQGERITSQTERRREKNKEKRKTGGESRREDGQGERGQNNKRHGARRKKKSDQANTRAETRGADEAREEEHEHNRRGESTAQTNDREGSRTQERTTAQTTERADDSERETGSEHEAKEGGRQRENTDRHKSEDKQETQRRREAKNEERPEGSEEEPADRAANRASERRNTRRPNKRTRNR

SEQ ID NO: 975805 - protein, 95 aa, Homo sapiens
MTIEARREYYEMRSPHIQTEGDDPTKPTKDSNTDQIYLRDHEDSKGNTVQATKKRQRRKLDEYCANIATFPRSLFLYVRLLSSFFSNLFRAKGGR

SEQ ID NO: 975806 - protein, 272 aa, Homo sapiens
MKQEAVIRRRIHTVGPRPPPGGAPSRERKAKNAPPTAIVLFTLPSYFLFILHNHTKQQTTIDYIFIYIILPPSPYPTIHNNTIPRTKYISFLLLSTSSSPPPSLTLAQQRKSIVFIFTLSPFPSHLSSPPAQPHNYEKAHKPTNTLFLLFPLSFFSPLPTHHERQQIRTLIVSSPRSAPHSLPLPRNHDHSDMKPPALITLSITIYSPLYPPSRPFLYTIQAEQTDKYLPSLTSPFLVYSFSYCLRASSLRYTRVEESDDNASFHQLLSLFS

SEQ ID NO: 975807 - protein, 110 aa, Homo sapiens
LVTKVANNGYTGEELLEWLPVYGTLDGVLNVKRELKALELGKLKQSIYMLENELREKDVKNKKLLVPRLINYYFWLIDHYMNGTVEKSKIDEILLRIKLLDEKINDRYIR

SEQ ID NO: 975808 - protein, 62 aa, Homo sapiens
MKTKVLPVGPVNCDEKIVVLLQRLKPWDPRVSLEHALTWSPTWLQLRIPRIEDGYHFGVAVQ

SEQ ID NO: 975809 - protein, 131 aa, Homo sapiens
LLVMVVPVDQPVMNMPKRYDNNSTMPNSWQDIDLDPGCYIEERTDSEYAQLAQYNMSFSVVGDKEESVALLNIRTMRNKVHGERTISETIEAATAASIEFLQHYRQKKNFNEKITQIWLHGKGGISVSVEY

SEQ ID NO: 975810 - protein, 123 aa, Homo sapiens
ALETQRRRKRSSEPRASRPHGSMCLGSALDAVLEEMACLCDLPRPRPEPSGSADSPATIHGALALLSLPLVCCRRLRMLLLLLMSLLSGWPWPHRLTLTVYLRRLFDRLSRMIILARVVQQML

SEQ ID NO: 975811 - protein, 217 aa, Homo sapiens
RSNWLLAPGSAVEPGEMPPPAASAPCHDDATRPRASRAGTALLSGLHSAPMMPELQRCVMCNAHAMNEMNVCYNVKTEKAKEKDKKAEWRWRREEEEDPECESEPHVLACMMPCLMANGCGNVRMPWPCDCLMWQWPEDERDVAEKDAVLCCQCDVMCPLNVPEPWEDCEGCVQRPRLKPPKAPEQEQVRPPGPALRWLVNGPQKLLEVRRRSPVSE

SEQ ID NO: 975812 - protein, 111 aa, Homo sapiens
ARVAWMVGSEYSAWFSGSSSGRAPLLALCGSLLWTCIYSPQAGRPLCFGAPVYSVNVFVTSDCRCCYNTTLIRSIHTGKGADVNLVQVVRIFQEHSLSRLYMLARNAGAYV

SEQ ID NO: 975813 - protein, 77 aa, Homo sapiens
VQAYGYELRAERQSQLMQHVIMCSELQKDDKDKKKKYNSVTNGKERKQRDQMLQQTATGDSLSFSSSLLFFSSFFSF

SEQ ID NO: 975814 - protein, 131 aa, Homo sapiens
MPRLQCMGGLLIRALGRSRVFTLHAGRTPVSPLWERGRAGATGETLPDNSLPRFSQTLNFFEKNFSNVSLSRAGAPLERELSLAAWKTTAWGTFLKRPGVVRGTTPVWRLHKRGGGEDTEIEAEGVMEQRV

SEQ ID NO: 975815 - protein, 109 aa, Homo sapiens
AGAAVVFECASVSECECRVLPLLVPPAEGPGGLVDVAGGLLGGRGSKSAGVCVESLRRIGGGESEMSWSESIVEWKPCKQMNGILESHGEQNEMRSGRRMREVGSRKRG

SEQ ID NO: 975816 - protein, 264 aa, Homo sapiens
ALSVVKAICRGVARPTECSRRRFGAQAPVRQRVKTPTGPLPYKKILGTFQKLKSMSRAFEHHRVDRNTVALDHAHRRAAHCGPTEKLAEVGEFDPSKERLLEYSRRCFAGLDDETLKKVQALKKSNLLLPITYRFKLVIAPRHPQPSTPGLPPPWTPVDDHATHHPTHSAPLPPSIHRIHWDLGAPIRPGPHQAATGPGPARGTTSRTPAPPFRLGMHQPMSSPGPFLLENQAGRVPPPPRVGDCTDPVSSHGPAEELPHLIPG

SEQ ID NO: 975817 - protein, 213 aa, Homo sapiens
LGSPKLVVLRDHFIVSVMWRTGEGKHGSWTGLPSPYRGHVQARGWRGETRPHRSMTEGQRHRWEGQRRSAWTGATHFVALAVAVCCCDFCVLLLHRSACFTLIRMSPAVCTTVAGVWGILAMLCSTFNGVKSSERFRADRIDAQSSPAEGTHGSFIVLKGVEDAALAAHQADIDGRRRRISPSPLPSSEETAPLQQRQGFRRCPLAHSYVFRK

SEQ ID NO: 975818 - protein, 136 aa, Homo sapiens
RRRDLPHLPPRLWGSEWGRGFGKGGARALRCIVSFPDLTASKENSGEQPGPASDPNNKEAAVRKLPDKPRGFQGNKLWPTGHGRCTEWKSERGLQDFCPEGGERYRGISSIPVRLVTWQKLAPLPSGLGDRARLRL

SEQ ID NO: 975819 - protein, 30 aa, Homo sapiens
MKYTVFGKVIDGLETLDELEKLPVNEKTYR

SEQ ID NO: 975820 - protein, 65 aa, Homo sapiens
MTQEVESYPRQRSYRIIGKSDVVTYLLEHLQESVIFSKNAHDVGIVLNSGAGPQRAREQSMEERP

SEQ ID NO: 975821 - protein, 202 aa, Homo sapiens
QIQSMFQKDDYGGTLTNKKTILSRLKQMQELEEHAENNFSNYTKKEGVLMSKKLAKLQKNLNGIRGLKFINNDKLIMLVADPNKDIIAIKEAKKAKVKVIGIMDSNTDPALLDFGIPANDDSVKSITLIFTVLADAIATAKGGKALFAYQPTENIVLPEVPDKEHKALNKFRKVSAEVQNQVHHKSFVAKAKPEVTSQQKEE

SEQ ID NO: 975822 - protein, 98 aa, Homo sapiens
VVHSWWESDAQGEEDETEFQYCGNGDSWEDIPEDILLIKPSCTLSLPISRTSVLSALVTVTLKCRVPTDALGTKDPCKIPHRCSTESRITEAFLAPKC

SEQ ID NO: 975823 - protein, 103 aa, Homo sapiens
MSYLMELEPPAYARATATRDPSHVGDLHHSSRQCQIVNPLSKGRDRTCNLMVPSQIINHCATDGNTHLNHFRVCSSGALSAQYGATITTDLSRAVFILQALKL

SEQ ID NO: 975824 - protein, 70 aa, Homo sapiens
SGLILGIPAVSQWLMTPTTDDEVQVNPGLPWVRIRLCRELLVWVADVAQIPHCCGSGVGGRLQVPLDQIA

SEQ ID NO: 975825 - protein, 112 aa, Homo sapiens
SAVLVQSIRRCMSCGVGADVARIPHCCGSGVGLEDKVDNENNKTTSRTYPYVAQVINRICPVNHEVAGSVPALAQWVNNRSGVAMSCGVGCRRGSDPALLWLWRRSEETALT

SEQ ID NO: 975826 - protein, 33 aa, Homo sapiens
MAPWLTNPTRNHKVAGLIPSLLSGLRIWRCHEL

SEQ ID NO: 975827 - protein, 69 aa, Homo sapiens
MTTDSAGGSSIAIYAIQEIEEISQKIDSRAETILNAIEAKKRRLQSFWASPGCEGPSSTQALGPPSVAA

SEQ ID NO: 975828 - protein, 34 aa, Homo sapiens
GLLFEAQIPDMIADSGKYIKLQNVYREKAKKDAA

SEQ ID NO: 975829 - protein, 87 aa, Homo sapiens
DLCIRALNVTKARVTPWSPGPPGLQVYSGGGYDFGLRMETSTVADQASHQHRSLQTPEDYASLLLPLNVSQATSIETHSCSMEGSQM

SEQ ID NO: 975830 - protein, 74 aa, Homo sapiens
LDKVLDRFTPGTILSGCTEEDVVDQGGFARGPLGCFLPLVGALNGLSAQDNWAKLQRDYPGALITNYYLWPAVS

SEQ ID NO: 975831 - protein, 36 aa, Homo sapiens
VTDATETTITIAGERKTETITGFQVDAGPANGQTPI

SEQ ID NO: 975832 - protein, 59 aa, Homo sapiens
SILYCCAFLTRQYTTIATDRRFVKEGASRQDTLDTLSCFKPGYLCSPQTRGSLSSVPRK

SEQ ID NO: 975833 - protein, 102 aa, Homo sapiens
LRHSRRLSVLCWEVGYSIRFEDCSSAKTILKYILMGCYFVKLMNDTLLERYGVLLLDEAPDRTLATHILMGCTERRCKTEIRFTGYSSERYSRCRKIPDKKH

SEQ ID NO: 975834 - protein, 62 aa, Homo sapiens
RNGYLVQADGHRVQSPDGTLLIYTCGPEDEGSYTCSAYQGSQAVSRSTQVKGGLTSYPTAPA

SEQ ID NO: 975835 - protein, 70 aa, Homo sapiens
QEGRSWLSPDLLMVGVMMGVGYVMATSMVDGCNSVVNEVMSTDLKVESRMFCSRRTTQVVGNSVNSGLQD

SEQ ID NO: 975836 - protein, 45 aa, Homo sapiens
MIRTEVYRPRIIILGARQRRRNGKRSSNRMKVPPGSNVLLKLLKL

SEQ ID NO: 975837 - protein, 43 aa, Homo sapiens
MYSKATLGVIDQTEILSRSVNADDLHDSSRVGYISTDLAIDSK

SEQ ID NO: 975838 - protein, 93 aa, Homo sapiens
MVLLILPLTISSHIAQLGFNTADQRLYMRQLGSKARLRFCQCVFQGSFHAQLLTADHSRDPARVRRRSVTSDLLIWSCSVWPATSRFNSSVRL

SEQ ID NO: 975839 - protein, 57 aa, Homo sapiens
YRCTETSKEMEVKPRTVTADRKSCATRSQNLYFHHLTNVAPFAQKNARTVSREWTSE

SEQ ID NO: 975840 - protein, 151 aa, Homo sapiens
MHQKCGEKLIEIARTSPVEYHMIHTGERAYECMECGQACQRASQSLASTSVYISGEKPYKCNECGKAFTHRSNVVLHNRRHTGEKSFVCTECGPVFRHRPGFLRHYVDHSGENPYECLECGKVFKHRSYLMWHQQTHTGEKPYECSECGKV

SEQ ID NO: 975841 - protein, 65 aa, Homo sapiens
PPGGDADCQLPVNLNEDGSPNLDFKAEEQYQLDIKDEFRCSPCRSWYCGACGRKTLGVASPGVMA

SEQ ID NO: 975842 - protein, 106 aa, Homo sapiens
SAWGFKGTRIRVGAVSPSTGRHLVDADDVKEVEPHPDMEAIFATTFYHVLIWHKGAAFRGFQKDKLAQNFNLDNQCGPLKGENSIQFLPFFPAPGSKKWGGYRGSK

SEQ ID NO: 975843 - protein, 34 aa, Homo sapiens
PEDTRKYTCGYSDTAERLIKSVIQVGEERATKGT

SEQ ID NO: 975844 - protein, 50 aa, Homo sapiens
MRYWMCQRHSPGLLTHFISLVYKVSLWPAASALDHFISLSMRPNLPHDAA

SEQ ID NO: 975845 - protein, 77 aa, Homo sapiens
DTASSYSAISFGTPYVLLSRSRRTSADSKSLLVTIREEPSWPRQTCCGSLGTKEMRWWKASWSSRVESMSVISLDRT

SEQ ID NO: 975846 - protein, 81 aa, Homo sapiens
ASADSCIDISVTDLSSLTDSIKAPYGRDEALSPAEAAQQSTLGISFIPRRRWANIWSALKKHGDHVDNSPVSIMVAQSDDS

SEQ ID NO: 975847 - protein, 140 aa, Homo sapiens
TEFVKDILFISRNGVLVLIENMARDCREYAQTRYFRGGMLTMRAPLWPTVLLRNLIIFLQTLKNIFEPHVRVGDAAKMNIPICGIVDTKIETPASSTTLYPEMTNSPIAVHLYCRLFQKDITRTKEKRQQLRLSIAIRPR

SEQ ID NO: 975848 - protein, 53 aa, Homo sapiens
GTRKTHAGMLHSSLSEAQLPWLNNENPTHACCRSVKHAAQELSGSALADNPDE

SEQ ID NO: 975849 - protein, 156 aa, Homo sapiens
CASCDTWARSIPAVSAYPGPYPPPGPTQERAGPDRLTQLPPQNLASYDVCSILLGTSTLLVWVGVIRYLTFFHNYNILIATLLVWPCPASCASAAAVAVIYLGYCFCGWIVLGPYHVKFRSLSMVSECLFSLINGDDMFVTFAAMQAQQGRSSLVW

SEQ ID NO: 975850 - protein, 161 aa, Homo sapiens
YFRSANGCGMHLGILLFEVLYRATAVAAEPLHSSSYVHRRESQAMWPGGGGASSHQAPSGIIVTASGDCFVLFHFGHVLGPRVTFTREYLILRLQRLGILYRSWRGSSYSASASAHEAKCGGRTALPLRIPGASGWGRLGRGRCGPGGGSSVPFGRSEGIL

SEQ ID NO: 975851 - protein, 67 aa, Homo sapiens
MGVFTVYTKDVTCFKNAVSENAIRDPKWSLDDCTLTGTVLKRCFRPPNSTALPVSVLTPAALPHSTC

SEQ ID NO: 975852 - protein, 48 aa, Homo sapiens
NATCSFLQDSRITLYQIAFPGSFSDQAMPSSVDPVDRYFVYIHVRRNG

SEQ ID NO: 975853 - protein, 66 aa, Homo sapiens
LDVDMRKDLYANTVLTGGTTMYPGLADRMQKEITALAPSTMKIKIIAPPERRYSVWIGCSMLAWLL

SEQ ID NO: 975854 - protein, 41 aa, Homo sapiens
QIDHLTPALDTGSPQGRWLHEAWLGGQHTGVEACAVPLGRS

SEQ ID NO: 975855 - protein, 89 aa, Homo sapiens
IRKVLYANTVLGGGTTMYPGIADRMQKEITALAPSTMKMKIIDTTEHKYSVWIGGSILASLSTFQQMWISKQEYDESGPSIVHRTCFQA

SEQ ID NO: 975856 - protein, 149 aa, Homo sapiens
RACHMEAFLHLLTFFVLVGLFATITIDLLLRDDPPRCRRSAESEEIARKLRAASMRRLGTVRSICQDSTHGGSGHCGLRGNPSKAPDHQDCLLLNTSVMNARGVSIRLGITSKKKAFTKYCKKWQDEDGKKQLEKDFSSMKKYCQVIRV

SEQ ID NO: 975857 - protein, 62 aa, Homo sapiens
LDRICAMVDNNAYGKLTLQEYQEGSKAYPHIVQALYLNDGLVEAQAGAGGMGTGYHTRWRIK

SEQ ID NO: 975858 - protein, 109 aa, Homo sapiens
AATYAHKLSQEICSAEHYEPHLKNSGDQAELHIHIEEPVLKSKTGDNLTTYSSAYIPPSSANPDYGYIESARTHVKTLAQGLTHGRSRKGLHFLPQKTTIAFMKLKVRR

SEQ ID NO: 975859 - protein, 65 aa, Homo sapiens
MSLHLLPLTRGGPAGSLGACSEEKDDEWEEECGVDTGATVMSSASLMLPAWASRPEMGSIKDAEL

SEQ ID NO: 975860 - protein, 73 aa, Homo sapiens
FWTWTYGRVLNEPPYSELHHIQDETRRGHHDHSQGRWPREMIKEKEAHSYRKPQGAETGKETPRETPTAMGRP

SEQ ID NO: 975861 - protein, 53 aa, Homo sapiens
LLALTRAPRGGDHPFERLPYQLSMAAAVPTMETTADGESGARFRRGSLRNGYG

SEQ ID NO: 975862 - protein, 146 aa, Homo sapiens
MPTAVTYAPLLALLSLTRCWPFALTLDLDRGGLLSQREIVLDWLVRSYRLAHLLLTLWRFQFISWNNIDEKIKLIKFRNCHGDIISLESPALVIFCVRVRASLLALTRVQPLTSKVITDLLLLNLVWLNATCPSKKLGDADRFGDA

SEQ ID NO: 975863 - protein, 37 aa, Homo sapiens
VDIMDVDFGGERSRRKCRRPDGTSSRVSHSSRKPLFK

SEQ ID NO: 975864 - protein, 114 aa, Homo sapiens
AASRGSTLCSDPPARGSVESLIDVIGHPRGEAPVGGAVLEDVAQRHTAMGEAVHEGRFQQALDVVERVTDAAEAVRGEQPQLGLFRQVFCLPLPSSHLPHLLHHCVPTALKVIF

SEQ ID NO: 975865 - protein, 46 aa, Homo sapiens
PKIHTDNNKSMGYFGRRSRKVKKQDQDVPMPEEKSTHKGEGWLRDS

SEQ ID NO: 975866 - protein, 72 aa, Homo sapiens
PKAAKTPEAKLRREIWSTATSDDKDERHKGTQYMLNDANKKLLFPSDTNEKPPSMSLTEITTYLMLILGYSD

SEQ ID NO: 975867 - protein, 251 aa, Homo sapiens
MQGEAVSAVCRHHEGLSVSMPPLGAAATRWQTQGPRGPASLRAGLEHSAFLMVVALIARAGRCAQRPRALAVRLTGASSVFTVVLVMAPRVKYAAHELSLAFSRLAESFGLARRHGCIGMSPRERALDDGRGTSDLTGGSASVVSAGLGGTCDRAGGSPGRLRYAASSSRVGGTWYSAGSGVLDVLAPVNMPGEARAVWQTSDGRRVTKGPSKEVARYDVGDRATFPSMSSKPLDMKPTMLARPERGPGAS

SEQ ID NO: 975868 - protein, 249 aa, Homo sapiens
VTAVMSRVALESTADFEAGAGIRPLDTTLRVLSDSDFLSETGARSAGQRGRGSHHGRELFQYHYPERTCHKLKPSFHSTGVPGNGMSDTSGCGMSVGLNGHSMQSPSTLIFTNEGRALKTATSLAEGLSLVRLVSRSGTPAVVSIQEKLNGKARMHIIWAAIHGHSNVSLSDPNSWGPVFRTVGIPGGRHARDVCDHSGGTKYVEVVQGIQHRRIGAQCDTKRPRGYPQHVLEMPCQILFYTNPKSALE

SEQ ID NO: 975869 - protein, 106 aa, Homo sapiens
MVRDAREGGADAPSQYLGSLATVPDEMFTKVMGSANIHVLNMTLNEEEYLVGALARLVYEEHLLPRSVTMVTSTAEGINGDPDLNVGVEPGDPCSEGRLLPENALT

SEQ ID NO: 975870 - protein, 66 aa, Homo sapiens
MPPFAHRGQLRVGHYRVTPFHPKVEHVVSGGGENREGATQYISKRAEKPVTYLICEALSHEQGFNT

SEQ ID NO: 975871 - protein, 326 aa, Homo sapiens
DRNGQLDQSGGVERRCSPEVKVLGKGGVSRANSAVHKPAIPAQSCSVTSTHQQPCTTYAQTGRPGLDSPLVHNIPCSVVWCNSIQEVIDHRERVSSRCVLPVLSSRVSVETTETGVVSNSSQSHNEDQTTTAIGCSVNPQSVDVNRLRSSDSMIRDRRSRGLYKKDASTRITCHLPEATPHSERYHFHQLLSESKRRLLELRGELNAGEGAWTHFVTAGSKMSVSSTFNTREMVGVLHNVVAKARAHRMIFRMDCIAVGHTQRDKVRPNVHIKPNARPCKFTVVHIPKSCQTEVRPGLPKNIQHIWHCNAMNEGIIVGRSKQDEKF

SEQ ID NO: 975872 - protein, 313 aa, Homo sapiens
GHGGSVREVGAAQSSCLGVVSQCHLPGSSCTAMKQKNSGQKPGMRTWVMSEQKADPPGYREDPPGNQKVKIRRKQLNGDCGQHILTRAMAEAENLRREEPEIGGGGKIIRHSEPSARHLFGGGMTFWMKGTASDVPPMNESYETNETLIVKSLYEKRLVMTECPDPEECSQQHWHCLMLNPCGAKFDPYEHEALFHHTGRGEGGQGTVALVSQSCGTSCIGLHSGYPAGCEGGERKAKLMIDGGGLFVSLHGCNSRQLFNAPNNQQFDVYQTNVYLVTMGCRQAVPDDDGPYGRSFRPPFASILEDKPVSEKE

SEQ ID NO: 975873 - protein, 323 aa, Homo sapiens
MTHLRRHPLARTGGYTLDDYVCTRSPLSHPLGSHEFVPSLPVSLNTRTTSHFRTPSDSPRNTQLSPPGTSKTFLYAPLFSNVTPRPAAPRHPAPHASPLPPRLSPPPPRPTHTPSTIDSTNTNSHHTHNTPTPTPPPLPLYPSPAPRFYVCLTPTPPPPPIYSPYSPLPPLLYHSQKYLLLYLLASTPLPPPTTSIESSSCFPSSHNSSPADTNNYYPRYPAHHPNLTNPPSPGPTLGRITSTPILHHTPSPPTHITYSPPLTSVAPPHPLPPPSSTLLMFTLPPSRIPLLFMPYQTHILNTIHQFLTSRRLTPSPFLLLHFL

SEQ ID NO: 975874 - protein, 216 aa, Homo sapiens
MGAWGSSCGDCWAVRLYVQLLDPSGHRIKNRNAERVSISRRSSIDGHNADASGILWALEVVMTESAYNMNGSSDRHVTSAVMRNPGGSSAVIFLQGKGPLMTPLSGSPLPGTQSVEFQACCYLHEFEAAPLTVASRRGLQGSPAWKKGSAYTPKGKTDHQLPGVSVNINPEAYGHPNDKNLTNGTRPQVPDTQGERLLNRSTDNPNTTAGTEKGKP

SEQ ID NO: 975875 - protein, 85 aa, Homo sapiens
DGMHVTISTSYDHGCQIRWFRLKDSQGVHQLRGTRVAELFKRLTSSVSERNKGQIDSLIERTGMYYGGTLAKKNSGRWNRVLLYA

SEQ ID NO: 975876 - protein, 172 aa, Homo sapiens
MSKSESPKEPEQREEDSSLVGLSFEQQLTGAACRSPLLSQLGQRLIEDSCALHEAAVQKHLNDASRGLRAEYVTYAICATDEWTCSLNELQRPSLQAGNANEFVEPKTELSPRRTILKDPGWPSFNLCTIEPYFVCVAINRTPHCKQTFTLTEHSSPTTAHWHKPWTLPLTN

SEQ ID NO: 975877 - protein, 229 aa, Homo sapiens
GGNFWVPGASYARPRPLTPPWGSGPGLDLTLLEPRYTPTQQRNKNKGYKNGQEHTRQDEKQVKIPQRRQRSQKAPRQARTHRTHKQHTRHERDRETQIETQAADRKDTEHSRYNTQSLRDGCKNHPRTRRTHNPSHADLTMKRQRDKREYEQAAAKQEEQTMRKTSRGTTPQQQDETDGNRSGAEKRTAAKEPTAEARQKISQRTERNKRNNAQGTENTTRKKERRSKK

SEQ ID NO: 975878 - protein, 91 aa, Homo sapiens
RLPASEAQQQNASDGKVKSFPKDDPDSSRSTSQTSWDTRLCMTHIVTGSRKGERSKSEQVRQRVCEDIVNHLSRRQLTSLDELGECMCCAP

SEQ ID NO: 975879 - protein, 219 aa, Homo sapiens
MALVALVCWCARLGGWRLSWCLGCCGADGALDVRAWAAPCEPGCAQLAMNADGWSVPCVSSTVVAVSCALSTAADSAVFDGGGVHAFVREERMCAVSIPFCRLTHASKCDRCGPLLSGCAGHVLARVIEIRYCALVDPSSRGDDLVSQEEIIHSVEVSLCRAYSRIYITLHLSPRKGPLAESSYWNSSLGDAIGELQDQRGFSFTDICEFFTIGTRETK

SEQ ID NO: 975880 - protein, 382 aa, Homo sapiens
GTSPFGSVGERRRRCASRGRVRQATRGAETTCERLSPAFLPGFLISQPPRVPGGVGGSVTGRWLSCSVLLSVRGTARPRGPEQTRGQGRNAAGMEKQAGWPEDVRPDDPRLGVRTCEPDMSSGEELDVGSQRLLPSLVAPKPGGIEDHRTMRFRRPHDTPFSHIIRIQTIRTIRSMQPKNQQITHAKQYGVYLQSDFMARAFNDPFIHKEARKHLTAYDIGTTSKHWWQLRNNSVKTTGDEQHMIIADEPGTIRGHTAHDEDRKRRDERERTERPETRPSRDHDYRHEERARDVTNDAPPPTAPVSSDKHYISEDRHYHSTTLENNPTHPLNPHHTTRPTHNARKGATTHKHYPLNSYQHTATSHNLPTATTYLSPTYTQII

SEQ ID NO: 975881 - protein, 303 aa, Homo sapiens
TYTITRAYANAGGLADGNFRTVRFAWGQLQRSGNCFFQNLALRFNYDEITFIASAISVESFSEVYTENRFSVRILTGNISLIFSKEPEMTKQPEDWLDDVPGDDIEDEDDEIIWVSKSEIKRDAEELKRLGAEIVDLGKTALDKIPSHADLRAAYELAQRITRWKVADRQLQLIGTMLRQTTTVQPYSTRALDMLKNRHNQTDGSCTITLENYARIVTESIKRDETIDRGSYTLLTGPTAESLTTLHYPEYATPQHRTSTGNTTDAQPARPKYTSTMHKLAQHRQANYPTTHTISLYHEHGGQ

SEQ ID NO: 975882 - protein, 67 aa, Homo sapiens
MTTGHRATCTGRKPRRARAQREENTARRQQDSKADTKQTYTTKTTGDSNNRHAAQRETTRQQPQNKS

SEQ ID NO: 975883 - protein, 356 aa, Homo sapiens
GKWSAPPPDSLESALQCTSISWERSHELARHVKETCGCVPRDRSEAECPGPQAREHMGTGSTVRASVPGEVAADPVPFPREEGGCEGGSTPAPLAQGEPVAGKTSHTRLPDHMGGSTCLAGGGYGRQGPPEQASPMILDGWPAECEPDDLDLDHGDSVRGLDTVFRLIPHTDAVHIQLDDIELHTFSRKATDSSPERDFPLKLRSPQQLDVTAIHTARSHRCTMKDPSTGRTPPRGHPGPTLLRRSACQVTTKSPICAVERSALSTVRQGRPTARENGATQAPAARTRARQRPQKARKWNRPPRRTRGGRARRDNATERPRVAEREEHLQHRPRSHSAAGRDPPSDVGPLSTHRSP

SEQ ID NO: 975884 - protein, 54 aa, Homo sapiens
MGEKSCSFHLWSRHACAVEWPMGCIRAQLQRRFGHNALASRLSPVSRGAESGAI

SEQ ID NO: 975885 - protein, 67 aa, Homo sapiens
VANHPVGDSAMPLRRPCLAGISAITTGIDAGPNERPLCCKHSRLTVALLCHFVQCTGSDTSIRPPYT

SEQ ID NO: 975886 - protein, 252 aa, Homo sapiens
MVRYVTTNSGRMPACSIMYCQHRPSQSLFLHRTGNQQGIFISPDRGSLMILPAINHRGHATYPGRKYRQASQFSQSTHAFVRIEVPDPDVRQCRRYRYDAYIAHQTRAVADITENVCPSASLSTLSQADSSTISSTLIPCHSRVSSSPATPLPQYPTMTAQGKPDTINPPGITSQLHVQTSHEWHIPTNIPSTQQHSPASAGDSPQGQQRTRRRPPKHGRHQQAPPRRPTTPQVTLPPLAQGHPSEPTRHTA

SEQ ID NO: 975887 - protein, 474 aa, Homo sapiens
AEDGTTQLDDDDYFLLSTFQLLTLRWHSRSLTDEHWRTTSNFTTGRYTQLASPKQSISTVRLNTAHARARASERWTRTVSQASVKERYVIQPSVAPSQQEDAPRCMIDASTASGPGLTEATVRSKSHAIQTACRQHSSQTRLLRPQRRATVRSGPEHAPCQRANLQDVSDNTRGRHNHSSTRTRPQLPTRLHILAERRPRLARSEHEANSQPHTQDPSHRAPHGRTSGERPRKYPIPTPTDPQTHGQQPTQADHHPPTPQPTTGTPRQRYTAATLSAHHEPTTNRPCMTQQSAPPEKRRGRTPSTPNATKDQLGTPDGTRTMATSPAEQLRTKHNTKTTVTHRHHRTIATNTNTRRERQIDPNNNSDKRSHPHHSTWEEDTLEQNTTRKTPSTDRKQTAQMPQHPARLTHYSKQCDPNGETHMYGPPPRLQPGIAAPPRRTKQVKRHKQRHNKQAHERQERAHMEQRRDTRGTT

SEQ ID NO: 975888 - protein, 488 aa, Homo sapiens
MDCTWWHAKACVLSLASLSGRLVSDHTTTAALRTDASSEDKSVSRRHLENHGLSHTSNPRMANKHSMAILLPTLFPWRHQGLDPRPKSSGHHTPVLAPLARELLGTVPDHNPLHLPKCNATKRPQHSLRTTSNTARATPHNQHAFPMGAQYGAIRWHTEPGDLNTHLHYPPHHTAHATKRGSNSGAPIHTQGALGPPHIPGNAITTDALDRRGTTLDAARSTVDRNPQTQGPLALPTRTFAHTRLAKEPHNQKKPDTQRTHPGQTNVRGTQNLPATRPRLPPPQPHRHPTPAPEPARPTPNRTHATPPNPPHAPPAPTPPTRAHRHPQPRTASTLPPGAPIAQQDTPQKQTKTAKDADDGTNQSSTRHPGHPTGPPSSHKTRNPHEKGAQPERTNRTSVQTAAVPRQQQNEREEQQRRGLQQAEDDTQQEVDTSKSMEANHTPLASNQLMPNAELSSKQGSCANQQAVQQPTARHTNRHAPTTGETTA

SEQ ID NO: 975889 - protein, 612 aa, Homo sapiens
KEQAPKYAFSEILRARITKAITHVLGAFLPSHRRHYLCPMGSLFGQPHSFIIHHFSFYMLQKQQYFPVNCTHQAHIIIPLSYYCTAHSHHQGSLVMSRASHICQVVIQQHKQNIQSRHVTAQYIPHYTYDIPDQFTTKFTCQSTRKIPRRRFTIVVHGDQQTWNADWARRLDNSQGTKHRRRQRTHPHTEHIITVKFKTRTHVDDYADLWTPCTQADYKDPDNDNPYNFPSTDRYEKKSGHSRTAFHDHTTTSQHKEDRDLTPVTTQYVNITTLTHYASDDDMNQPTITGGNTHSRTGALWITAQHIHKAHKRKTESYYTPKLPPQIHSAFTHNTHTHWGGASGPQTRRLASPHTGTHRAANEGANLHDATTTMSPKSGTHSDTTLVTQHTTRVHEQPQPHVKREKVRPNVPHNERRMESTTRDTVHARTTTSQGSRHSQWEAHNTMGNTHSGRTNHRVRPQAENTRAQRRITANHLAARNTREIRSNCRRHRRHILTRQCNQAGTQHTNCQRRGHRAVSHTQAGSGHRSNSEESKSTQTQTPTAQDRCNRVTEKPANKEETRHLTNRHRRQTHTCQHNAQAPRVDTAPEPRDDEHQQHPQCHQAHEHKPGD

SEQ ID NO: 975890 - protein, 643 aa, Homo sapiens
PNTKSANCIIGSICAWKLSYDARDYLDTRQEELEHRVESYTYPWYVTEEASRSKKVGNRASKDSAHERTKNNVQAHVIECKMYTLSFQCRLDIRGKTMPILYLVKGRRLVETLTRTMAKSHIQDIQTLNTRVASAGLNTKGVIFDVIVLMRRHKDHKLKGEPSIAKAKEPHHGYKGRRPYMTTARTLAYSGPQREPGMHKDMSLALGVEETGEGHRSNSIARDQAYGKRRPHWISAYCRAFAQTYTVFNSHTLVTRPKPFGCVSRKGRRQHEHKRDLSQDHGRMVAGQFVVTPNRNSGVGGIIRVDFRALALGHIVRSISPCWSTYSPPNGLRSPAYNTTKFDDRGGYPAISLNSLPQLLTFSSSALLQHTLAKRGLIGRRTHELTFNVDAPNRQCGSQRTTSALWNQPAKCLWIPSPRFSEPPTRDCKTPPGALRQLKTKGRLILWRTYTKPTALCATTPISRRTPKSSAMDRRHLRNLEGNPCAGTPPLPRMCAHTCIRIGGSSPYSDYMRSGFCIIIVGRQTSFRITMRHKLGLNEKSVPTFTTWGLNQCFTWSEHFTRDPLHEITLQTLILAHEPSVNTLRSRHPHILSATHVRTAMVATTHINSPQHNATSRFPQRHRARYNTHECTSRPIMTSTTHV

SEQ ID NO: 975891 - protein, 315 aa, Homo sapiens
MAVAATYGLGRGRLGPRGWQCGPAEVWRCEEKKVLMHRGDGAVRAGAGGGRAIDPELCKILVDLLKLIRGPASRVFQMLEVHVCPGNRLSELSPRTHAAVSLPTVEQCPRPREKQREQLPRGSIGLGESSSRGGSIPDGWMTHSQVDSIAGLAQGQAGLSKSTYTGQHTRMGQRLVASYVPSKGYMFTVLQLDNKPFREMQSGPGSSPPKSSFDPLYKPRSESILTEARRNLALAHGAGSATVTRTHRRPCEHEGSNDGSPQPRAAIHAEPAETHSKSPTRRRPPRKKQRTQSAETLHRSSSLACTRQHNVRPPD

SEQ ID NO: 975892 - protein, 76 aa, Homo sapiens
RTRTPRRAQSLRLFADPSPGRTAPARRKTSPMDDDIAALVVLTNGSRSCCRGTGIRRGRLSARPQVPVVPHPICGA

SEQ ID NO: 975893 - protein, 155 aa, Homo sapiens
MAYDRGATRKHPEPHHCANDGMRRTRSNEGETATREKDEARNQHRRRGLVTATRTPGGPQTRQHRGNKQQKRQSRTNHTHHRHNTDEDKQDTLHTEDSTESEHTNSGHKTRTRNESTRTRRGHTSNEGTTRNWPPTTTRTTRRREKRQQSSNKPA

SEQ ID NO: 975894 - protein, 240 aa, Homo sapiens
AAVPGAAAGLGLHMWRTWRRYEGSGVGTPVTEQKFWGLSLMAELRPGLGARWYGAPRAAVDICSLAGQAVLRSALMGYYCLSLQAGPLWIDTLGSWDGPFRVLCLEPSVQTWLCSRVHGNMHERVHVGNWGIPWRPASVSLLELYVCQTILDLVWLSHRAQNTNRGTKNMVWVVCDVFGEGSFLDGDVKPGPVLTRAGLEASLASFCAESKESWPCWEPYRAPPYSTAHIAPCMASQAPR

SEQ ID NO: 975895 - protein, 102 aa, Homo sapiens
MLETAGGAPEASSTGHRMERNPRMGVSQCPRHPDQDLRGPEHERESAGQHPKRCKTPTRKERTRKPRQHAKHAGHTDQELAGGLPTPETNPETDGESSRPTQ

SEQ ID NO: 975896 - protein, 535 aa, Homo sapiens
GQISCGRRGYASEEAMSGGYQRHHNLAIMTVGERQHMYAGRHIRTDYVTDVLTSLQVRGREYFIWPPYQGRIRTKASCRLSRSRLLNLAEMKVTVADQSPETTSPKIEKTGKGADDESRRSVRSGVACIARADVNPRIVHSDQDKKGDPCTSPNRIDMGYFASEGFPFVLAWRSSTGGRASTRVVRSPRGLGLGPMMGTIRRGLGGWYTPIGPREEGSLGRLEPFHFEAPRSRFRGGWGLGGSIHAESKGVDGNTPDSDVNMHGLTRVIGKGPALSYRVRIGTTRPQVNACPGECFREYPPMKKLKPLGVRLERGVTVPPPGPYLWSAERRRTMACIPKGHLALRGPVACPLGYLEGTLPLNGGFPPQNRGEILRRLGPWNGELTQNWGGNVPPSPGKIGGNVPFPLLGGIGRGAPSGVGGPVWGPQQRVYSGTVSLPRKKGAGVGHSNYRHRGHPVYPTRSRVRKHKQAGWNAGRLSGDMWRGVTPSKGSPPPPGKRAPMRAEETRVPYQTHEGQQAGRTRNTTADTGRTPLQR

SEQ ID NO: 975897 - protein, 211 aa, Homo sapiens
MDFPYNFPDPLRGLQAMDFVSGPRDTSSDALRRDRQPHDSQMGPVVPGGPGSLSRMELDESSLQELVQQFEALPGDLVGPSPGGAPCTLHIATGHGLASQEIADAHGLLSARSWPGMTWWALWPWRAHVPGFPTVAREEPLQSLPRDCGRPLRTQTEDTDSPDWAGRRPPPEARRASRTRQQTHGPPGLETAPLASPRQATRAAPTHQPGN

SEQ ID NO: 975898 - protein, 265 aa, Homo sapiens
LRGCGCNCSSCRRTGAACLPFYSAAGSIPSGVSGRRRLLLLLGAAAAAASQSAWPPDRACASREAGGGLPLWPPLPAAAGALRPTLPSVPLCCRSRWRGRAGRSGGARYGTEMSKNSLIWKIFTSTPPEYELAPSNVKKRKCDDVFLIRVSKELTLVMHYGRCAELFFPDCRIRNGENGIHFLLNRDGKTERGDAFTCNTGVTRRDCADKPLSRTTACYLGPAACGNYMTIRHARIACPTETLAGHSPLGTLRPPARQRPPSHRK

SEQ ID NO: 975899 - protein, 211 aa, Homo sapiens
MTDPRTASGAPAVTAGQEEPDHGPPNTGPPPARGTDKTHRLNRRSRWLQPMRGSRARNGTTRRPREPAPRPPPNAVHTPAQCPTRKPRNTQSGTAPAALREANKPVQGAELPRAGRRAAPQPPATRAHSTPLEPRARPDAPNHRDHTTPAHQFAQTPPSPPNRHTRRPTRDAPNPPRSRQRHPRSWSTTPTTAHNPSARATSHQSSTSTPT

SEQ ID NO: 975900 - protein, 465 aa, Homo sapiens
MGSGGGGGREVAVALSSLPDLLELDHFSRHRSHFPSPLSYSIHSFTYPYPIFNTYTTDTGDAAGEMAYTANRAGAPQHRRQQAIQRNSINRLCAQENNQRELGQARGLQAQGPWQMEQYHQLSSTAVTLGRDVTGCTHEAQSGPAAATFESHWGTSDGTCRMEGGSTIPTGTTRRNPRIDILRKSDRPIRSQMTRRARKHRHEQREPPIRPPMPDANRPQRTGGPSHAKPDNEEDTRSTRITGKRDPSRTPTATKEIKKKPPLEPERDKTTITHDRELTRAHPVKHQQRRPAAHVATDAEPANDKHITGTEQAAGRHARDFRQRTKPRNPQNGVNKQTTSGQTPHGHSAQSRETPDNTTPKARKITRQTRGRSQPTRRAAPTEQKHTREQHNRSHGESGAGPEAHGGRDERPRTKNAAKRSHRGASATRAQAAKEENTDRGYTGHGPGATDRRTQRKPPHGHRPP

SEQ ID NO: 975901 - protein, 138 aa, Homo sapiens
ADGVPGSSRRASVYRTTVAGAASHLLSCDESRRCLVGDHVSMWLDAELGDMDGGATDSMKQGRDRCAMLTGCGVGCSGDVRRGAARAKARRSGKVRCRCDVDPAFITIETIHESPYARDVKKTHGEAWFQNKSKASLY

SEQ ID NO: 975902 - protein, 310 aa, Homo sapiens
GCEGFSVYAAKSKAPRNPHGQVVLVGEGPLNEFAYLALMACAPGLCEPGWLPAQSSTSDSMLLLWAHERATLGGPCCVCAGALTAAYVVDVVAKMTWSPCGPFNEGQLWWLMAMWHTSPGSTLWPFDPYTTMVQRRAGDHAARVLHGRAGAARNEDGHEEPTHAAGATSASGTHDANRIIKQLRTTIDFAYHTTTSHPPSRRSSDPEPTEHTNGTPSTGQGDIPPRTQRSQLTPQHTRPTNDKTKHANPFHRRKKQRETHKTKRGRPRQNTRKRTHEEHGDNKKSKTKTRHNKQHKKKHRKPNGTQTTET

SEQ ID NO: 975903 - protein, 155 aa, Homo sapiens
MAHIVFRTKLRLSGPLCFGEEHQIRIDHETRTHTFVESKTDNSSLGIRSANFDQHALETKTPNNTTYTYVVYRRVSRHRKDIPCRLGPPLLVVIHNLRATVAKKFVSVSVNSHTILRSRNCVDTSGRSQTYRCTRQAELPRLLLIKFSLPFAPRY

SEQ ID NO: 975904 - protein, 328 aa, Homo sapiens
VKEKVGLKKLVCGRQLAHLVYRGLMSGPVPSSLPVNWAGRLRLSEREPAACCIVPELAQSRLLSKLCVLECSTPDVCASAPSARTPAASGPIAHHFLVICSTKAQGHLVQHKHTLVTIYVCIDDQPNGTRMAPALDRLDSLHIILTTATHLDTVCTNRHTLQHAMRRAYGDSSKEREYHTITHDKTNAPETHHSPTTWHTPSQTQTTTHHPPRRTNHARQHAPTPHQGQAHTTRPRQTTTQRNKEHTQNRRNMTKEKHDKTHNRAHTNKHIRKHKTPPQEPRGTHENPKKKHKHTEQNETKYKQKHNNTIKQAKNKTQTKPQGDKTYT

SEQ ID NO: 975905 - protein, 78 aa, Homo sapiens
DGEEEEFDEEDDEDEDVEGDEDDDEVSEEEEELDLMKKMKMRMRMKRRKQGGQQVQQAGKQQQTSMHARQQDALRPRE

SEQ ID NO: 975906 - protein, 228 aa, Homo sapiens
AQPPPSGLQPHAEPGGYSGPEDIMPVDNITRQNQFYDTQVIKTGKRVRLREETTGNGAGRTGRIVQIMKSRDEARSTSPCIPPDLKDFSKGVNVQIRQQIPESERGLSERKPGTGVLFEDYREAEEGAASSVSSSLTEEVCTAVQLLNWMTLGSALQTILTQSWDSFTALRRGGLLTDSGVKIGVSPAFTKLDRALCYNLVRHRSPVVRANGASDRGRCIAFPKTRPI

SEQ ID NO: 975907 - protein, 315 aa, Homo sapiens
MPVLEDYYVFSPIPAACRMPGLCAAEDDSRPSRLAHHPVSLPACSPLPRLAVPDANAAGSSAGGITLPPSPRAHFPSCTKQAPATMQLLPSTLLASSSAHSAPTTCTAIINSDPSTRTHHAHDYLTKDLRTPTSHNLAPTTSRHTPLICLLGALPLTHTHLAHGRTPTHTTPTRTHSPSTASPTHTTPIPTPPSTSHTTPHTPPHHPPSPPPTLPPPPTPPPPFLSPPTTPAPSPHHHIPPPTHLPTLPAPHTHLTPPSPPLHTHHSPTTTLPTPSTTTHSQPTHTFLHHPPLPTHPTYPTNPPSPTPHLTQPQP

SEQ ID NO: 975908 - protein, 87 aa, Homo sapiens
MTKTSHSRASLSLLSDFTRGVDHVHYQSQRSNPNTLCKNKPKHDQPTNTILFRAYQTTSGVCTLAGHSYNIDSGSTSSHGYYRPQHN

SEQ ID NO: 975909 - protein, 313 aa, Homo sapiens
LTVVNNWYDSLMARRHLSDLPLEPALLHDLLHCDHGGACTHHCRLYPRRPSSSDMNSQPPQNQDSEVDGGITLDDRTSPKKTLVADPGALPGRPGGPPRMSPGCCRPSPQMARYQQHSMAYTGTGAPRPTSELSLKMSQRARSRRRHSTAPATPPHHPHSNTTPHPHPPQHTNHPHPPHTTPTADNLKQPHQTRAPTFPILPLTHPTETARHTHRVNTTPANTIQSTQQDTTPITLTTHDTHPTHSTIPHPTQHHHTTQDTSTHNLTRTEEGVHRRETGGDGRPHEAEQTTRDAAPPPDRNARTRLAAGEGGG

SEQ ID NO: 975910 - protein, 75 aa, Homo sapiens
MHLQQMWRSAAETDVLRGYNNLCSYRTINLVTSHQYPRFMGNIIREQLRENRTGEPLKNSWHAPYGEAPPVGTQS

SEQ ID NO: 975911 - protein, 218 aa, Homo sapiens
MRCIRDSLHAPPSETPIEYAKDHARIIIPQNQVKRKSDIYVCMISFAHNVSSKGKYIAIVRYNCGNQGDLRRKSDSFGALGTQLNQKFVASVDSWYQTDLGTESQDLYSPHIMMPPSFWRTNCVMTLHTTFYRAMTGIQRFDFGEQMEAQARTEIYGEDYNASYKVLGTSTGHTAIRHTPSRVIIPVQASRKHPNYTTTNSTTRHPPQLSYTPSSKIS

SEQ ID NO: 975912 - protein, 337 aa, Homo sapiens
GVSSLLVRCRPAGPSVAAMVRGVCRALVSAQWVAEALGPRRWEASAGLWTPPGYHGRKLGGATREGRSSEGRGQHPRGGRLFFRNCAPSGKATRNFALRNQFVCPGGHRRTFGGGVTHKAALVCWGTAATQGGEYKRRAERTRGPHTPGPARCLWREWVRSYCGPTTPGVQLAYDAGPPGHVGWGARNHFAGYSSGKRRNGGSQQEIHGSISTGPGYLEKRLTKDITAKTWKPRAPTSGGEPPEQWGNVTGGTNPEPPEKSMNAGQFQDGESLKRFLNTGVWEKHRETALARNKGRNQWRVWLAETTGRRPWEQTTITDGRKRHREIRGQPDSATQL

SEQ ID NO: 975913 - protein, 130 aa, Homo sapiens
MVDAATLGDEAISNPGRTLHLSCGFHTAWLSQCTSVVRASSHRAQLIHRVVRERVRLCRPDGPMVSDPTLMGGRSFGWVTRLCYKVVGGPSRAGIAAVVVLIEPQRLQVNSTWEPNATVGYYTTWGITIR

SEQ ID NO: 975914 - protein, 48 aa, Homo sapiens
LSVRRVYNARGYVSNEGQARADERPQRGADITKNVITKEKKTKPKGEK

SEQ ID NO: 975915 - protein, 153 aa, Homo sapiens
ACLGKMAAYDLTTRIAHYGIGIYVFPLLNTLCKGRYIMKRLIEGKLALLSDTNVVDVCYGLYKKLYSDDIPHCFCRRRPQTPLLVAQGESRFGQETEANGDRLLDDPDSTRPYASTKGLGRLRLLSYPGRSKHWYLAAGIYLGYTLRICKIPM

SEQ ID NO: 975916 - protein, 144 aa, Homo sapiens
VSRRKMASATRLIQRLRDTGVRTDREEAEYHRRSQRISSSKLPVSPSHKLSNNYYVHSRWPPGICAPFHHHVVAEGAGVRQASRELCCSCHEKKAVTPAPPIKEVGACPSDQAYRVNTCTLKATRLILASLGFPPQGDMWPSVY

SEQ ID NO: 975917 - protein, 339 aa, Homo sapiens
GLCEGMAGNLCNVSPEGDQSRVTYKVDKTEQKGNRRPFTVLPVEDFFGFAIIRLRKNCTYSGLNNRHVHVQGYRALSYLSGPELCQWNPLKGFPKCVTEGIVPYSRQRIFPGEPFDSRVPLVLTEAGNNVIRGETLGTQGSLRATNARIVLFVATYHSVCFTPKYAVALSTGTFECPQVWDRIGRGVFPTSFDEHGNKTRLWREPLRPCGNSPCGGCSNRANGQRQTNSSVLENLPKWERRPGEMTSPRVKTHGNTSADGGINGHGRKHPQPGLRPSVWPTTVGNGSHRDSEGEGKPPGPRFPYDRFSHQAKTTGVCMHVTHACRVQQTTDGSLFYQHA

SEQ ID NO: 975918 - protein, 255 aa, Homo sapiens
MSQTQPLDTSLRNHHPRTYRRHTGTLVAKRQKLKEDAPVKLGNAMREKCRSRRLTNEVDEATSTRRWGGKEEEDKEGDGEERGWQMKMRKLSQLRGKRQEDDEDDDVQITKKAEDEEGRLDRQKGPFNKKKKAGGDLLTSNSGSEIKVVTFEYKETARHRGGCTGRRKAFPQTKQTMGIWHRATHTKSRPLFLKHLKGHAALYLKYRQFEGHKLRTTVGGPSHLGANQETYQSKLRPVVIRAQFFGLSTYHSSSV

SEQ ID NO: 975919 - protein, 217 aa, Homo sapiens
MVSTQSGHYGGYVADEEYAMSIRSEVEQMTLGNNEAHIDKTVRQRTHRQDSPHKEKPKRQAKNAHKNSESRTTQRHKQRRKQTESKRSSIKAYGYNTEHNRQSQREQGDSRLEKHKRKERQKRHNERHGESKQSLKHRDETQQKRRDRAKETEKRTVAREAQAEWTPQREYLRRGRADKHRAEREKEEHTERRDTSKTEKRTRRRQRDKAEKQEKRS

SEQ ID NO: 975920 - protein, 70 aa, Homo sapiens
ALRHARRGRTGEQQAESPAKEVDSLEKPRREGPAQFAPYLCPWFKYADLLLKVWYDEGSMCNTGILGGRQ

SEQ ID NO: 975921 - protein, 78 aa, Homo sapiens
LLKLGVVGGVHAGFNMRIEKCILSGPIYPEHGMMFVRNEWQGVQICANLNVIKIKKKRNPRKVGGPKAFRKAVVKSLQ

SEQ ID NO: 975922 - protein, 211 aa, Homo sapiens
VFSLRCATEDPGVAMGRRPPFVPYVRTSRTQSLASAEVSTDAKIRIFDLGRKNGKSDEFRFVPMVSDEYEQLSSEALRLPEFVPISTVKSCGKDGSISVCGPPPSRYPINKIVVLVLGLKRLQNRLARVPCGKAPWAHCAQWFTFAQSKSCPSGTKLQDKGSIVDEGPLRRAKVQFPDARRSNLKKWGSPRFMLMIWRLVLKGLIQDVGRQ

SEQ ID NO: 975923 - protein, 121 aa, Homo sapiens
MILQIMYRIMSRLRNGVNDPVGWSSKVGPRKKQGCMGFSKEIRQYYGPFFLTKREIWRFSRPFQKTFGKFRGDRVGITTLGKGGALVTHVGPNQWFPENVCEIRVYGKRPPCKMVYPIGQF

SEQ ID NO: 975924 - protein, 102 aa, Homo sapiens
MGSFYSQFPMMSIKIWLWKTGSIDHMNLEGKPILFFWQNSPSVCNLVGIKILGRECNLNLMREEGINMVENEVEEEQSYHDMGNINLTFFYKQEKSMIEWKL

SEQ ID NO: 975925 - protein, 136 aa, Homo sapiens
GGGGCEARMRVAQGCEEVVSNIADYRGCQSLDPGLCAHRRRTKGAGSSPFVVSSFLSLTLLDFPASSEVQFCAGKQPKGFEKPSTMTKLVNSGLLRGRVDNGPLTQGLRNLDEEVWGKESLFVSLVAPWGKGDWVK

SEQ ID NO: 975926 - protein, 69 aa, Homo sapiens
EWWSGVDEEVLVCVKVDDSVRRYGPVWVSAAKDPVRSTAGHHECCRVSIGRLIQRQEREVKDSSGDMEG

SEQ ID NO: 975927 - protein, 277 aa, Homo sapiens
VAPGLNRADEVGDPSSEYRRDSNRMIIPSLEELDSLKYSDLQNVAKSLGLGANLRADKCVKAFEGLHYNMRQKGNETQDESQILIPGDEMRYRSATRKKLRRQPLAIVTKTGRRCKNCPCGPLIHKNHGTQDKPGSQSYCKSSLLHQRAPGKLRMLFPQVPEIHRYLQRERNLSTQMSHPNLEKIKERAITYSKIEGKLHRSSFYGKLASIAQSFCGAHTPAPFRPNTLPGMNWSPPINKGGVLDFQDFQEGHSGVNPIATGRKRVWPSKTLAEGPK

SEQ ID NO: 975928 - protein, 158 aa, Homo sapiens
MTHVVHEQRRWRWGALDLALRLGIERDNPEHGLSQTSDLVQHLGIWVLRQGHFWLYSEGSRVSIHSAWVSSLTQHEVAKMTFTTVAVEPYSMWTHWTAAPGQARWLDGQTLPAFRHIIRDTVRFLPTPLHAPYGTSGHSLKKGSPSTSGRRFGTVPGP

SEQ ID NO: 975929 - protein, 69 aa, Homo sapiens
LAPEQQSKEEESEPRGLYQRAGGSPETGSAPFILILVLQLLFRIGTQGGSRRWRRYPQHRVPSSQRMVI

SEQ ID NO: 975930 - protein, 267 aa, Homo sapiens
RQRPSLPGLAQPLGGSSGRAEQLPARPPCSPGPRQAQARSSLGGHWKVGADAGRRKVARTCPGKPVPPAGAGKGGPRGGPPWGHGGAPDNNLERGLRVGGQRNGVRDLGGGRGERRRKGGTWGGSPAPGGRRRPPAGQPPGHPEGGGGNTLVKLPRAFIRTQGAARHLGGKQKKFLGGDIRLRGERGGVTFCGTRCERGTTGDSSIPGGPPKGSGGTPPTGSHPPVGRPLGGGRARTTATPNVSPLVHVGRTTKRGPQRGQGKGRTT

SEQ ID NO: 975931 - protein, 106 aa, Homo sapiens
DSGHQDSKMASVGECPAQYQLKDKKLLEVKLGELPRWILMRDFSSSGISGAFKEVTTVLQQVHQCEEGEQSRDYHVLACYVLLSYSFSYKHLKHERSENTTEEDTL

SEQ ID NO: 975932 - protein, 122 aa, Homo sapiens
ISDCCASNQRDSLGVGPSKPDAGYNLLVRRFLSPSEKRSIRVGVTRFSRCRPSPLSCDSERELPDPLRFPSEANASPCFWSCTVRTPMTCAHCLALPSEMNPVTQMEMQKSPVFCVAQRWEL

SEQ ID NO: 975933 - protein, 71 aa, Homo sapiens
LPPRSSEPLDLFRDLLRRALGRPDPRKVCGIRREVVGPRSIPRGRMRSDDVPLLTQQIQDEDDQYSLCGQP

SEQ ID NO: 975934 - protein, 125 aa, Homo sapiens
NPADRRWRMMQRAGFSPVWLTSLVTVLGGCFLSVLPCGESDSRFFSLVAPGALGPVEDWTEEHTVGLSWLWGPWDVAGALQLLCGLSWGPSALKTPAKFPKVSSLADDAVDSLLGSRTFLREYYK

SEQ ID NO: 975935 - protein, 241 aa, Homo sapiens
GEQEEGQKEEEEGEEKEIEEESHELSGYTANVHEAGRAFQDHYVPGWHVSGSWVTQQNDRLLHKRRELCTAFASGFHDYSQTCIRVGDKYAPSRLTFPQEEENNYSAEHEGQLVRASIHPSLPHREGPSDRGRSYAHLWANEVLRTTTLRWQESPQFGVESHAKNPKWCTTVTLFKAIFLNIQSKSTLLWNTHTNQWVKHVQENFLEVIPRAGDTIPTPPLENKVQAVSWNFERKNRQQLT

SEQ ID NO: 975936 - protein, 312 aa, Homo sapiens
GWGGRRPPEHLQFCRLLRAGPLSSRRCRALHGSPGGAAEGGLQRVAGGGRRGAEGQGVTFRVAEVHSCRRGVQRLGDGGHFPMCLVFAPIFTHKFSFVGENQNRGGLMDPLTWMWPVVSSTIYRGGPGKGGTRASATVAGPPVEHSLQLVVPTRVTFKPTGRGGPVGSGTSPLREEPRGNHAIRGQGGGASSHWLEEFWALPQGSLSRLSTTKVPCSHNLGFPSKKWVERATGGKGPLVAGTAWAVVGDSYTGALGLRSGPEIGGGGPTWPEGYGSRGAGEERRNGGGDYTGTESLGGQAAKSKGGPDDSAR

SEQ ID NO: 975937 - protein, 149 aa, Homo sapiens
MGKVKVGVNGFVVMGRLVTRSAFNSGKVDIVAINDPFMGPQYTWFNHVPIYDFHPVANSSGTVQWLKRTGKLCSSSGNPITIFQERDPSKIKWGRCLGRYEVTVPVWKVHLWAVLYTQPIGRNGMGASFVPGGEAQKGASSFFVGPPLC

SEQ ID NO: 975938 - protein, 38 aa, Homo sapiens
MVARNGRRGITRTNNQSQYSDGRIAGLSSRHICFPRLV

SEQ ID NO: 975939 - protein, 135 aa, Homo sapiens
MGSRSYLWVPYGDNPPPAPRYIKKILDEREFIEADNDRFQQGYQVQLHGKKRCEGTFIGPGYVAKLAEGVPCWWGLQRFCLALAAEPTACCVHAPCLHKEGEVDVEDEGREPDRVRSDMKQGILPLFGLNSLCSL

SEQ ID NO: 975940 - protein, 203 aa, Homo sapiens
PTAALKSHLCIVPHPPPCSPSRLRGALLRRGLRSFIARVLNLAFLFNSRASDHRVPTPMSDGSGRNTVRNIHHQGLYGRRRKWLKRGRQWKEKALVKGKWLIGEKLGEQGGDHVEGEGRKKRRNRRVGEKEGGGEETTGVMGSRDTQTCGTIGGIERNAEVKTQGGKAGKLNELIEGLPIVGYPRKQKNRGGIGLRTGKKANV

SEQ ID NO: 975941 - protein, 147 aa, Homo sapiens
MERNIAPLAACDDFFRVRSLCRLTSGTIPNEQRVVEQPVYYQTNYLCVAAMDDFHVGFLSPFNMILEEIVVVLVSTGFVWAAHNKDVLRRMKKRYPRRVNGGHVGELFPYLHVGSHGLGGWHNFSFAVDVYPCIVETSGTFKKQSGE

SEQ ID NO: 975942 - protein, 106 aa, Homo sapiens
MARCNTMKALTKAIKHQLSKKAFDPGESYLLPQKLVLAQGCFGAFYQLQRRPLGPPIWMGTGPHTRDHRVRSPRSPIRKHHRYYIRSGVSPQLSSPESSRKLSEGK

SEQ ID NO: 975943 - protein, 75 aa, Homo sapiens
CVEGHGALTMELSESVQKGFQMLADPRSFDSKRLHFSIAAAAFQSLLDAQADEAVEIIQIETYRPSAFKTLSCSS

SEQ ID NO: 975944 - protein, 74 aa, Homo sapiens
GQRGRSCGAPGGGSRARDRRPPPAASAMDASLEKGVSGLHCPGLSAVRRSRIPCNLPPSRDSSDSPCLSLPSKL

SEQ ID NO: 975945 - protein, 202 aa, Homo sapiens
EVRRSRGSVSVLQQLLGGNRSGDLSFPLPDRPSGFSFSVLGNPSGEPIFSGHPPGIPWDLCTATGYKWWSKASHSHCDPEDPKDTKLETAFPPQKGPRSTGAFHRGTHCFKFFPQKRVETACVLHTGAHQGAARVFTKTARRSPLWGPSHKVCGGVTPLLCRGPFRIKNLTFSRGPIIFAERRLSVRSWKGRLNPIIFSGKN

SEQ ID NO: 975946 - protein, 104 aa, Homo sapiens
MSCTASGFPLWGAWKYNTTKWSLGWKSWVRAQCILGDQHVSSLWRKMQSQKMKEEAELGTVLRYIWKAVLALGGGKPGSTRPICKTWCCLKMFDDDDAEVDDEA

SEQ ID NO: 975947 - protein, 94 aa, Homo sapiens
GRAAHFRRGGHGVRFAALLLHGSQSVNLPPEKLITSISAVPIPQKEDVADFKAFCGFFNGKKNIDPFQRTRIFNVQGPKKISKKKRFKGCGYSG

SEQ ID NO: 975948 - protein, 170 aa, Homo sapiens
MREMHLHPRGQAAVQMAMPGGDCSSVLNTWIQPDGLMPSDKTMGEEMTPSTPSCSETGACASTRALDVFVDSVNPESWMNVRTGIYPQVFHPEQFITGRKMLLNNYAEVVHHVQGAHGRSVVYRIRKLVDQCTGLQDFTWFFHSFGGGTDLGSTSLTHGTSLSDYGRSPS

SEQ ID NO: 975949 - protein, 87 aa, Homo sapiens
KLKMACVVGGLLRASVPECECHSLGHSAIVALRLLMWKKELDKFMVYWYPVKQKIIQLTQFLMPCTVVTQNDPILWGTAVSMESPKT

SEQ ID NO: 975950 - protein, 127 aa, Homo sapiens
GRPGLRTGCGMGSEAPASGAAGREEQPGEAAGVGEQLGRAEPGRSTCRRGGGPPWRFEEKHKSPPSAEHEFVLQNHADIVSCVAMVFLLGLMCEITAKASIILYSSVQVSPSQNGRTSYLNQVSLYN

SEQ ID NO: 975951 - protein, 144 aa, Homo sapiens
HACAHEGPVIPTVRSLMPAKHGSDNVPDDGNKRTLGPVTHIGSEDHPMVWRDYQGGSQKSIPPWIAPYKRMKSPVEKTTMCTPFGSTAAEKCPIPSAHVVTHFTRAINWATQGLHEYPIKSCPQLTLQASRCPLRFQRKIRSCT

SEQ ID NO: 975952 - protein, 146 aa, Homo sapiens
AAVAAPFGWQEESGSGQLETVVVTEITLPKESYLGELSSPAEMAQCACVTEPDCFLISQDWLFSKKGVSIPKAFSMQDHQVPDESHVAVTSRYMLSNSVPDETMGTPCDPQDQRSQLPGNIGLDVSPQWDCSQEEKPVHKTLVPDV

SEQ ID NO: 975953 - protein, 148 aa, Homo sapiens
MSSTRPSGPNGRLTKSGSPRLWAMVSQGWKSGWPTPNGGGLLWKSSVAALWTSKWGSEPQVVKEHQGPGRSIGKDSFITHGGGAEPRGTWWGPGIVSVRCPRPEAPLCRLVCQDLEILQRFTGARPIVGHRGGPLKHIGTIPGGPTQS

SEQ ID NO: 975954 - protein, 294 aa, Homo sapiens
MNALASSSRIMDRKCSMALCGAIKSLIQWVHLGWYCKYLVRIQSALAQNELDTDVSWKRSWRNCRLVSKLMGWPPIISALMDVVHSDCQARWWNLSKSSSRFVASFPGHGKPTREGGFVDDKRSLSLSNEGGTSVLTAEEIASQIREITPDGFIKAGVVRSPFLGSNLEPEDREEYVDVFSTIKRANNANLLVFQEQRYTPELGFTNCASTPCLSAVTGWLRDRRGENGQPFSGDQIMEREETHVSVKLFQCRQGQCGETPVGNSTKWLRGLCGETTDSLSPRDVRKTWDPQNG

SEQ ID NO: 975955 - protein, 108 aa, Homo sapiens
GQPAPVSFHAVEALLFRSFYCLLFVVHTAFMSCNTHPEGFATLTPEASKTTSPREERTTPDALPLRAVTLTEKVCSFTPEPARPEPTRREETLNTSEHQKEQNPDVPP

SEQ ID NO: 975956 - protein, 107 aa, Homo sapiens
MRSCRRKTQVPCAAEVLKQLVETKREREKEGFQKRHIEENHEVSSQYCAEEESGPTKVAGSTDETEKASNWCHIERVAKTRGYSRYDTLSGQTQVNPKTLVGGGLES

SEQ ID NO: 975957 - protein, 255 aa, Homo sapiens
DRETASAPEHRASPLPIRRPSTPAASFTMDDDIAALVVDNGFRHVQGRFAGEMPPAAVFPSIGGAPQATRPDGGHGSEGIPMWATRPKKQERGILTLKVPPFEHGNRPPNVGRHWRKILAPHLSTMSCVVVPGGAPPVGDGGPPLNPRANRGEDAPRSLLGGPFKRPRAVYGGLIQGLVVIPCEGLSCRTNWAFVMGLPVDGVPPTLVPILEGVNGFPPWQFCRWALGWAGDLMVYLSEVLTERGTGSTTRRGRM

SEQ ID NO: 975958 - protein, 166 aa, Homo sapiens
MVTSPVCVRVMKNPWLMTSQKRTLSLSLHLTPEFPSSEALIKVNKQYSLIPIEVEYHPESSHIQKKKNKWVIDTELSHSKSQRVVIENPSVKDYFVRAVGGSGILVAKNERLWVPREGPFIKTNFYLARANFKKQFLLYPPFFVGYNGFQKKHSLGIYNFSRLSLL

SEQ ID NO: 975959 - protein, 293 aa, Homo sapiens
SREDLLNICIEPDTISKGDFISYGSRKVRNPKLHVEGRSGLQASQCTWLDPGGSRGSLSMDSEEYEARPVEVKGSPEKLQSLWILRKREQMLKKPHPSEQQKTSKSETTLLGHRVDPTQGTGASAIPTVSSEGSPRAIFHGKYPLVPPTPGSASQRCALSPAWALRDSISACQHLGETGCPLLNNRDSPSGGSNDGTQDFPRGLLPRLTPPVRAQRGDKLPRPLQFASMTVQGLQEGASCPGTFKGQGPQRGGIREPGTESKSVHPKAKMEGPLSQDKRNRYNTQRPQGWQPE

SEQ ID NO: 975960 - protein, 146 aa, Homo sapiens
DGNVTRKYGNASGTTLLEALDASYTIVPMKALAASPGCLQNGGLWVRVPCVPSGDWVSQTRVWLVTLCAPVNRYTGSKNLVRNATMKALSEALPGDNCGASTCVTEWCLVKAMYRPGATVWPGEPGKKMTPANWTASLGSTGLQGD

SEQ ID NO: 975961 - protein, 105 aa, Homo sapiens
GQPTRVPFHTVESFVLSLFAINLATAHSLGPHCFYELNTHCKNLQLRFLKPAIPEPTGEERTKSRRATLRAVTLTARVPGFILEVSETKNPPISGTPPSNLGRLG

SEQ ID NO: 975962 - protein, 195 aa, Homo sapiens
LSRVWCLVLRVTLSCRLNPGALGSAPWGRLATKSGIKDLPLGTACFPKPRTRIRNWWQKLTWISTRLSEGKVQRLKRRAISLLWRIGPPALCTHVPWAQKIVGSTKILVIDAKLGAWKAPLVPRGNRFLESGGGISSPFFLSLSLQSFSSPQGMCTKAGGGPFVYPRLDSPKPPEGVLSFNNVQLDFNPCAINQK

SEQ ID NO: 975963 - protein, 219 aa, Homo sapiens
MPHSVTLRGPSPWGFRLVGGRDFSAPSPSHGSNAGSKGCYWVALCPGDLIQAINGESTELMTHLEAQEPAIKGLHDSTSQRVCGARPEGQELAQCPWLTGRFQGTQDPTIDPEIQDGSPKNQRAGPSGTRDVGQEGVARPKAGISIMDNPPPFPVPHKCSRRHPASQDEAPCSCVSTPKVTSRGLTGSRTESRLAPEGGQMLGTSEPGGEPRRGPRIGG

SEQ ID NO: 975964 - protein, 274 aa, Homo sapiens
MAPCVLLGSGGGGAQSVYAFSGARAGVEPVSLGSLRAKVLLIENVAFPLRHQGPGTTPQMNELQRRFRTRGPLLCSGFPRCNPVVGHSGRNGQGNGRKDSGIPLQSTSGPGWVGFRAQFSMALPRTVARLTRVAGGRHPSSSAFLAEKALAKLPGEGAATRGFMKPDPKSSFTCSSGRGGPAHRLFASWNLSWRKFPWVGGPLDRVVGHLKGRVHAPAGFPRTMWNNRRPWTSEDPWWSYKGGQVVALRGGPFFNRGLVGNSQVCVTPGGGTPQ

SEQ ID NO: 975965 - protein, 57 aa, Homo sapiens
MAQVNSGWKLNGARLNKFSPFGNTRVPLDTSVPDIYPGTGTLPELVTHPWDNERLSA

SEQ ID NO: 975966 - protein, 171 aa, Homo sapiens
VHRRSLAAVSGGVSLKKDHLALWGLAVCNTPGEAKIYVYTRDSVMFCEEKSKICSIEVYTEQYYKLRSWLVVKGGTQMFKNIQRDQLPEAVQSRQRCIPSGRDTIESNIWRKDKHERNGTTIGSHLVEKEPPCRISWNMATYTLFNVNLVLVSHGGTLECTLTYFWLLLRS

SEQ ID NO: 975967 - protein, 69 aa, Homo sapiens
TRGMESRWRSTRESFAMGIVDDCGGALYDGYHCWWYLSSNQRFRNSPVGETTDYEGVVTVIKTRLTVRR

SEQ ID NO: 975968 - protein, 159 aa, Homo sapiens
MPWDLMETFSRTLALKSLGKKNITRMEVCTCCIGKQKLDGPSKPIIALHRKPSVPRQKIGANAPWGSARQFYNPLLQTISAGILKIQVHYYEHGTGSARESKDIQIPNGLMSAPPAFNRWTGKRNRVPGKFDTWPFNHVQGYPMWDTFHMREKTAPICK

SEQ ID NO: 975969 - protein, 286 aa, Homo sapiens
DRGRGVGGLAHGETSLPELGGEDKATLAQILELEELLRAREVFFSRVDEVVPNLFIGDARGPGTASLLSPWLAGIKCPSCPPQATEKNAFELWKLGHHPRAEGRPQGLLCSGGLTSTAAVLSYPGVASQDLSDFDNSVPTFSSAVTFIHRASTTPGKTASVGREKAVGKPGENVPVKKCHTLAQIFPTDASGAEGGLRGPKSIGQPGIPYSGIWFVSVVWSGSATDIIVEVGPLSGDGSGGGTVLWVPIDAGAPGQAIRLRLIGGPLRFLGFVVTAGAPLFARHSS

SEQ ID NO: 975970 - protein, 87 aa, Homo sapiens
RSAGSRVQKWCGSDIYLRYYVGHMASLGRVSEDRIRPEGVTCNCHHRSGMRSTKQEGRGKVPQEGVRKIFLEEALCEMSLEMRDCGL

SEQ ID NO: 975971 - protein, 285 aa, Homo sapiens
LLFRRECSPPPAPPGVLQTPDFPVNHEESREESGANTVLTPLQPGYRPSGERDKYLVPSRVLFLPLCLRVLLLGGGFTPSLDRISPLPSRRKKEWFYQPCPEGSWRSSTSFRWRGLRYGFHSWPLQRAKPELLGTNRKSDGVHTVETEVEEITVCFDNTFSTIPEKVTSVNTPDYIWETGHRTRTLEAIFLPKIFCYELETSWNHHPLTVRLSKWPLQLGESFEPGDLNEALEGPGLAQGGGGPHVARLWKEALPTALRDYAAVHDKELNRRAGAPRYGLYNIFA

SEQ ID NO: 975972 - protein, 241 aa, Homo sapiens
MAGYSTGDQDRQCAEAVTHCRDTTHVVVGIVGLCENPFEASDLRIVFAAAHQCMNCNQGSYRDWHNLYGKRGLYHMYWQGNGQDEEAKKGMVDAGDLRASLKNVLPGPSLCHIGPNQECAGSFCARKRPHLDWTLTVTRSAGARSTLIGPKRLPAVPCNPCCLARYMIRVIGAQGKRSRGPRFGPKKVPEDHEPASGQIGHEHADTLDGESSHGGTRLNAGLKREEPYTSPGARNFSATLT

SEQ ID NO: 975973 - protein, 117 aa, Homo sapiens
KRQPHALPVRGLLCPLKAMAQGSDAPARDFDGEDSDLRGIHSFQQFQLSSLPKCTVSPQNKTNEASPWRALTRGTWGPGEFGFSTGDLIGSPVPLDILALLILSIPSDFVCSGMNAH

SEQ ID NO: 975974 - protein, 76 aa, Homo sapiens
GLVTASVGATTVAVAAPFVMAGRVRFWTAETVVVTEIILPKEKLLGELSSPAEYANVAVCNQSQSVSYLPGFALFK

SEQ ID NO: 975975 - protein, 73 aa, Homo sapiens
YLFKVPQRVGLEAEAVLRPSIPGSPGPPESREWKEPSFVLESSPSCRKRMWDPCITQGISRDRSWGSQKLENN

SEQ ID NO: 975976 - protein, 88 aa, Homo sapiens
SRGRGGRIAGAQATMQCKIMAHELDLVGPRKSPAHKPSGIAGRPPGIVRPFKELTLNNFYTNFVGNENEVSPKVYLKDVPPRVGINAL

SEQ ID NO: 975977 - protein, 306 aa, Homo sapiens
VRLPLSLEVPAQRRSRLPPPNHRPSFASSPGASPATCCGPAQSHTLRSHVHQVRVLVLLTARMVRRPGHQRKPDESSRSQTLTYVQTRTYSLGSGLCAQRNQAGKTFRLRPGTGGFSQGGSFDGAPCEATTVPRGGRAPCERTIGGNFPRVAGPHNSTTGCFKKPPEPRRKCEELKKLEVTGLQTNFDEVGLREPAEEDHAGRAEQLRAKEVGWGPLSTGTGGHSHGGEPQTKKQPVRSTHNWREYGTDMTVTSNGDETCNHGVTVESDEQDCESVGPGTGAIETVTNPGANNHRAQVWIGANVNR

SEQ ID NO: 975978 - protein, 152 aa, Homo sapiens
SRLSAFFGKPLRHESQVEEEANAQVKAKEEQMRQRVHVNPLACGTGGGPQGAETWNARRWGNAWVTNVVGDLAIANGKEAFVLQKWTSKKPYIGPSESARSTFCEDPNLCFIKTNMAPLLWSLLPLETLVDIVDQFRRGKFVVAPEVVTTHY

SEQ ID NO: 975979 - protein, 244 aa, Homo sapiens
MPLPISSTDPRSRKKELSDIAHRIVHLARGFLAADESTEEHCKAVQSHVATENTEENRRLYRKVLLDKLNDPWLNPCIGGCQSSFHEKSNRRRMMGVPSPQSIKSKGGVVGIKVHKGVVPLQGQMGDNTKGWMGCLNAVPVHEGRELTFAKVALCAGRWGTHPLGLRIRENASVLGRMQESASRMHWPSVEAEISLMAHDLSAEFGRRRGGTSPMTTLLAPLDHGRPVSNSRDTAQGQAENLGR

SEQ ID NO: 975980 - protein, 99 aa, Homo sapiens
KGNCEAKVTVDRAFQICSCRPGASPPCWCKVGVSPYITFYGPPSFTKASPVVKNSITKINGCEHLAGICHKTRIGIRRGENCARTQRGSMGTIDGKQHI

SEQ ID NO: 975981 - protein, 106 aa, Homo sapiens
SCCCLGRPVGSSKLSSLWGCVPCPGSPASQADLEEKRANVGRMRCGRVTDKKRALHSRGISGWSNLLHEKEQLTTGEQKWHTPQVCYIRGPPTKKGCPLGVGHRSQ

SEQ ID NO: 975982 - protein, 138 aa, Homo sapiens
MLAHWERSRSGMPHPRPAHGREGAHRGRVAAGLSQYHGGRLQVVPVAGEELTFVCCIPCSWKRKQERFDSFWKPGNSNFDLIACNPSILGGGQGGQESPWFGDFEDQDLAIFERKCVLANFNNLATILRHGVVGTHPL

SEQ ID NO: 975983 - protein, 73 aa, Homo sapiens
AVRVPIFVVVSVVGLCSVTAKMWESVLFVRWGRGDKHVPEHLKIRFVEEAKMFQEDDEIPLYLRGGVADALRV

SEQ ID NO: 975984 - protein, 118 aa, Homo sapiens
GARLLCRFSAARFESVRNLLVCPELEQRMLRSNHEYRNVPSMKEVCCCNRNIHEHGGVCSCPRICPIDCSQEEWECLTLLRRHYTRDVLIGELQQPVSLGLSIPKPDCDFLTEHGKEP

SEQ ID NO: 975985 - protein, 173 aa, Homo sapiens
MNVLYGLVAAAATNAGLQFDEELEDIASVFRVGQDSEMWWAKAGKARNTITGFQTAYKPSVYGPQGERGRMATEGVTFLSPPSSERYRIPYAKQPPESVDTLKVTHPEGHTENSKPDRSLRQGHHGSHWHAPKRREPPGGKTITARRNETQHHASLRSPTGANGWRRYTHGPP

SEQ ID NO: 975986 - protein, 91 aa, Homo sapiens
AEKPGLQRFRTVREPHPLPRRDLSTAIRGVVNSLRKNHLDILSDVRGNKCDLRPKKSKRCTVLRQPKSASKMDTKAVCGVPFRADTSAMSV

SEQ ID NO: 975987 - protein, 87 aa, Homo sapiens
RASSKERSRRGAPCCMPSLPGDRADTEEEPRAVMCCRVEEGRKRMPIAKCPEKNPQIRAQRGPGWEHILSLDEITLWLERPMCRGLL

SEQ ID NO: 975988 - protein, 80 aa, Homo sapiens
MCPFQKITHTGGMGPNWYTLRKSPVTRPGDSLRVSSRPKEGPTVVLGTLWWACPSTVGSGWTCTHSAREETPVPGGFVAP

SEQ ID NO: 975989 - protein, 86 aa, Homo sapiens
SVTLTSSESEDRAISEALCALIDSSSGFNHFGQNLINEKSVMGNLYFGAHGTNIYFLIHIMWIQKTCGSHFSQQFTGMNMGFHAIP

SEQ ID NO: 975990 - protein, 67 aa, Homo sapiens
IWGFDLKKYQTYDEKNLATDAIPRVREETYNKCRSRLGELDLNDESGDPDEESDAVANVSSLIAPPQ

SEQ ID NO: 975991 - protein, 112 aa, Homo sapiens
TVAGKLRTASDPEQQSKEGRESGDSSWELHRQSVVRGQSEFPMRSSWSERVARSSITTNALICPCLLSLSESERHPGIASGVVDCRKSTSIRSFASYSNQGVVEILTGSVMG

SEQ ID NO: 975992 - protein, 117 aa, Homo sapiens
MGREESGFLDSVRQCVVTEINYQRKAIWRTIFSSEDMAKCALCNRARVFSYSPRIGLFIVKGVCHSQKPFRLQDHQVPDKSHVVLNLQIYGSRTSVPDETYGTPFAPQIRGPSFLEP

SEQ ID NO: 975993 - protein, 57 aa, Homo sapiens
MVEVVHREGSGGGSMGAQPISLTHLVEFHTGTDLTKGLLEARKESGGRSGRSTNEVE

SEQ ID NO: 975994 - protein, 121 aa, Homo sapiens
SDVSAACPRVTVICQYPWNVNFFPFRALHYVAPFTWVMCKNTLMNMKHVSTCSSGPPSSYFRGIKTHIGESNVQVMEAWLIKSVLRVDPVKIVRCHEHIEILTVDGEYSVVDKEKGLVSNP

SEQ ID NO: 975995 - protein, 240 aa, Homo sapiens
MIERLQAEREWSSSSPSVSAGRRDVRPPRSDAHWSQKAGRVSSFPALDVARVVAHIRSTCSRRAVVQGSIPHKKGVEMAPQGMSIKQCALLGEWLACERCKTLSWRHWNRSDVVLGRSSHPAVFGGHRDAYRLRTASLDDGRLNLVTQFTGHNYLHKYAPCIRINTHLHIGVRKGLIANVHWWASLFESTIDQEEEVSDYEMELEGLRLFEQLWKFRKSEDMRVFVKDAFSGELEVYVVM

SEQ ID NO: 975996 - protein, 243 aa, Homo sapiens
FFNLVGVPRERSCCRHGRRPARMYRDEEQAYPKSRSCRGVPDAEDTAIPDSWGGRTVHIGAYAVHAASVRQLSGVQHDIIAAQCVLLIASVRSAPNLCAQSSQHGVKQVCAQKNGLPIIRVCGSHPFHTSSRHQQGWLFLVLGPDRAPQQGIASVALTRPPGHLWPGVHIWPKFIMSNPAPKLAEQGSMLIEALPRGKVQRFLGRQKDPHLTEVGLTKFNADEFEDMVLKSGHPDGVGSGTSQ

SEQ ID NO: 975997 - protein, 243 aa, Homo sapiens
LFPFGVPLKILVSPWAPPRRGYRYGKNKPVPKVSLLAEVSLMPEIRICDLGRKRQQWMSSRLCRPHGVKMNMSSCPLKPWSLARICVPIRTLVTEVVAKIGSISGVRVHPFPGHPASPKMWFPVLRADSAPKQGIAEVPCETPQGTGGAQGFTIVPQLSMSIRNQAADNQGGQVECKGPVRRGPGSKVYLCPPECIHILTRTGAALHTSSNGCCILARTLGLAKGSIPSCLGGQVLPQSCPSD

SEQ ID NO: 975998 - protein, 68 aa, Homo sapiens
GSERLRRTWLPACSGEPEYPKGIRAVLLGPPRARKGTPGTTDVFENFCVCHYSYWGHAEGIGGFVAQS

SEQ ID NO: 975999 - protein, 130 aa, Homo sapiens
MCRAQDGGPHTCCAWRPPYVAGETFTVDFQELDWRNWILSRGYQWILQVGGSLPKRVGGQALLPFHSGVQAPKGKNPWLPTSVCLLPGPFFSYWYNGLAPVSIVGALLLPTAGWWNTSSHRFLGDLLPPT

SEQ ID NO: 976000 - protein, 78 aa, Homo sapiens
ALPSSVSRCPAPAQPKSQEKPGRSWSGEDYAKERYGISLSDTITRKTRSSLGPGKDDLTIQKADEVVWVRARVQYKQS

SEQ ID NO: 976001 - protein, 290 aa, Homo sapiens
KGTPGLQNASVVPVKDKKLLRSNWGSCQADLMRDSVPSAIRSVQRGYYRTTTSTINVKKGSICADTMCCNATCSLSYSFSYKHLKHEGSGKSIEEDTFLNPPTKDCGRGPRVRTHNLTSVGGNSFYINSLIEEINLPKIKTLLGFTNTRNTPKKKTLFWGARPRKVLKTPLRWGGGAQYMYDTCAKGVQREEPLGTDKGVGSPQKKRGGTPRVLTNQGWAGANWPIRGHRGRKSRRGEANNKRDERQVRKERQEDKEQRHAKKTDRKERQGQKQSTETQRGKKTEQSSNS

SEQ ID NO: 976002 - protein, 130 aa, Homo sapiens
ASPNANEGVLARLIGVRFFLCCGDLLRPMRRRGAQSHRQVVLTYECEMKMYGGVILSLRKDCPKTVDNFVALATGEKDLLQKQQFPSVIKDFMIQGGDSTREIAQEEEHLGGALPRMRISKLKAIVALVG

SEQ ID NO: 976003 - protein, 104 aa, Homo sapiens
MGLGSYMPSGTDPEFTEFMHVIWPTLGGGHGCNVQSWARCLIFPLHRDGQREAARITINLPEIQKVPVESERQVRQETIWRYYKGSSEMGTFTRKNIGIKSIKL

SEQ ID NO: 976004 - protein, 128 aa, Homo sapiens
EAGRGTSRGRVEDASLGLEAVKQPLSWLRVENVVPGRRCKKGGPPVTMVSMSFKRNRSVTGSTAPGVARVAMSGTGRIIRGGPVTWVVKPLLCGNWADCGQVTHQNSIAKLSTIQYERHSEYISSEKW

SEQ ID NO: 976005 - protein, 95 aa, Homo sapiens
YVSSTHHADVSVKRDLLFQALGRPTTSEKEIISKEQGNVKAAGASDVVLYKIESLPIDMISCVWEGMGRGLQVFKERIRAPVYKRCNGLMEKSRN

SEQ ID NO: 976006 - protein, 162 aa, Homo sapiens
MQQGPGPPHVPYLVPEWGMGCSACDVALKPAVPSIAVERGLFPQCFLLTAHAEFVPLCKIDVVWAIVVPLSPAKLGPPKCGVLYQTTLKVTSSCSSFTKIYSYNILPSVAGIFPGKRHLKLSMGIFLFSPHCESEFLYKTKQCVSTQNFIFVQRGDFCWIQS

SEQ ID NO: 976007 - protein, 58 aa, Homo sapiens
VTGRRFTQATAHTTHSPPNNSIFHTQQALTFTTPQPPSGATLNLLPSNHQPINNNTKP

SEQ ID NO: 976008 - protein, 81 aa, Homo sapiens
SCTSSTTCSQGRGVDHLGGLGTWYTSKGSHHQRCHCDSRVPTPLCEGCSSTKSTDSGFPEDTFGPPTSWTETFEDYGYDDT

SEQ ID NO: 976009 - protein, 124 aa, Homo sapiens
MGNQKCGQAEDQKEDGSDLEAHRLLTQDMVHSHNGFPRAHSQRVGRLGFSTPDGADLGLCQGVRRKTWKTQGRKKASSVRTRNLGSIDPRPTKIALYQEPSKYVCKGSPRMMTTLKLCVPTTTM

SEQ ID NO: 976010 - protein, 213 aa, Homo sapiens
MATQTDMETGLCYYGPLRSVWVVENPPALFVSNLKIPEMQLMQSESYHGRPTIVGCRVHECHLSEWCKHRSRLVPTSLCGVVALEMISEEESSTSSQSHHHVSSHHPLNSAYTQVIFKPFTGVHVDPAAPQLQVGAGVSVPHWSPSAWAKSVRFGHRPFVGPRTHCCFSSGTFSSTPSTKFRAEPTSDGPKFSGQSRHGVIHHCAPQLKHALG

SEQ ID NO: 976011 - protein, 145 aa, Homo sapiens
EETEVLRMVGTGLVAETVWWMRCRIVIKCYDSPCCAGKGRAWVEVGNSQYTELIKNNVSYRDEPRDIFLASVENCTSVSTLTLEQIGWLGQTNVNVLTYGKAIIEASEAPFLLFNNNLTIYCRGHDWLSTQLLMAPQIRSHQGPR

SEQ ID NO: 976012 - protein, 91 aa, Homo sapiens
ADANVLTCLGQGMEMSPRKYGNGSEPTLLEGSWTASYHQFVKLTSPLWLLLQDVYKMGGMDTCPVARGDDCVLQTGVWWSPFAPVNVYNGT

SEQ ID NO: 976013 - protein, 77 aa, Homo sapiens
LATGALVSSVPSSARGPDLSPSFPQRMSGFQINLNRLKEPLGFIKVLEMASYLVLCATCGGFKGQTEIHVIVSSCSY

SEQ ID NO: 976014 - protein, 86 aa, Homo sapiens
PVCIHSWVFPRMLFSGVVGPQPLFTLGMMEVWAGSSRPIKAQSEQRRLWWGMDSRGILLQRMPQALKPSSDPQLCGDCTLPALSLN

SEQ ID NO: 976015 - protein, 262 aa, Homo sapiens
IVRKRVCARNTGVVKIPLKAKMERKRSYQHCRHVDTVDRAVHHYCHLIYKCGASTKEPLKNFAKEAAEMGKGSFKYAWVCDNLNTELTVYHHDISLWKFETSKYYVPIIDAPGHRDLSKTMITGTSQADCAVLMVCQLVWDWKLVSPRMGRPEKLPFLVNTLGGATTLNWSGVTHTVGIPHLEANPNRPGQDDTEGNVVHGQSSTYLKDNMWVQTPGTKVGHFVPNFLGGHWLPTLAGRQWQPCLGSQAGHVSRRLHSGHTV

SEQ ID NO: 976016 - protein, 146 aa, Homo sapiens
MAMPVEHAVEALESSYHQFVQVTMPLGLPLQDVYKMWVVLELSCCRCGRLVSQNRGMVGHLLLTVNCLQRGRYTNLVGNAPIESFGVKLFPGDKLWGLHWSRNCVLCKGIGPVRWGKALGSGCTGQEKWTPPKLGKASWPSKLATA

SEQ ID NO: 976017 - protein, 144 aa, Homo sapiens
GSSEYILVKRIVELLKSCSSVLLWGMCYESCCQNKLIYFLSIPLSAQVTYILVPFFFFSTWWLYFGFPFNSLGKRWIFQGRNPCVCVPFAKEVDRVSKLWSTVLSLVRGGTPLYNGGIIAKTFHVIPVEGGRRQVTLSHVGPFN

SEQ ID NO: 976018 - protein, 125 aa, Homo sapiens
GWEEGTPGREEHGGGDLVSFLMWTSTPRGSPMYVLIGSPFVSPLGAPGLAESKEIVRGYKVAAEVPLWTSTDKCVRGELCKKARFGRLVSLSGGGGRIFFPTRNVQRDQEEMDSTCCKRGNPQWP

SEQ ID NO: 976019 - protein, 104 aa, Homo sapiens
MLKGATVLLGYREYGSGLLSGEIERRKKGVFLKIQNNVEPVEGKGFLTIDDAVRKWCKYSSNINKSCSVYVVKSCLLTWACVSKLVPPKLLLWFGLGGKTFVHD

SEQ ID NO: 976020 - protein, 79 aa, Homo sapiens
RRDPGCGSSGGKRAVPRNGGAHNCHGTAIVSVWARVTLLKCLLIPNSRGFARAAIQQICEVHEKWLCINSQVCQYHSVI

SEQ ID NO: 976021 - protein, 79 aa, Homo sapiens
WCDSVLRVVLWSSVFNLRPPSLLPNVLCRHPMKDSMDMDMSPLRPRTIFSVCELKADKDYHLRVDTAETEHPVILKNGQ

SEQ ID NO: 976022 - protein, 122 aa, Homo sapiens
PPCRSFFCRSCAAVCARCADLYLFGEAASEETPGSQCRRKAKGRSQDWRTKDHIIWKVGAQEMVSCGAVKDKEAIHPFSKLFEAPICERQVLSMTGRSDPDFCWAPKSIESRHICSSWTLAL

SEQ ID NO: 976023 - protein, 235 aa, Homo sapiens
LSWRNHHGVHLYTYPENEGLKALIAAQYSGLRSGALRHPIPFGKPTTLEFLRKFPAARSQHWRVMMDSGVLESNALPYYVSNEELREDSRVSSPVVQWVSLVIRICAPKPVPVVPTCGIMHPQKQATENARREVRPNLGLWMLLEDEAFLVGDRVTLVTSQLSAPCCGSISRSRAFPPGFPITRGLTWITAQFGCLGDEMVVQWAFVPKRWGAPLKGPGRRSGRQTPVGREKAPA

SEQ ID NO: 976024 - protein, 72 aa, Homo sapiens
GYLKRMGTKAAVYAAVLASPSRCSLVKSALNRLQVEASANNGKESHQKCTPDFHDKSGNAVLASGATFCMCT

SEQ ID NO: 976025 - protein, 187 aa, Homo sapiens
MPHPRRQFIRRQSSDAGLRQEQPVKPPRLPYDKYSYSKDWRRQQRSEGSLPDKCPGTTSLDTAWIGRIDLDGSGPLLNWRWLIRQFSPGSTSGSHSTGPQSMSADEQYLEGAMLTPTRLWGSTYSTVLTQCSQQSQGATIFALGRNVLTWALGSLLHKRLSRGSHTMYNKGLVKHTRGTFSMDCVHA

SEQ ID NO: 976026 - protein, 103 aa, Homo sapiens
GCDPSCAVVSGAASFISVRLLSYLSACAPDGRSMDMDMSPHEAPRNYLYGCEPVKADKDYHFKVDNDENEHRVIFKKVSLGAGAKDELHMLKQRQLIYEGSPD

SEQ ID NO: 976027 - protein, 258 aa, Homo sapiens
ILRLTWCRDDRYLMKILMSEVQFTTTARENRARIKEKAVQVARGFRAGDATAESFLFSEEELEWPDCPGHHHVPMSGRVSGAAVPSFPSVLWNLGGHPGDHLSIPIMKCCRWTTRKKDRCNGPNSGVACPGGHPTQCYPGHLLTRIAKAEITRLGPKHPIGRHQDHWDPKRRKELAGDSGGSIRCSLSTLPARCGLPTQDYESRALIVQRKVFLKGLSRMVDVAGGNGNLGFGPEVKTYVAKEWNTLKRMAEVVDISW

SEQ ID NO: 976028 - protein, 70 aa, Homo sapiens
GCQLKSGSKRSGVPMRYKNFINPPVSPEQCERRGENEPEANISTSAGRLPGVQLATSRLPSLARHRMSIR

SEQ ID NO: 976029 - protein, 69 aa, Homo sapiens
PAVGCQLGWKAVVAAWVLGLGCSSRDVFSEAEPGRRMWEASPSNHRRYLKHVMKIRKDISAERTLRMLL

SEQ ID NO: 976030 - protein, 102 aa, Homo sapiens
MSESWHSLSLLIRAELASQANLLGNDHIYKLSSQPMHWVIIFFIVIPIIIGDLCKLTSSPNKSGAPDMAFPRIKQHKLLTLTSLSPTPARIYYSGGRSTEQG

SEQ ID NO: 976031 - protein, 286 aa, Homo sapiens
LRFFHTQSTHGPDFSWDSSKIRVRCSRCHEGDDAFAKETHVGAQLPEKIQKAFDDMAKYFSKEEWDKMKASEKISLCVYEARKYEAMIKLGFKATLPPFMCNKGPKIPGAHDLIMTLTVGTQVERPQMTCGRLRESPRKIMPKKPAEEDMIGGSARSFCPQNDCERAVPPVKTNTSEKIQERSGPKRGEHAGPQTAERKTGGGLLEKFRTLRKMRVLLLRFRLALGGTRRGAFRTCACAASYHVLPLSLSPAVRLLCQRGPVYNARAHLGPLCGSPNLAGTPVGGS

SEQ ID NO: 976032 - protein, 137 aa, Homo sapiens
MKEEDVLKFLQEERHVSVARILDCPECNQYDAIKRNGDGLLYHKSQEDLGEALCGHFVGLVGMEKPVMSSVISSQGIRGTERLRSSHICWFGNWEANLQICRGQIQFLENLCIEAKIQDRLPGTHGNSLWSSRYPRG

SEQ ID NO: 976033 - protein, 205 aa, Homo sapiens
MPNKNKKEKESPKAGKSGKSSKEGQDTVESEQISVRKNSLVGVVPSTVSAKLKGTSLSAHSEERQRAKFLQGFRRKAILENFQKLPSLKDVLRADSREAFYPEVTVRCGVLFDFVFLNPLSDPKGDRTCTNGAGFNVEMVELYHPIIGRVTHQTPIYPTKYVHYCCRYTLFRTIYQPFSSILNGSGIFDPGGKDDPIVRMEAGFN

SEQ ID NO: 976034 - protein, 98 aa, Homo sapiens
VAREKVGGPPFIQNCSAFVLAFLPLCRQSCEWAPEKRKAPVRRTNISVGRGALAHEAKAQTSTSDLCSDNGTSGGAPRLVCSQRFSHRENFVLRVFSL

SEQ ID NO: 976035 - protein, 157 aa, Homo sapiens
PRPGARGGKAEDKESMPVTNVAALVKDMKIMSLEEIYLFSLAYKESEIMISSGGLSQGMRFEDYASAEEDPCRPAHQVQRHVVPIGDLQMATLVWVKRCSKEVATGKSVGGPSIRGTKLSIRPRAQEEWGGPKDGKGPKLSPCKVKAVGSVMVRLIH

SEQ ID NO: 976036 - protein, 250 aa, Homo sapiens
IRFRSRGFGLYPLGGRLCRLQVFLCGSLALQGPVELGAVEELAGALRRESRHGLVAPIGSHLQKILLLERAYTCGGPHLNSFRPFGPGVWLCPHFGAVQPDWVPAPQTRVAPRENGPCPKESKVALLLLIHICAQSQVLWNETILWWAFKTYDEGFGHMCVLGLRGATTFFKALYVKQRFWSRGGGFIPFLGIPIWLYHKFVEDDWREEKGAPVKVLGNVSSRESRFADALEDLRTATDNINWGGLSGRQ

SEQ ID NO: 976037 - protein, 293 aa, Homo sapiens
LSIVGTLSVLGRKAPVPSKCLGVLEILCKLSLQRLITLHPTGAYGSVNSLYLTLIAWRGHALDTFEQQPFMTNGCCGCTVHPLSTIWTQPAVIARETGIMAFALNPEKGPNKGTLHSTPLTVKPFIWPLWETGDLSGPELEAPPCFKLVNGLPGAKKGFPMKRVLWKPGGGPLLSGRIHRGPQNAKQEAAGKFNMESNKGSGTKIGFWEEGNNIWDNILWISRKLDGLPLTRGCRRAEGLGLALVMSCLRKMGGSLIKAGVKREGIGVPVVQDIVELMWPLQKEWREEVAYDW

SEQ ID NO: 976038 - protein, 189 aa, Homo sapiens
EKRASKMATTKRVLYVGGLQRKWTTKFFMLRTSFVDITDIQIPRDYETEKHRELAWWNLSGQRMLQQVIDNMNESELFDVTIRVNWAKPMRIKEGSSRPSCQMMTVLKKFSGKTLEENKRGHEGSEPPKAETQEGEPMCKKAAQILRLSHGPSRLEHSRCRFQMLRGLIVVPMTAENSAACAINEKAVV

SEQ ID NO: 976039 - protein, 131 aa, Homo sapiens
MPCNSQPLLAAHGRSDHLKVREFRDQPRPTVVENPGFLTKRFQKNLAGHEWGAKPWQHSRKVLRRSDESVELRAHGSVAVDPKNGTSKFPAWAPGGKLRSQKKYDRQTQTKILGHATRGSSKHNLWGRAQK

SEQ ID NO: 976040 - protein, 68 aa, Homo sapiens
CERAVSVLLPSHGVHVRGFCYMLWLLISASHHSSPFAALIGTLNELKDCLQGTPIDQVKYPEFPCNYP

SEQ ID NO: 976041 - protein, 145 aa, Homo sapiens
MLYNSERVLTPGLKEAVGGPESPKNKERVTANVLGIPARQVFIDYYFDLAESARGARYFANYWVRAGFSPEKTLGGKKTEGRTKRTAGRNPTPQTRDYHATSGGPMGKGFMKFTPFLRLSGQHLNRPNALVVAEHNARCSSRFPL

SEQ ID NO: 976042 - protein, 71 aa, Homo sapiens
ACQSAPRAVCGSVSASVEASGIMSGFSPRARGQFSLGDTEWFAEGIAEGTSIIISIAWISKFTADKDVSTM

SEQ ID NO: 976043 - protein, 122 aa, Homo sapiens
KQRYQRRVPITAGEASARSSVGVRVIYARTADAVVGISSCRLLVDPGHGFPEVYQQTVVRSGHWTFSSGGNATAWGKEFAGLGTPKRGKIFRLQTPVGPKGGDTRGFFRIDPRLSLSLYEEH

SEQ ID NO: 976044 - protein, 76 aa, Homo sapiens
LLFCRLKHGGCMKRRRRRFLLCRDPEEKAKEFAESEDHAPEKEVCPKDARKALEDSLSMTNGNSGITRNMGQMYRI

SEQ ID NO: 976045 - protein, 155 aa, Homo sapiens
PPCRAVRARLLLPSGGPGVLCRVLGRSYPALPEARGLGLDDRTARAPAGAAAPWAAGGKALKLFQARTINSASRESRALCLQAARRGGLKVPDPDYDSNFLGVGNSPFGWGWEERVLWRTIQFSISGWEVVLPLGIGFGAHMFYSTQLVLGFLDQ

SEQ ID NO: 976046 - protein, 286 aa, Homo sapiens
PWCDPVLRVVSGVASLISVRLLSYLSVCRHPMKIDGHGHEPPEAPRTIFSVGELKADKDYHLGWITDENEHQYLKERSVKGLCHMDELHLCLTAEAMYEGSPIKVPLATFENLSVQPTFPSWGLCEITPTQCLKGRQCGSGASALFSGQHLSKLVEERCRGQKDWTGARRIVETLKYILEKAVCPLRLVSKGSHQEKHVTTLLDEDDSPDCMIEQRDADARMLTECTAFDEVTRSLKKKRGSVKKSNYENIRGKNCQSQIRMGTTKPLYTPVQRRESSKKGKILKP

SEQ ID NO: 976047 - protein, 218 aa, Homo sapiens
GASGQGRGFRGASGRGRLAWLSFASAVSQSFRMCLCCAGVPCVAGLFRSAGPRGLAAPGFGFFGRSSLKAGHPGLVAPPGPSGVWLQGCGDRVPEGGGRGPSLGAFGGTPWRPVWGLGALGGLPFGTHRQAGKNKSLGGGDPPRSWHGHTQEGGNKQTHLPEQAIKSPLPLRDWVWKGVGSWKNLSGGPRKGENLRGGENRSARGRRQTSRRSTFQII

SEQ ID NO: 976048 - protein, 314 aa, Homo sapiens
DRASPRVVGVPASTVLGTEPGARSPPRAGAHSKPSVTSYRSLRIVPQGPLVCGFQGAEEGQRQAMPCTVYILLKYGQPIDGSGDSNLLAGIAAKKINKAQGDPQRGPGYCNPGEEYTLGRVCYDLTSTRSHPLYPDVHLAQPFWTRTVVLVRSSRKGNFLLPKNDLFVLINQTSSNERGQDRGHNIRVGRTSWVSQVCGMRTHTERGGAEISVFRCQAELTSQEAPGTVSGHSNLWGKNCGGLRTSAQVVLSVGHYTLFSGATQARGWNHTGPIYRGHILANQNRWRPTWATHKNVVAPTSGVGSLTTLLGRPL

SEQ ID NO: 976049 - protein, 180 aa, Homo sapiens
RKTLLKALKKLQAEPELPLQVQPRASGPSRSAEGPEALLSCLGVPLPKRLSEGLSLRPEDLFEGASLDKGQNAGRLVRGGPLLGNGLRNIELEGPRLRKRTQGAEKNALSPAPRETPPHGKRVLCPRLEQPQYQGSLFATGTGHSQLHEGRSKQTEEGVFAPPGHTLMLASSHHHTAAVT

SEQ ID NO: 976050 - protein, 81 aa, Homo sapiens
RLGPARELLQSFAPSSPPNRIMLQFLLGFTLGNVLGMYLAQNMIYQTWLKKLEEIKSGLWMPRRNPLVHETVPPAIASGYT

SEQ ID NO: 976051 - protein, 106 aa, Homo sapiens
MVRKSVGKGFRKCPRQEAGSPARREPGFAGPHGGPVFHRHLKILGQTSSFDVLWRANWPFVVPGQAHSLGLYLYKRKGEIKLWKHMGARDTCASKGNLKEAYKKGV

SEQ ID NO: 976052 - protein, 332 aa, Homo sapiens
VRSSEEPKSERAEEARAPPRATQPRPRAGRKSARAPREGAPPPGQPAGITATNRQRKAPGAKSRGGGSHELRRGEGHPTTNNKQTLPRQDSRREAHQDAVASKVTPAPKRPGVEHAVCTPRGGAHPRDTRRAHIERRRKNPRSGQYTPRPLSETTHRGTDRCEHAHTLYISTPSNDRDGRHARDKRKNVSRDSTANVLVCKLRTQRRATGVTEEPTRLYIPPDPHPKRKELARPQPQKRAPHRRKPKRHEQLLSRPGRTKTVHNLDNNGEVVSSTKREREPPAAMGTGTEWNSCGKGTGPRQSGRRPIAPWRNSDRAALPPPGGGQHRARGR

SEQ ID NO: 976053 - protein, 94 aa, Homo sapiens
GRVPPSFSRSPRFGLPVPAFVSELRLATGSPGEEVHSDLCCEMVHPEEMVMVVMEPCGKNACHSLQQGPVPEVYVATVFENYVADIEVDGKQER

SEQ ID NO: 976054 - protein, 242 aa, Homo sapiens
SSSSGKQFVRYINMWINDTTFGSMQSLESLKRIHEVAGRDERTIESGVAPVSPGISRQCSSVSAVLRMSVCPVSYLRPWLHREPVELCSTFLHEVRVQKALPPEPEFVVTPEYGCECLEAVYSLQTTFVGPQSVRDLKKVEKPRVEIRACEPKERTVASQSDGYATYQAGPVLRYGKAHCWRNSSILRSKEWSEEVMQRWRKEGSNPPISIKKNISCSREKVKGDRWHDRRRKKFDLKEALD

SEQ ID NO: 976055 - protein, 108 aa, Homo sapiens
APSVLSDGLEIRRRSHSELIHNLRKNGIIKTDKVLKCCCYRPSHYAKCKPIHGFSKSIGFQAKISAPHMHAYAQEFYLISCMKELKLCDVGSKVNPYCMFCTVLVGCT

SEQ ID NO: 976056 - protein, 320 aa, Homo sapiens
MSSSEAPESGRSEETWLTDEDQGKYRGRELVMEGPEIDVNVEVAVASTCVDENGSIVGEQGYTLSGTEGEGNSWDVVKIGGGPECGLPGGAQLFGEGTDKLGSFETVEGREKAVWPKRYGLGPQNISYIPKIVATHSDKTKKEWDLHYLGTRGKLSKNLQEERSSIEPGNSPRMNTGGPASGRCCILTRHSSTALVTPGYPPTQLEGAPNRSRGPPKGIQGRWGHERRDEAGKAAHTAPEGSNTGGRSSEVTHKVVTRRPAPHRYKQMSSATHNLTEALRGGVHTTTPGGRQYRATKRTDTKIRVNDELDMKRRVGEYVR

SEQ ID NO: 976057 - protein, 98 aa, Homo sapiens
VSACALGMFDERSDVHRHQVTKISFAERGQKLRCAVIVVCHNRESFNRLVEHSGFILNVYCELGFQKRTRKVELHVDVRLQIIEACDVCLKEDDIDVE

SEQ ID NO: 976058 - protein, 97 aa, Homo sapiens
VLHRGPCEVFHYGFQHCPGERCGSVMNSRNTGQVGDGLRGVYRCATDRNDFLETCDTKGLLCCGSGLARNLSDIDLIGTSARGVRQVVLMPPVVLSS

SEQ ID NO: 976059 - protein, 68 aa, Homo sapiens
MRPTVRGCHHTVGQKVVAWQFQLPKAKEDYPNGTPLYCERSSGLPIAKRVQLHTKHWTFRGTNPAASW

SEQ ID NO: 976060 - protein, 299 aa, Homo sapiens
TRALEVKMEEYARRLPMRIVMTVVGLYDGSPLVGVSFHAITGCLRNSSMWMLTTDLRRRCLTGLNKNQGSTEGRYPFGQLGEALVSHDWTWTYGSHVSRGNKGRSLENSITSVFAFKVGSHNWQAKELAPSCPLLGYSRNGGGNLPSLNGRDAGSSCGPRDLGLLQQFPIGSSQCGKDPSNVASLQYPSSPFVRIYRPYPGSTSFPKDFYQETELVLRERFQDDPVTVGVNTLVWTVIGIGYKDLALFPIQDTRQRLNAHVLFPLWLLPKFIARNSSVKEPRPTERLPAVRWVVNNGAL

SEQ ID NO: 976061 - protein, 284 aa, Homo sapiens
VGHSCFLSASVLVLTLTSRVLFICLLLAPFRVCPSSSLFPGPVLAVPVFILLICLFLAHPVSHALPSAFLTPLSFGALLALSLHWPLCTLKFFHLPIRCLYFSIIYLSSSVSAHPHFSLPFLSWGTLPNAPLPNPLFPFPSSHPPFPSFPSNYQLCWSHNLFDEKTQPVVHARESFPHPCFTMSSWRTHTRQQTRITAGLMLSAGKAVDTYKTLERSWLPPRDPMGPLFGPLGHSTKISFQMAPGGPNLLIMERLEWHLCSHGHNWSCALCAVHGLSPLLVWKM

SEQ ID NO: 976062 - protein, 260 aa, Homo sapiens
ILIILTDATAPRGWFPEAAASANELVNDLCSSIESSTKNTPEFVSCAIQPKIDISNCKIPKTILLMLTSKKKSAAEARDTRRVEASSNHRRERQLWRYREQRRELASETWWPPPNFLPKIFQKGLFPSKVPRAKPLEILGVWASEPRFGIFSLQQIWGLSLRFVLYGTLILKIDAGFNQKKQPTTYPRSSRAKQQRRGSGARRPEEEFNTQRVGGGPKVRTPRHTCPKHSKQRGALPKKPAQRLTHQASAMDKGPGYRPG

SEQ ID NO: 976063 - protein, 46 aa, Homo sapiens
MACSTHWRRDCSTTGRATLRTHSGTNTRSTFLALNPRVGEHAKGLH

SEQ ID NO: 976064 - protein, 128 aa, Homo sapiens
LSPGVLVASDIVFKPCVKSLTHRRVMPRKTGDLNSNTSLRSSNYVDDYPKCFICWEQTNVGSKQMQQIRSVPSREGCWCLNGQRTTHDCARPSEGHPGKNNPSSGENWLASYPGETVALGVHPGEDLT

SEQ ID NO: 976065 - protein, 215 aa, Homo sapiens
PLRVLLVLSSCLDAMSLDPPPVLLILHVQVAAEGRGAGFTDESGDPRTLKQELSTVTMMADLARYARWHRRSHQDEGISSKPIVKARTAPLAKIQWVISVVFNVWQAPLIDLTHWDVYPALLLSCRYLDNPLYRPREAFPYKMYAGVCRNTLWHLVCTKFVAYGCSNPGPGLHPGRHWNYKARGVKNTRDFPSSIAKNFVIQQVLRFNQPTSVHR

SEQ ID NO: 976066 - protein, 129 aa, Homo sapiens
MPSCALSLEQRLYLRRLLSYLMCVPPPDEDSMTCHEPPEAPELIFAVCELKADKDYHLGWILLHQGAPVIKNLASKGAVPTDAVALLLTAGGNGITKAGPISGTPGTFEIVLYQPPFPLGGFEITPPVF

SEQ ID NO: 976067 - protein, 141 aa, Homo sapiens
MDMDMSPLRPRTIFSVCELKADKDYHFKVIHDEQAVQLKYHCTLKMLYSQRFPLGGFEITPPVLLKVAVCSGPVHISDSSLVAVEEDAESEDEEDGGCEHSLSISGRRSAPGGVSKVSTEKSKTCADEDDDDDDEEDDDDR

SEQ ID NO: 976068 - protein, 200 aa, Homo sapiens
APVNNKARKTELRASGGSKSMGRGAQFPWKTEERARLILILVPSSLLPSLFLTRIRAGRAAARDRRSSSSPFSSLPHGIVLLRVVGTLTFLMASPPMLCRTVWSALAFLVYLMSSVVLSSHWCVPFSTLRERIALGIGVARMFTGTNPAEVFGSEHVLNLRRGYGNNPVENTALPYLWVLTCTQTLMSLVGRHPEWDRNG

SEQ ID NO: 976069 - protein, 315 aa, Homo sapiens
AQSLSRREIQQPPLEPPRSRSPSPPARFSANAASEPSTEGKGIVSYVRYPRISTLSTPLLMHVRVMTCSCLATEDYIHIRIHREHGGRPFTMSRDRWIDYDKRTLVTPVTAKSLPANGTVNVSIRNMETVHSGYKGDQRKKHIARFLVGDVHVLKDESVKVHGLKSACGLTEGYVTGFLASEYNIPFSPLSPGLQTTSTGGYYSTHGRSAYNWDLVYVLYALSEKSHAGLVLEVLNLKDGSQIAPEGYSREPANRMLQQPSPKIKQLRDPSTWRTTIKGTRTAIQERENPAKGVVPVQRHKPRRLTQPMDKHRGI

SEQ ID NO: 976070 - protein, 113 aa, Homo sapiens
MSPITEARRIHFTLQTELITPAETCRAVRARPARSGQESVRWSVNIQQEDPRARRKGIAQPPLMLRGPTHTNKELTRAHRIKSNQNTLNPQRTKYPAPTVRIGSQSAGPSAIL

SEQ ID NO: 976071 - protein, 142 aa, Homo sapiens
MRPRYSLRPTALPVGRRLIAIRGGKVLRKVEEPFAKFTSVIDSRFCGTRGFLTYPPGLQNWTQVEVERLPCVFMNRLPFCVNTQIFQIHLLLGDKNPENPVPIKAADPLFYSGAQGGWLHNSDGIGSTAIGCLATRATRIWF

SEQ ID NO: 976072 - protein, 147 aa, Homo sapiens
MLPEKHLCMSLIRSCFASRSPALSPRTRKLSQIPEFQFLNPVLGITVPNNVKTQAGKTVRKSPQGLRTTTQFVKDAKLEKRRLEKGKSLTMGKWGHTDGSPIGGRHDNTAHTFCRADKERGQETHHGVHGYDNHERREQCNQIRGTL

SEQ ID NO: 976073 - protein, 306 aa, Homo sapiens
DSQPGPVAERKCGPRQARPRDAGPRGSGDSVGPRTQRGQARQSERRGGSGKAAGEKWLMTGLLSVRRKSGAPEGAGRRDPGGRLPGPSKGEREMGRGIEEDTNRAASGATCRGHMAGPGDPAGGPNRVAGGLLTRPGGTHAHWGDWCPGGQTPRSLDWAYLREPWPVGEQGVTTGSWEEHPANVEEGARRNRAQQMDSLASKGAPDTGDGGEKAKKGPVEEVTPRGVEHFDDDRSTRHEELREDPAGPQPGGKGPVFDYPREQRQVAPAACRKSRRGEGAHGGGTDVRDNVHHTPGGHPGPPKRFG

SEQ ID NO: 976074 - protein, 102 aa, Homo sapiens
INSEMVIRAGRKGMRRHSKNGGPLRVSRVGPMVSVLASGLRVGVRTLLCQAISVTESSRDDGTVLRPAKVRFDDMERQANKVVVTLQEPGSHQHELCGQAAR

SEQ ID NO: 976075 - protein, 81 aa, Homo sapiens
MNLVYNEATGQSERSPLAAQVRIGVAEIHCVIHIGSYVDGTGKPVTGGDICESHVYWFPTHSRLFYNQTTRQMRNNHIHRF

SEQ ID NO: 976076 - protein, 182 aa, Homo sapiens
DNAAGCPRARRVPRGRGALRAEGGLGSASLRSLKRARDQRGSRQEEAEGSSASLSSPLKLSRGKPGGPGVSWKEGGVPVAPKIGNSSSLRNMEDLFHSTQGSHNSSFIGGGGIMQGKLYHFLTKFPIECEWYITFFLKIREVCTQKIVCNKYMFPNVAIWWTKKSSWSPWKHLLLFTTGVGN

SEQ ID NO: 976077 - protein, 149 aa, Homo sapiens
MTSCRITQESDARARISMIDCARATGKDYLSHGRTEFIQNISEQIETIKKEKARRTAQHQHSAMIPEGAPPMSSTEPLARRLLDEQFVPIVVYHSVALRTIRQAFFSFVDKDLLGNLLAPVLLQPQGCIAVIRGADGMTTDPLVTGDER

SEQ ID NO: 976078 - protein, 110 aa, Homo sapiens
HFVTNCCQLATTAADLATTACVSEAELGLTSSAQVILPPRLGTTGETAPGAMNGDDTFAKKTQDDAKASEKRSKAFDDIATYFSKKEWKKMKYSEKISYVYMKKTYKAMT

SEQ ID NO: 976079 - protein, 220 aa, Homo sapiens
MNVERFIMSRVSVHWNTGQLEEGNPAGIPGLMDPQGHDGLTRVDHPPASVRLHKDERSTTCVWAKQSKPHKKHEPWIGSGGHGPSQCDKSIEVYSRLESPDTNTASVYGKHTLRDATHWEGPGKDKTNDLGVRALDHSITPTLPRGDTAEAQVTHAQTTEQTHECAPQPGLAGCSATVKSAQRRRSSEQPERPEKHAHTHQPQRNRTPPHGTEPEKRQDT

SEQ ID NO: 976080 - protein, 89 aa, Homo sapiens
MVVRVWSIIAERGEPVFSGASSHGFQCFDIHPWGGAVDTLAHWLVEDPLVLCPGWVAAFDRDRAWSQGGVKRVGGAKRHTPGVGGRHPR

SEQ ID NO: 976081 - protein, 123 aa, Homo sapiens
GHPEQQSKEDGVRASGALARGRGGSPMETGERAPFILILVLQFSFDRTQPEQRLRPGSLEPSGPLLPPGIVTLPGVGNTAKFLKTHPNWYSQRPVAWLALGPHSYSQLGTALVVSTTTNGLVI

SEQ ID NO: 976082 - protein, 72 aa, Homo sapiens
KEPLGQLRGVLYRLGGVEDITIFESRMAPSVELDSIKVVGGKSSAIITLRSVFGPNLRDRSATVCFSKYMLQ

SEQ ID NO: 976083 - protein, 105 aa, Homo sapiens
DSGRLQRSLTKDSVAVFSVPKPAMSSQKRLTKGLPQDARALRCVHLFATGPRQYDGTFYEFRTYYLKPSNMNAVHGKFLRKTFIFGPLTLNVLDSWSVEFWRQNE

SEQ ID NO: 976084 - protein, 90 aa, Homo sapiens
MGTRFQGLTVVQDCCRLGLPCGYTYCGHGKVCVHLLTPITKVIKARFSGHSGWIDLSVKQHLCLKLQNLAVSALTFCRGSQFFTNSGIAD

SEQ ID NO: 976085 - protein, 108 aa, Homo sapiens
MSTTRNSGEHQTERPRTRARQSRKSKQRARAEEKRPPDEREAGHDHSKTTTEDAATTTDTTPTRSEASREQTERCERTTRDSTQATQTGNRREHEETRHEENPEHRAN

SEQ ID NO: 976086 - protein, 216 aa, Homo sapiens
MCGQGPRQRAVGEEVVRQTGYSAEPHTTAPSSWGTHTNNNKRQERHKERTHKDKLETTPRRRDDEKRKNECKTKSTSDSKDNKEAHEERAQEEKRRALKKRHATEAAEKGKTSDDRARKRRKEKADGREDAKRNTKEETQSERKKRGRMTTERDKTDERRRRERRGTRRSTREGETKKQRARRKERARTRRGEEERGRREKDRREKTEEDESEERQ

SEQ ID NO: 976087 - protein, 185 aa, Homo sapiens
PPPVYPVLTGRGCIHEEINLDQVGTDKTWETPIPSPNAARPLHTHYFPLQAQPMEIDLDGAGQLALTSRSPYSYDLSQSHDLLPGISRGHCVPSAMELYSRLLLGGLGTTASHLLTPFSHSPRHTGPLGWDQGVGMEQRWSINSRVGYVGPGRGNPQNCGVEKAAQDGRHPSELLSPATPIIPAA

SEQ ID NO: 976088 - protein, 112 aa, Homo sapiens
RRSSPRVVGVSCFNSAWTEPGARSPPRPAAHSQHLRSPLHTHPSDCTQGPPTDRSSAAQTPPTTAALSLVAAHDDRSPPSQVPPELHTRTSRRPAINPPDHPGRSTPHYVIP

SEQ ID NO: 976089 - protein, 131 aa, Homo sapiens
MVSFRETSQSCFLLSLQNCESVKPLFFINYPAPAVLYSSVKRYKYTTTLNQMTKIPVQAIESKIRILYACMFNTVISYKRTQKPFNPSYAVGFFLRHFLKLHRCIFTYVHVCFRNKLFAKKSQKRPSIGPL

SEQ ID NO: 976090 - protein, 176 aa, Homo sapiens
MKWEKECERRVAAKQLEMQNKLWVKDEKLKQLKAIGLLDTYNMWKPGESLSGEARIVEEVSHIDRICPLNFILLPLLFSTLIENAPPIRLRHRRSRSAGDRWVDHKPASNMQTETVMQPHVPHAITVSVANEKALAKCEKYMLTHQELASDGEIETKLIKGDIYKTKGWWTICSVY

SEQ ID NO: 976091 - protein, 110 aa, Homo sapiens
GRDGADGDWQDFYEFQEPARSLLTRRTVTRAPSLGEGGPWAVGVAPTFSRPLACSLWRRKLEPVLPPLGIRAPSPRGRRAANTRERSSLQGGPRIVEIALTRLLCEWCCL

SEQ ID NO: 976092 - protein, 111 aa, Homo sapiens
RRGHGTPEGFSSDEVVGPREEWVTVPSWAAENRCFSTPTHYTLHWKCLTDDRLFVLLALSSSSRAPGRSRSPALPAVSPVGPNVKINVLEDFEGENPQVPKVEKSISGTSP

SEQ ID NO: 976093 - protein, 293 aa, Homo sapiens
GQTLSFSASVRAPWCPPGSSYVEGNWNMRLGGTSSLGELIGTREAADKVARTRRSEVSLCGPPHTCTYDRRCRSDNKLDPKDWCGAQNCYKVTNGAFTGEISLAMIKDCGATWVVLGHSERRHVLGSQMSCCGQKVAMLWQRDSEYSLHGEKLDEREAGITEKVVFEQTKVIEINVKDWSKVVLAMSLCGPLVLEDGNQKARKNEKSRMVESNVLMGGSETGLLMGVWDGDLNEVAAVIDGSGVGSLAIGIIGNEHLFYFERLSEPMARCEGGGHRFVPGATIGKVKGKNRRM

SEQ ID NO: 976094 - protein, 92 aa, Homo sapiens
MEGKPPPPPIKYTCIQEPNESDLPYHEMETLKSRETCPMAELCWNPIEKVDIVLYYYSRSSAMPLLQLKWKSEVSDLFSQQLTLFHLQTPEA

SEQ ID NO: 976095 - protein, 558 aa, Homo sapiens
MAVRRVLKTEMSMEWDVFLDVVACYSGTSSTMVGVGFAKPDGHARYLTKLRRTSRALEGPGAVRRTVKTRRLNHKERKRPINGQKKLRLATHTERPTEAEPSKSHGKPLLNLVPVLPKLAHNTRPRGTTRPTGLHLHVGAPHVGTHTPQRGLVFIVCGAPSAPYPLVVYGITLTVPFITWRRHRRGEHFGDQPDTHTRRTDTSGKTLPDLSGAPPWPGNMARLRCTAVMVQAETRKGIPVQTAPRCGLATTSTTLEADDTYGGHTRQRLGPRNTGHTILARAEGLKQTLGGENRATHTGKPSKLRTQPTHPQNKTQLRDNLTYSSLGSAVPRTPNSARPHGQRVPTKGEGDPHGYSTSDWHTLTVGTKHTALTLPHTHWDMTALPQHQGDKGAGHLQAGAASYVLRKNRRFPKKTKPHKRSRLTSCGQHNTWLLQPNTSARCAPNGEHPQGGGAHRDVNRQERIEKSPGHTVAASHRNNLPRVATEQATHYESAAEHTTDEEEEDTINILTVREAARQWNTELTGVPNIARRTNGRTPTMVQTRRNSDGPQRKRSTPH

SEQ ID NO: 976096 - protein, 88 aa, Homo sapiens
FFSRALSGFRIMLVVRDYNSENMGGPEGMDPDGCYPRALEVRIVLITFDEYCIYRSLSFVDLCLRVWGKAFGNSERANYSLVFTGYEW

SEQ ID NO: 976097 - protein, 267 aa, Homo sapiens
RDTARGESKDRSEQKERATARKPNERDEQQKRRQAARRDRTTTARAHTSQAPSAHQEQDSERERQSKAEGNSRHGPAQPEEDQRRNTDTEEEREGENKKTSKTKDGTERGRRRKGRDDKKIDKAKDATTRPASRGQTRRTEEAREEREERSSRSPESEKQQDTSAQRLEPTREQEQEKKEENRRQTSRENEEKNSRSEKERRQTRESPEGVRRSSERHDTQQSISKKHNDSRRDDGEAHKESGDSRRTERAKEKRTREQKSGEEQRR

SEQ ID NO: 976098 - protein, 272 aa, Homo sapiens
MKGARGMAVGYRGEMTNTMECVWDGIIVLGYGMKRRHDEIDMRRELGDVDRQAGRSNRLDTDTLISLAQNRTPQTGGVNWHRSKVNTGYRTEKGLNWKRRGKPVTVGAGKKLDTWSQVQPAIPWWGGKCRTLRHAQHKDSARRASPGLITQRIGPWRGVGQTSSFTPARENSALGQGKRQDTPQPTTSPQWAERIRPPRVRVTHEKTIQGGTTVHRRRRVQPSEKTNKKEGQPSTKVTEEHHDREPRGTGATQHRDVIGGGKPASGKGSGKQ

SEQ ID NO: 976099 - protein, 84 aa, Homo sapiens
GRRSSPESRLGFPASTDAMDVNPGARSPTPGPGLPISQHLLSPLTPHPSELAPNGPRLTVPSALRKTQPHGRTAGHTHYKSAAY

SEQ ID NO: 976100 - protein, 101 aa, Homo sapiens
LVWEPGLGRGRCARVRAGAVRCVPAPCPPCVLPGWGAGGEVTGGHKPLITGPGGYCGGSPAGSPVRARARLPGRLHKPQRVQPRVGPRRRPHQKICALPGE

SEQ ID NO: 976101 - protein, 210 aa, Homo sapiens
MPRCSVELMAVPLCGRLGTWCNTLGEGAYGERSTCCDIRVTERSSRSDRSYDMKRAVRPVQNNYYERDLVSIQLLQSLTHVATHSMVTGANGNIHISIFCAVLEPEETLLAQNRSRHRHAWTRMLTTIFHQLIAQGWYICHGMALTHRGFYSQKNLLVACTGYTSKSKTWVGNQDSGIIIGDVCAPDCVDLPYVLRTSVTQDFCDHRRVP

SEQ ID NO: 976102 - protein, 85 aa, Homo sapiens
MQEEHLSEGAETRLASAVAKGEDAFITRGDALAGRNVGQHQTIGGPRMTGDLSGPVQEHAQEGEGHHQRYTGTVRGKRAKGDMRT

SEQ ID NO: 976103 - protein, 175 aa, Homo sapiens
LLDDSVSRVETQIGKGIMYTRLVAIETMLNTKVQQSGISPATFNNIRATDGHTSRSRTVVEEYLMHSSNKVAVIDAVSLQLRQSSKRNCRALKIYCAISCGEDYQQVNCYITGHIRTNTLKPSMAKINGPHKLHTSNSSDKRHAFRTSTTRPDELESSARATVTYSPFHLVYSFT

SEQ ID NO: 976104 - protein, 180 aa, Homo sapiens
VSTQSGHYGRECAPARAGPRGAPTERGRGEAELQANPFYDRYLDKIQLLLQGQTQLLCESRLEKRSEFRKAASGAFQGKVIFIKCVETRRQMACAGKNKSCEPEDSLGTKTLSSNLSTFEMVKGKNLQKKLKPDCGSNIVQQRDTVYAVIPCRKVGILIVNRGSVLSNISIVLCQGREGH

SEQ ID NO: 976105 - protein, 43 aa, Homo sapiens
MAIPFYVENITAKDTDRRCGWILPIHLGRRHFRNLDDELGQLC

SEQ ID NO: 976106 - protein, 117 aa, Homo sapiens
EGGREATSRARQPASPAPRFVSPQWAASERVGLPSRRTRCADGATANGCGVKTQAAAVCSPSSRSLGGGAHAERRVMECPVMENLLTFLPQGIRELLNQTKGISKTTKCECFSWLHK

SEQ ID NO: 976107 - protein, 166 aa, Homo sapiens
TASVGATTVAVSAAFCWQEEYGSGTAVTTVVVTEIHPLSKENTGKFCELSSPADSGQMCFCNEMPALLPYLPGFGSLVKSVVDIPYRVFFDAGSSGSYESHVGAAPPGYMLIEQCALYDNLMGHPVWYPRRSRGSYALPGYSLGGACHPRLGPVFTEEKAWFIKLA

SEQ ID NO: 976108 - protein, 117 aa, Homo sapiens
MGGEIAISFDGDWPQGGITNIGVRTKISPQTYYHNLYVVSTLGESITVVGNTSAHRLLCPWLRDHARLPWVRVGPTASIKGDNRFNKGDTGQDYSQIPIRHENNVSYERCTEIDDIH

SEQ ID NO: 976109 - protein, 122 aa, Homo sapiens
MDVDFQLMRGTYGHLIRRSSYNLPIDESMWRPRLLRIDHQAQQKLSGPKELTGIVPIPNPCGGCPVHTVLTALTDFTKFNAIILWFPMYLLPLFKRPRCRQIPRPWEGQSSRRLPEEGFNLA

SEQ ID NO: 976110 - protein, 132 aa, Homo sapiens
MCPVTTARGPCEMGMNCCNAHVLERRSNVTKNEDSWNRYGLTVSEYRIVTHYRARAWDPGTTVVAEYIFAVGSEPSNRKIELIDGAEGGAEIEEAVHFSSCCPLLLSQILMSVCVNAVGQMALIVESRSLWE

SEQ ID NO: 976111 - protein, 205 aa, Homo sapiens
MSEEKPKEGVKTENDHINLKVAGQDGPGAVQDQEAHAVSKLMKAYCERQGLSMRQIRSGSDGQPINGNGHSSTAEMEDEDTIDVSSSDGRVCRKSHAGRAKVLEGRPSRPGHPRIVVKVSHVTCRNHKGVCGKLEDIHQMISSLDVFSATHNYICRDDLYLIGHSDVSCHGKCVEIWGHLGPFVFPLEIFNQFADGDYRRMTEWP

SEQ ID NO: 976112 - protein, 153 aa, Homo sapiens
ALGSRGAGDGGSRSGAELAAERGGSRSSSDQAPRARGNILAQHWALQGSGLRPEAGIEGIREDLGVVGNKVPGPGGGLFAGARGGGVTGATSNSRGSRVKSGSSRGVHEHVAAQLWGHNVCLGGGRALLLAGFFRLRKGLSWRSAAKIGLSGG

SEQ ID NO: 976113 - protein, 110 aa, Homo sapiens
GGGKRKGKLEKKTKMKKGKKMETEDENGKRDEQDEECKENRRLEQKVNDGKGTVDEDVETENGEDLTKRKTDRKEHGDLEQRRLDLMCDNTTDLTGWQMTERSLEKRKKI

SEQ ID NO: 976114 - protein, 33 aa, Homo sapiens
ENNKPTKDYRKQTVCLCRRGSAKTSAGARSEEA

SEQ ID NO: 976115 - protein, 81 aa, Homo sapiens
SDPTKQHYAIYAHETPNGGGDPFYTNTYLIGSVTLKLIFLSYQASEESPICNVTTPEKKEPLWIHRYGLSYDINGFLGLIV

SEQ ID NO: 976116 - protein, 107 aa, Homo sapiens
MSYSATFQLLEELPICQHSILRNVELALRPTIFFSHNTCLMASTLRPVLSSPIHVNLCSIPKCVEMMRKFDRVEVRNNERNRTVNCVKAKYKVSVSKEKWQGFRTAK

SEQ ID NO: 976117 - protein, 429 aa, Homo sapiens
LPWCDSVLRGCLVEQRHLISVRLHLLPKCVPAPDEKIRWTWTMSPTEAPELSLTDGELKGDKRLITYKVGKLTDNMRHQLTTFTETGYKDREDWMQKGLHVGPHLVRKPDGTRDTYTQTGQFHLTTGNTLAKHCCNNCSWYQATAGIPRCEEAIVGDITPTPPPGWGSFNRYLQKMVEITRWAKVGTSHPTLGDRPPIPVNTCWAGPSIASQLPGNALGHTQAASDRRLALYTHQPVNNSEDSFPGDINAPGSTYGPHHRETAEHEQQHNKAISHDRENPHTRSNDTSLAWALAVAHRTSRCESNVNLLLHTQAHSQRDLHNAHCHLTSAAEPCTSGQRTDTRATLFKLTTGRAKRRQSTHPVDQGSKTPPTAPRKTVHTELSNTTRPRRTGTSHSSDKQFDDTQQAATGGQEPHPSNATRADASNSTM

SEQ ID NO: 976118 - protein, 141 aa, Homo sapiens
MSSHELGTYSRRDVPFLVLRTRGVVKTNPKFGAVVNIECWDSNSVMHPIKGSKNHYADDVGTWTAGPMMEQTWVKSRKQGACGTPHAGFGSAATDQAGSQRGPCTVVQGGMCPARHDTAGHTGWTDVTGFLHKRVIVRPDA

SEQ ID NO: 976119 - protein, 175 aa, Homo sapiens
MGDGNGEAPGKGTTVHPRGRYHPSKRHTTGRGYNVWAVKRKDTCAVGPAGSNNGGFRYTHGGHVATPPHVGGAQREELTWTGMSDERVTENTVAATREGRPRGEGPAKEIMTNTIVTWRPLNAGTGHRGTIAQGREANRHGVGAAAADSRAWDLEEGQDGRGRPRGNTQPVERPR

SEQ ID NO: 976120 - protein, 215 aa, Homo sapiens
EVLYSLGNRGFNRYFALSVKVVSQALINNMASPWQRQLAERLKGAGYEPVKKDREHVNGRAGTMMQGFGVRFRCLSSTSAQDGIYYEAEGKNSTCRNDDVCRCSLPFCCHQVWFDLSSRWPELSEPIDIKRAAIRELLSVVEPLARKGSWHDIGVGQEVLLKDTCVRPLVINLVENSQRPSGEDTSWQKVGSVSIGWEGTALDMQTEGTQYIKDI

SEQ ID NO: 976121 - protein, 312 aa, Homo sapiens
MESRYQTGVIILNYDRAVEAFAKGGNLTLGGNLTVAVGPLGRNCGRKRALRSSVAVFTYCRVKGTLCRRVFRKGAVDRTGNTDPSRKFCGQDIRAYEIPWEIHRRPVQAEDLMKFLIPFTEHSHDTLQDTEIIAGKAAKGARGSLSAKEYLPKPWSKTTAVILRPVQAGTLALQKQFESTHRSDERCIPLSGSTLGFDFKAGTRLTVHVKKQIPCGWVAGTTSEVNWICPANYGTIIRAIHVSGSIQKFSYWRVLYAVHIAKICGQISGEDGSVEPGTVTVTHWANKRSVNTGRLGEVNIADLAPPSFVYLS

SEQ ID NO: 976122 - protein, 404 aa, Homo sapiens
MPQKPKPETDSTKRKRREEHTRASSGDANTEMKAAMTGTVKPWRHPDYLTRLTAKNGQQHQTREERQQTTAQDSATEHAKRVENNRRKGTQQSTTPRRREEAQTGNRDRETTSDATTNQRAAANTQGREGRTPHTTHPITGARARHNQRRGTPRLAAQTSDRMEPKRQPDNRTDPSANHHKGTNNTHQHACTKTTRGTPTGQKGNTATQDAHRTADQCQHHRHRQTPKDRHDKDTHGTAHQSDACTTKHRTRQTNTQGTPTQHTPPSHTEHAPAPETPSTRHNTTQSRTGTGTRGPNSETHRQPSTDNGNKHKNGRGKETNVTQEHSQHETKDTGQQQQQRQAKQPEGPDSTEGTRYNTSRMTTANTDGKGQRRAGKQNHRSEREHYGRAQKSKRERTRASLFS

SEQ ID NO: 976123 - protein, 248 aa, Homo sapiens
MVKPVSELGKMRVGLECTGEFKKGQGDKLILEDMGSGSLQGLKTESAQEGQRGYWLLKSKKHSGSQLERTAGFMNGSECSKKTRVKIRGAHIRLKTVSDTSSLCNTDIFKKWDDGVTQWCPSIMYVGIETTHFGRNEITCFKCGIMHKPMEMKLNGQAYIQDYDGLTPQPKGKQQLTDTTTSTTNTDDKTTLVDDGPRSDSNTTSGGRPQRRNKGRGPSHRNTRRSTQKPGGVLTEQNKNKSERNNPG

SEQ ID NO: 976124 - protein, 149 aa, Homo sapiens
GFPGEATPGASAGVGEEEEEEEVMATRPGAGEMLRLSSDATQVAVTLPGDIPGLGAPMIDARSAVKLKASMAWDLGQQGQPTRTHRNTNSARQTQHKNELLKGNLHCAQHIPTVGSPVVNQMPRTHSYCLSMGAIPKSKEKCQAKIHGQ

SEQ ID NO: 976125 - protein, 240 aa, Homo sapiens
MYERNSSACKFQGSKIDSMRQKVLVNVTNAVGCLNKYRGYRGGDQKLSLEMPQNMILWERCAGNKSVETSEETSFNEMHVTQRVEPSNSPPGTNSGSSFTGQPQGAKRVGFHERKLHSGLITCDWTSGPSNRGSSNERKHHQNIGHVPNVQTKKSILKQCYKFPKTSYVIAELPQKQGKLGKPQNTQEGEIFETQEPQQKFMSIREPSARLTQNGCGPPNIFPQIKAIPSVPGLPANLVH

SEQ ID NO: 976126 - protein, 303 aa, Homo sapiens
MFETFNTPAMYVAIQAVLSLYASGRTTGIVMAAPVTGSPTTVPIYEGYALPHAILRLTCLGRELIDTIMKILTERGTVSPPRPKRENRCVNIKEKLCYVALDFKQEMATVASKLPPLEKSYELLRARSSPWQMSGPLPEAFSQPSFLGMESCGIQKYFNSIMSCDVDFRQRPVRHHSAVVGHHHVTLIVAEGMQQDDSLASGTHEAWRSRIIGPPEAESNPRGIGRSNPWPVVHFQQWCHDSQFEILALHLTGNVSGGNDYFVTLFGTLLANKEWGTWRGGYGDRQQEDWAPHNGGVVLSRNT

SEQ ID NO: 976127 - protein, 57 aa, Homo sapiens
MRTPYTTSKQYWETRRKTLPYNKPGVKGSYRPDVPANVVHTQWYRRAYYGSKNQKRV

SEQ ID NO: 976128 - protein, 305 aa, Homo sapiens
EGVRAGGGRCMDDEEETYRSGKSQDHHAVCHDRAICDPGELTDPGGVQSPIGAKPIEGRRGRQGTITVLLPTRGPPTEPECWVSFQSTPKCGNTRTINVCTCQAQCKARKNITRLLNRGARQGFSPPSGTSRLPLVRIGPRKLHSGSKFRASKEAWLTQTSGTQELGPPETEVVYDQGDGCTRRVARILAPRNTSGPEIQAGGPCGAALGKTRVARGYSSHGPVAGGETSHTACSNQPLKALEAANSDPNPGERPGSKLAQVGVALVSEWPPSSQLESGAATHVEKAQTGSALRGGTNALGSAHS

SEQ ID NO: 976129 - protein, 158 aa, Homo sapiens
MGTSGFAAEVFVVPATKKRINMGDVEERQEDYMMKCSQCHTVASQGGKHTRVGQISMVSLWRKSRSGPWILLHSRHIIEQRHHLGERIHVMELFAESRKKVHPCGTKNDLCRHYEEGRKGRLSSLSQKSYYCVHTCHLPYFITPPEMSHDYFMCTILY

SEQ ID NO: 976130 - protein, 119 aa, Homo sapiens
DAPEEEEEAGGGMVLWWWGLRLARDRRSAGGRLYRACRVVHPRPWDLGSVSPRASCVFIPKVGPGIGARQSRVAPDEGEGTGRPNGRSINEPNLLIGRAYTRRQTIPKGVLDECIKPPG

SEQ ID NO: 976131 - protein, 219 aa, Homo sapiens
HPIHSSSQSSRYDPSRMASVHDTGIEIPRGVHRALVSTTSDIVPHSTLCNAGTHYPNLHRKDIVPCSNLMPANSPIQNVSHARSVDIKPQEELCLRSHNCSSQGMLRKKPTGGARNDGKHVGVPTNLYKKASPSYGIVPWREVLGTFFVVTPRHVCLTALEGSYDRPLTSESSSPIQRSQSTEDALWLGRVLDTDTRGSYYRHGTHSSRQLKPGLHWSI

SEQ ID NO: 976132 - protein, 231 aa, Homo sapiens
MSRYEHMCLYFTFLRCGVVLERYTCAVSSFLNSPHPWMQTRQGYFFTHEHPVQAIDFPHVIRCREEKCTPIDLSIPGPLSQEPQGGPQNKPCGGGPLCLMQVYGGLFALPCGEGTIVPQSYPSPGLYWDPDGPPLHRLVTPGNVHDPYVSRTISTTFWKSQLPQTCNGKNRIFLEHHCTQRITRRIFERANKVEITNEVNLSLELCNNQLHNEGHLTVATDYNPNQGSLAS

SEQ ID NO: 976133 - protein, 35 aa, Homo sapiens
MDIFKRALAITPWSTRVTLRAEHAARYQNLDCLAH

SEQ ID NO: 976134 - protein, 285 aa, Homo sapiens
MTDQQREDITSSAQFALRLLAFRQIHKVLGMDPLPQMSRRFNIHNNRKRKKDSDGVDGFEAAGATQSNKKDYDNFSHKCLVNLQCSQQTDAHLWLFFIHNNVYIYTPLITDFTGFHGRTKFFYDINKIVTVLGIIDMERHPINNNCAPTRAANHARPIFSHYLISFSGCPSFPPLYSVSIHLRACVLLQLFPVFNLAAMLCFQCSGALRPLHLSDPFACLLRTSVCTLPSLIRWDSFTPFLIILQATRSRPVTLPRLVPICAGLPPHRYPASAATCVCHLGCARA

SEQ ID NO: 976135 - protein, 86 aa, Homo sapiens
LFRLSPWKVDVAAESRASQMSAIYNFQSLLTVILLLICTCAIYTILGTQPPWTRNKTGCVGIYRGKRCARNGLTGQESLIVAVVLS

SEQ ID NO: 976136 - protein, 156 aa, Homo sapiens
SSLWPGCRCSCQIRDLVLLEKNLQAAHGVDIQPACLGLHVGRPYYLQLAQLRNLWRTVGYAQEGQRNECPGIFGTAWKRISREFYEAALSWDCWRCFLWFYDGPSYEWYSGKKSSSALFPTHHCIFECSMAAIITLLVSDPVGVLNIRHMSSMDAF

SEQ ID NO: 976137 - protein, 132 aa, Homo sapiens
MNEKLKGNTRATAYKTSVSRKGTLHPGAHRFTCRQPQRKVNEGHARHLTSTLPFGSTQEATSHHAQGQIGGTMRGTETSSVNRIGDGKLSFSELSRNTIPCSLQQTDRPEENAPQQAIVSGILEVALGYDVK

SEQ ID NO: 976138 - protein, 304 aa, Homo sapiens
KQWYQRRGPIRAGVKSGGLFCTAASRVMALVSRPPRCAPCRQERACASTFGTACGTLASVSCVIVSRYQNMSPWPERSPGITLRSYYKMYLNCRSLVKYLFNKSLYEGLNAENHKNTDHCCLPEDEKYHVFAIIINGSVGGPSVVLVIWFILSQCGVFKPKISQLNLESIRKAQLRIRESVEGRELGPANPRGERLSASSGTGDPDPWINLFPSGCIKSAGTAGRTTSEPILGPQGSVLWHSNLVTCVSYLPFWRETHTNCVRSPNLTLGAPDRAVEPSGAPKRAVNGGRHRRHALASTKTKAG

SEQ ID NO: 976139 - protein, 85 aa, Homo sapiens
GFGMATFSGPAGKSCRLIRRKMSSSTKEVAQVRKRINPWKKKEQVIRGVVYVRHPNYTYFEENPRSFHISPSCAICDTVSVLSRM

SEQ ID NO: 976140 - protein, 75 aa, Homo sapiens
RCVGLQEKMAVSTGVKVPRNFRLLEDLEEGQKGVGRRYQLAWAPCKMHEDMTLHKVATGMIMWATHGQIYCNQNI

SEQ ID NO: 976141 - protein, 312 aa, Homo sapiens
AWCDPSCAVVSGAASLISVRLLSYLSAAGTRWKIRWTWTLMPPEAPEHIFSVCELKADKDFNFTGGSLHDTHEHQLSLRTVSSGAWLHEAWSCTCGIQRHMNYEGPVHINVTTGNFLTQLSVQPKRFPLGGASTLPPTKVVLEGLEVWFKGQCIIPWTRTIVAVEEDCRVRKMTEAEGCDLLNVYLARGCPEVVARFPRQQTGKTLSAYCQMMHADDAQALIDAAQLKPEERKLENKPGENQRGYPATLAKVIRGKLNLPAQTKADSQKGNLKPRLWRDQTSAHKALQASNRNRAQTLAATKSHQHGTIEHV

SEQ ID NO: 976142 - protein, 104 aa, Homo sapiens
ASLNRGETKGVGGGDLTVVRISLFSALFVGRFSGNPKVGCGQRAETRDFRKWATTKGGSRLAEEAGPLHVPPVGAGFHSATLKNLREGPAQWTVVGPTWPLCTR

SEQ ID NO: 976143 - protein, 97 aa, Homo sapiens
PVRRPKRLDLTPVHITAMGSQHPLCRPPPAGESKKDDQGRLAVLKREQEEAIAQFPYVGIPGEDSINLVLNVPGGQATISNSSNVNWTCGWLVIPHR

SEQ ID NO: 976144 - protein, 108 aa, Homo sapiens
MGNVKVTSVVRCGNSHLKSATQTVFIFRFWCPRNYQICIEPLLVESREVLWARHLMRTLRTVAELTGVSDIGHLKHGEVQQLDMLSLIHANISHDQSDRGEAGGGRPE

SEQ ID NO: 976145 - protein, 185 aa, Homo sapiens
MTDAMSHGAPQRIADRDETVIIDQLDFAVGTKPPFKSTRCIVRRVNNHFISTTGRRLTPGQDGIEQLAQLSWPSETQFALHIAARGKVILENVPKKGTPLALKSYPKITSLTGEIPVEATEGIAKWGRAHPEASHIGHWTSGGQEPLLLLTTQQKTLDKGTILNARGTPNMVCLGYDSQRLPRTS

SEQ ID NO: 976146 - protein, 117 aa, Homo sapiens
DREQFRWSGSSRSWTILTGFYVLGTSPLSLPPPPDALYSDPPSPGYRHFQRRLVIVVSVVEATYHWDYGSFHSGDVVEEGECPPPPRWNVTPLPKWTCMDFYLLPRLVTNSLGVCRW

SEQ ID NO: 976147 - protein, 102 aa, Homo sapiens
PDVMPSCAVCRSGGSVLLSPSRLLSVPKCVRHPMEDSMDMGHEPPVRRPELSFSVCELGGRPKISHSKVDNDEKMSTSDLSEAAVRRAGAKDEWHIVEAAGD

SEQ ID NO: 976148 - protein, 68 aa, Homo sapiens
MAHLHRQACKQMRATTMHIQGLTQEEYPPGAKDKRGQKLDPCRQLRTTRSNREKTKAKTHAHHARRTV

SEQ ID NO: 976149 - protein, 142 aa, Homo sapiens
MGCHIMDKDIVTYVRIITRVWAGGNMGELNCGFQETTIRTQLPVGDHFAYIARMPRKPVRSRPCSGRRWSRGLSQWNERTILGLLHGYLVFGRCLNPILESSRTQPVAVAHVVQVPVRPLSLLGIIGLRSMTPTVGCEDTIP

SEQ ID NO: 976150 - protein, 115 aa, Homo sapiens
MVYRKQQTRSSRSRRETPGAFWFSYMGIADETRECAHMGFFHIRGCAPRHVMELGGILPTVPNPRAKVSCQRAVYCVLVAQGPLREAAIFGVKEPFTNEGMDLVSRGSEPFGLGS

SEQ ID NO: 976151 - protein, 96 aa, Homo sapiens
DLCRAEDEEETTFRMESNLYQDQSEDKREKKEAKEKEEKRTKDETDSKGRREQLVDLASGGQKSPETMREQRAQSCGQIPCVPLPGSPPEDASSAP

SEQ ID NO: 976152 - protein, 522 aa, Homo sapiens
MAEDRESSSKSNTDRMTDDSKRKIHCLPKKRLNMEKQGRRTRNEACAANMHCTFHKHGLLILTSFELYNFVRCKEVGSSVNDCAAPLHIKELLTTKAVHAFPICLSIWLAREGKKLACLVDRKKWGGKKWGGTDSELYEENKLAKVSAGRNAVNQKCLFFESTVTLHLSHCPLLAICTLRGFTHPQKYNNNNKRLCAPARKIPNTVGGAPGYDGECKHAHGVVPKKRAGTKMCVMHALAQHIQASQQLRVRGTYEGEEGRGKGKRREGRGGGGAASGDAADGRQRQRRRSDARRKRRAHTATDTTKTTNKGRAQRKQGATNEAGMRPRREAERRTRAQETNQEKQREGRRLAADGRETRQRSEKRREKQDRRKETEEQEQHRGERAKARTRKDATRGGSRTQTGNTTDPQAERTRNSTHCRTRQGQQQTRTQEDTPQHDASRTGRPGDDGRRAHKPTADDEHRNRREHQQQHASHNSAGDSQAGSRTPPGRSGGKQADRRHAQGTSAARTSSRATQQHQGAQ

SEQ ID NO: 976153 - protein, 162 aa, Homo sapiens
MLAAQAMWIHDDTQDLGCTHRKDALRIMPAISTRHHSYCVHENLGICARRSGQHNEENLQDPMLYVVSITLGRHAFQADPRVFGTSATQFRVKTNCVRPWYQDEDLFCSDSSGIRQLLIQELDSVILACAGSQQWSALLSEFCCSTDLTGGGRHGRILSAGG

SEQ ID NO: 976154 - protein, 41 aa, Homo sapiens
MLNTIGGGPSDRNGIRVHRNWSTTGVSPQHTRGAGHNQQMR

SEQ ID NO: 976155 - protein, 189 aa, Homo sapiens
ENQKHIYYITGETTAPGSEVSLLVYRLRKHGLEVIYMIEPIDEYCVQQLIGMGGEDFELSVTKRRPGTSMRHEDEKNEAGREIRTKFENLLQIHDRHVGRKNVERGGGVKAMGDISSAVCVTSTYGWKATMDENHESSSPKRQLNNGFTWRQEKHRGDKPVTIPLWRPEGNQAEVRMNDKSVKALVNLA

SEQ ID NO: 976156 - protein, 155 aa, Homo sapiens
MDAIEKAVNWPSSIVDGIRIHSTYLYLAGSMGYQACLHRSSKKPGPRDSLNERPWRTTIGCDLAAWLELEAGRIYIIPARQAQTCWVHIRVQWGTVVPLKMGALLTRPDTRVLGPQCVSRNLMPGDALDIENTPGRQGRESLSTQRASLPYELFL

SEQ ID NO: 976157 - protein, 69 aa, Homo sapiens
FRYCAKMVEEENIRVFVVAAGVELRRAVSLQIKVYLCVSGDLVKVYRHSYRKSVYTILHGHRNLVTESS

SEQ ID NO: 976158 - protein, 160 aa, Homo sapiens
MRPTHRGHYRLWLLEQCNSTVNIPRTHCISPNYIMYTQVIIDDHSLSVSLPSPSKQHSKREAESAKQARRKRKSENKRAERRARGHTEKQTRQSNRKQKQNRKGCENAHDEAETLDKTEQRTTERSSQDEQVSRASTENDREKIINSERESKSGDKLETQ

SEQ ID NO: 976159 - protein, 169 aa, Homo sapiens
MASTIKPYTCTYLLEMHPSKGIILVTHWTNNWPMYSGTLTTKADLKEAPTVWGSTQVLGCTWIYGRDVWAYGKCTKGILFEHSGMILKRNLRVRNENNTIPCYCNFRTWHKRPARKYWANFKTYGGVLTNNVDPPTTRVKRRKTATWTKLEQTRISPQEGCPWPQRNVA

SEQ ID NO: 976160 - protein, 203 aa, Homo sapiens
MEPWPSLDIYTRETGPLENPQPEGTYSDATYNNKLVSYSTGSSSKLLTRTLTPMKVYNITLVKPCSGTRTPWSHHYSQWAHWMPRNHGAHTEHRHDKRNNMTPNRENQLAPQRPQHGTNARHPDTTPTTDASASRHTNDAPTTRPKHAGEKRTDARADQNATPHHDSRESCYVLENIYVTAQTTLTRDHDAPSHSHDPGTQPC

SEQ ID NO: 976161 - protein, 67 aa, Homo sapiens
MPSASRSPPGRARRKRQGERSKRPHSDETTDERQTVAAREETTHNNNQTRDARDKTKSQHEPEAARE

SEQ ID NO: 976162 - protein, 104 aa, Homo sapiens
MSSKMEASVEFLAVSVSILDGQVVKLWYARGGPLNVHQGLYIASCGLDKLIIYHNKGDLIETCNGFVIIPREMSPGGSGASNNFVGKVFIWTRWVTWFQYGTWL

SEQ ID NO: 976163 - protein, 136 aa, Homo sapiens
MRPAYAVALWRYTGVTPRPSGTFYTSDGTCPSTAQPRGRTPYNQPPHPKRTPNIRPPTHRPNQRGHTQTHPSNAAAHRHYNTPQHTGRYNSSQRASTRPTQPTPQLVNENKHPTAARRPPALAPQHPHPHPDRGYS

SEQ ID NO: 976164 - protein, 68 aa, Homo sapiens
HIMASVANDKAAHDSPNAARVTEGGEIAGIARQRGCYTHKQLIYIVAPVYELACGHMRGVVVEIHWIC

SEQ ID NO: 976165 - protein, 66 aa, Homo sapiens
MSQSRKTRYDEGANVMQEGFQQYKGSRKSEVALLVFSSFVISSLLLLSLRPRTSVQRHTIITRQPS

SEQ ID NO: 976166 - protein, 211 aa, Homo sapiens
MTTRDDGLWRCWFTLVRANSVHQRIRPHNGDYSDIVDTPKKRGEPHYKRQRTHTGNASQGLFLPKDYGGLWRIQVPPPRNHTGHKQEGDLHPLSHTALRGVTKKNTLRRAPQQREPGPRDPKLWRPGPKTSFLTATRGETQRRGHPHRCARHSKRRHTPPRCQPRADQLQVGGGLPFKSTGSLLTKSTWPDPGETQQQQAVTKATMYHSTP

SEQ ID NO: 976167 - protein, 109 aa, Homo sapiens
MVAKSAPSYSSCQETTFQRKTAPIDNIIRAVDPDNCVLLGAETDCSPHSQVLNLLWALHYHGSCGHQNKHQGLWLAGGAIPSFISLFGISPIAPPQLAQAGLGPDNIRK

SEQ ID NO: 976168 - protein, 525 aa, Homo sapiens
HVDPECSNQSTTPTDTSARRHGNTHPHDVIQCLNPDAGTRTTLRPRRRTEPATLCYYHTNSNPIAQAKVRLTIQTLPILTIQERALSAKAALLDNRYHTHDSVKIGPLSTTVHDPHCYTQRQLEHCRTMDPMQLQHDTTSLVLTTRNQHRYTSRLPDIQNTSYIRQHPHDHTTHKQPTAAKPQHIASGHQHRTHREQNTRQHEGQTTQLTHTTPTTPAQLHIKTNEQETTTTLTNSTTARRNTHKHDEQQTTESNTARPRSNHTSGTNSTNARLTPQHSAPRYTIPFTHSQPVVNRSTYSTRTENCSSTTTHHSNSRRNTRPTARRTRYTAEEHTNYDNIETDDIERLTYTYTHRYNTHRTREQALNITNETANDRHRLGREYRVATADRETEVLDSSTAYELQSAAPTDNSKRKKPPEPLNTDTYNASAKPSKRSASRGDRGHTARAHAALDRTTDEKRTEQEVQQRSLTNSQTHSREKLATQPKQKHTAASNTLVPQPHTPSTPHTNTLTPQHHITACHNTLN

SEQ ID NO: 976169 - protein, 238 aa, Homo sapiens
MQRNTGQSEKRRTPRKGRRKKRSADEDTRERSETHRQERERRTRRRDKKPEDTEKTKRRDEPDIDNTTRAEQTRRRSTNAEGRPPETGRNEKDDETQREHTKDDVERKAAGRQKSKKTRANTHSRHNRKHRAKADKQERTQNKTEKEEREETEGEEQEERKNKKMSPTRRSGKQKEKTEKKPENRETRRRTTRKKERQRNRKKDNQKRKEGEEERRTTKAENKRKTHRSKRHDRQTTT

SEQ ID NO: 976170 - protein, 95 aa, Homo sapiens
EIGASGTRRKGGKSAGGEARWGNQEETGGGFRKVQAKTPKKKRNRCGAGQIKGHATSQKGGGRHGTEQRAPDSPRAPGCATGDHGWPQTKGNRDS

SEQ ID NO: 976171 - protein, 104 aa, Homo sapiens
MRDPVSSQYSSYSISGGCPSQQLDLSDLEGWVCQITANYKVKDSSMSGNNDPGNATCSKTSENKPWQVNGLLEYKHLQLLESSHCQHPLPSNWTRSKSKNSIYA

SEQ ID NO: 976172 - protein, 155 aa, Homo sapiens
TDYVTHQTEASCSQVNCNLAKGAHKAHPGACTNHDLNVATAQLKIRRLRWASGGPRLRYIMCRSMHCSVSGLCEKDPPSDSAGPLDGTSLKKHLTISNPIFSAYAVKTAARLPRKPYRPSRMLSFRLRKSYMRIQQEGSQLHSVEDSPETNTDGT

SEQ ID NO: 976173 - protein, 108 aa, Homo sapiens
MVKAEWLVYAESCWKHREYRSRFTNEETVSFCWRVMVGVIILYDHVASSGSICKISKIDMTRLSHKFLTDQSSINSCGTGFRTMVSGYRTKTFGVLRLPPSQLNPCGN

SEQ ID NO: 976174 - protein, 339 aa, Homo sapiens
APKGWRWRTLARSLARLKSESLVSRIVQLHMNSNSNESQSEGLVKIQVNQGNFCEQRLQETEGEAKTLRAIISRPLKDLVNMPKPGVLDLINKAKLGRMECPWQACPKEAARQELCGLGCQLTSFMWNPLVTVTAWKQTRKFTVGLKLWVGDLRKIGSTKIMSTGHNTNHAINPEMFMTLLRALRRCQEGGLNHHVVSPGIGVSYTMGTDLDIISPDFPRVLIYEHVTYADRKTGAAKISTQCGDTPRDFYTIEYNEELQDQQLATNQGDLHPRHCICLCYLQFIFLFMSKSDDPAPPEFYRTHTTHYRNTSHPDAPTPIRSPPYPSLIQSTTDSTPRS

SEQ ID NO: 976175 - protein, 154 aa, Homo sapiens
IGAKAGIGELPPADSPLSSRYHVSHARDFPRLRNSDQLRSTPALSMDIKSNTVTDSSGETAFLQVGQCPGRRLWHLPATQARTSNGTPTEDPSGALFLCLFLSPQSFLVLSWAISRLQSLFLLSGCVSSETQTSSPCTNLKAKTSNFFLYHVLA

SEQ ID NO: 976176 - protein, 265 aa, Homo sapiens
MMVLVHKLGCMSVIIKIISKPVLPFILHSGLVIWNLTIISPQVGSDFMQRNSSIYLLKGLGRARNLGPPLGLRLTLTHLGLDIWCTPRVLPQLRRRQRSSAPQVPPRHPWTARGIHSTLLMVFSYQCAFNLFSERCDTATRQRRPTDRVDQHYRRTKTTYARLLLDDTSREKSRRLEKGRVYTQRTTGRNANDSRDRPKSHIQQRRAAARQEKRARDGTERPGKRDHNSATRRTETYEPAAPPTNRRPHTHTSKTNRRQNTATHN

SEQ ID NO: 976177 - protein, 144 aa, Homo sapiens
MRHQPQQQPQPRQHKRQQHSEHQGTEKPQQAAQPRQRQRETTAQRKAPGHAAAPTRGRRPQSRDSTNHENSHRASAAAQPRAARTTTDAPGATNQYTPAQGTEETERDTPNATDERKRQANDADRLGAPDTRGGRDTTTEVYEQ

SEQ ID NO: 976178 - protein, 32 aa, Homo sapiens
MGGKTFEPCDNRCVAGHIIPAGDWNHKGQMWT

SEQ ID NO: 976179 - protein, 279 aa, Homo sapiens
RPLGQDGGGRVGAATARGARAQRSSMWWGARGGCRLAALVPACGTALSAGGQRVVQPGVDSWSGLPGSRVDPWSVVCPSFLASVPAGAPRARFGCAAVRRSGCPPGCAMTCFGEAPGVPTRVRSISRYGYRAHGLVWPARRFFITPGGGLRVWPTGVRGFFAGESGNFPGVTWYQGRTLFNAFSWGKAVPPLCDPLIGTSNTAWQVVAPNRGGSQEAFGFRAECAAPSIGERTRGLLTPKRTGEEGRRGRKIFWFQFSPKGVLTFMGRGLGFYFEEGTP

SEQ ID NO: 976180 - protein, 133 aa, Homo sapiens
WTGLPSPKPCPRKPTASPAAAPLGLGSHDLQGPETLSFPSPPKGPSQRSYPVLSPLTPRCTECKASCLQQLPQFPTCFRRPLVCCSGKGLFMGMFLAGARVGVWSHTLAKFPEDEGLSPLCGDRHSVYDLSSC

SEQ ID NO: 976181 - protein, 257 aa, Homo sapiens
PVETHMSRKVNKLKTKKKRHDINIRPSGTHTHQHNFTHRQEQQETKKTENELPHRARTTRSKRTKTEQKRGERDESRRRQRITRNETGRGNRDREQRRSREGEEMRTKQTSNRAELRNLQYRNMRCIRSTMETGTNSKAVGKTGQKDEADKHKHNTIEEVERGRRQRQYNAAETNHRSIENVQRNEEESTETTREGIREDEASKQLEPPERHNKTATTERERKDTESDSNTGRQYTMVEKAYRTAEVTTESNGDAET

SEQ ID NO: 976182 - protein, 248 aa, Homo sapiens
GLRPTQPVPDGAAGPGLWSWVRRVGPGGDGRSSPPARWAGGWHGGARPALRGPKASACEACAAARFSFPGCRVLCRPIVFGPAGTLSHRRCILPSSCCREGNLVLCRSLAKFRRDFNYPGKKSGFLLQLLRPLFREEFFPPEKQRDPQGLVPQGKGSRGTILCRGLRRLVRGPKKGCLPDSQQEALLLDAGEGFRPLKEWRLRDHKQSAGVNKPRINCGTNISSQAHKFPFSPDLWNGHRHPEDAIIA

SEQ ID NO: 976183 - protein, 111 aa, Homo sapiens
RREPACRSRDPSVRSPRPGTGSAPPQVASIRGVGPGIPPEAAAARASLARGRRRSSAREKGQAGAGAGNEGWEGRKEGERDQGGGYQGRMDKRALRGEDPKSPYKKPKSLS

SEQ ID NO: 976184 - protein, 216 aa, Homo sapiens
MLAPLSTTYVNLCLCGIYGFAFGGSAPILLETLMDLVGTPEVLQAVEMVTMWNAVLSILGATTYKVGLNGHVVADYKYYITVACGVAPKSISGIYRLHWHGASTYRLLRKETMNSNTEQNKGTVHEAETSHSMSAGGKPKHDMFTKRACQKFLPVTAEQDHQHETRDTHGMARRHTSQGPGNPQLGALQRGYHLDGQFPFDPTGILLEQHYSYLGP

SEQ ID NO: 976185 - protein, 367 aa, Homo sapiens
FYLVALLRARWVTSMLYLEPPAKIRPWVLSSMSVVLFKPGTGLILEIWPQLLCRHVISVRYRTGYRFHLRQDPELSSIGTAYWRRPPIIHPSWNILRPDRDSQSIIKKSNQGSHGKPVSTAYVPPYKGHTGWKQHQQRHRTNRGPINHRKQGPASHAPNMGTHGHSSKTKQRTQKDEQFIMDTKQRRSHGTQIPQGTHTHAFTSERQGNTSHGKEMTDPATHTHHGVIRTAINPTVANGYPRPKRTTVQQSTIPMGETRRQRHKGETNTTRNTKERKDDPAGTKRCNHTAPRSTTTTSRRGPQPGEACNTPPTPITKLSTKQQQQPRHTKQPKNKHNQTHSWHHPASTPTTTTLDRQHNKTKQQPPP

SEQ ID NO: 976186 - protein, 449 aa, Homo sapiens
MMIGRRNRGSRFPPWLSASIRSAHPCNDTVNYPPLSTQFHAPYTALTSRGKPQWSISMIPIHPSGQGAQVAITAPAHIPGAPHHSAHTPCTKHTTGHGHLYVIWDSSTLNIKDRLRQATTLGIWGTCIFMQFPMAFNVKRHKIANRKPIALGTAPVDPRYIAEQEHTATLQQNNANAHHGTTAQEQQAMDTTNVQREEPSATKGPTWSGSAWEQQDAPTREAQQGVAWTKKALDHAMVGPNNGRALKEPETAHHMKHTHTNTHHDTWPTQQQHTEHNTSHSRKTNNDTDRTQEAHNEEKRMNRETKREETDKGAQREEKRRTMTHTQRVTQEKQRETTTTRIREKRTQQKTTPVRKTKRESRDKQKEEQNRRGHTTENLPQREHTTKNNKQSKRQTHEEEEEERKTNTKKTAKDTKKTRNKTRGKQKKKRGTEPNTKETTKKTTTKEAK

SEQ ID NO: 976187 - protein, 35 aa, Homo sapiens
NQNHHHTNNHPKNHAYVLWALLLTEDERRSRERGS

SEQ ID NO: 976188 - protein, 346 aa, Homo sapiens
AISRSPDILADAVGWGPSRSYTARNDGGRKRQTNTHVLESINSRLQLDTETVRNRYVLEVTKHDSDTTDHDNGNTRQLVITAKQMAQTLTDNLKLEYMLMWAKHWMSITTVAHQSLTLGTAMRHNSLPAVVHTGYHGSKVTLTIHQKHAKNRLVTTVTLNHLTKFHLAHLQPAKHGPYQVNMGIENTTQQKTTKDNTRGGTQSHRHTDNRHNGRDETEPRETEDAHTGHNENQTEKQQKKATQVTANNNNNKKTHGVHNTRMKHNPPESPEHKGKKKQGPKKQRDKKNNKEGTKETREEKEQRTTEAKNKQPTTKRKNTNSTDNHATKKTTTTENTTETQNKKQEK

SEQ ID NO: 976189 - protein, 151 aa, Homo sapiens
MHDIDTKPTYKHLAKKYLSALGSQRFEDLHGGTTTCYTDETDIGRKTNTNVKETAVTKHNNQGIEANRGKNNKTPNCEHGEKEHQWVCNSHPPSVQRKNSHSERTEKTNDPDAGDQPELKERPREQPASRPTGDNDSEQEVREIDEEANNT

SEQ ID NO: 976190 - protein, 84 aa, Homo sapiens
SYGDSVCLRIPRSWSEVGDARFTDAVAETTATSPPQAIVRSVEDELRSVYFEETIARHTFVAYMVTQDGPLLVGKGGSAFKYHN

SEQ ID NO: 976191 - protein, 105 aa, Homo sapiens
MTDRAGVNHIIVQCTGCTEKLLALRRISQSSRHGAITEMSRRFNIHDKGNEEEIVEVELMDLKLRGRKRQSKMYDNFEKVSVNLQMLIKQMPICWLFVIHNKCLD

SEQ ID NO: 976192 - protein, 196 aa, Homo sapiens
MGRAEYGARNGSRHFIHSHFGYREVSLPCMFLAGPCIGGIFLIGNHTSGSCSFAEPMKKIGYRMGCLGQGAFEVPSGVLWAKFSMLPFRRWTLKGYGRVITDYPSRRQLISVSVQLNWSHLTALDCPIGLWTADYIVASTYMGGRPGSGVTAVRETMVRDGAYTEHSKPLTGIVVFPPTKRASGPTWGTLLLTDYQ

SEQ ID NO: 976193 - protein, 314 aa, Homo sapiens
AQFSVFRMWARQCAPKGYYGTTFIELASTTGESISMLSGTGRYVSSSHSGCLPVIPTTSDTIDHSTAWIDASWCPKQGCRLHPWRQSFKQHVSHPRPGTPAQGSPSCKGYMCATSTLDQLARWTFQSQMLPTSLLCPYTSRRNPVVLNCKVRLLFTDLDYSRTNFIPLWLNTTTWSRSRSFWRHVISHDRGPRARVAALTSERAVSFVAISAGRRSRSSFGPYVHFLLFCGQTGKVSYRSWTPSPPLLSVIASSCLTGNLRGNTQSVSHHWEYISDNDSSAVWTRYFKMISLFDSSVVIESDGDRVLHAYTQIM

SEQ ID NO: 976194 - protein, 277 aa, Homo sapiens
MGMQELSGSFNNRSCREKDSTIICRNLQSSDTSVESTEVLPAKAQELRISENQNCQQPTMTGSAKVHPSSSPMSGRSLNLYPDTEGIIQQHILKDVDSSIEQLMVANDGYLQKAKIADGGPRVRNTLVYFLDVLSSRRIEFTKNPKQQALSNMKTGTNQTVWIVWSTHEWARHHSSRKNVFQITTVSGPGVPSNSQIWTFLISARFHAINNALDRLGDGSRVIRKLDFQNPKISQPELLSPTQGFKHEPSQRTYVTRLTVDRETVSEEDTDTGWKVN

SEQ ID NO: 976195 - protein, 66 aa, Homo sapiens
SSIRLAREISVSVNMVIARYLEILVNDECLDARPYRQNALVSSRAVYMIAKNRHILEVRRGEYTGF

SEQ ID NO: 976196 - protein, 31 aa, Homo sapiens
MCNKFRTMYGYTSETSQPLVINIELVGPISG

SEQ ID NO: 976197 - protein, 98 aa, Homo sapiens
GWLMIYAGWARSVLWRLACFESLVSSSYCTYPRGCCAQRLRDGIESPNGTLRTSEAPVTFPEELFLSGCERGSMPSESIITFDYRAVNSMIMMHASYL

SEQ ID NO: 976198 - protein, 294 aa, Homo sapiens
VGQLGSMASVTLSEAEKVYIVHGSRKTSVWMAVLWGTTRCVERERLMWVSQHQWVRQGQACVTQTILVGVEQQKVAGTPKAGKKPNEGLLGVLWGELFTPVATPWKLKGTRTVIDPWATRDPAKDLSYRDILKPKKQAVFRTLKGTLLDLVPSGQPTWLGAPLNCGTWLRGYRGQVWVGTKFGLRLPIYPIGLGTQGLAFFFQSNKGITPTGVRRSRSSADHARGGPAQGTFWTCVARFDPFYGLVFRTTGVGRQLSPVLWVPPCATTGGYPAWWADATPSRREALSVGRWGGR

SEQ ID NO: 976199 - protein, 84 aa, Homo sapiens
NDARVPLGAWCKFDMGFLCDLVVLGVADHGLILTKLKDCSGGTTGAVREARCTSVQSCIERLIAAGPDPDSLFPPYGCKMSFCY

SEQ ID NO: 976200 - protein, 321 aa, Homo sapiens
GERKASGPVPPELRRARPPRMQWAVAGVGWWAALAPWLVASGVLTQVVVALGWGTAGRFVFQRVRSIRASLAARRLRWGLCAQERWPFPLRSGSWTPCAAVCNPQVASRFALSPEEGLASRWAAPVDTLPRDEHWHIGRPTWVHFPVTGHRAATELIMVRVATSGATGLFGVLSLRAKLRGAAHISCGAWQTSLRAFPKSNFVQVDTNRFCTSRGFGNNTGDNPTPKRRVDKCYSYEITPQWCVTEPESETYPQRGPHVRLEARQNPCLVLQTLLGTPKHTTCELWSADHHVARRVTYIPTPTISRQPPLGTISPRSCTTA

SEQ ID NO: 976201 - protein, 84 aa, Homo sapiens
QTLTFSRLAFQRPWWPSRKFFVGGNWNMNGWKAESGGARSGHSGDAAQGGGSARAEVVCGSATNYCTIIRFSPRGRMRSIPEDC

SEQ ID NO: 976202 - protein, 289 aa, Homo sapiens
GNFPERSVRCGGAVITPSAHIRRSFPLLSYIGLHAVPAVADGDRNNYYECFGGQTHMLLRHELREAYGYWAPKYHPDKNPNEGEKFTRFLKLTKFSLMQERDYMTKEENRQLKRVEQVAGLAPPWTSLICFWRRRKDAETNGEVPHVVHQLSVTLEDLYNGAQENWSAKNVICDKCEGQRRYKGSSRVLSQFGRGTGMANKNPSDRTLMVRQFRSVCLECQAMGTGSAKNGCYSAPQTISREQHFDVPLPRLKMPRTSARRPPVAGIYGDRHPRFRNLVTTYVATLLTR

SEQ ID NO: 976203 - protein, 117 aa, Homo sapiens
GRWRLLARPRRSLVIGWCIFGLLLLAIWAFCWIYVRKYQSRRESEVCLHHNSNFFSSNVHLSHQHFYQWIYLGFLHENSKVVHLRTGLMLSVSRQIEDTGIIAVTIVPCVPCDSVPK

SEQ ID NO: 976204 - protein, 285 aa, Homo sapiens
MCGNNIVNPVLALPSVARSAGKGPPVGGDSPVAWDRAQDSRGARALASRHAFLRGGSSRQRPTFFPIIFSGPGFWRPGVNGASGSKTFNTHYFGPAVWDLMTPYRTGLRTNHSSLAGVFHTTKEIPNSARDEHWNITARETYKPPPGAHATNTMSYLTAHGSLRASAHTNRHRLTPIWQFSPFAVSRRQSYISARTSGNSPYNGARRTPLSCLHIFTRALYNQLVGTRNTFDEGLLPAGTTSQAEGWGHVHPRLVRRDHTHLFAQHEVGSHKSRRGGRHNSTQAN

SEQ ID NO: 976205 - protein, 66 aa, Homo sapiens
MQGPSLLKAIIGLFSCLGSYVDIGRYRDVGIALKGNLSGEMSFRGSAHLTGTMKGIGGAMAGLGSR

SEQ ID NO: 976206 - protein, 295 aa, Homo sapiens
DCGAGHGGEPEPGAGQRWQEAYVRVVTEKSPTDWALFTYEWHTAMTIRVVLAQERCGLAREMGGGELRAAGKVMYAFCKIEGPLTLDVPKFVLIKLDSEGVNDVRKGACASHVSSMGSVPEGGPCDHHARGDEDVERCECIMVEGGQALQVPSTAFTRGEWRFQDVGPQAPSGLCVPEEQCASEIHKGLAETLLGHKRRKEEENAVEVDGGAVRPRAGGAGRRERELRSARGERLERWRRPNRVEPQTGRTQCSSARVRRGAAPLVPEGASGPPWGLLRVWPSGVPPRVSRALSL

SEQ ID NO: 976207 - protein, 319 aa, Homo sapiens
LRKVWAEAVHYVSGLKEDYSRLFQGTKGSNEVFLDIMLTYQKMTNTCDLSITPMKGLNEEFFTKKYSAVTVERYSEQMKYGISSEKMQQAMHNELDRKQGIHYAEGGVIDYLEAQIYVYAVLTTPWTLQKEPPMESTVRADCDEKFSENSVAHCESIYSRLENTRILQITPYKLTGTTEMGETFIVHTLCRRQDRVLKAAVAHRAVRGGNENRLLNHPKGEGSAGIKRPETTHALPAKGKTNRAVYKCRTHAAQSWSTLTRGTPRIAWPDSKRHPRWGHPQGKNSRKCRRNRHLGSKATPSATAHSQSGKRRRHKNRSK

SEQ ID NO: 976208 - protein, 73 aa, Homo sapiens
SWEVGAGRSAAVAAWDDGLSAAESGNTVGDNYLCTCIKSYKMWLGMVVHACNPSYLERLRLENHLNPGDGGGM

SEQ ID NO: 976209 - protein, 104 aa, Homo sapiens
MVRSEGLGQSGRRCPAQRLAMQYAHGGPLAQGPRFVFPLRVIRRGVGGRYNAGVNEAQGDPGYSGIEGRKKITLPLKQLYRTRYEHLFLSVFQRSKLLTLRGLH

SEQ ID NO: 976210 - protein, 109 aa, Homo sapiens
MSAVIVTHTPNLQTRPFLLTGLMGIKPTGTHCASYSTCGPCALVTLDYKDTYFPRDKLAHGSIPPPLNKATLLSGQQLVITNTGQVTFNTVTLTPMGQFLKLTRDLYTR

SEQ ID NO: 976211 - protein, 178 aa, Homo sapiens
EHSYDDLRAYTGKLKLLDSCRLMEILLHDSCFGMFIDASKQIQPGGIAEDVVEILSNFEVRAVMIVCLIPKESFEHQNHIASHRSVCGLKYPESSSVKLDLLTKYHMTGINNSSGMVDARSITSVSKMAKFHIAFKRLYFQELRRLHDVHRKIIEGFHSHPEGPNYTTINFSGISNLS

SEQ ID NO: 976212 - protein, 200 aa, Homo sapiens
MTREIPRDPFGCNTATDYIITKSTFRTCYNQKGGLPLASRNTVDRAHKEIHRGTYYTTNMPRTRAPSNSKLCVGQRRESNNNDEHYIVGKTEQQRVNDSSVQKKNIPFCNNRYHYYETALPLCARQKDNVRWPEHNTEQLDPLTRSGATPRKRTQYNAHRIDTAATTECANTHSDARAQPTLTGRTDTNKQRNTVYHQRQ

SEQ ID NO: 976213 - protein, 137 aa, Homo sapiens
ENHPGNPITAVTMNHIVQTLLSCQQRQPPNTRCSRRSRKWLCWGCPKTLSPDVHRDPHPQETSVPDHVVWPLFKHLFMNTCCLGLHSIRYSVKSRDRKMVSDVTGAQAYASTAKCLNIWALDFGHLPGPILLIIIPV

SEQ ID NO: 976214 - protein, 380 aa, Homo sapiens
GRGFWGAKSGNGVCMIFGACCIGPRAKSNTDDNQQPGQAWNLPEVDGDTETVIGANFQSSIQAETYPLIKDKDTDQTYYRMPLKRFETGDLQDATWDTNTTTRRRAAKKRPTYGDRPNPETINNLTLSVVKNRPRLRPDFLCRPTLDCKIDPPKQMMAPTATIIGEKGNSCTALTAFPGTGSSCATNLGTPTSNHKDTELERRQCPRTRTHGTKNTPGPQRSRGIPRSGDTTISMEAGNTRFRPVKYCTLGRPDAKALQGAKTVHTGYKQTGVWHIDRQRYRPRQAKGGPQHPVGSTGPSDSDAHHTNEWGLQIPTPGAPGTYSHRTAVKGGATNSSTHSDKQHKAQPTQKDDGYKREEGNKQHHTNIADTDNRSHGYHR

SEQ ID NO: 976215 - protein, 136 aa, Homo sapiens
MYKRADLEERGRMDFQVSLIPDTWCSVMCNEGDGFRACRVTSLNGPGYTRIVNMRQRRCKSPGTVAESYRCVVLKTSLTGEWHLGLMGTKFQLSTRQVLASDVRSDSNRVNHLSLSMDWWLTHVLQPQLGTSWSRT

SEQ ID NO: 976216 - protein, 235 aa, Homo sapiens
GTELRSWDFSIERLFLQSLDLRLGVLDLKALRRDSARNVADAEEHSGVIAYIKSVRCDIPRDNSNPGDLAKNKLSRTPVTTPPNEVLSPTWYQGQQVKVTDISTTFPTLQSEAIQLGPRDSNTSMWHGVWRQHAELSGQGRPGSQNGTGSTLATPYFPKSRPEHNQTNLTQKVRAIGPIALFSPHYCVSHLHSSLGQVRPFGSPHVRNKQYANPCIPLTQQEHLPVSTKWGWREK

SEQ ID NO: 976217 - protein, 254 aa, Homo sapiens
MGQDFSASAQEEIIVETWLQNIVQWTRGYVKSPGYYSAVIHSENFRHGCDVGSTHRKWLTTLDEIYGGRVSGQHSDENDGRYGRFNKIAVKRVHGQFFNKFTDRGISLMFKKQRVPFNVGHGRITGRENNRAHRVAESSTRTTMTAHIRALLARKQCNNLGWDPWTGGKWARNNSGFGIRLEAFGGTRFWGKIPEDYGGRVVHTWKATYWIGARGPPGPQGWVAVSEHAGGDVKLVQVGHGGICNRLGLIERDW

SEQ ID NO: 976218 - protein, 536 aa, Homo sapiens
MTSDAVRVSSCTLKETRAVRHPATTILRARLARLRCRGVLSGLGLYTKHDEILQRSLRISRIDGTRELDDSHFKGLEPTLAHIKQTPFGTGTTALMSWLISFRKEQVTRGAVMFERRHDVFTKFPVTGEISDSQAKKEECSAQTGVKTDESEIRGITTNREQKQGPDRNKGAVERGGEAPQRGESTRHKIGDKHREQTAVDRVQASNGETTETRTAVKSREAAPQKLQCDGTDTKKSDSGHPPTEEEQPSTATHTKTESTSDHERRGDKHGATQATTTEHKERKNEEETEHENERHNTGSTASAERATPSSNISHLTNKEQEEKMTAEQHSNETTTPGKGTTTKTVRTHRRDHYRTERTRIYHDNKNDACRSKKSLHVVCIPQTKLMDCSTRKSLLDNSTTHRISVLTENFQNTENLLSQRVQNDSLTMVLLPKIFSRYERATNEYHEHFEVARRILTSPKYCSKERESQQIRWLETKEMLRQQILSKRQRNGGSTLKTSDIKRNKSKRKNDGTRDQCTMKDDRYQSKHDEQSDDN

SEQ ID NO: 976219 - protein, 75 aa, Homo sapiens
MGIHKVVVGLVVDIWVGYASIKGDNECDFLKGHGGKIKVPLEKGEKGVNRNARVNKRLGMILKRRKLFVNFVYFC

SEQ ID NO: 976220 - protein, 135 aa, Homo sapiens
IEVDGKQVELALWDTAGQEDYDRLMPLSYPDISVPTCPSSWVGDKKDLRNDEQHKAVSLAKMKQEPVKPEEGRDYGKQDWRLWVSLRVSRRRDQSVGERGFGNGYESCLKLDVGRTKSGCLVCVNPCLQATALMR

SEQ ID NO: 976221 - protein, 54 aa, Homo sapiens
MIDLQSRYVKLLKDSTGGEKPLTYALSEKELLAVPVLDTYGGPEQGLSWRKHAV

SEQ ID NO: 976222 - protein, 90 aa, Homo sapiens
AYEVIESCDGGWIEEPVFNSCPLKVTTRSIPRVPINPQCVKIDPAKYRGVASWRGDPKGEFSYQRQLPTVVERAPSAIVVSDRDGADLCD

SEQ ID NO: 976223 - protein, 117 aa, Homo sapiens
MRDEVKYRKCSLFPEPKSPVVHVFDEYKRISQKDIDQSINLKHLVASKMLLLAYSKVALRNHICIFADKLYTSMTGLGTDDNTLIRVMPSRAEMDMWISGHPSRDSMDKSLYSFITG

SEQ ID NO: 976224 - protein, 68 aa, Homo sapiens
ILASALWLRVSDDSQAIIGPEDVGSNSYVAVGMVIAREGAITDDPGVFLLDAADDYKKESRLTCLTGR

SEQ ID NO: 976225 - protein, 190 aa, Homo sapiens
MAIHLGVPERSSDESPLCHRSCMAQRFKYTGVQKLAEFAHIQKYCCPHQITSTPVQDPHTWSSCGTVRALHFNIHVTSKHLGQLAQNLHNSYTLDTSIAFCLRITCLTSQAMQELLDKAPCRTIYEHPRTDTNLDPCNEVTSIQLGRYYSLTLLLLYLNKPLQEYQVDTLTNRAPTINSKNGQQTFAART

SEQ ID NO: 976226 - protein, 113 aa, Homo sapiens
MARSHTITPTTYRGSHPTTLTADTNSYTHRHHPVHRNYYQRITASFLTLISALNNMGSTSTYKTQTRKQTQNAISFPTHNTSIQPPTKQYYSVDKPPEERTTYDWRIHNNILH

SEQ ID NO: 976227 - protein, 82 aa, Homo sapiens
GSGEIIAHCSLYLLGSGDPPTSVSRVAGTTVATDVFNSKNLAVQGNNKKIFGRNKWCGSKNSQFGPNPNPCKGKGTGTNQKG

SEQ ID NO: 976228 - protein, 112 aa, Homo sapiens
RQIVEWRRRVKSWSAWRSTHPSETTDLSGSQPAKDPVRKYYAVDIMSGNVGIHREIKSSGRDEGRGKGFFKGYGGVRDIDLKRRLWYGGMRGSRGMQDDAVYELDEEIEFCR

SEQ ID NO: 976229 - protein, 139 aa, Homo sapiens
MNDTVTIRTRKFMTKRLLQRKQMVIDVLHPGKATVPKTEIREKLAKLYKDTPDVILVIWHSELIWVRGHANWLGPCIPCIPLASMQSTHMNANIALGKDMALRIEKDQSTTRTATERAHRKDTELAATSRADLPNGPHA

SEQ ID NO: 976230 - protein, 286 aa, Homo sapiens
APGRKPLSGAGVGLTQVQLTWVNPRIMRILVTGGSGLQANAIQKVCSSMELTSWRGLVWSPLKRPISRIQQDRRLFERSTQHVIILLHGGGPVPGYQHTLVTSGGNTGAHERQGLALGLWRWAPAGWCLPVHCIFPDKMTYPIDETMINMAPKKAIGVLVCKRIAEVQDTGLLSSKYGGTFTRVYSQTNVFAAPTKHFHHQRIGQWWLGSSQVAPWQDKAGRPWGWGQGIRGGGKYSWTGQAYQGAGGNRGEAPSSGEEKRLHKETTERGQSTGSLVKHAWVENHT

SEQ ID NO: 976231 - protein, 153 aa, Homo sapiens
SSGINAEGPLRPGGNTVRLWFGSARRGSWLSLQASTVFHLGVRTRACALQFGSRNGGTTWAFTVDACVHSASENSPKHCVTRWACQAHSPWEIHFLHETLLNTHVYPGTWQDIPGVGQLSFTPNFLYLSTGTDIARKHPLELQQSTARLPCTR

SEQ ID NO: 976232 - protein, 118 aa, Homo sapiens
MRREQGTHVAPNNGWSHKKKTPGETREQRAERRESPPHHYKNKRHGGGKPHRERRPSSENNIHPQGCGEHHRKKREHKTRGERSKKQKKGKSGPKGQTQPKSTTQHMNTARSISWGGH

SEQ ID NO: 976233 - protein, 316 aa, Homo sapiens
GRAREVPLVGGGGFLVREEKRDAHSAPGPARGGGGAGSRRAGVLEGHVSLAAPGEDGSTQRTTPWAETPRARSLPRGPCPFPLMLLLGALALGSPPRGASAPTCLDWGPQDQGAAFKGGNTTSPNYGRLGGAPPSGNNHGHMIAQSTMWEVQWHWKTGAIVGNDAAADNPRVETELGESGQRGDQSLGMGTPRGPKARQGDHKHSTRVNPSGHGGGLREQWPLSTSTKDRGAGLREAAKIVLRGQERVAPAELGVDPQRPVGQERRGGQTPIIQQQVDQSQSEILAHTDGGRGGAPYRHLNWGRGKRQRTDEQSAR

SEQ ID NO: 976234 - protein, 292 aa, Homo sapiens
RPVCSRRKLLQGQKPGVERCLCETGCSFTFSRLSPESSALQCLTPLYPFGHRTGRLIASSETCYTKTYIGSHQTGFQELTETWCAQQHTGDFWPHSHHNLGIPVSAHCKALHNCGNTGLSTSKPHRTSQGTLRAHRTQHLPCTPHGQWALSSQQCTLGGTTTQEGTTSPYSLTTARTFYSYIGQGSNGQDEGTTMVGIMANFSLTHGCTCPRTFPGLLPAYFNEPRDRILGATLNLVTKTTNHPFVRHLTNISGNACNWWSQHGTLSLWVDRARCVFQTLIFPQKYAKWLTS

SEQ ID NO: 976235 - protein, 83 aa, Homo sapiens
GCFGVQEMMAVSSRSEEFLVKLALVVRNFDRNVTAQSEKCDGSQISVGPLEDALKIDTYNGVTGMLDGPARTTYENRIYSPEM

SEQ ID NO: 976236 - protein, 318 aa, Homo sapiens
GDGVTIIVPIYEGYALPHAILRLDLVGRGPDWLTHEDPPPRRGYGSPPRLSGKSCCDNSMENGCDIVAPGTFDARDWPRCASSLLPVEKGVYELAVRARSLTIWAMQRFRCPEATSSQPFPFRGGIGGFLWASTKSYSFHAPSVNCCAVLHPPAKDVYAPTTVAGLAGTTYCTLGIAERGYGQTWRSRPWTQNNMKTHRSFVLHERMSPGGLGRHQCGPRWSTSSRMCISRQEYGEAGPSIVTASGLQRTKTSVGHPLAKPTGRNQRQRGPWDMAADAQAQGHTDGGDTWGNQKGAEGSGYATERERQRLEAHRTRKN

SEQ ID NO: 976237 - protein, 268 aa, Homo sapiens
QGLSSLNSQDSSMEMSKLTDKVQAEYRDAYREYICSDVPVEKGAPGSTTISGRSSPHSKIVTWCQKFIQGARNVIRKPESNEKGKDSEPKPDDEEESPCLMKRGDVSMYVIIRGFQQRVLPPWILSGEEDETIEISQAVGFSQARNLPKGSSLLPDRIDSLRDSGVRYQKLPSDEELNLAQKHVRYTLPLSKMHKTEKRKGTLRAECPKSPETGEETDKKLNRAKEHNSGGAPGKQGPRVTKGDHGKLPNNFCQGRAENPTCNGTLNR

SEQ ID NO: 976238 - protein, 461 aa, Homo sapiens
MGTCARLHRTLLWWELAILCLAAKYFGCYFPQWGHQSMPPKTPTSSRLRGDHYTGHRKDAWALARSLLCQHYSSSNRRTANTRLALALDATPDRPLTTTCCPHDRHRWPATPQPPHTRYITATLASHNSSNTAHAEPLAPHPRRSHAPRPHPKRHTYTPPTGTHPSLLGTYTPTATPTRRPPTHLSAHTPPARAPTTPHNLGLSRPTTWAPDRSPVEPPNSHHPRGPPATRYNTGQEPPTPSKPHNRATPAPPHPPDQPQTTAHTSHGEHRTATPPTAPDPTRQRTPNQHRPILTPRAKHPTHTHTPHHLSAEHKPTHKKSSRQRLTHIHNTRPTNIWRTPTAPTRTHERPPHNTTLHHHNRTTGGPPHTHAGLTKTTPTPSAAHAPRQRHRERQDQDRLVNRTSRTTRTNTTQSSDTTTTHFSHRTHRHQKTFSSPWSLIYLLPPPDRPTEERTTQTDRE

SEQ ID NO: 976239 - protein, 159 aa, Homo sapiens
MSNIRPHNQKVETLNQYKHGKAADDDRSQQNSTQLNGQEWTTQQGAEYKATTTENERETPTPTHKDTNRQNKQSTQYKTQHTRYGAHQRNDYREQADTTSHNSTTPQPREQKTSERWHNKHKKMSEKTHSTHKSHRHDSSNEAANRHQQGEQKKQTHSN

SEQ ID NO: 976240 - protein, 147 aa, Homo sapiens
TRATTTPRGTQNTARESEPWTNADRTIRRLGAMETQNEKEFKTQIINKMAHARGKHDRLWHATNNPRDRASHQAGPQHRRDTPYNKHKSTFQQTDSHAKIKPKSKPCPARPTWANRNTHSAQNIETIEKGQNNKKQWKNIQTTLHHT

SEQ ID NO: 976241 - protein, 69 aa, Homo sapiens
AKLLSCPNGAIIAGLGIRRISRNDEHTKGGRLAKMKQEPVNTCKIGRDMANRIGAFGYMECSAKTESME

SEQ ID NO: 976242 - protein, 289 aa, Homo sapiens
SAPVSTGSVSARSYRRMSGGPGRPRMLAEVRGRRAIVIYVRAAQTVAGVGMPRRWGPGLSGRLDTAIVARAVVYCARAPSCSLRPFQAAGGAPGVGGSLWGCSEVGDVLGVAVRAEFKRRKDAEDTTRGPQSKESGGEAGEDAAKVEPGSRRNLNNGQRGGASPWGSSGKENNRSLGVETQKTRDDSVAKGPTGRRSGAVGGDPSYTEGGDDSGERLLARRGVGHLGVRARIGTKSHRRGMVGTRRVMLARGRSMAASGENIARMENRLRMMSERRIRPWRLFQETVVS

SEQ ID NO: 976243 - protein, 221 aa, Homo sapiens
GRYRRSRRVCLIASNSVMRRNQIQVESTIQTYRPHLRYHSSAMTTLPGTIYLGHLLHNLGTCQATVQNVGSAPILPNQHIEPPKISSGTSFHQTVKRKPSTQPSSHIRYLARPIPTPYPLLCGLTIPAPPMHTDLSDTDVTHYLPAQIRPRTQTSRQQATTQPVPQERSHNNPADARPPAPTTQGHITDTHTCTHTTHTKNPPKTATSTRYPVAPRTDTTA

SEQ ID NO: 976244 - protein, 66 aa, Homo sapiens
QLAEWCLPRWSGRKRRWTNSEYRNQEAESAENQDESELLRVPDGGRNQLCPKRTIPEALLEESSLR

SEQ ID NO: 976245 - protein, 205 aa, Homo sapiens
MAGTALNLILSDIQFRIHDYRISSRNGGLGIITGGWVISPNLMSRLDGSVCEQTSYGLKNIVTFLRRTQWRIDRPARHHRATPKWDRTFLREKTTMKIEVEVTPQVVIGTRRGKLKGNNLGQPVRGNNPMLNSGPHSQTKRPKRGATHEDPTGAVNERPPTRTTGEAQTPTPHRATPTDPKPPRRGTNNSEREQIGKRTYSLDSQ

SEQ ID NO: 976246 - protein, 203 aa, Homo sapiens
QWCSEKTSLHVPTSASLHAEPASAGAPPRRGLRKIHRQSPLNLSLSCSIPCIGLNGRDTTTDQTDSPQDTSPKNNHQDTIKRQRRTVRRTEATHMRNTPPPANTRTLPEQLAEQSAPHRTTPEHHARVHRPTTAQHARDTPPTPRRQHTTGATPHDTRTTPPPPTAPYTPAHAAHASTLDTTRLPAHPVTTTPTATTPARRHT

SEQ ID NO: 976247 - protein, 104 aa, Homo sapiens
MIAPQLPPFEDPVYLNLDTEGKALNPPKLVKPAHGLRPCHNKNGHNDTPNQWPAKKLNICGGPNKMNSQNAEGLQKRPRINHMARTHAPPEAPNTHTTTPTPHR

SEQ ID NO: 976248 - protein, 116 aa, Homo sapiens
SLIISIIPLLFFNQINNNLFSCSPTFSSDRPKNPLLILTYRELLPRHNHGKPERTLIQVNHISRKKLYLSIRNLPTSLLSYNIHRHRSNHILYPLRKHTYPHLGYHHPSEATSQNA

SEQ ID NO: 976249 - protein, 192 aa, Homo sapiens
MGLFMVSYRRYLGKMIGRCKTFRHNPRIALGFRNSCCEILGTEDSTSGRLHRALSYICKFESGLVTILQHDRTPISSGQELPQFSAHPERIHNIQNTNSIYEPAEKTNCDRTHTGGHQAHLATIGHRVKLQEKDPENKTWGQTTQGDNAKKTRKPEQVSDPSITTLRLRRTTGDGQHGTHTPPGTLEVTDPR

SEQ ID NO: 976250 - protein, 293 aa, Homo sapiens
MAVGSSTSPVVTSGQVGALTHEGFQCAAPLVNTHQVNSTFAVQNEKTQMTKIQQRFVCGGPGAISKQSHKEHLGGEGRGDISRLAQDRRYWGFTERGTGGVRKTRRGWLVPPQRGKKKTSAGEKPGGRFLAEQDRDRTWSAPTEAAHERGGANLAQSRSVHWADSVQYTKSCALATRGGLDKTTISRRNFERTRQQVVVAATNDTIDALATTQTHPSTEHCISKQSSPAFQTHTQCTAPAPPRSATHLRHVPHTTLHSNHATAECPSIATFKASTINGQHGNRNRDEDDQTDN

SEQ ID NO: 976251 - protein, 49 aa, Homo sapiens
ACPLSRRAVGCVRVPGDGDMIGARVPDERVAPRLVETRACSGSRGARCN

SEQ ID NO: 976252 - protein, 290 aa, Homo sapiens
MGLQGLIAAQYRGLSVRCSPNHPIPFGQTKPHPMRLSPQNILPGTDPSMFEGDDGSCGVMRATPMCILCEHMRSCGPKFIQRQQPRVVHRGVTASAGVTDIVPPAQYTGVYPTPGPVNGGQQTKKGPTDDMHIGRQVKATTGGLRECSPPRQPGLTGGPNELTWGDTHQGGTAPRQRASNKQEDKTPSYRTGLTSTNGVSLINSQYGVLGQKNGARDGQCDKRDGPLKDPEESPEKNQPGHEREQTADQKREDNEGTARQKSNTRKKATDRARKKRQNTKAGTDPTADTC

SEQ ID NO: 976253 - protein, 113 aa, Homo sapiens
MNAQSPARAAGTTLQHYTHKNGKQAQGEHTEQQGTKSKQHMTDTNEQETPKKAKNQPDKYQNQITHSTRHTRITSKAKNRISEKQSNNKTRTQTDEKDLDDNSHPHSEPHTDI

SEQ ID NO: 976254 - protein, 322 aa, Homo sapiens
AGGALWPPGPAPQRQESHAEVQRRRYGRGARVRAGTRPQGGNPIADPGGPQVDYKVSRKPNPSLIGGFLRHNRRVLTITGQYSSFNEAGSRHTGRAFSPYRKNSSANGEKFIGKGEGILPLYSFILVHKVTLFGERQNSSTRQAWSSIRKVWGSLQINYFGSGFNSHRIEFLAEKESRVPSIGTSQGSGTAGHKVLPIYETRVVPSPGYITKEANPKVHRVDESKRAPKVSWNSTGTVFLFTKPACFQAPPLCEDWGNRDQYSGLAKHVLEEEAGYEKGRLVATEYAGSHTVAGHGDAAIRTAMIVGTSLLEKCALLTAGST

SEQ ID NO: 976255 - protein, 196 aa, Homo sapiens
MAQQYTLSIIYYIKGTPETEHTLTTTLLRQAGYHSYTNVEQQIGTNTLSVQTYQLSFPPHASRNDERANSTRVAEATLQAIPINVLNLTGLRQPLSRPYPALYSLYTQTPYEEQTPRPYDNGTHSLSDDNNVVHNCATATTREHNTGPSGFPPRHFRPTQSSWNTGLQTVSSYRDLQLGNHTQAASYTDTYISIHK

SEQ ID NO: 976256 - protein, 115 aa, Homo sapiens
MPHWSSHVGCVHTTNAPSTLNRTPRPGWRAPNPTLSNPGDNHDRPPTTVDHRRRAHLTIGRHTPSYTRHEDGGRNNYPPPHNPPDRPPPLPNNGAARATPSTCDHTPSTRDHSTS

SEQ ID NO: 976257 - protein, 58 aa, Homo sapiens
DPGELRFVHKLARKRAPYKVDKSSPETQRKMDLIPQQANTIMTRKTRQRTSFFYEEHN

SEQ ID NO: 976258 - protein, 186 aa, Homo sapiens
GRARWLTPVIPALRKAKRQENRLSLGGGGCSEPRSLHCTPGLGDSEIVHLKNISQNKSMSCHPAPMSCYPAPSTAVCISSDFQKPLNYQDEDPDVFPWVKKTNTIIAEIMKKNAVVGRRRYSATAVEELMCLYNTRIRGRGRAAPRKKDIGVALVRQKRGFGLRKGATVGAMKRPPAWEFCFAQMN

SEQ ID NO: 976259 - protein, 321 aa, Homo sapiens
SQPPEATARQQAGAGRVFLNTAALSLLRRHRAAQHPGLNSVPLGTEWKLMHLLHTVFQSSWTHQTDYQNYQQLVEEPLGLLTHSNNLDQDWMQDSPFGHSLTRTKQTPTDTTVHTLTTHAETNDTGLPYTGTMGQITRGKLPLSVTPHALSVPTAKLNTDTRCNTWWDYAHLASRSHLPPLSKAANNYRRTRTQFCATINLGSQRKKRPLRMTPQISSAPRVNLVATQTATPIRHLGTAHSPWRQLTQGKFSHSRQYAQPRPYTTKYNGAKQTHTTRHDQCLRIGGIYYPVESPYEDQTFTTNLSRVSTPTHKTHTLYSTN

SEQ ID NO: 976260 - protein, 608 aa, Homo sapiens
MNHIVQTFSPVNSGQPPNYEMLKELSRKWTMLKGDPQNLASHDVHALIHIRRRDLRCTDHVVWSLLQQPLHEHLSAMGIHSIRVFREDLEEQEDWLSDDESRAQDYALQRSNAMTQSGTMNFGPSSVTYCCRHHTSQADWSSVPSDEIRRHHEATELCRDLNSTYSILHYSACPTRQEPLDYGNVCQLLNLQFLDLSSASLISLILTAYKDNKGLVCNKNDNISAHRRAKHRRAQDTRYTEAKVIKSRAHKWLGELADEKSNQPHPSHDRPAQATTEAGQKRERRQQTSRQAATTKAERTAAKPQKTEKHSKEQTTRTKTKQTQTKAKNDKRKQTDRQTRTRTNERERGKGRERERKQQTQTDTRRRDKRESRDSGRKEKRKDKQGKDSTHKPSEEKEQQKQNREQRDEKEPAEKDTARTSQARRSRHTRKRTTQEPERENRERRADKQSRSEEANEKGDTRRQREQDEADHEAREAQEKTRRERRRGARSQRERRRADQQTKQRQPTKPANERERGTREDGRRGKERKEKQRKRPQHDKKKRADRARPRQDTGARTPQQREKGRESDRTGGATNEKQKAREEGEEAEKDETEAEDEDKDRDEDEERR

SEQ ID NO: 976261 - protein, 199 aa, Homo sapiens
MNKDRRPDTKNKKKNNNAQNKQKKSNKKHKVEDRKQTTMEKKQNMTSKKTRRIKKKKRNRARQKKEQKEEQEKRKNKRKRTRNRTKQQTERARKNRNKKKQKQNKKDEKEKEQENPEEKNTTEDQTRNRHKKHPQKQTKEHKTPNNATERKRTRSRKRQRNRTKRRNKKNKKTKRRQQKDEQKRSKNKTNEQRENNTTH

SEQ ID NO: 976262 - protein, 346 aa, Homo sapiens
MCQNYNDTCSNTEYQHNYRDTLFPKEVPSLPRTLLSNTRNPRTNAHANTATTIIERTKNQEYHLKTNNTHIRKATSQQHTLTIRLKTKRIRTTTKKHPYTEHQRRTRHRQSRHQRRRRSSHSEHPHHIIAAPPTNPNQRSTSKRTETTQHHKQGQKSKETKPKQTSSSKNTTKTKHTPTHRLKRRRRKETAMEREIGSKTRQGRQARRHRGKRRKRQPNSNQSATERPDAPRRRTEAEDNETDDTHSQRRQRERREEAESEPKCPRQTNDHRHGHHRHTTRTDTRDNGRANTNEAPRQQENEQEDNKETREDKKHERQTKRKDRDKRRTRHRERREKRKTKEDRNE

SEQ ID NO: 976263 - protein, 230 aa, Homo sapiens
GGWICVLRAIAICYYVSNEELRGKSPEAAAQGGAWVSFAEFRIYVPPTAQDTWVFPQALVHHATKKKGPLRLQRRKVRRNPGGCWYCLTKKRRGLFWLGESELTLADTYSMSAPLFVALYSRFQKPSFRQPFTNYQHAVPHLINPDPVPGCWGTRTVCQDGPVDVTRWRDQLKENTEEEGSAREQPSDGEKRLAALTGMEYRGLTRRLVSRRGKPNRHLVARVEQKSKRA

SEQ ID NO: 976264 - protein, 527 aa, Homo sapiens
MCQGSKKDYFKKFLYEPWPVESHLDHCMHDHLLMLRSSPRPIEKQAGCCGLPHLGPFCTRRMTENLADELATCRVFPIVTCRTTCQSGWSMTLSDLEQSNVHQYARTMHGDVAPPDTVVHDRRRYYYINYTTIGALQHVLNAKTKVRGACPRSSPMQQRYENSSHPATMKDIVPGQLAQEASPNRRNKPKVKDPAVWTHLSWGVPWPACVTGIAPKGDTSDAQAHRRGGLHKEETYSNKGKAPVFEQRRSVLLICLFFFPLFSSLSSLCQYTSHSKRTKKYINNTTQIQHTKIQNNHIKDINTHRRQTQITKQATTRERREGRRRVGERRTRAEAQAGNGQRQRDDSRREREHTTETTTTDTARSQTGRTRRTETTEDTKNTRTHTREEQQERGNRTTHGREKQQRKKQTTKRNAARPRQDREQARAEKKHQQDRKTREGQEHAQREETRGGKREGEDSKKQNKDGTSSRERANEDQKQKEQEHEEPREEGARPKRTASTAAGQMEGATDNKTKKRRRTAPTGDQSK

SEQ ID NO: 976265 - protein, 457 aa, Homo sapiens
SVLYWRCKGHCRGSVSSLGLAAAALARARVRQINQYREIPWERDSSSLPDESHAAMLDAHVSSAAHLDENTRDTKEIRGRQRDLWVQCIRRRRTKKLTYGTLPEDVKDNDNTAYLGGHVILGRIICIKASSPLRTCEHLTTYEGINLHDTLELFKYSGKRCCDRTQIPHGHKIGAKHWRQKGYTDEGTTDPEEAHKLETCTPSKQHADITHAEYTRIRKDQKIGQRTAATDGQMRQNNPRCSETYRMRMKRKKKTPHNNVSSKHGRESTYESFQNNNHAQLNHTNKHSLNPIHPHSRKVEEDMSVAVWSSLSPFLFADKKGTKDETRTDRRKTLKADKRGTSSPPTAKTRRNEMTGEKKETSRRGEKRRNRRQRKRREEGKSRRRKQGDRARQGNEERKREKERSRSKRERGKTEEEKSGERGEEEKAKQERGEGERSRQKKTRKRKKEKKEKKRTK

SEQ ID NO: 976266 - protein, 188 aa, Homo sapiens
MKFLLDILLLLPLLIVCSLESFVNAFYSYEENNHITGEIVLIPCELPHGTSRRTDCLMNLLNLKSNAGSLGYKYSTGLDRKQLPNARDLGAKVSYLWWYDCSNREDIYQALHRTADGRNFGRMLGIPEPTCWAQTNTLQILCAYNKTPPDPQRLLTVTWYFATISGTTTGHSFPANGRRNTPCHIAPV

SEQ ID NO: 976267 - protein, 409 aa, Homo sapiens
MIYRGAFPHKRTSRGRRCYATSPGPEIGKKLERDTRTIKAEPVKTQGTQDESGHSSNHLDTPGNHTINNIITSSSFPFSSLSILTTHQHKHKNTTRTPYNNQKTTTKKQTKTPTNYTTSTKQQTNKNKAQTKTQSDKKHNTTKQKQARKEKDKERREAKTRGPLTGNTRSTKKQNRDNTKKTHEKQGRSTEELSEGQNEENGKQERHTETNGSRESRTEPHTEEADNKAAENSSTTRATTDESGTKEAGRRQRPGRREQTRHKKTSNHRQQRVREDKHGEEQRKRRSKEERGRREEDRTRKQRRSGTANEESRKRGDRRHDSSTKDKDTKKRQKPRQDTTGDKGKDGARRPRSETESENKGKRKTKRTEKEKDQVKEKGGTEEDTERQKTPQHTRKHEATKTSKEKREP

SEQ ID NO: 976268 - protein, 418 aa, Homo sapiens
MRRSFHSCPILSGPLPSVLGARADSARVTPALPPHRPPSPNALAQHRPPPWPASFPNSLARAPTMSRSCHTPSGSAALVVWCLFRSVVPPPPPLPPPPPSPPLPPRPARALRALPGRPLRRVRRPRPALAPAPPRSRLPRPPAAARLSRGRRRWPPRAAPPQAASAGSAAPRRTRRLHPRLVRAPAPTAATPGGQLATEARARAATDVHGRAPPSTHVALLPGPGAVGVPWRARPSRCRAGRAADVGRRTRRVVGTRLRARRHGQRRPPRQPPRPAAPAPRPRPPAARRAPDSAPPPPPAPRRPASAPRAHAQRHEPVQRARYYLVPSSHSSHTPVTPPHSSPTHSLTLSSSPPHSRTTRPPPYPSPAPSSSSSPPLPPPLLSLSPISALPQPPPHHHSTLFTLHRPSAPIAHTTLIR

SEQ ID NO: 976269 - protein, 102 aa, Homo sapiens
VDQIDLRWLTVEPEITLTRNPPTTDRARKWNLIRSWLAQNTISVIASPVQNHECGIIVVALEEMIKCIEVWRWLDTCGLYRPKFPNTVDRLSVLCTCHYPVV

SEQ ID NO: 976270 - protein, 145 aa, Homo sapiens
LRRAVVPANRPSGREDKAPAVPTGHSRHCRANDPHDVADVAPVLGALGCLLRVTCPYSVYTYLYRTTLTGPCEAGPSLTQTHDPRWDLTLTGAEDPEERRSGMNDPYVTTPEGRGKTEPGGDGTTEPRGGYLRRRDTGYSLKEPD

SEQ ID NO: 976271 - protein, 230 aa, Homo sapiens
MALSPAQVLRMAILLSYCSILCNYKAIEMPSHQSYGVSWPIPDVHLIWYIQAVFPGHLCELTDLIQSSALEEVGTKEQEQAAQKLISSSEDLALLRMCAAISLVGAVPHVVSHAVHGSLNVYSTEDHLIYPESLAGTYNYHSHAPALTNPPHIATDGGYCPYIVQIPSMHATLPTTQPIPPAHVPQPHTLPCTTSPLRLMGNYYYSAWIMRGPKWYTGTCSLAPHLPGNN

SEQ ID NO: 976272 - protein, 103 aa, Homo sapiens
MAELSKRKAPLLLIPRLEKQEKTVIYSSEVAKPRNSYITGSLYAEADGGLWYVTTDKSKIWPAKTCGLTLQDSDLFDEFWALYKHIQLSQFILHAWHVIYLTY

SEQ ID NO: 976273 - protein, 113 aa, Homo sapiens
RGEAQEGGGESCEAALLTQHYGSKPVERQGAVQKRALSTPVVDKTSASPESSSSSSTDRGKQQVDHGGSSRALNKNSDHSNGSFTLEQLCQEARGLITGLGVLANRLVDIHHD

SEQ ID NO: 976274 - protein, 232 aa, Homo sapiens
MAVQLDGGVSWGRTQNKPLAYIANRVMTADTYSGPAFLLSLRLSADTQAVADAVTYQLLVPTAFELNEPQCSNTAASLLKEMCTIPEDLMGESSSQVDPQEGGQVYLSAYGGYDERQSFAMLRLGELYIYGLMWDATLTEGHAHGRVSAIHANALAVAMERDGPGEEEIGLAAIGEQGKPAGIVETDPNSVHYTADLGSVEKNAVVTLTRPGTNNKAQPVSTTNWGGPENRG

SEQ ID NO: 976275 - protein, 67 aa, Homo sapiens
AHSPEADNPYAKVDVSVATWKKTFHSQQIELRSHATHRIHRMLLAEPCCGSTEEHAMVNTPVRRIYR

SEQ ID NO: 976276 - protein, 152 aa, Homo sapiens
MSHSAVLLTKYRFLLKRVPWSMMVRSLVATCLRVAKWLCARVSTESSCVESSTIVTSHYPAKYLGQEGSVGVWQACVSRRVRAHTAQVYLERVFQTFTVNTLRLYPRKSAGKSLLAESRRDYALMQLLDAQALNYLALINGSAVIYCLHTYP

SEQ ID NO: 976277 - protein, 150 aa, Homo sapiens
GYAAQMWVYEDASSPIMEELSHLFMIMPSIIQLLICLTKSCMPFFRKTILEKNTKLNTSSFKTVMEYRRAVLKYSCPDIIASSLSPPIPRILYITEGGQRSLPYHQINVATNGNCTYEYTDYGGLNLQSYILPPLFLEPGDWDSLTLTIE

SEQ ID NO: 976278 - protein, 159 aa, Homo sapiens
ANRCSQPLRWIPAIACSCIHSPFQDPNNRSRCSQDGDPCLSCIFHLALQRLRRNNKMLLGFLTSPTPIRHLQHTQISQPNEAESASGMQQTTCHLQNSRPATRLPPCHLTTFQVKASIDGDYDAFFEARENNAVYAFYRLAQPTWFKGKPEVQAHARKH

SEQ ID NO: 976279 - protein, 104 aa, Homo sapiens
MGRDVAQQLPFSNDFIVSYSPPQQGPSKQTLKALREPAPSPTKEQNVSPNALLLYTHFSGPQRQALKHALTDASHHALLLTLHTLRIPTRAFTALQQLALPIMP

SEQ ID NO: 976280 - protein, 139 aa, Homo sapiens
MRQASERGSLLVSSVWAKKQGRGLRPTNGDHIEIRQCELHVSQIRRGVILTDGVDHPWMRCDGPIPWGSDVCKTTVWPFCKGVGSLAANRVNRREMAYTAHIVAVTGSRMKVYLQCGGETYEMRRICFATLPLQQRNRN

SEQ ID NO: 976281 - protein, 208 aa, Homo sapiens
MTGFLLPPHSQRDSGIMQQNAEKGTEKKEEPKKLVASCPTSFALSPVCLGASPTTLAFPPVVLTRSQPPMGIPFCPEVCSGVLGVLSFPSGSLISPWPLPGVEGGYPFPGLVHPCGAHPQEFIQEFRFGYQHNTNRSTHNFAGPTCSPLKEGLHKQFVVVAGPRVWLSTTVAIRALKRNCAANNSGVDYSRLKAPGGPTFGTPTRLPG

SEQ ID NO: 976282 - protein, 292 aa, Homo sapiens
WCSAADPALAAGARGRLLGQPPGLGLADSGDAGETSSRWARLCVLNLIAQIDEADEPITTCARPDRFRAQGWRTPVRTPVLGALRTKLLWQILAARGAGLIQRPLVGIGRAAQAAAPVFLPTRKVVVMGCALKPKVLGRLDMWDIRIFGNEETTHKRWLGNPMSTQLMLSSVQPLVSTKACRDTKKSVDDDAASRNQPPRQWRTIIEDSNQTPRGREELNNVDSRWVVAPAITNRAGRGCEPNRCVRGDMLKSIDTLRAADSIEWQLATEKVARETGSLTSDDARQPRVCGT

SEQ ID NO: 976283 - protein, 70 aa, Homo sapiens
DTHLYSAFLEGKRAIPKGLSMAVQLMGKQERSLPLSKENFQLVRLQGVRKEKVENRKRSWLLQGVTQCSP

SEQ ID NO: 976284 - protein, 187 aa, Homo sapiens
MAVSTGVKVPRTFSLVARILTDRDNNGEDDGNSLRLEVIDRMMNAMTPYNGGHGMNYRATKDLSLKTDIYTPDTSRMWTLTVPRRLLRQYRFCRHKINMTPAITLIPGWDGWMPGAYAGVEAKIGNNSYYALKLYFEELKTSNDANCITSCQLPTADQKDETIQQLILSWISNLSYNQQTFYSCQVS

SEQ ID NO: 976285 - protein, 275 aa, Homo sapiens
MATFSGPAWPVPVALIPARQRLSSLHKDALAQVSAQAALSHTRKKDAGNPSFYFLGSNVQIVAAKSKTKDHTFEVKRPHKEIPFAPNKFVTSPQDVWRHLWVETHGVISQCTVVPSMEIVLYTTGVHTWRTNMLRTKGGPILPQLLVIRHSYVASLRCSEHIVCGPKRELELSGHVETSPYSVGHYHNVVTPTCDLVQDVHNTERNPITVGEQRMGIPHFLVKTCCAQQPCCETNTVRLPIVTQPGNTSVYFSSTTAHLWGEQLYIFPTVYKTRP

SEQ ID NO: 976286 - protein, 68 aa, Homo sapiens
SVSRERTTKRVFDMLEPRDAMSYSQRNWVFVTRLLLGSESLTCDGLTKERLTGGKYATWLAEKRVEEE

SEQ ID NO: 976287 - protein, 161 aa, Homo sapiens
MCHVGCRLVSSSKRSQEQMGGPGIRCDMCGGLALLVFHRIIEGLHSQYEPNVSLGNKSTKKSKPVFAPHWEAFHLLNVAANCFNGRGRGPTNNHIWASSVWGRHVHEWGPCQLFTPSVIIYVGTRQIWAPRHNATSYIVTMTHVVGGKLRCHSNTPSCWGT

SEQ ID NO: 976288 - protein, 116 aa, Homo sapiens
HPICGYPGTRISRELNVHIACSAVAISVRSRYVRREPRWIERITNVIYIICSLDAQRQYLGILRREKSPLCLERKSRTFKHLIQVDFLGKRGVLPNVGCYSCVFSSECPKKLPRPE

SEQ ID NO: 976289 - protein, 69 aa, Homo sapiens
TGVTTKKVCDCVTGEYTAEEVNLCLYNSMWPLVGPVPPSDNEGGRSVPNSQVGIGESISRGIRKANRRN

SEQ ID NO: 976290 - protein, 86 aa, Homo sapiens
SFFTILKNRRRGQPSRSGPQLQIGPPPEASFNPGVYSTHGPSKLRDSDISHIDRPSSSGAIPTALTSIIRPSYNTSISLFGFQHTH

SEQ ID NO: 976291 - protein, 73 aa, Homo sapiens
GGGALPSLQGSAGRPAAGERKMNAGSDPVSSSRRRDHHRFLQWCLSCCPVQDLAPLVIKEVLKRATVGPERCV

SEQ ID NO: 976292 - protein, 137 aa, Homo sapiens
MSAANLCVIPAAHSIRAHPGVITAKVAQVAIPIGYKMTWALTSCWRFLYTLCFQPVNSMPYIKHLWVVLVRTYVLYFSTSNPVDLCRVGATELHLGGGGQRCSSIERLHRFLNGQTSLRHHLASGLCPLSEYHESAM

SEQ ID NO: 976293 - protein, 68 aa, Homo sapiens
MTQKSSDLGDTQDTWNKEKKTETTATKTRNETDIQHNSNRKTDKKTTTNTIKTKQNDEQQRDKNKKTH

SEQ ID NO: 976294 - protein, 498 aa, Homo sapiens
KEEQKHRTGSRTQATTSDTWHNELITSEDTSTLHIDEDMTTTSNKTVRQEQRKRSRTTSTMNNTERQYPWNHAHTAATKRSTTPHTITDHRTWKEHIHTEHHHHTQNTTTEDKRCTEGEENERGHRHKTPRAYLDENRRRDENLETTQTTQREIYTLDRKSRIEKKTTTDEVESVQGTVGDDVVGEAETDNAGEGRVRRTEQCKCDEATSEEARGREGTKRHADKREGGGTTHQREPGQKIRMEGHGRGIERLEAIESVSSTRHDRTKARKCKEKARDKTRGAEQKAARQRRMLGRRVREAEAATHRHSKEQRGRTQMAAEQATQTTDERETVESERNERERRSRDERSNELHQDSPQKHRNLCIDKAHKRRAHKITKSDADMTQINRTAEQDSKIDIHNNTTQPKTSRNQTKDNRETMTKHRRVRRDDVHDHKKRHEKLQTNNDEGAQEETKHGLQQTSTSQRQTEQQTTSDASQESDQDEGEHQQPTTEHSITQIV

SEQ ID NO: 976295 - protein, 183 aa, Homo sapiens
AVVGFVMQNVEKALGIWSELLKSYGKVVDLAHSNFGCRISPFYPFRQQLGQLRKLWKLWNQMYDPDTLAQDANGAHAGTDVMLHRATLWFSQGKRVWYVDTLPYYVRHAFKVAMNRAKWLISSSKSGERHLYLKGMERQNLDKNDQEVRNGDGRRILSDTGLTRMMGESVSTVSYGLTDYEVE

SEQ ID NO: 976296 - protein, 114 aa, Homo sapiens
SAKHSRSAGAAPSPLTVSSVRTPVSLPRMPGHPTEVIGYPSAELDKIPARGSQRDAATGHREFRESEVTWTRRYLVISYSSNGCRSSAEGVRLIRTVTASRHLFTKGFPYGGAD

SEQ ID NO: 976297 - protein, 241 aa, Homo sapiens
MATQKKRYTFTNHRKPNETHQLNSAIVQEEPKALTPGPAPQVETQHTSIQTTSYNIGPAGHTNTTHRHSTLPLDMRPTRNTRGTECMTHAQPKPTQSTNTKRAPQGPSRPINTPQTPHGTPPSTALTHKRQTTVPTSEADNEHDTTSARTPHERQTQNPSIGNHRAETAHPTKLHITGNNYTHNHQEKKPRKQHHPNDTTHQHQTQTHTKQTHPQQRTHNRNEHNTTPTHTPTNNNTQHNK

SEQ ID NO: 976298 - protein, 270 aa, Homo sapiens
MTQCQLPNAGRGNLKCKTHTPHSAANLGGALTTHAPPGPPPPYERRQRIQRTTTTWTSIQPHSEIATRKRPPPLKRQTQKTSMPSRRRHVAATTRKARRCNPKNNEPPSNDCKVPSPTPPSTTNAHLSHSCVRETPHSTSPPDPSDPIPRNPHTHCVVTWTTNMQRTGRPQPPRPPLAASTNSPNSPQSTTEVPHVNAATSQPVQSHTKPRHQTQEHLHRDAQPPHKRTSRNTRASHDHDRLHSTTSRPPSLHVTVTPLRPRTPRLDRHK

SEQ ID NO: 976299 - protein, 328 aa, Homo sapiens
SSVGGQGAWGSLHAESPERRKLLPVSGLEEVSSGVLPPGLSPKTPEEPGIASNTESRDHPLHVSRPIVSLRGQAVGLEEGRWEPEYLYGTVLQLPKRGVGAPQGRAGAPQKEESEDKYLADPISAERDPKLVVKTVPDRVVEMEGASKGHFFSPEATLVVHEAAGGRTFSDGGYIPNTALFSQKAGVRSKAGKQEAIHAPDRQARPDSKRHRRAEEAVTPGGLAASTECRPKVERRSSIFNKGLLQPGAPGGPAKSYKRPVPPHKSGGATNGTQGPSPKGAQHRNRRTGDPKDGGTTTGRNDPTELAQQSGGQQRPGEHRRTERARRH

SEQ ID NO: 976300 - protein, 105 aa, Homo sapiens
MEDGRIARNLIMVGAEKVAWGSVKNTVHLRNGSETHTRRSRLENDRGNVRLSVTTQGENRALIGWMGLPVQVQATFKLLGELPICQGIQLLSRWTSSKGPGCFTP

SEQ ID NO: 976301 - protein, 503 aa, Homo sapiens
MAPECTEDGGCCSDVYAPSVGFALTCECHSLGAYSATASPQCLLQCGKKRALTNFHFVVSGFPGARHKLISRHPCNLHCQLNPGWSHPDIATPTFHRGHSRVGPTWGSKVPQSHFKAIRNGNFPKGRATHPFWGGLYSIIINSLCAAFPDPYMSGCSLTPQDTIMGVGRLYRLATQQVFIAANSTKRYVACTPFVLTTGSCHEQRVHPTGWGNLSPTAFARRTLHYDPWLDLHTLNPTPNMEAQRNAWSMWRYRGSAPPNICNLPTFREHTQIRLVISNRPRIHQTLTRIHSTVFQPPVQRTINQCAVIDIGYKTQGRLPMGATNRARPINTEGGSDHIYKYTLCDNAAKTSGERLNHEEAEYMGHSRLNTADKSLPPTILVGRGTRAVKLKKAAITDIGSGTRARIPRATVYGKTHTVCARTHGTSGPPRRTHRCNTTRRELTYNIRNDRTQRYHTDERIHQRQVHLTEAGGDKTPEERLTPRWGDYQQHTDATQQEVKRKT

SEQ ID NO: 976302 - protein, 73 aa, Homo sapiens
MKHSFPIVPQCNSYPRSCVKGSDSVIPEEPITVEEPETRKEAPKEPKKIRDIAIYNFVTESTGVLRTWNPVNL

SEQ ID NO: 976303 - protein, 196 aa, Homo sapiens
MWYDQKARLCLAFISAWTFELFQPFVAMMNMFECYEHFMHKFCYGEENEDTQEEMNISIRNNYYQDVRESMIMCPEGGLLLMAQNNNTLRNVSSVMPYPDGGRSSCTSIGKMLPDIDCPRFELIQLISSPGAGNSYISCFTSKLTYDGKLVYVTRLQVLGQDIGEGKEQRWPLHSSHSLFGGHTDTLLGQESVWRQ

SEQ ID NO: 976304 - protein, 102 aa, Homo sapiens
MSTLLWSRHRRACGRCQFKVLIHIESWNIKYICLSIIMLRQSVLEISVCKEMFVKVSFMFPQSDALLVCCIIPYVVKTRHHYSMNQFYMQTYVCPLEMEVIF

SEQ ID NO: 976305 - protein, 318 aa, Homo sapiens
GRGRRTQLKLFRPHDVPEVSRAFSLLCKMQLLRKNSCAPGVGRRGNRFQTIKGSLVVGVWTKVGYGVVDNSSIWWEESSWLMNFVLCVGLLWKDKGFKGDDLDWILQASGELNFLYRNLKIVWHDNEINPVDPANFYKMVRGPHGRRLRTTKKGKQSASTLWPHGHWVLSSQFIIPSKIRHGTGLDGIILVVGSPTQVHISYGIVTLGPLWCITQKHRVHCTGGCSRGSCKNTGTLVGGKLCHSIPGSCQDGIGGNMAPQGGAGWQGGNVQGSLRMIPTALQYLTTAAAHRRQAKVNQSDHGAKRAGKQRTPPPQEGL

SEQ ID NO: 976306 - protein, 109 aa, Homo sapiens
LLPMHGVHCRAFCYMLRCVTGGTSSSPFGHDIAFDELKDDYKSPIDQCNTLNPLVLPEYLIQASSCVRCFVQQSGYTGLKYAPSCISYLQVYEYDQVMSAPGLYDVEAS

SEQ ID NO: 976307 - protein, 225 aa, Homo sapiens
MQELFNMPDDPKSSENNRDRSFLMTGILKWVTSDYNMASMKRHQNGQDAVLLSPRLSARGTISSHYNSTSGFTAILLPQFPELVGITVKPKESSSNLDNLHHYNCNKSPDEKQQPSQAVTIFCSRHSMESSDWIPPHCVGSCGTRSTGPRMTFQEIKRGKSLPRGTTLPAGTRSHADANFRKRGPPHLSNSQHPATAASWLPKTRAPHKPYAPPAHAQPGTRASS

SEQ ID NO: 976308 - protein, 108 aa, Homo sapiens
MGFPSRCLMGVFCLNIHACKGPKYWYMDLGSYKFTFWMFPGAHSSCQKYKMLRVSACEGSVTGDLQEQAAACNWCTHFEASMDRVMICGRGSPFGYFLPTLDHQKAGV

SEQ ID NO: 976309 - protein, 71 aa, Homo sapiens
AELGGAVKIRRAQSPAQFLRAPEDGGPLSLLTQPWLVGPKKHLKLGGSSKAWMLNKWTGVLLLVHPPSPQS

SEQ ID NO: 976310 - protein, 293 aa, Homo sapiens
GPSPMRRDCVWVGRHSRGSSVHELDMDDGRHSPPYGQKCYCAPRPELPLMMAKEKPPDNCSWRCGGRIAIIVHDILTMWRVGAAAEILKERGAYKIYVSGTQESCLAEVPRLIEESSVTEVVVTNNCSLMRFRSCIAQDKDCGYQLGLLKPFGESTMESPGLPFPKHHVDDYAFTRSRPLVPPERKHAKMQRHEWYRWFLAGEDSKSWSNFSFARIMRRGSHSPERQSMGILNCVMLCITGPKVTGKDGVLKGGGQVLMICARGRAEREGEKGPQLGLLSFFPLSRSYPVITT

SEQ ID NO: 976311 - protein, 115 aa, Homo sapiens
PSTFLCRVPSITVHDSVQVCNGDNAADRKVSCLGQIEGVPVVRARGHVRSSIRSFSLPEELNHASFGKCCLGALYNGWGSELQNRIWLRDGRWKEKELIAVVSVGEEGMSTKEVR

SEQ ID NO: 976312 - protein, 360 aa, Homo sapiens
RRSSPRVVGVSCFNSAWTEPGARSPPRPAAHSQPSVTSITGTLGLAPRPPPPIQRRASHQPADTHDLSLKSAAMTTASTSQVRQELPTRTQEAAINRPRSPGKLYASYRKPGPCLNNFVTGMDVGFGRTFGQILTFSKSHEGRGTHAETPCMQAAAPTPGGPNSTLQDHQATRDRAARQTPALNERQVCLTIGTHTWRTQATYGEPGQKLAKWTKVAPQSGVTSIGRHINLELSQVRGDQRMWGPTVTNGAQRGNRTEIGGAQNISLERAHLDARDNGSKARAQVPPIRGGDTPGPPGRRTAHWGTPKPSKGRATTPHKSLQCETTQINACRKQATQQAVGPREHNKWGAKNEACTHEGH

SEQ ID NO: 976313 - protein, 288 aa, Homo sapiens
LIYLWFATSTPVVLCACPLMSNRRLLEIDYDDLCLFTIIKNERMYSAPYMASIASLDGSSLNGQFLVSIRKHGVQAKSISKLGPRLVKGYASPNCQSLRFETLVGRGTLIGYLNERSSQKEGKRVSPTRPRRENSLRDIKDDSLVLGRPVNFGANEMANGFAYTAPPLGKKAKSCLEGHGSLNHCKWSGFTLPFEGTSSSFLSGGWKYLWHPRKYLNSNMMCDVTFRKNCTQQQVCLGAHILPGFAEGCRRGSLPGPSTLRSEHWPPKEEPGGSGHTARALHRICHKE

SEQ ID NO: 976314 - protein, 94 aa, Homo sapiens
MRERDLDTWSIAWFNAKNPDIKTVRNSHGTCSSEGLVQQERTWRERRTPGQGTLPPGQALEISAGQIVTKRGPHFRTSQVPVGPARWRARFSRV

SEQ ID NO: 976315 - protein, 226 aa, Homo sapiens
APRGPWGARKPGVRDPGPQPSVAAWFAAVCRALVSGMVVAEALGPPRAGEASAAVDASCYLRKLGAQNAANAISKEAQNSRGAGFLRLQTQVAGDLDFAIRNQIWLGRGAGTFPGKYAKGGLGRGARDHPNGGESNRRREDPGASYSGHRARSWWDWPGALRTPTRGHGWRERPRQWGGKKPPGISPRKEPTWPREYQGTKSNPALNKTYRDPRRDGTPARQGGTQ

SEQ ID NO: 976316 - protein, 120 aa, Homo sapiens
MIYERQSIYSNTGNFENVCISQWLPLGALIITAAVVLRLTVWFTGQCNISGQDLVAVEEDAESEDDEEEVVRLLSISESGMPLEVVARFHRTKLNLVADEECWDGDEEDVPSDAADDWFG

SEQ ID NO: 976317 - protein, 271 aa, Homo sapiens
MRHCILFNQTIALGVAAIVIQTTEAYTGAVMLIIATGLILIIFLPSKSKGTNALHSRVIILSQGRSRSIHTNSILDDVLAGLVNAAFTPDYEGYLENLSVHSNQALLIEYHVSYLQDSSYKSQALYSPLILTSNHNGAHSRRDKQGYSPHSEERSLVFIHRIPPLVVVILNPDISTEFASYQNVGHRSVDTVRSGRHRNVLAHICGGPSGSGVARGLRTARRGLPKKRGPPLNSGLGWTHGTASRGENEERELDITRESWTHKEVLACFSG

SEQ ID NO: 976318 - protein, 317 aa, Homo sapiens
MSRLCEKLERSRSVPPHGQILGYYRQIPSRLSTSSRVDEGSESGEVMRWDLEMKEEKNLEVLDGLWKNLIGRNQSGRVRTKEGLMWSRYLTFGQSEVSGDECLPILGVRTMCVDHREGGRKKGVSTKSNVWFLPDPSPTSERPKTGGFQSYLSVLTGRYPAQVSQIAFAVRTNRPCKGGGFPGAQGNEGKRKAQGGPRVGPFGYSRLAPKNFPQSEKGLTVGACEPPGGEIRRSNAGSTLAPSEGLTFERGPGHSLQDIEVLEDEETVGIFLLPSARYKLRNMFAPATSAGSHTETLKIHQACPPWGPSGEPRWSLK

SEQ ID NO: 976319 - protein, 114 aa, Homo sapiens
MPIGVTEQKCVVWNNAGSSPVANVCRGCPPKGRVEMQMEFGRHHGVRIYGRSQREMQVCELDAPLPCAVSTKDRLWLLGMKCAANGKDREGGSVFVETHFRKEHYFLGWRLLEP

SEQ ID NO: 976320 - protein, 178 aa, Homo sapiens
MPSIKWQSLMERYLTVDVEMCQTICDYEDHVGRSGNGMMKADDDPVSSTKCVTWQQYLHKRSSQVVAPTKGMTLAPPEDDETKEKRTDDIPVWDQEFLKGVTKEHFLNSFVVQTYLDIQRLGLMLHARLCANMIKGKNPEEIRKTFKYQKIFTDEEEAQVRKETSAVKRSECCADTVT

SEQ ID NO: 976321 - protein, 43 aa, Homo sapiens
MPRRRLTRSGSSPKPNTCGLLFSHSLRQTLEKKFRTVTLHNSS

SEQ ID NO: 976322 - protein, 298 aa, Homo sapiens
MMDSVLCGCTLELRAYYTHDPHFLSYLSACRHPMEDSMDMDLEPPEAPRTYLFSVVNYQADKDYHFKRWIMMKYEHQSSCKNGSELKRAGANSDELAQELKQQATELHETASSNFTSYHLAKLLATVCNKPTGSPLWRAFEHNTTSGLYALQVVRLTGHVHYQPRQHLRLLSQPRMQHVRPMHTAPGAIVKHSYVSSATRSDPGGWLARLPQQTVTLAAAHHADELLTQQLLNSCCATATDTTHTAPEPTNPPNPTPPQPTNPTHPTHPHPNPPSPTHTPTAPAPTHRPPLAPPPTTT

SEQ ID NO: 976323 - protein, 146 aa, Homo sapiens
MNLPAETCNLCASIYSIDTVGSPCLLPLLTPLPTSGIGLLHNYYSAYNPPAPIAPLLHALSNSAKRRPPRLFALTHASMLPTLARLPLSLVIYSNNLTPHQTLAANTPPPHLWLHIHLHAPASLSPYTTPSLNCVHHNQLPHKTHH

SEQ ID NO: 976324 - protein, 269 aa, Homo sapiens
MPQLYTSSFNPPPLLYPYTPRLWPPQRSTPLFCTTHATLSLSGPRTRCFPDPYSPCPAPLSALPLQLSLPFIGPLWPRPPRSPFHLGLFASAYSRGDSTTLCAPYRVFRPMCNPSSHSLRICSPSPLHAGRVPKPHYAPAWTTPLRPPVPPLPQTSPPSPTDQLPTLPKHFPPPTSRNLLSTRGPFNKTPPNNLASSTASARHTHNALPKNPPPQLTTTDLYVSQLHPLTHSTSCMLTPPSPHHHLLYGHDVPAHCTSSKPSQATDLTS

SEQ ID NO: 976325 - protein, 332 aa, Homo sapiens
MSHYLDLQAEQRQKWMSYRFCGHMVTDDTMSSCPLKPWSAARICANKYMVHTVRAPHDGFHTPRLRLHPFSTLIRITNDVSTCCLARCHSAPTQRTADGRPLPTQPPGPTCLGPRLHTLAPPSITVLSRTHSPAAQPQAPHCLTLTRPLADTGPNASQRSSLAPRHERNSHSLRPPQLSASPPTASHCLHLQLCHDTARSAHKSGSFPRLGCRGSTLHPPFLAPSRTHFAQTSHLSSMGFQHCASPPLSTTPTHSTLPPPAHPPAVLTHHPPPAPSPSHPTPPPPPSLSPTLSTPPPPTHTPPPPHPAPLYIIPHPPPPPHPPTYHPPHTHP

SEQ ID NO: 976326 - protein, 244 aa, Homo sapiens
TSRAELPSMTGTVVSRSLAVILIRQVHPGRMRIRINHNYRPRCRTPTTPPTPPTPSTPTHTPTTPPPHPHHPPPPPTPPPTPHTTPTPRHHPTTTTPHTPPTPLTPPPPHNTPPHPPPPHPPLSNHPNAHTPPPPPTPPPRKHDTTHKPPAPPPAIATPTPTNTPNPPHHPTTQPTTTHRAPSPPYHHHPTPQPPSTKLDQTTHNSTTPHPQHSPPHNTPPTAPPTPTTTTPTPTPTPPTPPTP

SEQ ID NO: 976327 - protein, 264 aa, Homo sapiens
MVAVVAPFALREHGPERRLRAVLKLRTPACTSSHVVSSGGAERRMAGRTQSQSVKSSRPEFDIGKDPVGGGEAVDPQMKIPHKGHLSAPSARRDHCLVFLVVANSGTESFLHRRRLHSDDGGGCWVVRLAPTIQKGDYWAVVEGSVLWPIGSVGREEACTGVGHVLQRSADGCVQSSLSSLAPNFMLIGSAAKTSGKKCTLPQLAKGGPSWVFRATQEAKMDVAPGRCGTKSPLKVISKRSLPFNGPRPGFGIGYWPTLLVWVV

SEQ ID NO: 976328 - protein, 67 aa, Homo sapiens
GCDSCSCAVVLWSSVFYLRRPSLLPKCVPAPDEDSMDMVMMPPEAPRSIFFGGELKADKDYHFKVDK

SEQ ID NO: 976329 - protein, 100 aa, Homo sapiens
ADDVRGGDFGVIPVLCASALEAEFYILRVATLHTVYVRCSTMSDGRHSPGHGGGNAHESATNYLLARSVEPRKDRLKGSTRDYYVCTRSMNNDATELYSS

SEQ ID NO: 976330 - protein, 74 aa, Homo sapiens
KEMGNIISDGDEKSRKKGWSSQWKDGKTLNEELEIIEGMKFDRGYIFSIKFMNDIKGVQHNVQWPGMPYVRGCR

SEQ ID NO: 976331 - protein, 113 aa, Homo sapiens
AELSKETNPVGMRCGADGEPSRADNYGIIFKHVPRTAENFRALCTGEKGLVFKNSIFHRVIPDLVWPRRRYHRNYDGAGGQSIYGDKFEDEDFDVKHTGPGLLSMAKSRPEYQ

SEQ ID NO: 976332 - protein, 81 aa, Homo sapiens
YQMEVRHCLSAYCHQQLVILVSWQRLDLGPVQTPRGMEKRMSDEVRIYSNILGPGSNRYRVGTRDLDVTLHLVTAKLIKCD

SEQ ID NO: 976333 - protein, 218 aa, Homo sapiens
TAGTENSLLPQPWLDRAWSLQVALSPFFFPASPSNSLPSPVPQLTVSGVCTFPMFRGRESAKGRIGTTVPSSLSEVTEKKLMGSIGCGAHQGAGPGISRTPLFLARLERKGYWLIDCTLKAPSETRPETSFSKTYGPKKITGYIPRFTFLGGNVDCHAMDLCCPDSLTYELILHGRHNITDSGRGIGTPDYGANFFKKFSPWNQGYTVSKNIFDVFNN

SEQ ID NO: 976334 - protein, 208 aa, Homo sapiens
GSFLRARLPTTWTAPLSSGGGVLESGAELHVKTDIKTLSRSLCLDRDGTHGTSGTCSIWLKGRIPANKSGPELYTHRGASSTRARTILVLDQQIDQTWKKAKLAMTPWTKPRHIQRPKRPTTNTHTMSYPQTFHANRAEHDRTPINPEADTGKPTIKKNEARHTDSQTSRLTPPIWAHDGLPKRYTPVIPTGLPLGRLLTPLASWTAP

SEQ ID NO: 976335 - protein, 68 aa, Homo sapiens
DLAQGRCGRRLSAGIVRVGVCGSVEGSGGFLSFFFAVQLGTSACPSPHGSEELQKDLEEVKCVAGKGY

SEQ ID NO: 976336 - protein, 84 aa, Homo sapiens
TICQDPRSAEQSAEVAKLAPSELECNHESLDSRLSGCEIHPFPAGLMSDVGLDAICMKCVLGSLCILSPCITLPISRELGGQSK

SEQ ID NO: 976337 - protein, 265 aa, Homo sapiens
NFEANNTVGRSVSRILWETHGAFSSPTLGLYPSVHHRAWAELNSWTRICQEECQRDALSIDSVEDHLCLGARISIAYNVKEPTEKLPFSHHRMIGIGQLAILLGMLDPAEKADQGHACGTGLVCGCRHWFLIGKLKPVYPLTSLPLARNFGVDDSQEIRQSLSQLKADTHKGWQPPADVGRTATSVDCAFATTSLTTGRHQPFSPKKGSSPPNESSHLARTYLRYNPSLKSLEAAGWCCSHSDCRRALVSPAAVPTHSGGTKAKV

SEQ ID NO: 976338 - protein, 183 aa, Homo sapiens
MTNISHSIGRTDPSLTTACTRTFHRHATPETSFAHSNNPACVVVASPIFTKGAYYRVNNIPVTSLDGAHVPESQFGGKHSKAFTLTWNGQSKFPTGALVASVRFSTTQSRSICDSFVGSTEFLHLGTVVYFPMDLVHTNLFFGNALSVWHAQVPTHTVQSGYTVLILRVDTRPWEHPPRLAIT

SEQ ID NO: 976339 - protein, 274 aa, Homo sapiens
GARRRPWGPRLPAPREPPCGDTPGLSEEEEALHKKSNKLKTTTQALLALKNATVAAAQPAQGGVKRSLSEQPVHGHQPPATVAGTTQLVKSGAQSVPSKAETKKLRLQTPVLETPEGHVKGPEKGPVPTFPSRPEAAYLLDELTCNESSRLAPEDTSLVMRTLVSLGDPDFEELRTMMGRKRQRAQGGCDGSPIGKVLTWGNERTVGGCPLPSASPSPEAGSGTVACEGTGQSTEIEADRTGIVRATDGQGPESPRITRNGQAPRVTPDTRTSR

SEQ ID NO: 976340 - protein, 152 aa, Homo sapiens
EINSLMAHTKPVSWSLHTDVHEICCHDLDRGTSLWRSIPHPPALCSVRKIHLMTSGPQTDQPKKHLTISNPGLCYTCRKSGHWAKECLQPGILPKPRPICVGPHRKSDCSTHLAATPRAPGTPAQGSLTDSFPDLLGLAADRLAARLPRKPL

SEQ ID NO: 976341 - protein, 168 aa, Homo sapiens
WHRQCPGEERLTEHIQEEEGSEPPKSRDPRQGSSPCANKGPRSNPQVYMDITDWEQQPAGRIQIAPASDVVPMTAENFLLPCALMKRALGYKGQQLQRIIPSTMCRAGIHKTKWALVGKSIYGKKVDGGNPLILKHTGPEIKIMGKSGPKPMVPSFLDVTRQPVMDAW

SEQ ID NO: 976342 - protein, 345 aa, Homo sapiens
KRCSVSVERRLKQPQADFSKNRSGFILSVPGNYAPRRPGPEPGHTPSPGSQSSCCLRNPCPLETCCEGPLPEEPRTHMERSPYLVYCLGISSSSVLTVHGPCSISQRPGAPPRPLGMTSRTTLNPEATGLVPSARRRMPVHQDQAQSTWTRLSIPDADPATGKRVRDAQNHLRRKPHRHHTLPNDATHPPAPHLQARSGPADPPETLPNPSSRAASTTPGRRRDHHRTAPTHRAHDNTDQAHTLKNKLHTQPAHKPPEARRNRTSPHIPTHTPTHTTQPDTQRADTETKNEETTTKPTRTRTPPQHGNLKPLVDTRGARSTHSTLTLDEQGVKQHAQRQGATPAT

SEQ ID NO: 976343 - protein, 247 aa, Homo sapiens
MCEAAKEVVAALVLREAVRAGGCRPRGGLHSRAGMGHCVSIGSAVAISCDHLIDKDIGVQVCCHSCVLLQDVGGGSWAELGRSERVRNCSSPEFYQDSSSLVRFETVQKLRFVIYDIDNKTPELRADDFLGGAECSLGQMVSSQVLTLPVDDLKPGKPAGAGDHQGLRLQEVNRTNRVVTHGGRRPESLDKKAVLEHSDPFLQYFRRGDGHVAPGVQHLEGHQETLNLNMDASLQSRVTHYWGGTRQ

SEQ ID NO: 976344 - protein, 179 aa, Homo sapiens
MWSPNKERTLWGANRTRKGGRGSSLLTPIFKKKRARGGGPPREGLSLGNQNPPNRRGESPAERAATQGGAISILHTRARARPKTGSAPEKLIQQFKGAPGPGWSPNRTTSRRVTLQQTNLTEQETQHESKHNNKIKNTLSREKNTQTTTTNTPKQTHTTTKQQPTTNTTNTTPTHANTR

SEQ ID NO: 976345 - protein, 108 aa, Homo sapiens
MSGRGEHAGDNKRVHYKRRDTGETRAKGARGKALLPPNIKKRRRPRGGDNRERRFSSRHTQPPRREESTPGEGHHKRRGNTISKAGGAPPDEKRIGLYKNYKPPAAVR

SEQ ID NO: 976346 - protein, 128 aa, Homo sapiens
MAVWGARGAPKVYTEHWGLNGGVPREKTRGQNTGGGFSPKKKAPGGEPQARFETTPTRGEFREALQKGGVSNNNRGCSQAGGAAVLKINRPRVVRLHNTSSHIHPPISPTITNHYLSYAHQLSTPRNL

SEQ ID NO: 976347 - protein, 91 aa, Homo sapiens
DNDSGKWTFTERAQDVMKEPGDTLTQASYRQYNHKPIIESGRDITNDNCHYTRRRQRRALKRNARNPTTRTQETHRGHRHVNSPDCYTLIR

SEQ ID NO: 976348 - protein, 70 aa, Homo sapiens
EYSRITGHVVGLYTIEDHRLQNARRATVLVPVYTSTGGVDIIDDSRIQDSIYVDTRFTVFHGNTECLGAY

SEQ ID NO: 976349 - protein, 137 aa, Homo sapiens
GRARWLTPVIPALREAKRREDSLSPGVRDLPGQYSETPFSPKKKKKNKKNKQLCAAARAPAGPPEKTFLKHQSRWGGAGAPRGGESGTPVGAKKDWCAHQRREHPGANRDKGAGGVLSPPIEKEPPPGRRHTESAVL

SEQ ID NO: 976350 - protein, 174 aa, Homo sapiens
MQKKDQIKDQCELRIVLIDYMWVIMTISQAFQIDLRENSTDNEPDTWLTAEETRGPPNNSREENHTEAHTDKTPPQKHNQTKNQQNSDTQNKEEHRTETKNKNHTDKQNPQGPDPPTSQKTTKQDKEKKAKQTTRDHEAHTTQTNQQHHERTHTNTHSATTADTATTKHQRHKR

SEQ ID NO: 976351 - protein, 153 aa, Homo sapiens
STKEGPETPPRPRDQLPPHPLVPPVLRGRDSSPPPTQSGPLGTRSDDTGDLAPGGSGPGRLVTQATPASPRRTPALRQPVPETRLDRGGPGGPQEAGEGPAMLGPQTMTVGSGARASEGAGMCLLCRRDPKTGHELMGAKAAGGRWGLGQEHP

SEQ ID NO: 976352 - protein, 106 aa, Homo sapiens
MKLLEIRQVVRFDLRSSQELDRKGRYGSISFRTIVGGGKSSDDFMPWVTKCETRNSVNGPQCHGQVHTFMWTEKHFPCSLSIPKRDRTIPLDSEDFKPRETQHDAP

SEQ ID NO: 976353 - protein, 56 aa, Homo sapiens
MVEKTNILNRGGDNKREESAKTEGGRLYIHTDEEKSKKRGAPRIIYNIKAPSRGGG

SEQ ID NO: 976354 - protein, 71 aa, Homo sapiens
PENIPPKEFLFKHPKRTATLSMRNTSVMKKGGIFSAEFLKVFLPSLLLSHLLAIGLGIYIGRRLTTSTSTF

SEQ ID NO: 976355 - protein, 63 aa, Homo sapiens
MTGGPKRTTGGSGHYARGFSPKYKKTPGGTHELGLEPTSEGGPGETKRGPHNKGDQEEGPRYQ

SEQ ID NO: 976356 - protein, 100 aa, Homo sapiens
VTNMADGSTIFLSSKKEMWSGAGTLRGPNYSKTLDARSFNNSAYTISTRYRFGETSWSMSHTLDTRQTTQDANEARSPGHNSTTQSSTGLFPSNKVLKAK

SEQ ID NO: 976357 - protein, 144 aa, Homo sapiens
MSGGRISYIYDTRGESLYTREEEKHLCNNIFSKTIYTTTRAELCGWCLAPTRTRASSRRQTPQAPTHTPPSVLEPTPHHPQSTPPQQRGQSPTQTDPTDRTSTTPSTTHTRGPRPLHTNNSIKTHTLAAKHNQNVEHLKQRQQN

SEQ ID NO: 976358 - protein, 33 aa, Homo sapiens
NSDEHKDIQSCTVEVHFQKIIDKEGDDYEVIPN

SEQ ID NO: 976359 - protein, 166 aa, Homo sapiens
MADMSLLRRVSVYCGGSSVWTGALGTAPRTWGLPHSWLSEGVLRSCSTQLETMGKDYWSSDLRTSSMTGVFRRLIDDSTLHDWDSSSNLHNILVNVFMVKLNQQKVPEGYVARSTGNIISIPYQDGLPVIVYDSGVKRYMNRTRGVLQIEGERGELRVEELEDAKN

SEQ ID NO: 976360 - protein, 329 aa, Homo sapiens
CAGAPTEGLNDHRPGMMSTVLGIDEDPTILKASTPSDDGDPTEHARSVGPLVRNITQRSGIHYEMRGDQNDRKTQGLEQQQMWGETGVRRSMGQTEVLLNTQREEDVGRGTAVYSWTMPPVGNTKLSVIHYAIAGSLQHPIQRDSSLKYAFRKATQEGNFRPMLFMELATKGNGRWTMAATCTSQINQAVGPQFFNSRSQWRPGALLIHQDQSQTYTGQRQVLREPQLDNTCATRLVLRGDDVGHDDDYTMGGPYQGGRVRETTWRKTTIARTRLDENTQQQTNTGATGTYKRSETEQIQSTKGQPTYTTEPQRRKHTKQTTNDTTQNK

SEQ ID NO: 976361 - protein, 110 aa, Homo sapiens
RWLTPVIPALREAKRREDSLSPGVRDLPGQYSETPFFKKKKKKKKKNFWAGLRASRKKRFFKTPICVFGARGGAQVRVMCGHWGHISVVSLRRRTPGPMELEWSGYSSPI

SEQ ID NO: 976362 - protein, 124 aa, Homo sapiens
MQRHTDKRGNKRTQETNNRTHRTKSTNKPTQDKSNRQRTPEPATAEADQPQRATEPTRDERGRQNKRRTAQTETQEGEEAHERRDEGEDEQREKHRDGRHEEQRSTQKQGRETEARAETAGEER

SEQ ID NO: 976363 - protein, 216 aa, Homo sapiens
VGGTDARYIKQTEKLEEGSGLKHEVHSDSRLAVTMYLRLCFAAAVLVWHVPNRCSHRVNLLSTSNILERDHDTLTVCNQGPSREPHIGGTTNTLHVHKTCQQTLEDMPWATWQAATEQKTPARQAATESRAMHTHRDGATDNAGAHHRQATGTNQNRSKDTDSYTKKQTWLTTGTTEEDLNENTQKTIDNAITRGATTQPNKDYNDTATHPSKKEK

SEQ ID NO: 976364 - protein, 105 aa, Homo sapiens
STSATIIIAIPTGVKVFELTRHTPREAIIEMICCSALSPRIHLVFFTVRGLTWDGIEQSHHSDYRIYTDTYVRVYAHLSTDVAIELETLVIAPIIRKASIHWDFP

SEQ ID NO: 976365 - protein, 121 aa, Homo sapiens
MRAKMSDWASEKISQNEGREALVTVKLLKHKEKGAIRLLMRRGQDPEDLCQPLITLMMELKPTQVATVPGSGNTHADSPTSAPSKSCGHRFLNAEIDRISNQSLRMAEEIEEREKKADRQE

SEQ ID NO: 976366 - protein, 151 aa, Homo sapiens
MPSRSLPGRGAPVVCDMFSGRSGRRWGVPAGGRLGPRGVAPRAPACAASSACGIPGLCVSHQVFCFPAQLGRRGPFQGSPGTMGQPWERTFHSASKPGRGCSRDLGGHEELIQRALAGSQKGEFPALLLGQLERFPSGGPSWKENTWEAAS

SEQ ID NO: 976367 - protein, 249 aa, Homo sapiens
QTLTFSASGPAPWCPSRKLFVWGKLEYERAEAESGGAHRATRERGQRCSRQNTRVWFVPPTLTWPISDMALREKLESPSIAVAGQNCYKVTNGAFTGEISPGMIKDCGATWCGPGALREKACLGGSQMADVGRKWPMLLAEGLGVIACIGGEARGKGSWITEKVCFRADKVIADNVKDREQGRPWPMSSVWAMCTGKNGNTPKGPGKYTEKLRGWLKSKVSDAGLQSTRIIYGGSGDWGNLEGGGSSLM

SEQ ID NO: 976368 - protein, 136 aa, Homo sapiens
APVPAPRANVLRSGGAYARGVGCCRQELGGGGGGAAETAAAAAGGSLEEVVTVGKRPGVGDDGRDPWQVGFPLLPSSPKGGGAAARCQTQAGVVRTLLRAEAFFLRQGAQRDSPLEGGGPSGKPFCWGPKAQEASV

SEQ ID NO: 976369 - protein, 200 aa, Homo sapiens
MSSRCLRGETKPALLLEEEKRQMTVEMSPKSCAIHLPREKHRGAILLFSLGNSDPSLYVLVCAVINLTCVGVKADWHGFDFSFLDGLIVALLLWEMPLYIFPSLTILFSGKINVMSSMLKSPNPELPLNLLGAEDGPPEVIQQRTGGDAGPAKWNGTWEQAWAQGNRDPGGGEGSTDQRPPGGTAFVHNRRAAAHRPQEP

SEQ ID NO: 976370 - protein, 143 aa, Homo sapiens
MRRERRTHRHTDTQSRHYIDKTQQADERKYDTHTGEQTDSRREHQTEKDGKRFEESTERRPRRDNKQTKASTHTSHQEHDEDNQKSATHTHAVWHNITRPIRKNPRDGRNRDCKIDATQTSCNLDVGPVTTSRRRNITGEPTE

SEQ ID NO: 976371 - protein, 115 aa, Homo sapiens
VTTISDPGKMAAALRVRVECRDAGLQAPWSSSPALAGNRVTGPYLRIQEVLKHGQALSGGKGKNRLLRGGRVRPRDASLVWNATQSRIPERKKGPMEDPFLITSNNTCYAEGTWP

SEQ ID NO: 976372 - protein, 263 aa, Homo sapiens
GSVSISAWEGAPRWAWTLFSGRVGPGGWGVLRVGRLASGCGTPARPGPSSARLPGVVSHQLSALPGSAAAGPLQFPGPWPTWSGLSWPSSRDGLQRALGVAGKIHQRAAFGARGEFRPSVPMEMFPRGPPGKEHFEGGHYIWALKDRDISSRGWVKVLLNLGGRVCVAMGSVGGGLELWWNTGRGDAVGGDQSRRFKGRGNIRGGDFRAFRCARKHSFMGVLRTVVKRNRLWLSLEKWLVQVCVMAGQWIRRGQRGSYAGVVA

SEQ ID NO: 976373 - protein, 194 aa, Homo sapiens
AVVSTQSGITAGGGARWLTPVIPALREAKRREDSLSPGVRDLPGQYSETPFSRKWKKKKPKDKKKKKKKKKNFGGASGPGKGLKHIGGGRGPKWCQGTRGPRGVPRETRGTEQRGGRVSPPYKKKARGGHPGRVVRPNPEKGAPESAQRGGRYQHTGGVPKGEGPDSKFTPRGVWGGNDELEDMPEQSHRGHNT

SEQ ID NO: 976374 - protein, 167 aa, Homo sapiens
AGRGVTPVIPALREAKRREDSLSPGVRDLPGNIARPRSPENGKNNNNPKNTKTNNKKKNMGGGRRAWTQEKGFSHTHCRWGAGGTPRWSYSGNNGAPERRCQKKHSAPRTQGGRVFSTNNIKKARAGGHPRSGLRNKPEERSRGGHKRASHTGGPQRSQIKYAAGGR

SEQ ID NO: 976375 - protein, 287 aa, Homo sapiens
VDVPVRWTASDTAREAFWTDPTTNRPMKSRCAALKDVYKIGFLVLFLSPECETDVLKPGMVVTFCSNSTVYNGTYHLSKLHHDSFDVTALPGDNVGASMSTNCVCHRDVTSVDTILLVTCKGMKPTQVEAAGLHCSGAYPEPSQAIEAPSYCPVLDCHTLQMCLTQFAELSTEKIAAASGKMLRYGLILESADAAIVDIAPGKNPSDVEGPKKSTWDHVNLLDSDNTAMGHQSSDRSCGNAKPTCKNKRNENPDSPTNRRNKPTGYGPADTATDEPQKCQHWQRAKP

SEQ ID NO: 976376 - protein, 73 aa, Homo sapiens
CFVSAGSKSVHECRLCCLSESHVEKRYGRQCLVPLMGKTRVDVLRYAMSKVCDYVRQVQRTEDNHATFCQITP

SEQ ID NO: 976377 - protein, 241 aa, Homo sapiens
MSIPHTYSQALLSARTRGNHNSQRQTGSVEHKELLAPRINKQAILHSENFKQSSTISHRITHTKSWPQHSNEHTSRPHPLDHTTLPKTHQHQPHAYTDTTHQPDNNPTTTTENTSASIYPDRPVTPDCPWQNIEAKEQMRRHAHADNSDHTESGTHSACEDRATIATTPHADQDEQPYRQQAHLRKPKRSTFHTDTSQSTRQDTRATCSYNRITTEPSEHYNNQPDRKLIVQRQYTDLRSA

SEQ ID NO: 976378 - protein, 142 aa, Homo sapiens
PRLVVTPVIPGLREAKRREGLSCEAQECENLPWANDTREPGSSLRLQEHTKDCVRENTVETTPGETLETEPDETNHRCEERSQRGHPQRRGNGEPVYRKEKARGPQKSEHPGAPRRHKEPRWNINHAHNCNTPPRTVTTDNG

SEQ ID NO: 976379 - protein, 229 aa, Homo sapiens
MDQDRRPTRANCTTNKSREKKEREQTTAPSCCCYFYLLCHYHTMLYTDTRHKSDPTKTRDDERTEGEPAERTGKEKGETKSEDEGETEESNETKSGKKRAVKRRGREKRNDKREEKEDKKRGGEEERGRRRGKKKEKEGERRGSGMENAGERRDTERTKNAREKARDEQRSDESKHSTSETKGRRERDSSNSSMGAAEQRHNQRGEGPEGRGQNERSDRGERRQRETHQ

SEQ ID NO: 976380 - protein, 169 aa, Homo sapiens
MSSYASRATCCRAVHWTLLNNKQCAAVPYSLLPPRHALLPRPQPAGRPCCTSVDYTSSAMRHRRLLPFLRHFLPSDYASSELGTAGDESDGAARPRRATAATLPPPAVAVAKQQDAAVHAARACVRLLDVSVNCTRRLHGRDECVRESLQRARVERERPGDPMRVGLTP

SEQ ID NO: 976381 - protein, 241 aa, Homo sapiens
MTTSRQTSTNHTTVQTSVQDTISKQRYTRVEETLMKQNHDYEQSIDGKTNSNAIALTTQRGAGEHKREEPAKRKKNRPRNKPKRQEEKTQKEKRQTERDTRKETTEEKDTQKTERRNSERSGDKEGDERKKQERRATREQNKGRQEEGQEPKNKTSSNTARPDRHSKRKKATRRGTRGEEQQTTELDTGQKATAAKRQGANVPDQDTDEAARGEPEHETTESNKTRKHTKRAGERQRRDTT

SEQ ID NO: 976382 - protein, 154 aa, Homo sapiens
GRARWLTPVIPALREAKRREDSLSPGVRDLPGQYSETPVLQKNGKTKTKNKKKTKRVCAARALGPPRRSFPKHTLRGGGARGAHRGATVNTGAPNKRVGSHKAQTPGGQARQRGRGGLHTHKYKKSAAGEKHREGASRGTQLSQKWGGPRRGTT

SEQ ID NO: 976383 - protein, 112 aa, Homo sapiens
MGVRATSGGPKGRGFLREGKLRRGPERHRGGAGNSLSPQIYKKKRARGGGSPPEAGPRGNTKIPKGEEEPSKGRHPNRGGGLSLHPGGGGSPKKERAPRNNSKYYKARGVGG

SEQ ID NO: 976384 - protein, 46 aa, Homo sapiens
MQIACRAGETRVCKGKTHIMRWCKPVDVGLDNAGKRKILYSKYIPV

SEQ ID NO: 976385 - protein, 138 aa, Homo sapiens
MQHRKTKTEGECGGPAPRGAGGGGSPIEHLWWRVGGPVRPAGRAGEEDARRLSGEQKRKRKRKNSAGGGGTYSTYEYREQSGGRSSKPGWAGYTKPRGEDELGTEATVGGVDNNKQRATAGRGAKKNKTAARGGAVGG

SEQ ID NO: 976386 - protein, 102 aa, Homo sapiens
MLNNYTKARAGGYTNGRVVEKKQTRDECVHTGPGFQRRRDTTSGEATQGEKEKKLTTYGPTHKPGGGTEWLPEKITKERKKQNPKKFGTDAKKKKKKAKPKE

SEQ ID NO: 976387 - protein, 113 aa, Homo sapiens
MGGGRGPPEKAFKNTHRGGGARGPQEGKGNRGAKAGVPREKPGARNKGRGISPHNIKNRAGGGKPRSGFGEKSPKEGRGSGGAPYGGPLYKKGEATRRRPENSQNISAPALRG

SEQ ID NO: 976388 - protein, 132 aa, Homo sapiens
MRRNSTELLPAPECVAGDQAAPPTPHTPPREPGITGRETHPTAEQHRETSRYRPPPGREGSRETNSQGRYTETGTTMSKHRGTHASRKLTSPNAATKPKAKYRPAHGAPTRASVGPPQAAQHITHTGRNTSN

SEQ ID NO: 976389 - protein, 425 aa, Homo sapiens
MPKGREGERVRVDVSVIADPKAVRCKEVRSATDKLGEMPRVCETKGVYGNLVCAIWDEGTIAYAPNERIIISGSAQNMRPPDLYIIGCATRGRGEAPIPRSRGRALQKVAQSRDGSVKRTICNAQRTPMGTRPKRPGVTSKAWRLHGLGPRTEATTKPKDAPKKSTNVKDKPGRNLWLRGTREPDRHGTRGLALGGQQHRGAAPIHPIAHNGTEAQALCIPSSGTPMGTALKPSRVQRERHRRLAARNSQNSRKSAFQGHRRMGVGTTGTQTGNRDGELPPKSRTDLEPGPPATQRPLGPPGTGSGQTHPRGPASHPAHPADTDSKTAETKLANTTPRAKHGSPKSSPQQQADNGKPPEATNSRGGLRRPSPTPTTGGGANTPPAQSAPPQAGTPPMGGPKKTLAADGNHPRHIHRRHHTSITQR

SEQ ID NO: 976390 - protein, 252 aa, Homo sapiens
MCVPAPDGRFDGHGHEPPEVAQNYLLGGELKVRTKIITLRSDNDENVALSYACRERYRCIGAGGRGGVRTSLNAEVIELRKGSSTLKVIIWAYLSDKLSVSAQSVYPFARDFRQVITSHQLDFESVRPCGFGDQVSIFSWDEHFSYGIVGTCNGIVTNAAQNGVATRVAQGTAETHSLKGTKTGKKPVHWSLREEWGRQGFPPRQREKPKHIARVGLNTPSSDENDSPFLPTGLHVVNHIRAPPSPLLPDVR

SEQ ID NO: 976391 - protein, 132 aa, Homo sapiens
ICEAAKEVVAAWELRGSRSGCVLVGPRGGGDSRRGDGPECVTSVFSCPFPVTSLIDQDFGSKSDPVCCPFTRIGGMGHVVMSLAGLNGCGTVNALSSLKSSTSFEVPCWRQSTKTSALEVLLYIDIAKRPEC

SEQ ID NO: 976392 - protein, 62 aa, Homo sapiens
MAVAMGPTIFVPQISYALKRFVQLEDQLFYAPWCVTYYRFHAVEIICATPGITADKHIYASL

SEQ ID NO: 976393 - protein, 186 aa, Homo sapiens
LTCSAWCIPRYRPMRPAIQLVAQALRCRDPSDGLPAAVQVAEQLHERQSRGVRVIPSPTVLQSLNFSVSFLANLYATLSGCSVLIFKGCRYRWWEYGDKVYMMRHLEPRNKGSSNGGVSSTVPHLEDTSVLITFECCQVPLEGRPNLLLPSLVQGHSPGGNNILFRLGHWIKVSARGPSHVIVTHF

SEQ ID NO: 976394 - protein, 103 aa, Homo sapiens
ERACAARQRSPRIVRGLSLSAGAGLFAPVVPQHDNHHRAGVRRVGYSGSVGSRCAWKFDPLESHDVSCIELWLKFAREIRTSNTRVTEMYAAYDHRRVSCARC

SEQ ID NO: 976395 - protein, 96 aa, Homo sapiens
MEFQYYATYAEDRSRKKKGQRIGPLGDKRAVSDIFDAFRLDTLLAVYPNYLVRKTVGYPVNQKRLSNELNRSIGRTQATASWGMNEKYETVSISYD

SEQ ID NO: 976396 - protein, 138 aa, Homo sapiens
MAVLATSIALVYSVPRLSRWLAQSYYLLSALLSAAFLAREETAVALSSDLSHPNAKTVNPCDFDWREVEILMFLSCHCDDEEPEIHVPDDSDNYPRRIYIGPLSICIATYKGVRTIDEELATGHELVAWIVEFFARLV

SEQ ID NO: 976397 - protein, 102 aa, Homo sapiens
MPDTSRRSHTESCKVELARQALLLETNYIFGTVKNTWVEGNTDKPPGFTWLTGGFKLQPSQATIFFTRSPNRQRGFEKNFNMIKFNPHTESFNLCCSRHILL

SEQ ID NO: 976398 - protein, 36 aa, Homo sapiens
MTTLVFQRHGGDLGEYNTLAAARNVHFKPCPRGSCA

SEQ ID NO: 976399 - protein, 116 aa, Homo sapiens
MDIIVLTTEYPGVCDILKPPDFMQLLCDSVHVFAKCSATQNLDVSALKTYSKSFHPKFIKDVRVIEEWTTLRQHRPWLQSFLDGRELCLDPKEKRGVQTGLVPQKFFEEVAETPYN

SEQ ID NO: 976400 - protein, 110 aa, Homo sapiens
PRAAQTEITCLINVNGYYAGLNGSAVILRGTPDTSVHISFDSVNKCMRARLLNRHADIAATGPVRTVLVAETLVATPTRSQWRIDQSQLACQSCLLGQNMDLSASQVSDN

SEQ ID NO: 976401 - protein, 40 aa, Homo sapiens
ICEGMAYLHAQHDIPLIGFILEQGASCSLLSEQKGVGSQN

SEQ ID NO: 976402 - protein, 90 aa, Homo sapiens
IAEWRRLRRRSPWAVTRLLDRCPPGSAIAGLRFLSGVPRARIGKSEGWSARMNETLASARKKRWLEITKWCNTWYGSESEAKCLPVLLLA

SEQ ID NO: 976403 - protein, 96 aa, Homo sapiens
STVTYRASRTRVLVTHYAIIDSGKVKDSIVRDVVIGDVNCGYDQRVYGASDVNSNWGGSLSSLEAMCIREFEQGDGLMKYERDGVVIGYELVGPRG

SEQ ID NO: 976404 - protein, 85 aa, Homo sapiens
LETTLYQFDTGRSGTVDPQESQKALTTMGSQAESPGCEFNSQNRYSTNGQITFDDYIACCVKLRALTDSFRSTGILLSKVCEFPI

SEQ ID NO: 976405 - protein, 144 aa, Homo sapiens
MKCNRTDLYHLKLLLQVQIRQGTNLVTIKQDQRRVHLSEDTTHGFLKLEKYGAHTSKQLGNERRSKRRLVVFVLSSVLYLVSICPVTAAVVCLYEACGKIDVLSIFFLILSNVSSLETGAEDKIEVSKYYVKVQIFEYHCEMSL

SEQ ID NO: 976406 - protein, 148 aa, Homo sapiens
KAEVTSRMRFVVFSKLESTSRPPYHTTLFSDHAGQLSRVPSIPYLKKNVDREWNRDNTPWDSSNQILQGLAAYCLCLLPPVPFSGQPVLFLLQMVSSNGVLPTTQHTLFLRRPFLLVRPSGTHYLFVASSCRVPSGPHTLCNFYATLL

SEQ ID NO: 976407 - protein, 322 aa, Homo sapiens
EHFLAEGAHRAQEARSSSRTMSSPTPGRKALGRTPRVPGRELRRRELTQTVSSRRSRAGTGGSPSDNPAPHKGRKKLRGAGGGGPKHRVLFQPPGEFQGTSFFPPKKPRGGRRPRAQRPPPDTKEARTRYQVPGRDRVWPVVAIGIAGRPGRGHQSGDHTNGGRLRATPGPRHSQRHTQREEHPAVYGGTNARGTPQQLSSCDPSSVDRPYKRLRKKETPPKPPWGVPPVKMGWNNGAGHNKRNDGGATRNSITTRQGHLWGGLPQDTRNRRLRGIIYKSTHERARKGILTTAGGRQKRGGALHGWQRGDGPGTEPSSPDTR

SEQ ID NO: 976408 - protein, 104 aa, Homo sapiens
IVHTAVIPADKETERGQSLETARAGCCESQNTSALVSSTHGRREHSLRTRIIPEINNSVAAKSTRHFHARMTDPSYRSLLTRHGAIFDKCKHHSLQEVVRFNLL

SEQ ID NO: 976409 - protein, 97 aa, Homo sapiens
MSDIIKTLNPAEQGGGNQQHRKAKTQNKEREQTSETRQTHTDNHQSHEQTNEATQRRHHKRRTEQAQTHNKHNNQSNSTTQNANQHTRTDTTINNNH

SEQ ID NO: 976410 - protein, 187 aa, Homo sapiens
RARWLTPVIPALREAKRREDSLSPGVRDLPGQYSENPVSPEKGNKENKTKGQKNKQKQKQKQTRCGAAPAGPAGKALQRKHTIAGEEARGGPTKRGHRVTNRGAHKSRGVPHKRENTRGGATGNKRGGREILLPQPHYIKKKTERARGRDTQPRRSRALAGGDTTTPSQREGGEEHTSRERGGAQQQ

SEQ ID NO: 976411 - protein, 86 aa, Homo sapiens
SRPERHFFGNLCAMRAKWRKKANAQVWKRKRHDTRLTAEVQVNPLALLAPCCEEAHMDAGNMVNGPDAWGNAWGTRFVRGEPGMLS

SEQ ID NO: 976412 - protein, 249 aa, Homo sapiens
QVSALRPTLAVAQPETQRTCDVQASSCLTTGPLRRWSHNRSVSSEKSRREAASGQRSVPMLLPTIILCEEFTPKWAPFIPLDSCHHPTFRTGCRTLMERSHHPTGSRSCNASPTRPFNAKNLRAPIGSSYSPPVGKSGGHRSPRKHCSPIGQQREDRIATTKQTFVLFHNADIRSNTHIYTHIRSPPTYTASNHCWTQNIRGGTSTPNPIYTKETADTRMSIAGLETMAKSYSGDAPKHIEDRMTVYTH

SEQ ID NO: 976413 - protein, 238 aa, Homo sapiens
RCRKSGGLLAASRKMARRGGERGGRLLEAPGPRQPRALSCRAATGHVTDANSRREWDTVKKAPIFRPRSRRHTAARPTQAKCLPGSSTSLAQHTGDPSLTQTSSINFLAPLAHIPGTTRGAPKFGRQYLNDKDNHSPAIPCTEGRPTTGGPQAIQTVDNTNLLSHLQPTTGKTKTIPPRAKVFRAAPAVKLPKRKALFRFWRGPRFNNRKFHDPIIPSWSDWLTRTYDKNHRRELAPW

SEQ ID NO: 976414 - protein, 271 aa, Homo sapiens
FPLGCFPAQEPQAVGSHGPSRNGMVLKPHFHKDWQRRVPRGFNQPAGKIRRRKARASQGAPIARAPGRGPIGAHRALPPGLRLPQRKWLRAEAGGFQAVRGEAQGGGRAISTRACGPDTIARIFRGRELPGGRGGKQMSSGGSPWRGPNWLPRRCLEREVTGFHQNFNPFSPPREIGPCGAPPKGGGTDRGVLGLEEDRWKSGAQPQGWNAGAGVTMGPGSEGKTVLHIEKGRDNGSRRSNHIGGGRAEPNFPKRAFRVRLSEVVGPGWPN

SEQ ID NO: 976415 - protein, 136 aa, Homo sapiens
MINESRMHELSNFWGGVDVSPENSVYQSDLADDRGGDEEPPRQVGRRRPVPQRGQCPAGGEDLRGLGHLRVLGVCLPRQKYIKTQVGGVKQTRAVGLRKAKTTQLERTRSRRGENFDSRGTRHANNWGLAPEWVHR

SEQ ID NO: 976416 - protein, 102 aa, Homo sapiens
MCLPYWAHFKTSKNHRNINSYTVFFSPTNIQTDYIHHVSPCAHNFITNTRERPLSYMGPSFGGRPPQIPQKEGDLTKRGQEVFQIIKALKREPREKPYFAGG

SEQ ID NO: 976417 - protein, 321 aa, Homo sapiens
MPQYQTWEEFSRAAEKLYLADPMQGTCGSQIIRHSCLGTCRAPQLPSTDSRSGSAATNTQTHMLQPLLPRHALGPNNFPQGSNLKLADLYWVSPNGKAPATWLTHWRHHLGACTLAHHLHTLRPLTLSGPRRLPLYSATPATPLHSFSPAPTYHARTTPLCLRGRTPVNTPRLTLIPPFGLNPLKTVLDNPLASPQETRAYYTANASTQLLNLSVAHTRSTPPFLSPLNTLFKTLYSRQAHKGNQPLINAAHNFGPQQIRRSVLYSSYPNAHLLQAGHINMVPPLLFLSNIFSPTPPPILSLTVSDTNTTSLFVAHTHSQH

SEQ ID NO: 976418 - protein, 207 aa, Homo sapiens
DTRRRSGTPKEKKAKTPRRRSAPRPRRSERVPVPTSQLTQGTQYCLCNQVSYGDDESVRHTDECPIEVSHFSCVGLIIKPQGKWYCPKCARAGETEKNMGTKPRGRKSNKKEKGLTKQGKVCGHQAPGVDARTKLTPGVITINHWPALVLEGGQREVVTKVSIAKQTVFTTKRDTHLLFNREWAGELRVAPLSFIEATRLSPRTGVL

SEQ ID NO: 976419 - protein, 112 aa, Homo sapiens
AVACENRGTRLVYPCINMMFTAWYRGMSVVYGIGTWSGVGLTCLTIAGPMAKSSVDQRDGSAGECTQLNLSERPKGFHVETVVTYNEDLVPNTEKILNYVEIMDLVGPGTEP

SEQ ID NO: 976420 - protein, 317 aa, Homo sapiens
EAQARVSKGTCAAPWGGGGPRSVASAVRLTEVGAQRGPGEGCCPKGGGVRMCPQTLRRGLEYRAGFRRGGGRDPKYSKAKEGRPARGLSFFNPRRGGGPVGELGKGRWQDGGNNPPSCGRGNHRELSVVEPRGGGHNLAKAPAQRNRAGVPPSIIPQPEKGGSSTSKVYKHRSALGARNLARRGAPLVTWPTLKCPALQRPRGWPKTSGVLNQLTWGAPGEDLWRKGVADCPLLEGVWAMNLALCYLEAPPLLVGHPALGEFVASWHRVFPVHAAWYSRTGRGIYRCQCGSPAGRLACVRHAGDILWTLWRPHWRQG

SEQ ID NO: 976421 - protein, 254 aa, Homo sapiens
AGELQPELRDLRPPAPTAWAARCAPEPAQPSTLRPRGGGVLPRRLIMRVRLAGSRVCRGVTGLHARDPPGGTFLRLGPKGHFKPPRSFQRETNRGTKGTHGVGSCARDGVDVGPGFTGPKQKHLRHKVVDGIPVATAQEQNFRGIPFVGARKACTEAKSGNEGAQGGQQATERQWGGHTLSITGGDNGNAIARVNACGRPGDSGVGTPGCNIAISGKEKRHRRIRRVGYTRRRTSGHPRATIQVAAIRGEEHCA

SEQ ID NO: 976422 - protein, 72 aa, Homo sapiens
ALSQGVVPPRTRGVCERYALKAKMAKGKRLIINIVVMWTVRFGQVHTLVAIIYQMRWHRQKNHLKTFENGGC

SEQ ID NO: 976423 - protein, 290 aa, Homo sapiens
GCDRGLTRVNPGAQDVYQRGEDTLIPELVKLPDEYCESHALDPVSAPDTYVYGCELKARQRLSVSKVDNDDNEHQLSFEERQFEGQVADRDEFAHGWTAEAMRLRRCQSKYKVTVETVVNSCLNKPEGFPWGGFEENTTQGGLKVDSVESRGHVHCELEQHLVAVEEDAESEDDEEEDVKLLSNIWKPVLPLEVVARFHGKPVPLGADDIMMTIMMTEDYDDDDDDDRSMMRTLRQAPGRTHIEIPSQQAQGQLHERSTSSPDQGRTSNEHLNQRHLQHKDIDKSVQGNT

SEQ ID NO: 976424 - protein, 196 aa, Homo sapiens
RWLTPVIPALREAKRREDSLSPGVRDLPGQYSETPFSPGNTGNKQTKQNTKGTKQKTKNTQKKNLCGARAPGVSKKGAPPEKFFKNTLAGGRAGAPKRGKADTGEQTGVTKREPGAKSTRAGEFPHSNKKHRGGDHTGTGFRGTKRPRRGDTGGAKKRGETKPKGEAPTQGSPRKNNKLQPPAASRGGTRQERQPT

SEQ ID NO: 976425 - protein, 209 aa, Homo sapiens
MRYGDRGDVELEWESETSGPERAPEKPGKYDHAVSGGLVSGVSDYAEEKEIQSSNAERAMCVIGDRRSREQKAKQEREKELQKVTIKKEDLELIMMRWRYLEQQQNAVGNTWANVVEALMCRNNWLRAFPKKREREKKKFLGGMGPREEGLNTHPVGGEGPMKQVNGHTRPEDAGSKRGGSPKKKGGTRGLNNPEVEDEATGAKDDNSG

SEQ ID NO: 976426 - protein, 131 aa, Homo sapiens
MVQRLEIQDLGAIISGSVDDPLPVSEEIITYGNWKHSPIQMLSYHVLIMQVTMFNRVNSVKWQKQKTPETIPWDEDVLITLGTEEFQKSETRSLKGYVSTRGSQRNDTVKGNDLEVGTTGGGMNRQQIMES

SEQ ID NO: 976427 - protein, 119 aa, Homo sapiens
MCGGRACGPEKSFQKPLLWGAAGPPERCKREQRGHHKRVPEDKHRGATTRTRGRRVHFLQPKIYKNERGGAKQPRRLFGAQQQPPRRGGRCGEGQNRGGPYQHQAAALTRGDGADYIKI

SEQ ID NO: 976428 - protein, 163 aa, Homo sapiens
GAATHPIDKVQLAKVEDGKRMELSQLLNEIRANYEKILTRNQIETVLSTRIQLEEDISKKWGQGSRRGLRGLIKQNSRRPDASGTTCKWKWNLSMLWKGALKIPTCQRAALPDASEGPRDCDGPGLEKELQEVRRGSKSSSRARDASQHEDEVEQEIAIIATS

SEQ ID NO: 976429 - protein, 408 aa, Homo sapiens
VTRSVFMAVNFRDLPMPDMSSFSAFLCCLSPCDATVTIAHQHHHPHKQPHCKHSITASWPASFIHQLLAGHSDSGIHCLHHRFNMHRLLACQIGMSGHPHSMVPTASHSRTKGTQPPQQSQLGAAMLEHFLHSLVSTQMNTLGLLLNFHVSRDGCRGPHWTRWHIGFLECNTPFPGRLHKTLHLQRTDIHAFDTRGLTQDTTLDTVHWTTSVYNLVDHTRVYTHPFLLLVELHLTHTFNFVLSIGAIDELYDVTNVRMHTFDLWAGTFKVVQYSAFKDEIIGKYIHVELQVYHLVGQFYQRQKGMRHRDTIFAHNLDNKHICTVHPTAVGSDHILWDAVSHYGAVHLQPHISPTHRQRHTAWGITLSRYYSLDTYLLSCRVSPTLYVNILNQHLADRATDSTTTPTVL

SEQ ID NO: 976430 - protein, 138 aa, Homo sapiens
RWITPVIPALREAKRREDSLSPGVREPAWVKYSEDPGFSKKEKKKTKKKRKLSVGGAARTWPLAEKEFSMKNTPEVQGGARGGPPRKRVGRRVPHNGGDTRTGYHEEGKNPEGQQQQAEGEGCTTPASEKKGPRGLPH

SEQ ID NO: 976431 - protein, 161 aa, Homo sapiens
RRATSCVTASVNHHGHLSGSAALKHSSSLPSWAWSPVASTETTFNSIMKCDVDIRQRPCTPTQCCLAAPTNVPVALADQDATKEITCPGEPRNNEGSRSFAPPERKYSVVTSGAHSWASVSIFPARLWDPASRSNERRSRPFLCVPNSQKLLYLRAGLMEL

SEQ ID NO: 976432 - protein, 313 aa, Homo sapiens
ARLHAPPLPRLNRLRSSRNAPEKGSMVTESRVLSFESTSPGPPASCRPEPCHTRPTLTVPGNLATYRAPNGPYQIIPGTWNPCVASTDTGSWYWTILLNRQFCGTPCGKGCQSLRPGQHVLLPNCGWNANLGPKALEICSVVHTLEPTPEAHTPRAGHGHPGADHSHITRDPVNVAWTMETPRCVEHCKRGLCCKNPPHVDPLWARAGLASTIRPFIMSAQLDMNTERIYYAPAKHGAREITDIMGGQIPHILSADHTVERVTTFPTCMCFPQTGERPQSAWVSFGMWRRAYSTQQCGVLQETTNNQRGGATG

SEQ ID NO: 976433 - protein, 112 aa, Homo sapiens
TLDLCAPLLPDLPPLPFHSSSALNLLLYIWCRSLFSYTVAALMSSHMALTEIQSLTVQSQRGRLRVSRRRIVRHEELKASLRYLGAQAYSGKPQIIATRARKNEEKTEGHNQ

SEQ ID NO: 976434 - protein, 202 aa, Homo sapiens
MGISNEKIDVNAAAFGSLKKEMCVSEAFKKTDLGQKCPNIKAETWSHTFYLVILHITYRGQRENTFMCRKNFTLKTVPATNYNHHLCWVLPHVLKNSNPSSFCEHSYSCNGQSKENLKHKLDHVIGELGGYNGTVYGNVLDRGKRFQNSIGEDTQGLKGYCLIRKNRKGWPSRGPVAGSIDRYFRDICVVPKWLATFKSSPI

SEQ ID NO: 976435 - protein, 83 aa, Homo sapiens
GTKLLLSHAELPFRLASHEVLARVVSSIPSAVSGRAGVDETILPGAGITQEFWPDLVSIHRESEEPDDKHNTNGAETGLIREP

SEQ ID NO: 976436 - protein, 77 aa, Homo sapiens
DLSRGEVFGQTCVRMPGDINRYREEYNSSGSAVSMILHYENTRGSQNHFVENVALYDVTNGELELPWIVINARISIA

SEQ ID NO: 976437 - protein, 306 aa, Homo sapiens
ETLTFSASVQRHGASRKFFVGGNWKMNGRKQELGELIGTLNAAKVPADTEVLVLPLCLYDFALKKLDPKMCCGCAGKCYKVTNGALTGEISPGMIKRLGANVVGPGPLQRDGGVFLGEADELDWATTRVAHMAPDSRGTREITSPCMGGEHRLHSRRNAGNHRENGLVRPQDKGSSQIHVKDVEAKGPPANMDAFGGHGYRARCDTSQRGLGIVQEKLRECGKYSASDAGIKRPRIIMEALCLGTLHEVARTCGMLLGGAPQAELGLYPKSHTFPPCTGEAERMPRIGGSLGHHDFGIPGGRPMGE

SEQ ID NO: 976438 - protein, 176 aa, Homo sapiens
RVAHAVIPALREAKRREDSLSPGVRDLPGQYSETPFSRKRKNKKPKGKNNKHKKTQKKCGGGRGLGAREKKASKHHSAVGPPARPPRSGKVNPWCTEAGAPKKKTRRTRQSGRWWVPPQKKKRRGGRNRAAVCDKHSRGRGEERATRGPLTNQEAGPSRERRITKYRHDRGRKKTK

SEQ ID NO: 976439 - protein, 198 aa, Homo sapiens
MDFSMMLRSTVVAKARAGTRNTSLQIFSDTTFEDLTKCLCWLTTILLNHVVGDLKNRAKAENGGLPGNVDFSIRVNTKNEATLSSSLQKYFNLAKLILKGKAKHVTRLAVYEENTLTVGTLHKNLRVDLYTPSGASANVWKFLPLRFSPLIFVWTLIFSRQFWPTGGRGKEESLSYDGEHNSFRPPACRAHKHWGWDT

SEQ ID NO: 976440 - protein, 38 aa, Homo sapiens
TTQHKQTQQNEKKDVIAIYGPSCSAEGRAPGAYRARKR

SEQ ID NO: 976441 - protein, 175 aa, Homo sapiens
ANMAAERGAGAATVAGDDGRLTGGSSLKNPAMKKGRNTAVAICADLSEQSLKDGRGAGGGGPQKKNMSCLVDMEPHPTWTEMQEACGCESLSPEGNDCPELETLCLRKNLIKCMRIGEELQSLRRAGSLANQIKKMENLEALTESGDPRYFFKSVRNIDGVDKVTPIEKIFLVNN

SEQ ID NO: 976442 - protein, 225 aa, Homo sapiens
MPLHSKPWGTRSKNSVSEKKKKTKQTKNTFLGRGHGASEKKVFTTQFCLWGARGGPSEVHRGPRVQKRGWVHKGRTFGDKNKWRGGFSPPILKKTGPGAEPPRGGSYNKTSKKGGIREGTLNAESHNKGGVPKGRPANKENKPGGGEKTEQHTKQRQQRLTTDDEDTIETRPQDTEDIRTHNTQAAENESEHDTDNRDNKKTTRQQMRPKTKATKSTADTHDATR

SEQ ID NO: 976443 - protein, 137 aa, Homo sapiens
MTTRKKQEYLKALAHEELFENNSKMISTNTNDSVLTPPRHWRSLLHQADDYVKKVNPKKQIRADEKPQEVNIYTTLNEGCQQGLRTLRRDKISELHSGVIPGASQPEQACVFFVTTQTRGKLPSLDVRNSLGKRARS

SEQ ID NO: 976444 - protein, 197 aa, Homo sapiens
MDIQTQRRSRHSTDHHSPSSCTDTFERHQRDNDLVVTNKKPPGDRDTLLLIRGKNPPRAPLCCPAHLSTITATGSPTSPHNPHYLTPPRHNTANTHTTPFLLDRRTDPLYHQQRADLVRHAEHQLQAYHTTAGSHTMQARHHIHPAESSPNSNVDGCITMRNTRTSHSSLVVRFLFVSALLLLTYYFSAMVSIDKST

SEQ ID NO: 976445 - protein, 87 aa, Homo sapiens
CRRGKRCDGGNQEEPGDGFAVSGLKEVHERSEIDAEPPDIKAGTRKQPGGGWKKERNRDSQAPVLCNRNQREQLSRTRHSLLFCHEH

SEQ ID NO: 976446 - protein, 131 aa, Homo sapiens
MSHQNKFTNSDKYDDEGSVSTRHVSIAGPKGTYDQAWSPKKPILDGLNLEIGRDILGRFKRRTSRGHWGSHLPFWIPICKPRKRLSHNFFGLCLPGGGPPSIITPNEELKANNGNHLVTGLGDDSAYTVCC

SEQ ID NO: 976447 - protein, 318 aa, Homo sapiens
SEQELVDRRSASEGAEPPPRAPLPSGTGARAGPRRRPAVPRRQAGVLARAEETRGRKTRASAGEGAEPRGRRRGCAVEGTRPCWRGTSRQSNVTPPPDKGWRGNKNTFSNRDGPNTKTASRSTTTRRMSGCTGHRKRQTQKQESNPHTNKKRQHQQTPKETRTTQKKKRRRKEPRETKTTKRHKHTKSSTARRTTKEHHRAQKAGQTKTGTQTSDGAPESSDKEADSTQDILDKTHRHIAEVKRGKRQSSRVEKQVENTPRRRNEDGERNKEQQIRRRKERREQSEGKNRISRRGRQRKGQQHEASTTTRPHTGASPA

SEQ ID NO: 976448 - protein, 136 aa, Homo sapiens
MCWLQGQAIPGRNRRAPSQVRLRRPQSSSLRPRQLDLWQEGATTQGLARAQDLSTQTVRSPWRARKVGRIADRAGNPFRGKQLFHMSQKQVRFMKPKCLCVPKVPGDQAHRICGRGIKIPRMAGRQLPVNTVPQTN

SEQ ID NO: 976449 - protein, 135 aa, Homo sapiens
EEWQRQGSQFREGCRRAGARGTRTRFPEHPDAPSPRRCPRRKVSSAKGRREEAQEEIGRLVQYTLLQKVEAKRKKGAARERDRLLQTKQSATHSSDSGGPRGTRPSGLYQGNLEDDLPGGNAGNTKALEEEPRPS

SEQ ID NO: 976450 - protein, 114 aa, Homo sapiens
LWLHYLTDKMLKQMTFKTKCNTPAMKQIKRKIQEFHRTMLNFSSATDLLCSTVCLSKLNVSYCPEMRGDCLEASVLFQPPSPQEGGTPILTGFQSAFQTRICFQMEMKYFVESV

SEQ ID NO: 976451 - protein, 287 aa, Homo sapiens
NQSAVSGPSQPRERRCVRRAQELGMSYKPIALFPEHPWLQHPWAGPPVPYRKRPVGRRGSVPGAALLSDRCLTTCDRFHGYVQAMKPGGPGFPEQTEGTLLSVIEEDGAKRNRRLPLLLARKGAAYERLEEEEVIIPMPGAPSQESCLGKKEEAEGPDVNRKGARAQAFGPYSGNWRRPRFLLAFISDWLNPFRGLRVRVSPCVWVPPRTQGEVASQVAALGNPPKTGVSSEVPMIPPMNLRSCCPRTFGGPTVQAFQILHWSELFPRGRAGPLAVLAKASSGAANA

SEQ ID NO: 976452 - protein, 163 aa, Homo sapiens
AKHYANGMVPRSCLAVPAEGARNQFIPARLGQDALSRELGPCVAGPRLETCEMEKESTRRHKGKPQEQESCPSLPLEHLRTWGLDVFRHWKTSDCRGCGKSHHLEKLEDSSGEPGAGAVPHNQDPRILTMLSPGPVRYRGEERQRLPFLFNFQRETLSGWELI

SEQ ID NO: 976453 - protein, 118 aa, Homo sapiens
SKIERGAQERARRNEARAASGATPLRRRRCAGRSRRAPRRRRARAGAETTAGINVARQTATEAPGAENAEEEGSHEVKAAEANKKQQTTTFPGKGSRTGGGPAGSPKGTPGAKKNPGG

SEQ ID NO: 976454 - protein, 274 aa, Homo sapiens
MLETFNTPAMYVAIQAVLPLYASGRTTGIVMDSGDGVTHTVPIYEGYALPHAILRLDLVGRTLIDYLMKILTERGYRFHHQAERGKSLRDIKEESLCKRARDFEHEMATGAFQFLPGRRATETCLDGQVTQPLQLRRFRLALRTLFSSLPFRGHGSLCGIHENYLQNSIMKVLTVHITAKDLVAPNNRCRRGHHHVPLEFADEFARREITLALDPSNNGGSRIIGPFWSASTSGWIGGLHPGLRATFHNVVPQQDFESRPQCHTEWFRRIYIVA

SEQ ID NO: 976455 - protein, 218 aa, Homo sapiens
MPLELELCPVALGGLGNNSCFIIAEIGRTTRRPDVAKRMIRWPKEVWALIVARFQKSELEFTFNRKALERPYTSKHSRGKTYGEHNNDNPEFSHDQYRELQRYAEEGGIFFTCLCMAGDGTLNSLHELNVPFFKSWVLEHPNNFPYLKKTVQKNGRPNGDLPSGNGSHGDPMKPVYPDRDSPFNPIFCSCQCPSEYPFQPEDVTLRHSDIELFCFQRI

SEQ ID NO: 976456 - protein, 252 aa, Homo sapiens
GRIERVLLSGGAIIGGEQNSGDQRSDTKLNPVDPFCSPSASKGRDVVPKKDYLEIDESRLPSGTLAETRSPGEKLREDWDPCQCGSTWQRVNSLYETKHEVQVENLLLMKCCKRNTKLNAWSWYGCTGRQNVGHYLFKKTEELYFINRTLWGEMICRYLDSKGGSHGVATTRPPTNLFVCTLWTRPTFYLNKQAFGTNARPKREASQMSRQFIPHIISPPLNCALAKVGSGMPSIHHTCGHKAFLASLKDYY

SEQ ID NO: 976457 - protein, 301 aa, Homo sapiens
GPTGCSETIFALFLIRLLARRSRLRRALPPAGRGTRGRLNRPEGPLKLSHSYLNSPCNRDSPGSCPNHCQEGSPVDTQLREITHSQWDFYTAPTPPGPVCGTRRARTHVERTTAPGINRGTLVTLTGQLGGNTVSWFAPTLENGVTNREENTKGEHDTVAWEAKATHTVHRDPRPRHRTPGRQLGLDRDTNSEHRHNLDRNWQGQNTRCETFHSAYNGGRTKGPGAHNCTVRTRGNCAYRDTGPIRHANNVVHEKYTPTELRHNGQKKKQQTPENKRNGETCEHLTRHRRRPEQTTTAATQ

SEQ ID NO: 976458 - protein, 340 aa, Homo sapiens
MNQTVQTFFSPVNSWQPPNYEMLNGGSTECALSLGGCPNNPAPPMSTVIHILQLRPSCALTMSYWVPVQQPLHEPLLPGLHSIRLLRCSLGTRNDGLATVDRGPGHMPPPPKLPEHLWPLIPGQSSLTILATSSSQVLIFPVPIGYDQGGHPLEDPRSSWPMTVYPKYSNVPFLRPLPRSRESCIKPLILNTAFSYQLCIPIKGATVVLEKPTTHTTNNTKPKHHTTHNKHNTKETLHTSTTTPHPHNLRAHYSSHIYIPTRKQHEDNECDNRQEKVAMSLHGVTHTKQHVPTHHTQVWMCTHPAGKRNELEKCPEATHAASDKRRSRKSVDGRQREDGT

SEQ ID NO: 976459 - protein, 151 aa, Homo sapiens
RLREKMAALGEPVRWREIFVEQLNLEKYKGVEKYHKKLQALQRVLQSEFCNAVAERSLTHVYETVDISSSPEVRANATAKGLLLLHFAASDRTSSSSSGELPKTERGLGFKYYGRQRTKSPIYIIPNNSRWNGDRQWGPQNVEINLLSVME

SEQ ID NO: 976460 - protein, 152 aa, Homo sapiens
ARVVFSGIVGGACDALQHLSSGAEQDDCCGCCAHENCGKRCAIVLLYRAALMEWQDRATVSLWQPLVSRRTIYVLIPWAVNYTFCQHRGPVPSDTSTWSECIEPKHIVDCTVSLFQSSVALGELNSSGVFIHVTNMAVLGGICGFVLSPTAI

SEQ ID NO: 976461 - protein, 81 aa, Homo sapiens
NPLGQTVIYSTIFAGTAPSQRYARTDFYLSRPRNKHASFIQFYQKNKPSSTEAAIKYFLTKQPIHNPSNSYPLQQYTLRHN

SEQ ID NO: 976462 - protein, 73 aa, Homo sapiens
GDGVGVGAQAATWRITASLCLSVMSVSGARPVLGACFIPKGPNRGVIITMLLTCQFVLSLLLMCNSGPNQPSL

SEQ ID NO: 976463 - protein, 72 aa, Homo sapiens
MIRNTVSEGLTTCALSYTARRIRDSRRRPLVHWLVYPPWVARIPTATMGGGAPKRRYSERGSSGEKGSLLNC

SEQ ID NO: 976464 - protein, 88 aa, Homo sapiens
MAPPGSSSWGKLEDERAEAESGGAHRILNAAKVLADNRGGLCSPYAISDFARKKLDPKMGCGCAELLQQWLSGAFTGEISPGMIKRCG

SEQ ID NO: 976465 - protein, 75 aa, Homo sapiens
ETCALAHACESQLSGMLESAGGYVDAQGVVDLPDAYTRYPVLHEEQERDTHPLDEMQDITIGPGKIFVGTQGPFK

SEQ ID NO: 976466 - protein, 110 aa, Homo sapiens
MAYGCVGFPPNKKSAGGHTTSVFLAHTPKWGVQGDTNTGATYTQGGVTKGKSVQRYNKKLKRPRPVGDKERQQLKSRKGQQQTDRAKTNRREDKSTHQTTEHSNTGNKKQ

SEQ ID NO: 976467 - protein, 113 aa, Homo sapiens
MWEFDLRAANLPASSCARRPPPPPPARHMGSRDLDDEGNTGKRLLMDGGWRGLEMTRENYSGYEGVPINVGGKPLAPRERRGNNKAKYQRVWLEHGWVLNWWIFPRGGQKTFN

SEQ ID NO: 976468 - protein, 256 aa, Homo sapiens
GSCSRKFAASRGRNGSRLLRGVERWRAGLRARAPVRGREWPPWHREGGVPPLIERAGAECVWAEGRSMAGRPKKGDGDPITNGRGPQKGEGSQGHPAEKEPLKFEGSPCQFFPKQREEIKKGGWPSWVTHERGPIYPKAVRPGGIMRPLGTKRARQEGAQRGGNAPPSAGGGTPQVQHKGVGCGPPQGSVWGTPSLVGHTRRSVKFYPSNNVGGRRQKGALFFAQGKEELKANGVVGSSLCLPILKKQEGRAEKRE

SEQ ID NO: 976469 - protein, 221 aa, Homo sapiens
MGGGGGGPEGIREKRRNRQCPQRKNLMGENNRRGDFSHPKKKNGGGETPGTSLLDTPPKWRARGSNTGNITHRRAKDGGRFKLGPTWEDRVDIKTRKQEQKQVCVTETTEQGRSERGSRERSEAERARAERGRGRGREQRGGEGSRAQPERTGDEEEGEKKGGGEEREDGREVSQVGDETKSQKGERQEVKDDTEEQARQEHANRAAEATREEQAKAGSTR

SEQ ID NO: 976470 - protein, 106 aa, Homo sapiens
MGFKWGSNPMYLFLKYLGSSSGGSSWPSPLSPPNHHPARTREWPLPPRGKGCRGSTVVAIPVPLQKPNRHCCDSNLTVWRVELIEIPGAEFDSGFQCSCHRYESCI

SEQ ID NO: 976471 - protein, 129 aa, Homo sapiens
NEADEGHSNSSPRHSEAATAQREEWQNVIGGLSWDTTKKDLQGTTFPNLVQVVDCTLKLDPIHRAIHRGFGFVLFKESESVSIRVMDPLKNINLNGKVMAFRKQGPKPWKNKKKAVKQNFGGGLSPDTP

SEQ ID NO: 976472 - protein, 249 aa, Homo sapiens
ETLGVWTQRRRERERPSSLRVVWLFEGEKKITINKDTKVPSACYIHHQQRRPHMGNIIEITVVDLKDPQVLLLATKPPTPVEHKIIIRVQTRRTYSPQEAFTNAITDLISELSLLEERFRTCHASPSPSAVMVSFPEALPSHTFCTAVRTVSQLNLFSSKKDTNDTTQTTSGCGERHSTPRKKAYNTPPVDAAAPREGRRNVGHAGAQREHPRQHTGGSPPNKKPAGNGRLEQTRRARRHTGTHRARKQ

SEQ ID NO: 976473 - protein, 88 aa, Homo sapiens
FREARGLEAEERPCATKWRLCTVSRSSARMSQLKLKKPPLLHMPSPCMCMLWWCVKLPHTPETILNDVIVDPPSVGSMMMNNWAIRGQ

SEQ ID NO: 976474 - protein, 169 aa, Homo sapiens
APLAALKSHLCIVPHPPPCSPAAGLRRAPPPPAGNSGQLYRPESLKLSAFFLIPCIGITGRAPTNVRRSRRHQAPKSPTKGLKGEEGSGGRGRNMEEMPLLTGMLMRKMWEQEVDNDGRPKKRNERLGRTTEEDRRTVMVRKRIGDGRLRNAESATGKRRKLTMTEDDD

SEQ ID NO: 976475 - protein, 134 aa, Homo sapiens
MGAARACAAQRGASAGQFEPCVLQRHWNLPRHYSSSTLTLQVLTFRGLCADLQGRWRTRSCGPSLSLEGVRAGSGHPDLFREDSGLTISGQPNLGRRGTFLPTLQRNLFSNVLSTGRKQPQPQGASTITGRTTR

SEQ ID NO: 976476 - protein, 78 aa, Homo sapiens
GLAAGSPRADPGCGIDRGPWPALPDPPGLGAPGAVYGSGSSGAFAFGLGDVKIKTSLGWEAEDTPRGYPQNHQCLIYS

SEQ ID NO: 976477 - protein, 332 aa, Homo sapiens
GLRPPPSCLGKPGPEGRPNRGGAGEGGVRGAMPLGPSLVAPFLLGDLSWAGAGNRPAFLLRTWAPDLWGPPVKDMRFERASIPCGAGSFVGLAPVGPLASLALAVLQAWASAGALDTCSALGRGYRKPPESREDRGGERDNPPVQAGEYRWDPGGRSKARWGEQGAIAGVVASKEGRAYVKWECGPKAPGYRMGPGTLQHLRAAPRKRVLGHRDPKKATRWGQGPTILQTKWDGLKYIPGKTGPTCGHHRGGLYLLNHRGWDSWHIPSWDFAWEPGRNYTRGLGTCIPYKAARARAPRTTSWDLLWWADLGGPVSALPIGTPEREKAVVGNT

SEQ ID NO: 976478 - protein, 468 aa, Homo sapiens
MPILNQDFFFLTGERDLSLFLLRRRGQRVTLLPYIPTLCYFFDTQTTRPLHTTFGHHCQPCATRDHLDVTHVTRVVLQTMGLTDTPCGSTSLYQRAPGTHSNDTLPGPPVYYTGKTYHATPMGLLDLSAPYKPHRLFLKPQHYILSPLVTTVLADALAPGPIFSQQTALYDTRRTTVVQRTGPFLGYTDRVAPTPDCCTLGALNGTRTLVTEGSRTVLGHWYPFDRHNFTTLDTRWWLPPQLPTRYTSFFHLLPFNTVPLYPALAPSLTPVPLRLCGPTVTTRRSLRCYAFQLLLCYPFFPLFPTGFGVTYVLSLLVFFGAHPILYVHRLVSTPVLGIGLTYPFSRDTPLPQSVVGPSMPLLGHHPCRRPPTISLAINYFWRASSHIYLAGTNSTNNHHSHIGVAPMTSADSRHCHRFVVNEHLTDSLSSPLSHFGIIPTGNHKYYYTVLDTHLIASDVLVQRHTRVH

SEQ ID NO: 976479 - protein, 193 aa, Homo sapiens
KGESAKGRCRALFLVTSYRQNSPGAKMVNVPKTPKKPSVRSCGQNQTHTRRHKSTEGQRILIDMPREGGRSMIRTPRDGILGGARQTDKILPADPNGPLKNSTIEKPHCGALTGALTTSGWLEAPYTLCHRIPTKRRQLPVLSPTLNGHALATAQFLVVKQVLRQRHDTYEQQTVNKSVSPNSFCIFHNVLLL

SEQ ID NO: 976480 - protein, 149 aa, Homo sapiens
GRRRRGANLNAVRRHGRLLEIQDILNTAEIWNLCLFVYGFVNKAITPEASYIGYKRSFARLPAQPLKACCTINDKLTFLENSLMPHSVTLCNQAPDRLAFARLNELYHVENSLALPRQLYPPNSTFFKHTELIKTLIGFYKHSGGKRCA

SEQ ID NO: 976481 - protein, 144 aa, Homo sapiens
MTILQPNTNLNFNKVLQLRPPCAHGLHLPPPSYHRDTFIRVGTDLDRAGTTTSDLPLNEHDNHNTTNTPSPARLPHQKTPDPSPQGPAPHLDKPRTRHKRHPKKTRRTTKRSDPPHKKPRANHRGCQHAVTHRGTGHHTSGTDK

SEQ ID NO: 976482 - protein, 133 aa, Homo sapiens
LSPGVLVEVTSSLNPAWQSLTHRRDAQGTTRATWKSNYFLNDHPTIGMIIRTCFIVGRRQLWASNARCQQDPQCPFRWASACACLHGAKNTHDACKAHPRRTWLQTNPSSGRQLLPHIRGTCGPLVFTTGGPH

SEQ ID NO: 976483 - protein, 128 aa, Homo sapiens
AGLRTVIASGCEGTLATVPGNNRACLSRYPILSTPLPLPPCKGRTPDTSKGTLTGRDSRCTSIRKSIIVHYEVKLPFLENMGDPMLGDRQRMSTQIIRLKSLNATTDYNFPGKARWLPRHVKLIHPSK

SEQ ID NO: 976484 - protein, 105 aa, Homo sapiens
RGWGKRGPITDPGSYRCRRDVASLVPSSLPGLETSSGGGGAPTRCPRSTLPVLACLCLCPEPCVGEDGGHPETGEETGVCLGWREKPLNGVVVGPDTFVLQGGWA

SEQ ID NO: 976485 - protein, 99 aa, Homo sapiens
MCLVHMGVKEGVPERKPRRHNGQLGGVGFLPQLKKKAAGRDSTGGGSPDTNSNKGGPEGGPTAGRLYPTHRRRPQGEARGEYNKLNLPPPREARTNIDR

SEQ ID NO: 976486 - protein, 112 aa, Homo sapiens
MFVRCAPSSRTAVFSHGNAVTWARCAVLHWLGSRIIARIFSYDTRDRASVRAKPLEKELLGGIERRVQGGWGNPGYGVRSGELYLSNGQSFGETVPKGYNLGLPKGMKLWQG

SEQ ID NO: 976487 - protein, 73 aa, Homo sapiens
DHLLGHQEEMLIKRIESVLSGESSICVLIYQALVVYGFIEGCHIRTFCERYRIEELGYKKNHQAEQQGLEITV

SEQ ID NO: 976488 - protein, 74 aa, Homo sapiens
GALYSRAACCRGCILKWRRRPGQVCGNSAVCKYLPENELKRYVTVCDLLLEESTVRPVSNTSNQCVEISSGQVL

SEQ ID NO: 976489 - protein, 237 aa, Homo sapiens
MKGATQREHRGQQSKDGRGNFHTQYKKKAGGEHPEKVFREQKLPRRRSSESGQSGGEQKAHEENSTEEGAAKYSKLKPPRPWGKKTKEKRRRGTERRSEREREERGGEAGGEEGEGEKRGGRRGERGRGRRGKEGRGEKTVHGAGGERRERRTRAQGKGESGRDSGGKRQKEENPKRRTERGQGNKDGEEGGETREREEGEGKRERQGERSREGAEGGEQDGERKNGGGEKERAEKK

SEQ ID NO: 976490 - protein, 133 aa, Homo sapiens
MPKKGRGEISICISKPLAIVGVSCAISIMQKFMDDECVEREDFVKKIRKNWEWFMKGELFLRDLHYKDHLKPMGEVYFGRKLLDRLGRWAGWGLIKTAKKDDWMRKFQYTNGRVGTCEELKEKPRYRVDRGLL

SEQ ID NO: 976491 - protein, 101 aa, Homo sapiens
MTKNREEREAEPERKIQKQRIEAETRSETEDKHTENKETRQYDREPQRRKTQGETRRIVHRQTHIDDRYRSTRRQVDSRIIDADIDAKQESDNIKKTQINN

SEQ ID NO: 976492 - protein, 308 aa, Homo sapiens
MSLIENKRKQIIQALVITILRGLYFTLLQASEYFESPFTISGGHLNGLNIYVVATGFPRDFTSIMGSLFLTIWFNPQVIFHFTSKHHLGFEADAGYWAFWYDVVGLISGMSPIYWMRVQRNYKLKQNFWAVLAHKNFIAQLSGAPGATQKSIEQCGQQVDQKRIGHRKCRGSTINKTPGEPACLENPRGVTEHKGHNKGSTEEDKIKQDGPRGGEYPTEADTANKYKQHKNMEIAYTAETAYKKATAKKSADTRLSNAHDGTEGEAKQESGKLARDQSRLTADTQHYATNSTTEQRTKDGRKNHNKET

SEQ ID NO: 976493 - protein, 305 aa, Homo sapiens
MQGEEMKCINHYGGYLCLPVRAVINDYMARDPRHQCLPFKPQPCPPGMSPKIRTAVVDVDECAQALQRVSPQPRTAITCLVPISAPAPDGLPTRIGPEVVWTETECPLPVSAKAPLAVDTLPGSFRWQCDPGLPAGALKPLLCDVNECDMGGPQCEQALFNSYGTLPCVGATVGMSCTRDGSPAGILDECKILQATTVSYRCVHEAAPVNSGNCPQELYQAAGQTPLQELGECESVRPVSRAKLCNYHGVPVRDTTVVGPSPGSQNRFAATYGEATWRIHLRGRIHRPRERTGGIDRAAPEEKRG

SEQ ID NO: 976494 - protein, 190 aa, Homo sapiens
RPAVLRRGVPGTFQESASRDRGPRMLKRLVAIHRLQGRRSCAICYQHQPPTSTLKTPCDPGMHSTKMCVGPGIGIGNATREAGSSPSEMMGDTLTIQVNFSHPTLGGSLVKRTRATRRREAELEVGVKKGEIPEVLESKMRKPNQHFGLLNNRKHSARHYVGGLQLRFLCRKVSRCTRFGGCDVKTEPSL

SEQ ID NO: 976495 - protein, 70 aa, Homo sapiens
MFGTNPQDGGPGEGTHNGVSTPPGGLPEQEAHDQNLRPPRGEKRTEQDYTDHNEQQEKHKDNTTTTTTHN

SEQ ID NO: 976496 - protein, 140 aa, Homo sapiens
AYGEAGSVASGAQGELCPVQDGGRGKLIAVIGDETRGLFPGCGIGELNKNGHPNFPGGVEKDTTINEIEDTFRQFLNRDDIGFNPHQPVPSQRWCGMPRDAHQQSIPCVREIPSKEHPYDAAKDSILRRARGIVHAEDLR

SEQ ID NO: 976497 - protein, 113 aa, Homo sapiens
DGGWSLSESSALPSPGDEGNSLCLQKRFCGLIQKHQQHQRGGDSFLSRFYSLALSPVKQLPSTASAGSSLDKGRKPARVGAIGSAGMSHCWRSLVFCGKVGSWFLETGSRSVA

SEQ ID NO: 976498 - protein, 242 aa, Homo sapiens
MTTTTENNNVVGGRQATRRKSFFDTLWLGGRGRRMSVVEQWATRGCRENPWVRAEGVGLPPNKKTAGPQAGVKNPKGGFEDNGAPYNGGQRRTDKNNARAGERATQTRKTPGNSTIRERKQQHSNRKKEETQNRKQPQAKQSSIGQEQEKKPDKTEENTDDKNKRTAQHQTEQKKETMKDKTTAQKKQHKTKRDKKQKEKTQTNRRGKNIPKEPTNAQTDNRRHQTNTNYEQSEIHAKDTPD

SEQ ID NO: 976499 - protein, 191 aa, Homo sapiens
EGQSSQSQRCSKRIQLHSKQAAAPPQQSPYTSISKVWHSAHRSVSTDQSNSSSQPYHPIKHCGSKSSSNSKLVPNLCAPTNTSFSKASKLFYMHSMHSIVETKKRNCRPKTANSMQGLQRIIRAKGIQQTILAWNQKLPFSDFTRRKPGHGRSPVDSHPSHSLGWRSRKPLQPILFSFQSCSWGTTVPMHH

SEQ ID NO: 976500 - protein, 96 aa, Homo sapiens
DTLFICPAACFLLIGNSCFSLARNGPQCSCRLWLLCLCGSCKCKECKCTSCKKSCCSCCPVGLVPCVPRLHLQGDVRHCAACLCLLPGQLWLSRCK

SEQ ID NO: 976501 - protein, 81 aa, Homo sapiens
MTGGGGREAEAALLYFINTDTRDTAHPSTQQNNIRHPTLRSHDQSHNHYKHRSSPPQRSTRSSATSVPKSYDGPANTKTQT

SEQ ID NO: 976502 - protein, 260 aa, Homo sapiens
GRRIGQRDGKLACPSDTGLEAVSDRCSQAGGDASARGTRQLRALGRGYCHGQAVAGIECIILQRVPPQGWDPKDHLIRSREDFHLPEELVWDDTTQGVPRLSPFFPNFFPKNAPHTQTTHVGWGPPTRAQQQSQGGRNTNQQEGAVPSPHIHHSRFVGVGGAPPTSITQPHHSRACPSPPTQHHTIINKHPILLNPPHKHNTNNTSLTLNTRVMACRIDQPSTTHSSLLSSSSFSSPHLLTPQNNNSPHSSLLLPFSSTP

SEQ ID NO: 976503 - protein, 313 aa, Homo sapiens
CALKKGNWVQTHCVAAYLLSVKDNPVQSSSVTDCGSRGFTSYWRNSCVVRFRNTCWMNRLRVKFGGHRSRVDKMYAKGVLEALGEEFFTVGNVKARWVVCREELGFDSGFIDRVSEDIYEWKSIKMLVYTLYCLVFTWPMFVSVCPGGLNIKLGSFVLLKSKQGIPTFFEWVQTLIFLEKPFCVFGTQQHNAGGGGSTKTNTFFFAFFCSQHTPIQTHAVFFFSHNRGRGGGGNNPTYNQKTTSLLLFSFLVPAHSTRRGTGGGPLPFHHSNLKPAHATRIQRYDRSVGPTPTDRHDGRTQFIAGEAHTTTHQ

SEQ ID NO: 976504 - protein, 183 aa, Homo sapiens
MVNPTVFIADYCRSTASPLAESPCGAVCRSGPRDGRKFSCSEQLEENGIWLIRVPAFITNNSKVHCVRVVIVHNAISVDWWQRSIYGEKFGTDENFIQSIRVLHLVHGQYVGPNSRMVPSSPIVHCKDMSGGWPAVWVLGKVIEGMRIVEAWALVGPWNGNEQQEDHHVLTVALDLSGLCVES

SEQ ID NO: 976505 - protein, 82 aa, Homo sapiens
CRDMMVDVDTILGCPSPVNVTFWHKCNIHTLVMSTGNANSCYLLRFAIQIDSRLMSLQWAHTSETDSLYVQRGICGPTGAIG

SEQ ID NO: 976506 - protein, 108 aa, Homo sapiens
MGEENARVAPWMSLTLHDQANFPRGGSPKQPVRGYYRGAVGGTFDRLHNAHKVLLSCRVHPGQEQLVVGVADKDLLKSNVAALSCSNLIQNVWNHLSEFLVDIRKSPP

SEQ ID NO: 976507 - protein, 179 aa, Homo sapiens
MHRSATTDKQKRSKTKKKAPETKRPQYRRGSSPIKTRAKVAEDARTTSKDNASVMYDNNTGGEETRDQLVYEARDCRYTHKTRGGERSQSNKSTARENGSGSEHMRPTLTEIARQTNQTSASRVKSRARWWVSRKKEKHRETNTDREEDVWCGKVDALLVASNGSSRRDRTARVGGQDT

SEQ ID NO: 976508 - protein, 283 aa, Homo sapiens
RWLTPVIPALREAKRREDSLSPGVRDLPGQYSETPFSMKKGNKKTQKDKKKNKKKKKKFLCAAALGLPEKCFKNLLRCGRRGGAHKEVERSTRVAPQRVAPQRENTVVAKEKRGARGLLTHTIKKSAAAGGRPTRERGSLARQNLPEKGESTEEEGATNRGDASKQQQRGGSKKRETAQDYPQNLTPAKHPHTCGGGGEKREKKQIKKKERTGHGQAEKEDRETRDTNTDHQNERKDGESRDDGSDSAETTKTKRKRDNGAQHPNATQTPTEKDKRKPQQKRN

SEQ ID NO: 976509 - protein, 133 aa, Homo sapiens
MRGLGGERETTYTKKATRDKRKQKKKRARVPPPPVGVRGGVTKKKHKSRDPQAEKKERAGGGGAPRNLMCYFSMKRRQQKDSKDDETAQGGPATRQRDEKQRRQGGRRESEETTKPSTYINSNSLEHDIRATQ

SEQ ID NO: 976510 - protein, 82 aa, Homo sapiens
CCTAAKNKLNQVVMIEDLSKKMRGRGKWNEIEDNTPEPVAESSENSLKDPNATDTKCNSADGPCDDNKDEYQSQMSLEWAHI

SEQ ID NO: 976511 - protein, 269 aa, Homo sapiens
MSRVDPQPALERGLGAAGRRPQMGSEGKAAGPLSGGGPGFDGPGGAEENLGGPHSPGVARVTRPGGFPGGRAAAIFARGHLLGGPALAFLGAGPRGDTPLGLGVGVVAPRRTCLGDPGGGLEFPAGIRRGGPPFCHRGRLSRAQGRGAHLWMALGPPWVPYCAGGLFVALYVYTGAPGHPTMVLIRGKKASLKWELRPTGGAGFRAREMTKGPGTLGGAERGWALRGDRTRRLRALEGLMGPFPKTDILTGRIRMWATGGPRRPLDRHM

SEQ ID NO: 976512 - protein, 152 aa, Homo sapiens
LRATYHRLLDKVELMLPEKLRALYNHPAGPRTVFFWAPIMQMGRAVCCMLNGQICRTHLAQLTLLSDGYRVYPSRYSLVIIPKNGVCRCQLSCGGSRSLSASRIGDITKNYTAKATPNTTSSLIHPEPTLDGWDKTHVDPSSIIRPMITRTR

SEQ ID NO: 976513 - protein, 241 aa, Homo sapiens
TPAQHGCFRDCSLHRCPEAALQRSRCGRPPSADYSSDCLPAPIGYGPFTELPDCQYADGALFPPMKGQFRKKRSDRGRLVVAKKGVGIWGVHRGNVGTVVLFTKAWGRLQGPGKKMFGRGKNPRGKAGGTNWLFKTPKRGVSPSGKGSTPNFFPRGFQFKRTGPNRCACTFPFFSLSKEELHQYRTALINNITQQCCVGVGGRADLVTPRGGEKSFFDEEHTMLVVVWGARKPGPPIVCGV

SEQ ID NO: 976514 - protein, 254 aa, Homo sapiens
MTYTYRTTQVPTIQPHYLNTYRIKHSPLHHTHIHNINHHTLLNKPHFPQLNSKPQLKTTIDKNYITINKTTHKISINIQLSDDFTLNLSNTNTPYQPETQPNINNHTNPNERNIINDITKNKTQIQTYQHNQLKSNHKNIHINKSTQHTNTIKLLLEHSIQPIYTIYLTEQATPPEPPSGPTPIHNNIRSSRPRPRYQRRSRVKQHTLQVRVTPTRTAYQSDYAIRRYHVIRPSLSTAHSPLVLPLGCTAGAIK

SEQ ID NO: 976515 - protein, 123 aa, Homo sapiens
AVFVFPRLFPPGRSAEDACSMPMEIKPEDAEQKWLVTGAGGGLGPGAQGVGPAFREWRTVGMWGAAWAKRKREGSSGEAFRVGPKSASVPIWTDPTCGLLAYVGTGVSYFTPPLFTNRVAPHP

SEQ ID NO: 976516 - protein, 113 aa, Homo sapiens
GGAEVAVSQNHATVLQPGNKSENFKKKKKKRRTDEGEDTNRKKKNEEEEDTKKKKNEEDRTNERRTTGERKHERRRRTDDGTNETGRKKQASTQHKQQKQQKHTKVWGGAHPP

SEQ ID NO: 976517 - protein, 72 aa, Homo sapiens
MFCLVRCWVPSVKCQGTLRGNNLKGAQGRIKLVGVWETLGLKLGLQKDGDFDPGSNLVSLKGLVQEQRLVDD

SEQ ID NO: 976518 - protein, 281 aa, Homo sapiens
SARCAPLSPEQRPLALPTQPLADLRYPLLPASLAASTCSQTCTACNERPAPCLCTTARPPPPPPARTGPPWLAHGAAPHPLPSTSPAHPNLNLPTELPTLRPHTPPKPPPRPPHRPPDPPPLAPPPTPAPHAPPPPPAPPPPPAPPRPHTHLLTRHPRTLAPSPALPPTSPPPPPPPPPPAPPPTTSPRHPQHSHPLDPPTHPTSPHPPPPHPHPPPPPPLPLSHPPRPPPAPPAAPPPPPPPPPPPPAAHPPPPPPPAPPPPPPPPPAPPPPPPRPPPPP

SEQ ID NO: 976519 - protein, 123 aa, Homo sapiens
HINRQDVGGAAATVRAPGRLWSGVGASGGPDPCDPQRWCHRVINNSFYYQTNTFSASASDSLSPVILVHAFVCACDNFKEPRLSTQDRRAFGLKAGRPICALAYIKTRSSGHKASHGKCLGIP

SEQ ID NO: 976520 - protein, 145 aa, Homo sapiens
GSSHGGHEFVAAGFRLPAVASSCLGLAPFGHFCLGILRGFPNSAFLKAACSLFPGQTKRVWGAPQGGKNPPQKSLCGGAGRGTHTHPHQKQHQGGTKKPVFLQNTFFQQQREGGDTLSNAPQLSFFSHPQNKRRGGEKKKTYHTM

SEQ ID NO: 976521 - protein, 123 aa, Homo sapiens
ETFFCRDVVGVSCFNMCLDGTLALCSPTPVPGRPKPCPPVLFTCTLGLAPEAPAGRFQRRAADHLAGLAAGHSPFRSPCHLTGEIRVYNLFGKVLPAQREILTPDPKGAPFHKGKWGGHLWPT

SEQ ID NO: 976522 - protein, 239 aa, Homo sapiens
MSTAISRSPGHRVTQRCKGLGSLLQPLFGPSVLLILGPCSIGRCDKSCPGLGQAQCAGGKTLFMAPEYWQVGPNISPCVPVVTLWIPHPVVTKSSGPFFLCRTKVVYHQKNLHTKSVFNNPRWGEVCVAPNPKFAGEKNGGGADTNNVVGSPPPVVGIDKKKQRGPPPPRKILWWEGDNQKEERTKDNGQAESLYFFWWRQHHQKVIVTCTHKIPCMDSFLVAEKKPKRQSPPSDDTAL

SEQ ID NO: 976523 - protein, 110 aa, Homo sapiens
MRLERGERNNTPQGMSRCIGVGYPERSQFWFDYRSGTWLCVPHIGKKASYPWPGSCDNLIGLIVHHGGHQRLSWTTVATPHKDFGDDTRLVFSPKVRLRNIALRGQTRNI

SEQ ID NO: 976524 - protein, 128 aa, Homo sapiens
VDPAAVQMSCSWFSGVYGKGLLAPHRYKGLACGSPLIGYVVDLIDWRCKGGQKHVAQTRWADLKSALVFITFTYGFSPVLKTLTESVSTDTIYAMSVFMLLGHLIFFDYGPMLCPNWWVNFPKEQNNL

SEQ ID NO: 976525 - protein, 105 aa, Homo sapiens
FSQRIRLQQQVDLGFSRALETPGSQVSEGHLPFPLVTLFGEETPSKALSRTPKVLGPFSGSSFTSTLYFSVIPWALNQRKTGRIQHYFCTHLQIFYLKTQKNKKH

SEQ ID NO: 976526 - protein, 69 aa, Homo sapiens
ELITFHSTFQCCGPRKLREQVQLHAQRSLSKRKPTQKRATNFVAPNFSRENFGETTPNFFSGQQGENPQ

SEQ ID NO: 976527 - protein, 165 aa, Homo sapiens
SVWKAAVQTFNGYYYENKKNKKKKTFVGLLRRKKFSNPFCGGAGPKGKETSGHNGVPQRTPGAQSTKWGGEFSHTNDKNNTAGRDNPERGFLTTISQLGLLRRRQTGGTLTQQERGTRGRPSIQKINGPSYSGKKHDDTKQQRRAKSNHTATDSRRMRINNRTDQ

SEQ ID NO: 976528 - protein, 135 aa, Homo sapiens
GENGSDGGWAEWVSGAGVGLRLCGDCASSGVCFGAEFSSEACRELGFSSKLCLCSSGDLLGQFNPASVWILMCRGCLSGGSTIVKPKKLYAGAILEVVDEQWGRFPQVQALLGVINQMFRGLQNQCNVRGLRPVY

SEQ ID NO: 976529 - protein, 105 aa, Homo sapiens
MTSLQGAGEPVAAFGGLPGYQKWLWSDFYLRYFRRAQGHVGHEFLESNFGRTESLDMPNNSNYKHDVMIRTQRLMCKECIGRLTADLWIDGDITKQKMMLVGPPP

SEQ ID NO: 976530 - protein, 287 aa, Homo sapiens
GFLPPLSEPDCNLGRIPDSLLYGVAPVLLGRKLARCEHRSISSLGRGSCAIHGLEHSCSQSWSNYADVVIALVTEHVPLITGRHTSFGRHMGHPQDTIHTHPFITDGTMCEIEQNVGNTHSLLGRGPVCEHCPFPSGQGPFICFTLGPKGSRGCKLTRCTREKLHPFVSGQHKGGPPRAGVTKSRPSLHTGPPTLRYATTGSCTRRNPGWPPPRRAASSPKHDGPGRTTLVDGKTWEITPRGRRKTGHEEHSPMSIPQIRKWNQTRDTPRMDKKGTMNETWTGTVNT

SEQ ID NO: 976531 - protein, 283 aa, Homo sapiens
GRPHPLISKQGRCGVHHAFHLPQCFLRFSLEKSSLSSVAMDPKCPATVVSPATALVLQVERLQLQPLARRAVAPVAPWVGTQVCPGGCVRKGASAMCSDADDARTTFTHPDVNRGELVQTRGFYMIYNYPTWTHCANITYSLVNILVHLEYVQPSCSTVKKSNIYMIEQTPVMATMRRRQTMFRHQTNGARAPNVRTNGKLATSWCTRRTAWRRQHKGDGLLDHNKNAPWAHPAVLETQHTGDELRHKTCINDAAIQRSDKNPASGCRDDTQRHERRSRQPGQ

SEQ ID NO: 976532 - protein, 175 aa, Homo sapiens
MRVKQNESRQKDRAKKNPASWVGGKKSTTQQRKPQKSTQQKKKQQRNTNTSKRRNNKTTEEERKQRATGADEERGGGTGRRKGQRHEKRRRASAGKRERSANEESTERVKRGDKRTERNQYYGQRKRKRSKREQQASPSRRDERPERQGEPTGQDGQKETKTEREATRQEESRSA

SEQ ID NO: 976533 - protein, 123 aa, Homo sapiens
QTICEHLQYLCTLCKTVIGDTLIHQDLLKPWAWTTGQQEDAQECSTALYVSIGQILVSKQKNPDVRNMSQQQFCGRICLCNCCATSVAESLSFRQNFYELELNIQGHKQLTDGISEFSTAEQV

SEQ ID NO: 976534 - protein, 146 aa, Homo sapiens
RSLPSPRSQRGLWTGDPAAGRSMGRFRGGPAGASSTLLVGFNLALLAGWIGRHCFWDYGPVRRCIQAVLHQEDNVPRVFPMWGCMSWFEPGPDDWPGGGFLRNCCGAHCRKVANCVAWGLTLLTLPSWVNICVADRYPLEGYCAIN

SEQ ID NO: 976535 - protein, 169 aa, Homo sapiens
CSRCAEKNPGPSTRVWVRGPRSARGLPAEVSARAGHRNHVVGPPAPAVFTFEADENENITVLTGHPVFGKHVIDRLRNPLHLFEVSVVSWCLWCLKFLNDRLDTKQEYAEELALDASQERIQKIRKRLKQGQKSLDRERACCPIEQLNPGANPFRRAGLIVRRGGEKGA

SEQ ID NO: 976536 - protein, 70 aa, Homo sapiens
AVSRIAGVLAIRPESSVFATAWWPTETGCLSYIRYSQICAKAVERCTEDQNSKQMLRRLLGSNRNTLVTT

SEQ ID NO: 976537 - protein, 73 aa, Homo sapiens
SLLSSGARVARAGSGKGRGVYREQCSIVPRGPDSGEAASGLLPFTFLSWEDTAAGRVTAANPLGKGNLADYKD

SEQ ID NO: 976538 - protein, 67 aa, Homo sapiens
GSRRLPSSPRILRSEPVRTPPIPSVLSFENTRRSKCHCDLVFTYGAKSPCQCLARRGFCTQIALESQ

SEQ ID NO: 976539 - protein, 117 aa, Homo sapiens
GRRLLAARRRRVLSSAEGTMFLTALLWRVTFSRPSVDSGSTGGRVRVVAAQAETSSGAWEIEAENHYLLSIALIDPGEQGCGGQPAGGCAKRARPFGEKVFLRTQFLFGVPRCPRYG

SEQ ID NO: 976540 - protein, 111 aa, Homo sapiens
MCQVSLVGKLMCALAQDAHSSRTRKRTKVKILARTSGTTCALLSNLLPTTQETTLCKLTIFIVDLVAGKYTSNKPSSDRGEELANTSHSIVQAAFKILLKWHLVRLLRPGS

SEQ ID NO: 976541 - protein, 120 aa, Homo sapiens
EEGPSAQQSAILHCYPGSPAGYRAAPCIFPPRRQELRLMAEVTGEGAAADANPVEIETQRTPVRLRFGLHQAPSHLGQWTPSPGSPWEWPGTGVRIHRIMSPVPSWNHRPKYFQNEWPHY

SEQ ID NO: 976542 - protein, 85 aa, Homo sapiens
VDRRKLAWAGALVGPLIVYLPCAEYQHSLIMTYVDHGFCPKLINALRVITSCSLEKVHDLVVSLAGRAYIALESVEPKSPTRSML

SEQ ID NO: 976543 - protein, 170 aa, Homo sapiens
MAGRDHKEREQLEQLVIHRVPQEETPLWQHQQLWLELHHPHYNKKRAEGDHTNRSMRTKDHNRWSNGADTRAPPEAHTNTPENQKYPPPGEQMPHTGRHDIQRRNHRRTQQNPKTLSARPEGMTEKSHVRNSKTTKHEVRNYDTETVTQESDEREATNTTHTDETQRTRR

SEQ ID NO: 976544 - protein, 155 aa, Homo sapiens
MRSGALLATQREVEQRRAGTQKSACRPTKKAAREREERRRRERRSDKTVRRAKNKESKTERNAHAHDRRNSTERQRRRTNSATHTTPHPYDQANRRSSQHTATNADTSRSRPHQHTTQSEISASDHVHIRLLHGATRPTPKTRYDRTHRPTLPVS

SEQ ID NO: 976545 - protein, 302 aa, Homo sapiens
DTEPRWDPHRSARPGAQEAHEEPGSAGTSGGPPRRRRSRDPWGHISRVAVTRPGHSGVGAQFAMGDFLDARPWLLSGLQGTPDWLALVPFAGRPGAAEGGEGSRPEFGPGPGALFAPTPVWHWLGGPGVSRGPNFGDAFGPPVVPLKVARRAVRLPLLFVLRWGLVPFRPSGWLVPWYKRAILHWEVPLCPPRVGPFWLFVAPRELLPQRALGAPSGVFSGPGLAGLLTMLAREARASCGGVPGARGLGSVVPLFLKRSGNHALTGGRDNAAEVVGGPLAGLSRGGLPSSRVLSLSGREAFA

SEQ ID NO: 976546 - protein, 109 aa, Homo sapiens
MHTHQTPQTAFSSIAHITRDVNYGCIIRYFTPMAPQYSLSASSYTSGEAYITDHFSTQKPETSDFLLLANYNNSLHRLCPPVRPNIILRGHSITNYYQHPIHWDKDLVT

SEQ ID NO: 976547 - protein, 362 aa, Homo sapiens
IKIRRKRLRRNLQTCMHACGSIKQAVVQVMNLEFSTKCRQHTVSIRACIAHCKAHLRSETHIKPVPRCEFSRSLASRWASKQEVMHSIMLHRTGKSTSDIMYPQKVATAIKCLFTIFHGYSSGQVRRNLIQPPIIDYQSLFSNQSPPTKNTIAHSTHASGYSREEPEQHCRASPLWALDGDYWVIGLHNFHAHGLRNWCCYNCTATQLRSVLHVLRPVMELASMNLGTLLPVTTTTRWPMPVKHGWPLLMPWHSQYWSNLGQGHRTFHGANNVPKHRVSPMSGHIRTTPARNTPSAQGRPPRQQRRTRERVAPKSDEGHPVTIPPRGEITLPKAKRASTKWPSGQHATIHPHNHNNQAGACH

SEQ ID NO: 976548 - protein, 54 aa, Homo sapiens
MLDNKEDRPQGVKHTRLLLLDDTCNTQHNTCGRAQRFTPGGATETARPTRTQGP

SEQ ID NO: 976549 - protein, 120 aa, Homo sapiens
MISLGPILWRCHVPFTFGESRLMCLGGLDRTWLLGFCEGFISPPFGRGFSISCRSGVHVGSAKLVCAGIDITRNRVLKVRDWVASAGGFALKQVWPHGGHNGEPRRLGCKGGKLFTNVPS

SEQ ID NO: 976550 - protein, 266 aa, Homo sapiens
AQHGGRSQSRRTAQFLQNVKCHEILCKLSWEGDQSTPPSAYGAVKAYTNFDAERDAWNMKLAIKTKVWMRSPLSAFGPTAVMLRGTGYGLSATREGSKREVASGPEVSLIWHAGDVILGYEGHLLEYDASELKASHDGAVNREHSLIGIICSRTNQELRNLQHESTGLYKTDPETGRPLRTHLVTSAQLVVALQPGEPAEDGPAVVTDGMARRPGLMTRSAEEAWFPRWSDSDRGVPLKSLRTNERKWGPGQLGRTLTRGKTVGGS

SEQ ID NO: 976551 - protein, 211 aa, Homo sapiens
GKWIRVERSREMQMIDLQTGTPWESVTFTALGTDRKVFFNILEEARELALQQEEGKTVMYTAVGSEWRPLCYPRRGDHLNSVVYNQGLADRMCQRRPGIHRSPQVVTLTEAFLTECGYLLNGPPGLRKEQFYHSPGLGRTGSTASACGASTDSSLLLMTVINHLCGGARSKSLYSWRMWMLFLSRDLVVENQYSTKARSLTFRWTVNALDG

SEQ ID NO: 976552 - protein, 278 aa, Homo sapiens
MGKVDLVPKGVSPKERPGRPRDKAWLGFPPQDIKTRRRGNTRTRFCRNNLPEMGALGRHITGEPIHNRESTQRAAPTILQTLTPLPSSRTHTQHTTQQHPHTQNSPTLHPTHQPHTHTHITTITDTRHTNPTNTHTDSNQEHTTAATATKHNSHNTNDPQTTHHTTTKTPITINRQQPPTPRALTSRPPALPPTASQPLPPRRQPHHRTTPRQSHKYSTHTGYSERHGEASRRTPDQPTARKMGGTHQCKRAHRNNKEADTGEAPHDDKNRRPNTQRT

SEQ ID NO: 976553 - protein, 128 aa, Homo sapiens
AVLRPEWPSPPPPGRWPRRRLDPDPAKWRCDVVQRACAGPALNLRGVPVTRPEPCPLRPWTRSGVWAPSRYGCRSDPLCSRCVNSTEKTPMWVHPPKMGIGQPAGDTSRQLFVHPATPLGQRLVGPPG

SEQ ID NO: 976554 - protein, 165 aa, Homo sapiens
GPGAAAVLRASSPPQRIMLQFLLGFTLGNVWEGIWLRTMIYQTVVKKKKKKKKKKYFFGRGLGAQRKKVFKTQFVFGGRGAQCWYRCQTGATHGGGPKEGDTGGSTGTRGCVGTSHHPKLKKRARGNTPPRRCFDENNHRKMGLREATQRGTSHKGGVTREGTNL

SEQ ID NO: 976555 - protein, 168 aa, Homo sapiens
MCLRFGCCAINEADEKNIPGCVCITDGSDQQDMVRVSTNAAQERHAMGANAVSHQPWRCNMDIMPGIIHKKGRMHCGQICTLTNEQFPQTTQLDRAACGGGMEVTFMHPIYGCPNHWKIWPKAYMVGLRYATQGRFEPIRQPGVPGKPRKGAAQGGKNSKGVSRPTVG

SEQ ID NO: 976556 - protein, 231 aa, Homo sapiens
EKARRGSAVCSGAVGPVRIVSCWFAAGKSGERVGIFVGIPAKDVVRAMRVVTRMVLKRFMPPSETIWDLAIGQAARLWVMKRANTKSSSDLCGARDRKEHTGRLVIGRSEIKISLPNRGKKDKNITEELSLQYQQSMDQYIITEDIGILWTWFSEVEDHDGEGDVVEMMMMTMIDSRDPERFQMIPEREFRSQEEAKSLVEETPCLLRPLIEVEGSKNNTAVKSDYKMDVW

SEQ ID NO: 976557 - protein, 113 aa, Homo sapiens
MGTNDRMYRRLECWSSVRRIYSESDLEDESRVSCKEYVVQAEKPCEVLKQKRLYEAALRNEIVCSQRSHVNQWCQAIVYHPVFERKSMTSVDAMKLGVKGNDEGHTSKVRIDQ

SEQ ID NO: 976558 - protein, 89 aa, Homo sapiens
ISPVSEPVIYSSICAGALITALKTRDDPVSEEGLRTITMLGASSTCWASSYTFVPRKLHHRVSSLHSIQIYNPSNSYPLQQYTLRTNEP

SEQ ID NO: 976559 - protein, 147 aa, Homo sapiens
LCGVVKRGLGRRAGAEGLPWGGGRSRAPGPSSRRSSQGLCTTGSRAGPSAGAAQVTASSFGGRGLGQPCAAFGDLNSESRGSSSCCGKRNDFNRLFRPECTLFENPKSKVSFKESQCWITSVVPGDYDGDSQMDVLLTYLPKIYGQE

SEQ ID NO: 976560 - protein, 145 aa, Homo sapiens
MVQKALFLGGWNPGASKRNRRGPEPCGSQLSRRHPGHKNGPNMWEAFGKKTQGFVGIGEYIWPFNRVAGLFRSHPSLHLHAHPVAHPVFWTRGSGALPIPFIIRISFKQLRGNSQFTHCAPSRLHGRPGRHSGAIHGVNGVGTCR

SEQ ID NO: 976561 - protein, 250 aa, Homo sapiens
AGEEGTAAQEDCADEEVAESWDEAADSGQEIQISSQSAHCDFRTIRLPAGPPSKDPAYLKRPTQQTDVVTQDPNPHQTGPTPIPGQRPIDNKRKKRQKLHAQKGPRKAQDSIGSQASPKTPRKTGAPRGEKPTNPLPNRRPKTPRATIRTKSTRTSTQAEVERPPNTKLAQPPRNTSTITGRIPSALQAYIKKGPLCRKNHSQDLATYTPPAKETTTQTHTNNARDRRKLRIRRRNQTTDHIRLRRIRIR

SEQ ID NO: 976562 - protein, 326 aa, Homo sapiens
TARPRPPRSTELAFADPPPSTPAAVTMDDDIAALVVERLRHVQRPVRGRDAPRAVFPLHRGRAPGHQAVMAGHGSQRILCGDERPRAQTRHPHPESYRNSEHGSFNPTWGRHGSKHLAPQHFLTMRLLVVAYPKERNHRWLIDTGGPTLNPKGQPGEHDDPRSLFGTFNNPKPCTFSYYNGQSISPVRPSGRHPPGIVDATSRREREAPKQRCQYYKGNASPNANHAAWDVVARTLTDPSGRSHRSGTGQHTDERKMGVTEQSGDRPHFRNMQEVSTRKAAAEQHPCRRRARPSPRSEGTTHMRSTKPSGPLTENTQHTAHNPHAW

SEQ ID NO: 976563 - protein, 413 aa, Homo sapiens
MMTDWLLEAKTISGQKRPSRSTKTGRIDRARYTTIDSGFRDVMAHNITLPAIVTPKRSILATQGTITHHSTSGTRGTYAQWVEHQQRTAHGTQPYRVRHFRVQHVEPQQDRHTENNNRPHPMRYNPPDQHNRPPKKMGTQRTPWNCWSTGHRTNSNQRALEATKTETTQHAPPATLNPTRRTNQQRGPKGQAKTRPTGGSTTPTPTCPTKKGVPQHKSITKEPGRTLSSNPNQTPTTHNKSTPAQMGHRSKQKHKEKHQFHTHSSTYEKEHNMNPKVRGAKRAQNDNPKTRQKQNPPTPVSYKCNIRTPTQLLPTTHINIGTTLTDKHYNNPMKIAYNKQPRKDMMNVDPRTLCENPTEPHKNNKKSLNHSTITERIHHTQRNKRTTIVHTLREQYDMHKIHRTISNIGTKTT

SEQ ID NO: 976564 - protein, 179 aa, Homo sapiens
RRDVRRPVLLTCSETGAASLLRAGPGSSGSDPTVIQSVRERRGALYRSPMNQREPFQHIQWALCPTGPNTHLIHHNKWCPGTYGGDHYPTPQWCNPLPRDTHKYGWRRGWPSGKPPKTTSVFVVEDQKKGDDARDPSHVPTKACWTGSLLLRGLVGEHAHLNQTAPRRSLSCKLLVANL

SEQ ID NO: 976565 - protein, 127 aa, Homo sapiens
MGESPYKFGHAQTFEPGRKFFSLIFGTMPKLNKSPEDRRPFINSGWTCVRYFQQDCRTGTPWGGDLGHVHYQGRDGLAPQRKYLREEGQFPQAIPKARNWTAHGLGTGRKRGHVGGRTSWLSPSVRV

SEQ ID NO: 976566 - protein, 291 aa, Homo sapiens
GGRDRGPVTPHAELCDVAACGRTARQPGRPGLPLPCRRGNGNICPSAGRPMCVRQTWAPFRGLPGQDPSRCVPREDKGSREYGRGPTSRGQTLGGAHLGVTWNLCGNFWLREARHGWGVKGVHGARNFLGPFQGKKRVITAVAPPRLVPIGEGWSTGDWGGTGVITLLPRKCVGEKVGGWQTRLWWRTAGNFLSLSRLCKPNNGVTFPKVGRCQAEVGPERDLLKAKSATRSNAWKIRERSIKNTLRERQEPTLEERGAHCGDTTRLVLRYLGGLHGEAFPAWDGLPKEDD

SEQ ID NO: 976567 - protein, 209 aa, Homo sapiens
ERKTVKDTRLGGTVRTPARQDPTWAWRMERGLQDSGAGRHGARRPARPRLTTIYHIATRQQPGNSYNSLLDMSNTMDTLVLSHYSTRVGLPKEALPTLSTAAPFRPSTRPALRRRSWLWAPEALRSVHTEQRQLACALLPRELLFQVRWYPNDLQKMAWPLALPPCATDELHRWYETVIFGNRPIWPFRERNNIWVTPPKGKHLFWRHA

SEQ ID NO: 976568 - protein, 343 aa, Homo sapiens
AEGESAGRAGESEEGAGQRDARETQARAARKGSGRGHFDRCRQRQTSCGCAYSDPASKDNRQVVSAGGWSQQKNVHHKTVQGLAKTTGKSYHHGGAGMIRGVNIQKRGPPHKVQANWPGEGSTPGVIFGPARTVTYVAKADTSWQTGMDKSQDEAYQPQERDRVHNTEQQSVRLGAQAAGTKVDITPGQTAEHTNKHKGGEHVIHPKQVHTPEVRRRTARGDLTTQRLASPTLTTAHHQRPKHWQSYHTRRQKRLLSKQQAGRSDTGTRQLHARALAGRNDSQGGRQTVGDTRPNATTAVRTRRLFQAQRRRYTVTQNSADRGERIQPNSDCLERLNANTATS

SEQ ID NO: 976569 - protein, 299 aa, Homo sapiens
MVRSEASDKSGRVPHAGDLPDAETPRAPACYTVQKCGVSRDGYIRAELLGESYTAGLTTPPGDHHRNKSHIARKHQHSAIPHQNTKLIYDPKHFSHSISRVYKVHYHTLQLPSNTRRLTHHLFVLGPTRDTTLSVSFTFFVPIAHRSLPSSTTPGDHGGSGPQLQTNSHRGSHCAHFVLETADLTLPLGKHNKVHSWPRNPHGCVNLFPNQSGVGIFLHRINTFPTPLDLDHPLGPVRDINRLLGQFLWGSNSCQQSTLWHNTHLWITKTSLLHQSAHWNRLHIGRHMAPSTSHNHMRI

SEQ ID NO: 976570 - protein, 83 aa, Homo sapiens
VAEEPEEEGGEVVVTERSLVTGWWAQMGVVEEICNPNGAKFVPAKFKKLRGARKNSAHSLHEETLAPKESYDYLKTLVVMSYV

SEQ ID NO: 976571 - protein, 69 aa, Homo sapiens
QATVAAPEQRKGFNVFSSDDKSSDMKSKQLLIIVVIRVGCNSVMSLKQVGFYETGCVFFSTSLLELLLT

SEQ ID NO: 976572 - protein, 258 aa, Homo sapiens
ASTGTRDLRREFPLCRFLITITFQTINIAAVVFTGHSMCSSPVALSDADVHKARSQQYAWLSMATKKPNGEKQEANEMHKAEASSSNKQQQGRASWHTPPKGINSIQWGQSSMASNSHPAAATAAFGRPARQGTTPKYAPKLGTARPSGAIHTDSSLSAGHTTYWTSVTSHARTPLRPNLAECQKHPRTTFPGHTAASGVTQRIHHTQGSHKVAWDWGNGELGVYLTRRDYRDQPRIWACGRTLESGIWDQDWTGNNQ

SEQ ID NO: 976573 - protein, 455 aa, Homo sapiens
IPHLAGFSFTGGSTAQPSGFTIGSAGQFSPAHGTCHVALHSGQASQPTTAVCHKASWHPNTHSPPYNSTGPSLLASNSNWLTTYIWPPLGSSETPFTLHSRFHTPDPTRTYPQQCSHFARQFLTTDAQIAHRTLQPARQLSRLSIYHPSAHYTHTCGTSRPPSLLIFTLYIQHTTRRNVHYTIVHTDPRQAHSPLTHPHFTHHHYTPTLCAPTLVRTTTPLTLSHYQLTTSNVPTHIPTPPPTPRLSTNSWTTTPKTTTLPLRTAPNNKCYQYHQIPPPILYPRHTHNPHHLDDHLPTYNTHNQHTIAAPPAASPHTQSTDTHTFSTSSTPFNTSTRPSEQITTERDNTSHNTSLVYPLPQLHHSNHDDDFTLNSPTVCNTHRINPIYATPHAHTRLPHIVHHSQHKNLYHTTHHTTGAPIPTHITLLYYTPTQPARTTSHTEHQDDDHTQYNYI

SEQ ID NO: 976574 - protein, 215 aa, Homo sapiens
VVYGICLDSLLVVEMPRSAGSCIIRELTEKAREESSPLHRVRGDAAREWPSGTQCRAGIRTSSTVPRSWLTESDGWLGRHDKARDQGICDFERQWLYTSPGRNGVFLIECSEMPCTTNVIADELGHLQTSHGVGSRHASAMRERHYTQQTHLTSPNARLSTRSKAYLMAPYLLPSEDHTLRDYCGPVYDDTDFAPTVDHHGTTPWSRNGIQNGDL

SEQ ID NO: 976575 - protein, 294 aa, Homo sapiens
MDYKRLQAMTRVDWFRDDGRQDETTRTNINTLKDKTATCHRTHHPKQYTTEDTDDAVRHMTLNTSSQNNQDYKARQSRTNQNNTYQDIEPEDTPQRSATNGHHTTPTRTNQTTTHIGTNTIPTEHPDTAGPHAPPDEPQQHDRNNGNKRQPNTNHLHTPQPKHEHNKQRKGPSTTTERNTQHKHPRPEPHYPQHTEAKNNKTQLRLAHQTSPPQKGKKPRHETHTEQLQNKNTRRTRDTETQPTPTRNNNTRGTKKEKEKKYTHRDTQNKHKTNNTKRTNKTNPRTNRKHTPTT

SEQ ID NO: 976576 - protein, 313 aa, Homo sapiens
ASKRAPSSPVAKPGPVKTLTREEKQEEKTEFLEKLRLREVSNEASQAGPWCCVCCPPTGTSKTFLKHWNGCCNEWLLKQQTLMAPEKPLVISQTGFQQRSPKLSSTNKNTRPRLTLKGRGDAGRKRPGGQHGRSVPSGFQDGQEGASTSHQGQWTHAHNKKGTKDRTNADIDPERTGHRSITQAAKLKDAPPPAPTHRATRHLRSDRPLRTHPRILPTTATTRPTHAANNSRANTPGPPATRTPYTPHPRDQTPPSAGPYTSPTPCPVSLLAGPPHEPPPPPPLSPRVPPPHLALPLSAPPPPPSPPPRPSSP

SEQ ID NO: 976577 - protein, 290 aa, Homo sapiens
MQERQQRRRQRRTGRTARRAQTQHIAREVGKHAQNSKLTRGSKNDRSGKKQGNTTQTQHDQQDEKRKTRRQKSTTNERRHNARHQKGKRTNTNTHSNQHNDNTSHQREPHQWRKQNTPNDRTMRTTLEEKDKKKQKRHSDRNTNIKLTHDTLNDHENIDNRIYSKQQTYTNKTTNIPEQHNLEHYRRQDGPHPHDTTQNYTVRIRWTQKSYARERPDDAEKKRQQTEPWKTARKERQTYQSESTKTETISETQNKNNNQRRQSLVVQSQTHTEETDRHTQRPLHEKEQTR

SEQ ID NO: 976578 - protein, 508 aa, Homo sapiens
MAIRAQVKRAGISFKASPSNTKGPSSADAKRPGRHSSLHIPLGRPGDLPPGGCTGATHVLVGRVAWGRKRMWINDMRYHKLTLFGGANTGQHKEADLYGCPGDQKCHVRNMCPRGVQHASGRRHRRGWRQHCAPLKGPVRDKFSLEKQGSPLTKAPFTLGGQPYVVGRLFLSIRAWGATKQGSKRGGRAQCHNTNLRVRDSAGKNKNNSHNNMRHFQKPPRDIFSPHMISKHTRSNSLCRLLHQQRCYQVRAGAHTQGVHQQKNIIYAGTHIFLTTTRCRQTGIGKICEGPPRYILPRPLLTIRTPREGHPPLSSKEGQYIMTYTHKTKQRQIKRRELTNGGSPQETSDIKVAPKKAHKEGGVEDKILALHETTSSFGGEEDVSTSNLEDHTTTHTDQTKNAETSGKHQGVHNSTPPKRTTQKPTNNGASHNHHSREKRRDKDPHLLNDTESKKPQQYEEHTYYGTEGERPKEATLANVKPQNDQTGAHDLKNNTKCRTKNTTTYEGL

SEQ ID NO: 976579 - protein, 427 aa, Homo sapiens
MTDDSALVVVVTAWLLTGLRACLVMSVRVVVDNGSWCHDHQWWSGARSSCRVAEERSWGGTIGMARGGLDGQRETEVALDVLGWSSDCCRKRRELWFRVGVAVLCEPFGAYREHGLDITDLAELNPLVSPDGTPVPGRTRESGSHGDSFRRKNPGLCQPRRVQRSTPFTSARPSRAHNVHDGTNPGTGSATHPKNTIQGQTVHIQLGLSTKFYTAWSLKDFQPNTKLLPIGCPDGTIPAVATRFSQFHNNTGRQLATRPLTAKLHRHPRDPPLGTTHPRWPARPHSREQRRRTNDAGQHDTTNTNEPRAQHNQTPNTAQQRKQNTETRHTSGQTQQEDTDKRTPPQRPKKQRNTRRENRDRKPRQTAPGRDETAGQTGQPQRTDGPHKGAQHNREKSRTDAEQHTEREQPPHTRTTPTRPDDARDHA

SEQ ID NO: 976580 - protein, 147 aa, Homo sapiens
CDGVPRRMWRKPSTTSSIWHGVIIARLTWWTVRRLVVYMKSPGDEEATGPSRVLVWMRDATWSGRQYDEKGSVNYEQLHEGMFPCLWGSMVGSLMNPSSWGPEHRVMIIDEYETFVARPCIDPESEPQAIGSVFKSDTMWVDPPINS

SEQ ID NO: 976581 - protein, 314 aa, Homo sapiens
GAVSLEQKLSRLEATAEAGEPGRPGGGSTSTWISCPQRAQCPPCRVPGVTTDVGQTRRHPQRARPKENTKETTSTGHSHNAGSVTQIKHVISNPSRLEQHLRFEEKLQAESMKQAQGIRDQSEGPAPNHVATDTFTTDTLGRNYATQTDCAQHRQQPREPMDCRTRMHANHRTTPSTHQIQIGQKRAKQLAEATSRRANQRAAKDTKERPIPPIATMAMIATAATRRANELGHTQQSEDTDQHGTAARVTPKETREQTKTSPGTLRAKDQQRPHPWDTRNNRHNSNEPRTRQGGPPKPPTTHQFLGGQADTPQR

SEQ ID NO: 976582 - protein, 104 aa, Homo sapiens
EGTVAACGGVPGYLASWRSELRFENNCEIGCFARLSKTYCLVAIGGSEKLLQCVRWASSPIPSPWMQRVVSSDAASSGACVWGTGHASPWYPSNTTDQELQEIT

SEQ ID NO: 976583 - protein, 199 aa, Homo sapiens
ATDDFYDDPCFDSPWLRFFEDLDPRLMHVGALLKPEEHSHFSRWLVHPGPGLHVSDEHVLLLPMRAPPVRASAYCWACKACKRKEHQLPTCRKGATMRERCRLSKVNEAFETLNALHCEQSKTSGLPKVGDPAQKPSAYIDGPAGSAALTGLPVPPVRRQNALLLRRARVTPVLWMASTTAGDSDASRPRSNWSDGMMD

SEQ ID NO: 976584 - protein, 265 aa, Homo sapiens
GPDPRMAWSLDLEYYHSHDAKVQVLPKSALLERLTRSPILVATSSTDRVWGVFRSLGGARTICAARDASLRSPKAACPWRPPPVRPLPAVSWVTGAHVSYDRLLQELNATRGRNDRQMRIIVVSSLRSDANGGFEERHEGRTSRERIHEKESMTLLSSLLSPGLPEGFVRLRPLWRLDETDESHSLTSAFKIDLPALVGQSQPPVCELHEMRARPSATQELDWQGQLDTMLWAAASADLSRGVFPPGKGLCGSAISYCVHLVTVW

SEQ ID NO: 976585 - protein, 170 aa, Homo sapiens
ACSAEERRPARRAMNLLPVTLTDNGLLYAGFNPGPRMLACGMENGFRRHEPPCRVTLTARGCIYAGFNQEHGCFACGMENGFRVYNTDPLKEKEKQEFLEGGDGMFEMLFRCNYLALDGWWKKGEIPPKKVMIWDDLKKKTCYGNRIFYRSRRQSQVREDRTGGGRGLQD

SEQ ID NO: 976586 - protein, 122 aa, Homo sapiens
ALGAGMWNLTPMNSGRVLAACEIAAMFLVNSFLNGGWVAWCAGGGGWGPGWGAWEMCLDVPDHAVGLGCVVVRRMGWRAVQGGGRAWRVWLRCDLCRLLHPLGSQVIMRHQDRRLACASTNA

SEQ ID NO: 976587 - protein, 105 aa, Homo sapiens
MANMGYIFASVPLGMGPIFPGSYRINCPLPPIPERDKFPGNNCFGGFPTKDPSFPPRPDNSGARQEMASWNLRHGFTKLTGLWGWTSVKSASPNGVQGTIVPCGP

SEQ ID NO: 976588 - protein, 487 aa, Homo sapiens
AVNLHHCAPTSTPLRCLPASDVPPVMVVLLPVSVLSTMCLTCECVPTCALATLCRHDLLCYNGATCEICPAYHCLDAWAAHVLNLCCMLPNGAKQLCHFNELADLEILCMLCDDSPWQACLALCVLQWGPAMGNLLTCGVPVPLEHSLALPSWLCRMAGGPSVAPTPPQTPLLAECTPYKFQWGRQCHPCAATVNATCGTCNGGCELNVSFPVDDQYVDAHLDVSRLVPGHSENPAPGTTKRADVGDHRVGGGLGFMAMSLKRAAQFRIVCGRMTHFPHGIWRIYGAECGAIPPIYPTPAKWENWVGHTRPQGRFGKSHPCWLGGKQTFSALFNPTDITTLRRVRALLGLPSHRSPPTLRTTSGTWDQTGPCCDHMRYWEGNTNLAPTSLLEQATNQFTLRRIRGGGKCASYIPPRPVNRFGSLVGHSFSHTSTNRADDERLQTFHFLPDVISRLTDRSSQHSSHKQLSIRQLLLVRDQRRRPDPAG

SEQ ID NO: 976589 - protein, 225 aa, Homo sapiens
MSREGARSQGKGGRIATQGPGRQYRGHPFTSPSLSATSPRYASWESNSSTKNSWAHGGSVHTRGTKGGILKRHPRRDTGAHQGVTHGETPERPTTCERRHHHVMLARPTRVTTSPTEPTPIKPGGHNPQRKRGSRAKAYFPSRSSDGVNPPGRRAATPTRRNAQVRKKQHPHRRGAPHHPQAATRTHRRSKTRDDRPRATDAIGPIRHQPTQQATSRTNIRPAKT

SEQ ID NO: 976590 - protein, 545 aa, Homo sapiens
TKTTNLLSPRGLLLSVTILISMTATLKCYGDYGTVADAATGNLGPSEPLTLDVLTLTTASVASLDQVSYYDWDPSYLTLRCCQGTLLLGYEPAHTLTAPSSTQLTHYDGRPVSLPKRAGATLQEPHRAATHTRANARLLTRADRHTSLAPPTNCLTPPAHNPHPPRTPPSTPTTRHHHLRHTPTPTTKTGKHAHSHTPTNKLRTPRNSNTTTRPHTQRIAAHPTDQPKRPPQRKEGTQPPQAAVPTNEPQQKHHRLDKHTHGTRRSRSTYHPRNDRDTKNDSKQTNSELRGTQPTPYTTTTPPDHHTRAKRATWARPDKTHTNNQGEPAKARAHPHPTTTMTELRAEHNTTATAHKTHAATTNTKYKQTPAPTTADSPNTTSNDTGPTLKRQRTNDSTPAQARTHTQNPRGDRAVVGDRLRHNERTTTTQKAQTTLQPTNNAKTEGRDAHIPGSDRLEATGGDTQRIRLAREATEMTQQTEENNSTTTPTAAARSTDADRTRRNSDAPQRNRTTRRTNTQPTDREERNSRERARGDRREWCGITT

SEQ ID NO: 976591 - protein, 270 aa, Homo sapiens
MPLHSSLGNRVRSCLTKKIKGMWKRGTGEKGHEWRREAKQTRLDARQELATASRRTGYPKHFGTRTGPRFPTGVFDQAKAIYRRQYPRDNSRSPDREKWQGIHEMARGGRVSTNWQRKSQKPTTKKSQLTMEETQQNWGAGIQDSTWSPLDLNPPWRPYTDTQRGDKLKPKNTPLRRQTTTGVPKLHTTGPSGDITQGKRTGTGPITHTGNKEATDSSNSTPTERTNKRDTPTASRRQTQNKRQHTKTTRNTHSKAKNAQPRPDAETPQT

SEQ ID NO: 976592 - protein, 469 aa, Homo sapiens
SRVPERVEPDDWTSTLMSRGRNRPPLVLGDKFFADLVVQLARLARTGEVVGRRVRLGGGTVNPKDEKWPCPGCWAAGYALTANIFNERSCVVVRADRDRLLDTEKPGWVTPMVPEIPNLAASQKVKKRSLSKGSGHLPHSQAPGSHRRGENPPTSLPKDLEALTLSDSILTQLFGSRHPRDRTLTEPERARAQLLGPAARRHALRRPALHTHPPPPHDTRTPQPRPRTRTPPPRPRPPPPDDTHATPPTHQPPPHRHTPRPNTSAPTPHPTLMPRRTPTPTHPHKRQHTHTPGTQAPSPHAAVATNATTPPHNAAGGATRARRTARRAAGAQKRQAGGADGTDRESETRRGQPSKRARQRTRPETRGDGGSAGDQRRGAGAESATARGGGDGRVGGGQRPRGGPGAIAADRQEPGPQTAGGRGEKGTRRPRARRRRKSERPRRRRRGAEQGRTPAPRTARQSGRSARAP

SEQ ID NO: 976593 - protein, 500 aa, Homo sapiens
MGNGVKGRPVDLATEGSRDCEVKSKSLSRPLWHKAEECLRECAIGAGGWTTWLVIDTVYDLEEEQCSCDNHLHGCDELTMSSTEGGIDAVDEWQRPRSASSERRVIGSDRGSSETSRVQCMMKSYAQNSRYRIFMNALQVEPFYSLYNGRTQWQVLGYSSGKVGGIKLNVTDNHRGNSKGESLPRVGSKGPKIDPWLNAKRMGLDLFPKLTRPHGTIHWGPLEKHGDARHETYGTAQFLTQYTRLFRPQTCKKRRRRGMILHSRDRIPPHTGLPDTKQPSWVGTIAGRVGAGPRRGQTEPTEAWMDTAEISAPACTQHRLPPGRTRTHDDVKKNQYQKDRNNPISNTLSNKPTTLCHHHPTVNIKPPKIYAYNNHYYTKIKKSTNTIYITLFISKSHSAQRGSRERETTATRHMTKQERRKEHTQHQYNDQRQPTDKKREKREYGRRMHEIEQERRVAETQRKRQHERGAHGRQQECGEEARIVTRTREQDPNGEDIAGN

SEQ ID NO: 976594 - protein, 169 aa, Homo sapiens
MTRDGHGSARPAINPNQRRRRKGGINTQRRDDKRPQSRYDTRLKRRAHHPQHVLSSPRPLNGKCRNNSAARDTQKATRRKEQKAGRIENKTVHTKKQEQHDLATSEHSPGKQTSRHTAAAAPQIVSTNKQSRPMPLREHSIRRGNNGFRSPPPAIPPAQLNDETTEHSR

SEQ ID NO: 976595 - protein, 261 aa, Homo sapiens
MYLVTSRWFTIPLEPCAIFLKDRGASGALSATAGRRSLENRGKSTSALCPAGGVHPGPRGAREDVAVCRAPSGAAPGGTACIMWACKACKRKNIRADRRQGRTTDAASWSQLEQSKVRPEDDSQAAALSSESDQAVAKVGDLAKGIRKSRACRSAERPGGEDLRGALYRRGVPGPEGQKGDYRPTRAKGLRRGHRARKVRGGALKGQKTEQDNSDKGRDKRVSEGLEERHVKIITQDADRPTAATIVASFSQLSLAYTGEE

SEQ ID NO: 976596 - protein, 541 aa, Homo sapiens
MQGTNRRGSFDIRKHVAELTEDKRNSGREQQNRNENILLETTDQTLLGSTRDTSIKKSLTKRRMTWTLFLTRSTSPGFQQALGASSQAAMAKYRQREAETMHVNTNMLLARPIADLHHRGNRYRPIIRAMTHARQWALSSSSMCRNSSVNTSSCTQRAKRIIPTRNNGLNSVSEITNWCMQHHHRDRCQLLVFEGWAWHETYTRLQLQNTMCTLDIAIGWNTNKLSILQLEPITGPKIHERGEKQKGEKHELDTNPKEQEISHQYDGNVNENSTRHEAGPGRSLTKLSHRRNRLNQKHMAIQQWKNPRSDTQTRRATSRRHQHEHHSLLLSAPTDAKEKPDNTKDNERRKESKKRKARKRTTHTKRRQKQHENEQHTGTRTKRKKPTTQNTNGNRTGRQATKKREQAERQEKERRKKKRESTKEDEDATHRQRTTTSKRKTTKEEKEKEAEEKEKRERNAEQERGKSGEAAGRRQRRDKAKEKRTEKRTRRRRAGGARGAREEATAHSGTGKMQETGLRGSGTDGEKGAGARKSTARQRDR

SEQ ID NO: 976597 - protein, 117 aa, Homo sapiens
MAYLTRYEPVARTLRVGAYEDSVQWPVIPTDGHIRVALKSVRVPNGGGGGGGHTHNQHRFVRAGFTESELAENNEASHKCYDRRDWTSVHTLPDTDRERSTDNPGCLSTAHCTDQRP

SEQ ID NO: 976598 - protein, 662 aa, Homo sapiens
RLAQEGTPGLCDPARPAMLLCAAAWWLGLPVAAALLCGLVKLACDALLPHVPLGLRRVQLPRACALPATTEHRDKPSDTTSVTLCRVALLCTWEDDMPGITISNAERRPQVLTEPVSTWHEMSCGHNPLVPDCTTMPLAGVLLLQTYVQLTMLDMAYYVLRCHTVRLMERSIHSAMIHFVENLYRSGKMPEVDYVVHEGNGLKRNERGTSTREMLHTLISLPTTYLNTLKPACYILHTTQPRENGTRRRQLGHNPQSARAITNNDRHTQTLIGLSLHPIARSTHEPHAHPKTLNHQSNRQPRLNALSTNGYTSPKSLITYSFLLLPLLLIHYRLKRKPHNDHSSKHTPHKPNHRTNNKYTKQTHITPETKPNDNSTYYYTSAQTDHPHTTIRTIKYNNQASRIPATPTTTKLATDNQNRYTQRLQTTTKTSTPQSHTDKPAIIIDTEHERHTPQQLQNTHTVHSKTPHISDQRKPDDTTHGDTRTTDERQSRRKKGEHRHRDTHEQTRDVAGATARTMDSSKKDNERRQQDTTQEMLDDTQQNMMAADNGRPTTNTGQSRASASRCEGASTEQAATQEMPEAETDRQGARKREYAAQTSTPDDERLEPIKTRRHSTETSTVERAWDTERSTAARAVIWQQLGQERQSAEHTRELEVIETKRG

SEQ ID NO: 976599 - protein, 71 aa, Homo sapiens
MFIVGADNVGSSRCSRSACSLRLAKALWVARMVAHERPIGLRAKWPIPGWVAPLVEKTKPNGFLADEKPVA

SEQ ID NO: 976600 - protein, 313 aa, Homo sapiens
GAGKFPFSAGQKCCQMRGSPDSQCLSGTEQSLVKSGRFGNRAVVCCTTRVMPCIAMPLAGSCPSMTLVCQLSTGECTKVLVEKRRGPLQVPHGTDMQCIAGGQNLVQIGSRRQDSGPGLEKGLVHLGERPPRFLSSNMGLNLDVALVGRLSGFPPSGVPTLWVEVEKPLWGGFYPKAPATNRANPNWVTQSMVKQLFRSPFQKTPGRKGSPKNLSKPYELLGSKAEFVPRGLNPVTLRGNIRDDFTPTSRVVLRTFPPWKKPGATSLKWTNCCALLRKRDSKPTFQVSPLGQQLGSRAPHTTGKPTTPTGPFG

SEQ ID NO: 976601 - protein, 196 aa, Homo sapiens
AEDYDAGANCLGRSGGRQLRECGRLRGRLAWGSGLASSDRITVLSPVRGCRYRLAVGAGAVGLRLSVLVVGLLGWLSPRGASPEACPRAMICSVKLRRDSAGTSSPTTEYLCALQNSVPAALPVLRLLREGVLDFNADRLRGVDCGASAETPSRSTKDLTLGLHQELLPGPGWGNTGSDSDYILQNVVSLRYDTKM

SEQ ID NO: 976602 - protein, 459 aa, Homo sapiens
VRRRRRHTRTHDDTHWDVTTEDATTTTHDGHDDLTCELDDDGPQGTDLDDDHDDDDDDDDDDTDDHDDLNGHDDPDDALTKITTTVGPRQPRHTTWDDDDDDDGTTTLSDDDDDLGTTTKTTHDVDDQQTPLTTSEADDRYVDTTENDDDDDDDRPANDDQGRRKRRTDPTVGDVNHRADRKTDAHTDLTNITRTEDTQTRHTPDDQDTRQAGARTIAPSRHAQAKTKHKEHRNRNACKPHTQNRPMTNSPEETQIGPTERTEEETNERPSTLPQDPRTMTDTIRHQEKTVHPNKTKPKGIQPTAHGRTPKRKPHTPQARAQKNETHAAPRGNNENQQQSKRQQPRHTPNTQSTANNNTQDTHEQHQTPREHATQKPPNHTGQQAKTGKRTHTPEANAGNKKKTQTETAETQETSAPTKTHDQDPRKEPKDTPKKERAKLPEKERSSTTHQTDNTENRE

SEQ ID NO: 976603 - protein, 248 aa, Homo sapiens
GAAVAVAGGAGSWVPSSVPAGSLTHPPADARGVWLLTCCGTLLCVCRWADVFVTGDVAEELVEPLVHCVGCLAGCPRADVLVLASSPSCRPVAALCILIWLLQSPPHETKGRNSAVHFPSQTQILHLSASGTAHPTAPDASSFCTAMPCFFPELGSRALTGEPLLCWVREWRRVRVKINQYAEDSVLHSVSCYGQLDRITARWKHATHQQATHTALREACFRLQPYQALTRPATPISTCPHIPIAYRT

SEQ ID NO: 976604 - protein, 342 aa, Homo sapiens
VVLGSSGVLSELDGHSGVLSELDLRGPRVSITVVLTSVQEQTEKTLTPSELTKLEALLCNGYWAFECLTCTETTIDMICGICACGTPKWKWLRASDENVASTEEQWRSTWALSFLGVKMSVKVRGKPECTQKRDKKFTTEATAAAQHNKRKNIPESNTEDRSSRKEQQQTPQELRHNEANEAGRTQGREATRDATTPHRTGLRRTRHEEPRQQHEKTPKRRNKKHNTERATQDNTEIDKKADPAGESTHQATNRAAAAGEAQPHKHRTHKKNEATGSKAQSQTKPDDSAATEQTHTETTDEQNNKTQEHTEYDEPKRRNNRENQREHYRQHRREHKPGDSST

SEQ ID NO: 976605 - protein, 309 aa, Homo sapiens
ALGPGKTAAFALACLERLIYKPRQAPVTRVLVLVPTRELGIQVHSVTRQLAQFCNITTCLAVGELDVRSQEARLCGQRDDHSSVATRGPDRWITSMTALPSTWADIEVLILDEADRMLDEYFEEQMKEVIRMCPTPQTMLFSATMTDEVKDLASVSLKNPVRILGTEHRCGSLSGQEFIRIRLIVKEIREDIVAVVDEDLQLTCDAVSRKTKKQDHDAILPGAHGAARWVSSIGSCHRRRVEASGFQDDRLNLGGMMWSRGLDMRGRTGQSNAIHQAMSRGARRVEEAHLVDNNEYQTQGAESGPTATD

SEQ ID NO: 976606 - protein, 112 aa, Homo sapiens
MATNNRHDNNDTNCYTLPKTDGLTTTYDETRLTRSTTRLNDQPTKRLTEYLNISNSDQALAWRRLQTRDYHIRRTLLNRVFNHHRGNTDSSIWIAGRDNGTSVHETLHKSSE

SEQ ID NO: 976607 - protein, 266 aa, Homo sapiens
MRTTNKTKHTLQQNTKHKKKFVNTTTGTDRRAQEQSKVLRERKRNKGKPKMTERKTQQTQKRQTNKNGNNGKKKTYPTNSQSINNENNTRKIPITKHNTLYLTEIHKVKITATRSNKTNNKFQHATLKSKQHTKTLTTYLNQVFVDRPAENQRHNPNRNGKQGTRKTNEKKEEQKGQKNKSKNRRTHNMEMRARPMIAKQIGGERAEHGAQTGEQRQIAGKKTQTTRNRKSKREISKSRKRQERTQDRQGRDSARTTQPADQLTSI

SEQ ID NO: 976608 - protein, 172 aa, Homo sapiens
GLVVAAVAAGRVAVQDATVQMVMLQFISSGLSKVAVPSTIQCDHLIEAQCVSGEKELRRAKDIKQEVGKLVAVQTSRCHSTGRGASVEGLWIWNHSPGLFWKYYAYPGVASDWHLSSQTPNGGVALGGICIGVGGADAVDGHGGDPRDDLERGRHGDFDVTDVDWGLLRHRE

SEQ ID NO: 976609 - protein, 61 aa, Homo sapiens
GLTKGGEEAEPRRVVCSDPFSSKDWYDVKAAAYSLSISKESDLEKYCVRSGRGAHRKPKWH

SEQ ID NO: 976610 - protein, 321 aa, Homo sapiens
TIIQMVNPNKATIGVGLGLPSFKPGFAEQSLMKNAIKTSAGVMDLNTADASKTPVNGPQTGRPPMKPSEEQVVVGNPTCEWLRDQEKTGSAGPRAQAGPESQSPHAVRQSRSSSGLEEWTRRSPWERSSVLVTLSHPELHAEMWRMNAPFPRLCVSSWQTPSPVRQVQAVSSRQGPTGQLPPLCPSTCFGVPGLIQQMSPFCFGLNDWDDDEILSFGVAVSQQEYLDSMKTNKCTENRPRQELVGPGIETFQPSILLSGPLTIGLPLLLVFCSLFSLSFVHLVFLAAYPFSVCGPLNTSGAGKNKMPPEKMPNQRGPFICV

SEQ ID NO: 976611 - protein, 253 aa, Homo sapiens
MCETHDLRLHHSTKGILLSPLGTFSASEGEVTIAAVSQYPLEGTASAANTFTPFSSFRKIPIPTMLPTPDIYHGHDLRLLYHHESFRFFCRMAATYNCITARRHALPCVALSPNDNISLENHESKDLTIGEAGFPPETLTAFSVPLTNPYLLKAAELREQNLPTVSNHTWARQHTGARNPGETQHKPNVTAARDNSDPPGSGLDREPQEQTKNPKRYIDARIAITARPGTCRQGTLIYHDQGNTTRSTKTHQA

SEQ ID NO: 976612 - protein, 320 aa, Homo sapiens
MTWCGCWEKLVEPGGPAWTEHALGMIPRRLMEVCLVLVLKKWGTPEEASRRGRGTQDVSGQGRLYLALVHASDGAACEQDDRTVPSYMDIRADVQDQLAHGTGTLQHALERHDGVMPGRELRLSRNWDPTEALRGSAFDGTRRRNSWNRSIHGFDARARVPRSAHCDLQNIPLKTQRKGGPVPLLGLGPWAIASRGELGQRGLGHGREMGAPFGFGRELMRHNAGRSNTQSPPIQIADQTDIRSTHTGHTAESHKGPNQRQLGPQWHNVKPKDNMNTNRYNHTTMHTHTRPRTSTRHPDTLKRTRDTTVYTADSSEQQHP

SEQ ID NO: 976613 - protein, 326 aa, Homo sapiens
MAEVEQKNDADLPAMFTYRGCGPRPAAGHVLRSSMTACMYMCCASCVCWHEPGGPAAQESQATHLLERRLLHTATRSEESTPMRRSPERRVQTAHIARTHDHSVHRSMGGAKNCDEAPLYPPLQDLSNHGGTIRAAQMTRATYPGATISPITLHNARSSNGRPGPSGAHHHMPSATKDPYLQVTRPTAYHTQRGTLHVPDNNNTNNKHHAERHHHRPRRATAHTTTEKTIANYRAPNRAPNTNTTHLDPPRTHTGTHNGDTTQDRHPPPITEHRPTTHTRHRKKRPECKTPGPNTATRGDTNTKHRTNAARTQCSQPMADTANTAT

SEQ ID NO: 976614 - protein, 129 aa, Homo sapiens
MTNANREPTSFRDTLTQQSTDARCSSPDTANTHGPSLGLRQGRSDGILIPQRLPIHDHPTDGTHHTDPETHDRTQNPAKRTLQQTKTPGNPGKSYTPKTKQTSGDGTHGSARTGPSNSPPDTPIDTEQE

SEQ ID NO: 976615 - protein, 139 aa, Homo sapiens
MYRDVFSIQSDFYPSERARNLYWYRALNPSYEHQYLLDKIATKKTNSDSNVNNAYFTIGAAGESLEVPKGEQRLLKGPHPFNVRKSADALGGQTQRARPRSHTGLKSEAEQVRYPNPALSSGRTTDPQVAISGKIKFMS

SEQ ID NO: 976616 - protein, 164 aa, Homo sapiens
MSVLRLVTFHGATRLGGVGWRCVHACSISCCEYVSWGTVVRRGVGRSLDIAQMQTHVMVAKDACVDEGMHLRMYTAAMILHAPARHVSIFQPRIHETNEWPRVDGKGMVGPGERVYYRVGGEHTHDPSLLPSTRPNRGDRNTVERVGRDSDGPPQTFSRNKRRV

SEQ ID NO: 976617 - protein, 174 aa, Homo sapiens
MASVLNLSYCKIFYIFALILFNLVINLELMTPCGAPPFPLFGPPHCEMYDGLVGFPGELGGRQPGVNLVHCDFETSCEINNVHHLLKQQNKKNPAQETEFPGEQLICRRERRKTKRAMGKGATVQHKQRLHGERQVSLGYHEGGNNYGAGIPPVMGTATNHTTRKDRVTTGIRT

SEQ ID NO: 976618 - protein, 338 aa, Homo sapiens
MAPRTRTSSRGDLERETRPNPTVHPVRVQTSATCRRTPRDTRIAQGFRPTDHYTPFHLDSHEILAHNDNLDTDFGTKTNDHTLSVPTTSEHRNTTITYRKDINSTTTIDANTHTHTSKLARTAPKKHRPPYKHNYKRNTTNKRQGPANRNTDNTQTQHNRDTTHRQQPTPNHTDAREHITAARTNNTYTPDNTQTRRHTDSITLTTTLTINNTTHHSTHTNRPPNNGPHTPPARYTHNINQDRHTKHRQDCTTTNESNSRPHIQTLNIQTATYQRTTDQTHNNLTDYHKQERRNAMTRSPTHNNQKVKQNRTYNQQTQNTPPQNCTRSNNNPNLNKTT

SEQ ID NO: 976619 - protein, 119 aa, Homo sapiens
AVCTKPLAGESLAEGPCTRRCGTRPVTGNPAASRRTGSLDARWQACEESRLAHQRSDSAQERSKARSSGHRVQALHGPASHRRLIVRADADVLAGTHGSYLVTDGGNGQWSISHSMGHS

SEQ ID NO: 976620 - protein, 305 aa, Homo sapiens
TPNPVILQDCMWSGFSAREKLELRLERECCSTAAGRQPPVPPAQSPGSRRLPALRVAGHWLGLREPGLRLVAALPCLSSAHPGLAECVDPCLWSSPFPVNKLRASARALQPLASAPCGWARAVCLVGAVVFACTSLVAPGGVCPSCCPSAVLPLTSGWRPHRPLSTLRTRTPSSDSDDEDDEEDDEEDTTLDVEPRRNTASDHPSPPPTDRHQEYSQHLEVANNKRPRSREEEPHPPEQMPTDECHAELHTSDANHIRRTVTTDMRALKDAHKQTTIKQAEEKDQTTSAHPPQLTALSAHNHPPP

SEQ ID NO: 976621 - protein, 408 aa, Homo sapiens
ALRTYLRLRALQTAPHAQSTDALMPCALQCSACSLPCLVALSACCESSEDVCGQLKDDKDSAKKNKGKEAVDCDDSSTDGGYEQSKDVSEKRSCREYTLTDCVQGFDPAAQPRRSRAPGLRPKTHIDDIRRTRPESRVTVLAVTVSFDGASSHSLLVDFAAYITLVFPGTYRAIPREGTRATTPLLADPPLYPWGLCAWLAVGRSITWPAVLPNLPRESPKTAPETQWELISRIPCVEPQDRPLSESRDTVTHTARVKRQTEARCAADPLHETPTRVAPPPPRPHYPCATNRRANDLANVAQHTPNNRPPTNKPEPNSPQPTLNHHQHRHTSHPPPRIQNPPPPTYFNPLYTYTHKPTPNKSTEHNQHPKSHTLLIHHKLHLPNLSDSTVLRHHSSPHNPNTSRQTDP

SEQ ID NO: 976622 - protein, 169 aa, Homo sapiens
MFPWCRRPGRGTLPALFNPGAEDSGKSGLIRDSEAKNASYSWASLLDQFLNHYVRVYSKTPRCPCGGIIHGLSLVHSCCEAPRGHTQKKLQGRGTRTYKPDTGPKSAESSRGITSHSQADMKPPTASRKLGGNRAGPEPDYPDTARTGVRRRNIAGQGPQQSKGMTGPS

SEQ ID NO: 976623 - protein, 324 aa, Homo sapiens
MADRGERRGKEQWLPVDATNRCSTAKPRSAWSAKPEAQGAAAERASPGSVTSSGSQRRCPMTVPSSGTNGGQAIPCMTCNGGACALHASPDTAAWRSPSEAADEENEPQKHESSNASDEEACEKRDPGTQQAFVFGAELERDHELTPDKLRAWTEATMADCWTPPAQTLRNRNELSLQYISDSYRTNSSNSADASATNRIWQNMSERVWMTPKNYTRSVQSCNTQTNAAASQGLKSSSRRPPHEKSPGCTSRPNQETDGSARGKHLTVLPRIAAQSHVFTLPVPHASRPPTPWVQKPRRSHHHVNHYSIRHNNAPVRPDHAPTH

SEQ ID NO: 976624 - protein, 182 aa, Homo sapiens
MWKKAIVRAWVSWGTVLVSQECPDGRTGGVRQGLPSVSERGAREATEEGGPVGVNLRVLAEGAAGYTSGGVHTRRVPSGGGKGGTPLRTTLRKPSLSLRGNFGHAPLRNPVTWVLTGGSEPRGGTPCGNGWGSSRKKEKQGRIEPKKEESSRFAITQFVWARDQGLECIKHKGGKGERNGRK

SEQ ID NO: 976625 - protein, 342 aa, Homo sapiens
WAVARVVGLPGGRMCAPVSLPSLLQMVRLRSVGAPGGGSHPSTVVPSAPRNHCEGPCQGVGQPVPAPSSGLHAAVRLKDCSWRSEGLSSAQPNWTPEGEPRLPSPLPQLCSFIFSKGSEEAELERPCPLRPQVNLQTESWCARTPEALFRRMRANPGAQEECSPKGLHPHCGPKSSTVQRSAPRRSYHPSKAFELRPLYGSTKATGGSIQLDERTRRERWRENWAVDIEKIGAQMDHNMYSLDSLPGKDGYEERTDMTRAEVKRSQRGQSANRQLGTSRVNSARTKENEQKKRLSTDSHDRHEAQEKNGKRQVARPHDGAMRQWTRGSRTQATDEENDNLPE

SEQ ID NO: 976626 - protein, 155 aa, Homo sapiens
MCPPVVGRIRKHDYPNNDSLVIDSAVNWHLAQSQQFCGKDMLSTMIWKYARDFEATLLTMPCVTMRYANSRNGAQKWHSGVDNGPFRGGGYDSYSPIQSNSVRDLKLSDHVVETFCAKVHLSASTGALISCEAPFVKPPHHEFHIAIDIRSRAKP

SEQ ID NO: 976627 - protein, 348 aa, Homo sapiens
MRGHIDFSLTGPAAKCGKYVCRAGPGVCTSELLNIFPKEVFRASIRSSRRDLSHHYPRQPGVWDSLSWTHDGEPPDVTAQSKETGRSSLIQYLRSAKATPCYNVGSRHEDCRYPSHSYELSNPFPVAPGPAPGACGSCAIVLGLLGMRALTLGARVTIYQSPFAQRLNRCQTESAASCTSVGNVREHVGTAKSLSLPRPCQGSRLGLGWDSLGLWARVPVQGTKGMYSFHNTGIQKPDPHGCLGLHNIQPDKPMQQDPFPVVSPNNVGCFNNIHQKGNMNSPRGRTAPTGDTNPDKDEGSHFTTTVDVTWPTQTRVGPQNNGTQRQGANDRGHKPQEETNTGTTSETA

SEQ ID NO: 976628 - protein, 312 aa, Homo sapiens
AQVSCYTYPYQPTRDTGKRLISTIVRSYHTYDSWQVHHIAGHSDSITLRWHRSKLNQFETSLRTEAAEMGKAAPIKIWPGSRDKTCRNLRRDNVVITNLILVAMKDTFENQSRYYCEISIECRQEDKRPCITKKDELARGPIYTGVTMMPDLYTSLGRAGVDSDSNISTSLGYFIRTTLEPDRQTDAEMTAYPRAYSNTHRDIDRKRKTFTLRLRESYKTENDKGAVHTKPMACDDTPKHNGTTERPQANNCTGAHHTTALSTGDNEISNAHRATQPNRNSQDGALPEKAPCNNTGKTHISLNGPSNLINSA

SEQ ID NO: 976629 - protein, 320 aa, Homo sapiens
ERLLGQRTSLERDPVAWKRGGSTRRCSYRRQDLGIQAGHDPSEALLGVAAGCEEPKGVNDGDHAAGRMGAATNRGARVEIFYSRPVVALCVTTCVDSDLMPASALTGPGSSENADPRLWAELSSGKDQAPSCCDEVQCTGHRGLTGRLPSPCGCADMSNCRADERDAGVVCTNETRSTHTLDLSRSSREALGKIFDSQRGCDLSISVNVQAEDALGFCVATRSVLECKLEGQALWKELAECPHEVWMPVCLPWSGAFRTLIRRIGFPVLVNASQAALHWPGVRDWRPLAPPRAVNPAFFSGGRRGISRGGTDARGPLFAP

SEQ ID NO: 976630 - protein, 192 aa, Homo sapiens
WQTELFIRYSQLEATIRGVKSYTIDTYKEIKNQNTQSEMLVGGRGRGWARQWGAPGCSPQGSPGGGDAGFLPPGRPRSTNHSKGLWPSVSAAQAQGWWLDGKDGTEGARDCTPPGWSGRVKMAPAGTRLTCVILPAQANRHRGRPSNDNENYVSYCQTKRYQDMADMTGVSQRKRKRGEEGKEDHARQSRDD

SEQ ID NO: 976631 - protein, 140 aa, Homo sapiens
VPVFPGLCPCFPVTDSVHSCTWTPVSLAAAGCVALLPIPAAAAVCAAVVSGVCVLCLVPVLCVTMCCVCDLCILMCRNLMCFTLCRIALQSCSLPCVLCEIHLTYTTVRVPKSSTVHNMKLCKAQCARKFVASHSASASE

SEQ ID NO: 976632 - protein, 230 aa, Homo sapiens
MHDVCLKTQPQRIVVRAPISGRFCARRTPPRGIVAPCGGENTRCCEGGVTQSQSDTDDPPPPPHVVLHWIHTHPIQQEGQRAVRTRLVETPPASRRLTNLTQVDTGRAPQLSESRRPYKQSHNAHYVGPHYDAPKCDTPLWHQVYSPPLIKTVGCHLQKISTGGVYAPSSYINLPNGLPLINERAYTQGVGNTKTSGLLDELTEKTDNWLPRYITRGSAIITHLRYYPPP

SEQ ID NO: 976633 - protein, 195 aa, Homo sapiens
SRQLRDWEVLVLGEAQVGPGCCDLHMISWPSFCSRLSLPRDRQALVKKLPQTFLALCATDYTLAMYPPSMIATGRIGAASSKAVGACFLCGDELTEAAGRGITGTERGLAAGLSGADLKLQSSRESLREAVYRASSSPAAPKPPGAPAGKGPADQHSYRCHSHTPVALERPSGVATEAEEGPCNQLPGSRKPDQI

SEQ ID NO: 976634 - protein, 181 aa, Homo sapiens
MLRGCGDASGGAHLAPLVAPLGRMFRRGMWATRGIGPGLGLSGEHQGVGSPQQGSRGGAGGGGWGEGLSRGWFRGRVVCGEAPTREGAPRGVDRERCDRGSGTERVLTRLGVHHEGGSPIRGRGPRGGRVSFAKTFVEETLSPFPLGGNHLVPGPLENPDLCLPGGFRSSGGEPLGGTGGF

SEQ ID NO: 976635 - protein, 350 aa, Homo sapiens
MVQRSRPGRSADVRPGNANGAAGIARAPLSGPIRASSVRCLQRFGYHHERCAPDAASSLDGAQGVPAIQQERCARSIVTFLWIRGGVNKVHGSPCRPTCRRLKEYRSNSSSSSRQEALAPKKGDSSAEELNIGHPGDRTGSCPSGNVYKQGRKLESSLRKQHRISKPSLVSDMARANARLFGYGQTRAKEAAEQDVEQDKIKPSWGLGISQAVMLGLHVSVITRWEQLGPGMGLHCCDFSWHATRELLDKTVKPWINALPICVETLMRGRISTECTRATIQRAPVTDRRTSQTRPLRPHYKAEQLDRMPQHNPTLEEPPYNTHATVPPHKHNNAELFYHNTEHSKRSPLF

SEQ ID NO: 976636 - protein, 179 aa, Homo sapiens
MLNVVNNLSRAAITPAGASQSGQRLHHTLPRDYTTTPPKYRHETPYRPTPRRKAAVETTTRVGPPPPPNNARETNNIKRSRLLKSNKTSGGIRHTVKYYPQEEGLLKPHRDTQYKRHRRSGNHPTSSGANNKAELTTASEAHLKNTCSNTIAVANNPNKQRGHIEAGTPDKQPNDSYTH

SEQ ID NO: 976637 - protein, 75 aa, Homo sapiens
MCQPPVPVVLVITIIHCGQAAWLPLTVLQVVSSSSGFFSECGPQCEGHNSSVHVEVYVEQLMQGASQVSCGMAGR

SEQ ID NO: 976638 - protein, 95 aa, Homo sapiens
MCRKANVHNYAIRLRYIEYGTRETSSQRNFWEETRAPFPFGDSHYSKEDLWQTSASDNASPPETQTRCHTSVQNRNDIVVRPHPAVDYDTLGIDA

SEQ ID NO: 976639 - protein, 214 aa, Homo sapiens
CLGCAAGVGPWSCLRRLRLPGASCCCCLLRMIILPAGGVQLDLCWLPAMPGPLCCCSVPSGAACGCCVIFPCVIHCLLVLSVLLCDVGACAARAHCMPGAACHPACLSTCPPVVDALRCMLPENMPPSNGGALIQFLGSWRGNIFPSNLGVSSLSLILYHTMQARRQYHLEPGLTVCPVCGTRGWSGDAPSWRLRAIVCPRLRLLDRIARHILR

SEQ ID NO: 976640 - protein, 218 aa, Homo sapiens
AGYYGRRVLPGRTPPLHAGADVAERECTSLLNNLRSRRGTGHRYLNTTVTNGTGPHPMNAVWVHHRPRLVLGDLLVELTDGGSTRSLVSRTPTIEGLNRENLEGDGDLREGRIACWADCRKPSFPVVSPAGKRGGLPVHNTGPTVMSFEQMGPGINQRVYRFQKLAMRLLSMPGAQGKLQQQGLKPLQTHEPRGTAKVHEPENMSNRKWTAPVPEKRP

SEQ ID NO: 976641 - protein, 499 aa, Homo sapiens
GCEDLVRLLAEAGLSWSVPASEELLRGEPMLLNVMLCLGCCVRRMVCPLLAVPHAVLPGVISEPGASTLSLPCPLVLGPADLVQMRMLQHWHALVHVLDQLPLVPVPPDDLNVHCFPHTPDCPALCLCSPMPLVTCCVTSWDRGLPVLGCWHVRVCLLGTWTNGQSLSTNDSAPSATLLGHVAGMWGTLTCARMAVTVTMTRGRSGLWEGYTKSPAETRGHGLRTHDNTHAHAKRASQTPSPAKRTQEDTPDHERATTTKNRRTRHTTHHPHTHTIHHADTGAKAARTSKAAETRQHEEEKKETERQRASERAEDGATQEETQARQHTRQQTTAAANTGRAQQRIQPASSEQPERKGEKPTRPPTPASTTEAEATQTQKTPPEIDEKDDTDEIGSPTSTRRDRSARESQKTRSNIDSDPTHLTPNQHHHKDEANNRQNPSKHNVRDDDATHAAHQTEDDTRHDSKAPTHTPHSLTATRPDDSALGRPQHGEDGAKRTDD

SEQ ID NO: 976642 - protein, 312 aa, Homo sapiens
DYKRLGAGLDGASSIRVGRGEWYDENMNTIRQYQVCTCLSQARTMVRTKFIRRRGPTDHVEMKFSVRDLSSIPSCAWLLQRELQLYYYEADFDSAPKNFPNWMENPWVKVDTLAATRDFSQVDLGGASSHINHRGAAASGPVSRPPALYLTSTTYWPACMSLISVRVFYRQWHPGFIPRIGRPLLRKHLSRGPEQPPSLCVHAPARHASLVPLRDTPMLTCYPLLKPSSPCHPGGPPGHRGLVSSPIARPPCPMLPTPTWDFKGPLPTHRPPPLCAPLVPPLGTASHGAPTQWLKSRVPRSSPTDPSPSSRS

SEQ ID NO: 976643 - protein, 331 aa, Homo sapiens
MGLLLQLQCVLDGVESRQGSIKGLVVSSNFQNVKQLYALVCETQRYSAVLDAVICQRRPPPCVRRSCVPAPGQGAQLYELFVWGKGFLSGCGGPMERALFGPGTYVRMLKAELDLAQWFIGGVSLGMSDLLGSWAPVPGPASQLPRFVLCEPTLKTCSDDVVDLFHGEKVSPITGRASSLDDLTSPQGERTFSPGPPVMPELLVFPPKNDLNEHPLYRADTSFLGGSSAGCLPACGGAPARSHVIMLLLPRIKKQQLGWSLKTTDCALTEQAGLHGSVAAVLWTARGRGPLSVRAKMGTELIRKWTGTTRMVERLALGSTGGGRTLCALVG

SEQ ID NO: 976644 - protein, 179 aa, Homo sapiens
CTEAVITRKQYYALQALQRMAFLPLAVLATALSRSHCYQRPSMSTGSNIALSSSTTVMDNRPDEPIADIQPKRLKYTSNVKTCHPYNTFGRNNRHLTDKRKTARCIPFLDNQSANCAGHFVEHDIDTFDRIVHRDNSPITTLSMQNHMPPREHDTLYISVAKAPYITNSITCARVSWNT

SEQ ID NO: 976645 - protein, 201 aa, Homo sapiens
MCWATNSLPSWSHVLLGVQIHDSRLGAPSRLDAISCCAIQGGNAYIGRQATGPGVQAEVAPLEGSGIHCRSHLGAWRGPPPLTVRPSLDSSRPRAYGVLEECRSCSKLACSSGPWTIALKGISQGGPGGPLDRGTHFDLVELAAVHVASSMEGCTCVVSWRRELLMKLAGGRMGVRLAHCCTVSSRCSLSCGGSSFGQGLV

SEQ ID NO: 976646 - protein, 331 aa, Homo sapiens
DTARRLEALDQSWWLDLLLTSELRCCTSLCFGADSASAETVGRRGSGMGTIAHQASEERQGQALSTGVKAKQGAVDHGQESLSEQSPDHVARLLTEGRSGPGYDVSEPGGSETSDEASACLILAAWKARGGPEREATRDLGGVILARDTYWGSQDGGRDQMATVAAGDGQGLEETVDTGLTRSRRMQSTVTSSTTGPREQTGRGDQAPSQPHNGASGDVGRAQRGLELEHLNPVCPGAGIRHGHCAKIALEGRLKRLLSRCLAAARLPGGTLEVDSSSSPSTKKSQNHAPPSHTCCHRRLHTAQPYTAVAALPLALATTLTQQTKHKQHAK

SEQ ID NO: 976647 - protein, 62 aa, Homo sapiens
MIPPMGKFHGTVKAEKREAVINGKIPYTIFQERDPSKIISGAMAGLLEYVVESTGVFSTMEK

SEQ ID NO: 976648 - protein, 140 aa, Homo sapiens
CECCGLCCVTAWWCLALVCGCPRASPSAAAALNVPCCLLLLLLLCPVLPMWLCAVWMACLLHVLPALAYNLPVLACLFLLFPAFPVPPAVLPNSFVYCCWNAAWLVMWLWNPNAGHDACCGIFAVPWPEPLPGPVPLPRL

SEQ ID NO: 976649 - protein, 306 aa, Homo sapiens
APRRRGVQGRCRCGSGVELAGGRVKPMQIAVDPQEEPHNAPDVNYVVENPELDLEQYAAATGLLMRIERVQFIADQLSHAAGVMALKMALSFVHENLYPWTCTEEDPPQCSQRHQGAAECTLTPSLRAGVEPPAWTQLGGGHCGQKAAAEAGEAGATDLNELQGAKSIKESIRLRHETCGDHYLECGDLSNALKCYFPGRDYWTSAKHVINMLPQLSFHGQASTLQTLVSCWSDYRTGKALVNPKKIAELTESVTGKARAYFTGSVVRSLGKLPPGIQGGCQSPRGSLSPWTPECVPKVASGAAPG

SEQ ID NO: 976650 - protein, 691 aa, Homo sapiens
SPLPPFTISPGRRLPRAGAERVYTRRDSPRGPTYVQRAETERPNTHSGASASERGPTSASRSTAQRNSVRMPRGTHKGRSAVGREHPRALRKGQRRPEAAVERPGRIPRRAHHLIITIQGDGRPDVIAPSRRNASASRSTPDRNTRERRKREGPPTRLQHRREWHNRECRAPKQHPRPREGQEQYEADNRRQPTEQRNHDEHEKNQGTDTTRPRSTTADTRAPVEKPGPKRGRPPCERQQRATTAREHTQSAAQQHQSPPTRAPTTHTHPDECNEQLQIQRPDDTHEDSIFSLTPCSTLRTHQHAKAIGHSSDESTSSEWTATTPSDPSREIHIAHPLAPDKECQLAPHPLALPCVCSSLVCHTQKHGTTAHIAPPATHATLHVAPKQRLTDRHTPDNQHARDHTTNNHGPTNCSQQHQTLTRGTRADTRARAADAQKRPQHAQRTRHEKPPGALARALGTSERKQAARTRRKRHPTVGHNNVPSETGKPGTDAASAQESKARTTGSRRRDMGTRLAASVGSRHSDSDARRSAQRRGNEAEKQQTEAATRTQHRARTKKPEDMPRHDRHSDTTRSKREDGRNITGETTGRGGDAWERRGVAMGRDDRTSKAKRQGVIDRDEITDEKAESEPSTRANSAGRRRRERKAEKRGRAQEREPQAQQAELVRAGDDRTYRRRVKTSPSRSSSRHRC

SEQ ID NO: 976651 - protein, 128 aa, Homo sapiens
MNVRVSTSAPLSPNSCTSVWQCLPFSIMDYVVFVLLLVLSLAIGLYQLVVGWGRAILFGELLDGGSQNVCCHSGVHCALTGHPYQISQEAILGVSVRDLQIMGPNIWFLWLLLLIWRLHDTCKIFIPD

SEQ ID NO: 976652 - protein, 262 aa, Homo sapiens
MGLTSCELSRLSKWLQAEEPGKWSNDLLCNAQPRTLDKKHDANERLQHKRVESTVHNWPIVLTRSCTLHRRRSAFLALFAPTRHSAPVLTTMARAPACALRRRACAPPAASGAPAPTPKRVSTRHTELGTPPCPSPPKAHRQHTARVHGARPNTPSPTHPRAPLRPTAQSTQTGDMPTRLRPGRINRRRSPPGTANTRRRTAPGAEERDPPRRTEEEVHPHAHRRDRREGGSRMSRRAILLRRYTEGYSSVSKAQGAGAADR

SEQ ID NO: 976653 - protein, 240 aa, Homo sapiens
MMLWQPCRLMPVNLAPCAPVVRGCPWLLRTPSCMGSLWTLLVSWDVRLLQGPFSLHVDVLPVLAILKCPLQEPPVIGANTMHVKRSLLLGRWHCVCHNDLPQDGDMLWGVHQMDWGHGPNDSLMVTCPEERLTSSTPEEINGTMRRTEFLVLACMIQEGRMIKCSRPVLGQRRWYRCDGGPDKDTFTYLGPSSNWSKLPHHQKPQVTFVAILDLPAQDEHQDQSFCGVGQWTQRTLPSPK

SEQ ID NO: 976654 - protein, 117 aa, Homo sapiens
GPSKGTFQYTYQVTTGLLYIKCVGVISQSVLGSILEEGEGRVCTRYRARVPTKHSTLSYTVRKLPPIQTLISSNKGLYSRIELPVGIRTYVSPIFRVRTSQVGIHSCDPKGCLNRWG

SEQ ID NO: 976655 - protein, 265 aa, Homo sapiens
MFPFVLNWAGLPTAPLWIVIDDVMRMGAINITCPLDWGSPQDLFNGSPREFSGKGDLVPHLVEQWFDNLIKKVDISHWCKWFSLVSYRGLLGWVPYEERSMVTWITGQDVHRYVRPTLQSWGPSYLYHRMVSMYLTCVNAYRALFQCPPCFALVVNVLYTQTLFSCGDRTGNPGERQNLRRGAQGGRAHVRDRWTLHLSRCVATPYKCIYRTFVEFYDVAVLQTLIGTRYRRSQRLLIWICRVQKTLGNYPGDSEPRKGDMSRPL

SEQ ID NO: 976656 - protein, 77 aa, Homo sapiens
MTLVVTVASLYKGCLVVETCGFVEFYSVDLNKTDGIYRLTGTRIGAENLKACTSAMGHGNRPPGSWEPPGVADHNHH

SEQ ID NO: 976657 - protein, 30 aa, Homo sapiens
MLMKTLSRHTLCGQGDAQAWVSLSRSSDTV

SEQ ID NO: 976658 - protein, 102 aa, Homo sapiens
HGGPSLGGSWARRAPGESGLIYPANTLFGLTWSYRGFSVTPVVVLRHPSHNILPGTEGGCGKNSVGLEAPPRGSLRDKCIATGGGEHPFRRVARMRGAERMR

SEQ ID NO: 976659 - protein, 106 aa, Homo sapiens
MPPNATRPHRPTRHTPLHGTPHTQLLTAPAHTALSDLQPPPHPQTTTPPTTATYNPVRHRAPNTHVLHNTTTQAPHTEPRQQANHHHNTDPKPRCSDEHATPLHDI

SEQ ID NO: 976660 - protein, 570 aa, Homo sapiens
MTTRRLTGTTTRCDVLTYKHDLLGPRQARPTTCDDDDDDDERRRTLTVTTTTHSEKTTTTNSDEDAPADNGDDVRRQNDRVTLANTQGHRRPTERPTERTAEQRPTIGERHHTDEPRHTIDRYLTRTDDDNDRTDRTYEQNKIKIEKRTPAKKQRTIQRHRKPIPEDQQTRRGDNTDRQPTRGISTPEQTRHTPNTKRTARNVAVEDHHPPRPKDRSYETNKTQTNTTTRRGATTKKNNRSKTEAAYSPKPIRIAKTNEADTYLRSDTASHSGQTNKQRGQSPLHQTNQSHTNTNTRPYSNKRQSQIEKRDAQNTKKPPTRTENTRKTPQQRRTRTATIYKERQITAQRAQNNSKLSKDDTKKKYTPNTPYLRAKSSHSVSLGTESQRHSTYNLTKATQRDKNSARKVCYVSQRRRRSGLSTQRNNYTKYNTNKHTNLRGVRCKRKTLTHDNECQDKIRIFDNYSATEMTVHTAGRRQTQKRTEKKTENEDEHDGIQREQCRSERVKLRGDADETSALSPAQLSRVRCKRYVKHIELQVETRYDTTTRRHHRRRAGAQRRHTSGRRHTLE

SEQ ID NO: 976661 - protein, 197 aa, Homo sapiens
NPSLAFSALEKTKFKPPPRVCNGGARAQESREHARKSRAGETTEVRGPRAIISPCECGFVGFHSLCSLCVAVGVEVLRGVWSALRGGSRGPRVAPPLCVREFSQRGEWERRGSVSRGAWDSRGRHRGVGSPQKDLREKRAEEGGELEDKEDSSLRECVSERGVLTERAAQEREGGPPGAGARWRAVRRGEGQEARYN

SEQ ID NO: 976662 - protein, 152 aa, Homo sapiens
EDGRLGNLAEDAGKIVSELVWNQTRMKKGRTGKQTRRKRNKEKPKSDTTEEIAEEADTVFPKAKQVTKKAEPSEVDMTSPKSKKANTNEEPSHNDISPKTKRLRQNKEPIDTASGSSKTKKVKNNEEPSEEDIDAPKPKKMKNRHRTLTGDT

SEQ ID NO: 976663 - protein, 279 aa, Homo sapiens
MLGERENNTRGRPGGQKGRGHKKVLQHNTGENHTHQWGATWGGGEHHPPPKREEPLGGTKKEGGARGREHKGGAGGERGGGTKGRGLVTKKRVEGPQKKTGGHQMRTPTRAKALKKTQTEATQKSYLFQQTGGAQKGSKKRNTQKLASNPRGENPIFPKRETYVRHTQNGGHHRVGHTTVGVNPIKTSDPPGGYVQETKKCKQRLTNNTVRKRETETRAGGTKKNNRLIQPKRGAKLETPVTKSNCHETQRKNKVPWGGHKPEENSSYKHDKKIHNNRR

SEQ ID NO: 976664 - protein, 102 aa, Homo sapiens
MLVVHEVVPDVGRPLHLAPRPLKRRRVGRQGEGESHALGDMNREVLPGDLWCFGFLDRLHEAWTRTLWGSQGVGCAPRSPSGFPIIVDVQIGVGTERPVHLE

SEQ ID NO: 976665 - protein, 216 aa, Homo sapiens
MYAFVRSWRTSLLRAAVCACAIQPRSRLDFDNQKVYAVYRGPGGIGRRAESPPAPPATGRAVAPQGPDPLALEKTKSDLKTVVMPEENKNAQAFLLNSCRTNEWTRLTDLLGTTHEFNKLRPHFKENLTGGKSEAESVAQQKHSKGSGVTRSEKNVGNGLSLGAYTRCPEREFRGTASPRITTGHGAGSKDAVCVTRDPVLTAAGVQHYQESNRKR

SEQ ID NO: 976666 - protein, 300 aa, Homo sapiens
IKMEFRHVAQVVCELLSFSDPPASAFRSADHRCESLPPGLQGFLIPRDAIWFESLIWVTLILMTRMVQGFWTGIHTGGNVTALAWGTEGFLFLGFLNQKLQDPEGLPLEGMEAQLLGLINKKNMDFQHLWEALDADKIFEYKTSYLEKRLNRPNWATGHNDLIIQLGSAMGPRRIGQVPHYLAILIYKRRGAFDKRPHENNFAETDAAEQVGKGLLTVVPGLGINWTLRVNRWISPVESSPWGEIGTPGRYIGKSLGPQDRNFINTMSPGTLGDGRPNCTMCKSRSPKGTDILGKGHTWR

SEQ ID NO: 976667 - protein, 145 aa, Homo sapiens
MHRGHAPPRHCTPTTEQQHEQRHPRQTQTTSPDCTNTGVAHTRTRRRSTNHARRTNTNERPATDHEHSNELTTAEPPQEHTPPHKPQHATQQDRDETPQHDTEPTKQHTLAKQQRHTQHQAPTPQHTTNTRAHAPPEQNRNTVDN

SEQ ID NO: 976668 - protein, 289 aa, Homo sapiens
MDAEGLALLLPPVYPGQPWWTGGSERICSRAQLLHVRWSGGAGPIACVGCCAKSSLGLTWRGAWTFLPNAEYLAPRLISAIRLPVFAPATAIGTLCAAGAARAWPDGRGVLDLTAVSGWRDTGVWRCEGRGWVRCVVCPFAQLSDSARSAPVDVARPGGAPGVSTGSIRWLRHRRKDATPRDSGVCVVQVVGFAGGQGSAFSTAQELGRASVMVKDDSLFGGPAGWGGVPCRLPVGRGIGWVGGSVWWGSGVECPVAVGFVGSLLLVPLSWVLGRAGELPPGPVLRPPP

SEQ ID NO: 976669 - protein, 271 aa, Homo sapiens
LSHGCLSADPASRISAGRKWKKRSPRVVIDDGSGMCKGWFGWWTTSPRGRVSLPVGLGRPRHQGVMVGMGQEGLAYVGEEAAMSKRGILVLREGTPLSMDIVNQLGTDMDEDLEPQLLATRLRVGPAQGASQCLLPEDPSEPQGLTDQKMTAGSVPLPAMFLPEGIQIMFESFKSTGHVRGIQSVLSLYASGRTTGIVMDSGDGVTHTVPIYEGYALPQAILRLDLGGEELTDTHEDPPLSEGKVHTGRGGEIVRDIKEKCATSPWISGQG

SEQ ID NO: 976670 - protein, 309 aa, Homo sapiens
ARTSVVPPRSAGRVLCRSQLEEEIAALVMTMGPACARLVCWGRRSPSRFLPSSGAPDTRRLGGHGPEGPPTWWTRTRASCGILTLKYPIEHGIVNMWDDMDEDLAPYFYNELRVARRSTSAARRGPLNPNGNQREDDSDYRLRPSRPPVMYVASRLVAVPLRLWAQQGIVMDSGDGVTHDGAHLRGYALPHAICVWTWWAGLNDSSWKILTERCLHAFTTKAEREIVRDIHGEAVATSPGTSEQEMATAISFSLEKELQRLADGHVSPWPRTARVKGASLLLDDFRSRTPYSLKWRGPHLPMVVATPLS

SEQ ID NO: 976671 - protein, 111 aa, Homo sapiens
LLYACRLPLTCRPSASSSVLPPLWPGCLPVLGCGASAARLCAAGVVCWPELLHAVLCDLSAPGSLLSSHMVAWTMPEKPLEHAREDFVNLTCSHMCANTCTNASTLLANSR

SEQ ID NO: 976672 - protein, 63 aa, Homo sapiens
MESEPISRVISFGAGCLESSAVVTMISTSFGVGGKRVPFPLDEGVRHHFGYSHRRCQRCSLKS

SEQ ID NO: 976673 - protein, 256 aa, Homo sapiens
MLIFCGGTDEEPPRGRPESLWRAKGAQTGGPPKISPLSRGLAPLTGLFNRIFGDPCVRAAPAHLREPRPIVMATRADLELSAYIETRGNSGGTRTQKAEQFCPPCEAFPPRSPRDYTFNQPSGPKSPKRVSPFKIPLRELSSLMTLTWLDSDIAGEVPAKHQRHCTKGNNERPLGAKPSERTTQARSPGSTRETTNRRRYHPIQEPGQNPPRRRPKAQQRHKREQKERQHTPLNRANSPTSTPTQPHHVHEREEPH

SEQ ID NO: 976674 - protein, 355 aa, Homo sapiens
MYFRGESEASSPIGGAHAGEGGGGGAKKGARRRKNTGGSTRRRHTQAGGAPRRGRENHREKTHTREKRPRASDCGGRESASGERRGKRRGVRPLERRREGRPHSPERAEQHTTTHHARGGPPLPRRAARKKERETTACANTARVWAQKESESAARREREHTTKRDHDQQHTEKDTESEEGADPTQRGGDNKEPAKSGAAPPQRETTEQHTEQKLLSAKEETLLCCETKHHHNHSLSSQRRGEKSPLRGESRTTQREERGEAEKKPVHSKVSGDAHHAQEKTQPRAQAWIDEDCRDNTPPRRRNRSPDTAGHNTTREGDESETTTTPQEQRERGATPHTKQTRPGNEIKQEQRCAA

SEQ ID NO: 976675 - protein, 140 aa, Homo sapiens
MTHYMMHATASMTELPRHPELPGVSLLESTKMTLGVSSAAPTETTVVWYMSRPAKGCPVQRFPWLLGLSCCGLVPQRKLDRDVTVLRFTFPGLCCRPPHWLVGSSPSPPPRPPSFIVSWGAVPLAWFLFGFLGTVRSRLV

SEQ ID NO: 976676 - protein, 328 aa, Homo sapiens
SCSADRRSAVACSAGRDGTSEIYELIIDNGLRMCDADEAGRHSASPSRVTFHRRRPQKPGVLLCMSADGVLRGLTEANRHSSVVLSLKYPIEHGIVDSTGTTSGEDLAPHLLQRAARGPEEHPVLADRRPPECPHGLDSREDDSALWFETVQTPPATCIVGQSRPVLSLYRLLVRTLDIVIGTLDDGVTHHGAHLMMGYGSPPAILSLKLVAGLSEYLMKILTERGNKLFDTRAAEVVRAQRSCAGRLDFDRDARDSPSWETLRLHGRLTWDDRRSGGRLSGELRAEPILRGGSKLPGVRPIRCGERRLKSPWWGRRMPLLSCFVVPS

SEQ ID NO: 976677 - protein, 313 aa, Homo sapiens
WLCVSSWVWARRFTGGREAERWDCMALSAGCRAWLGSWRFDLAPEPASRLASSRQLWGPAPCCSAQCSLCSCACPSPPHLAVPGPLGPVTCGLGLWLPKPGLQPWLTPEASLPLGPRPLTMTGAALQPGGLITEHPVEHASVVGQCPHHALLLQTVLASVLGALLLVFLLMDDAPVVHVLGEVGSLSKLEDLRRLAFHAYGKAGKMLVETSIDVLNACATLHPAFYVRDRRLAGPTFFGPGCSAFHVGWPPFRMFLVGRRGRVCIVAPGQLRDMMAPSNLQSMAPFYTRVVGPAPLQQAYVGRRRAHTLGVRP

SEQ ID NO: 976678 - protein, 209 aa, Homo sapiens
MNRQAHGVPHRYPRPRYVLSPPTVRRICPMKDIMKDVNDETILLLCVERLETLYSLQNTIQQKRALYKMRNGYDLSPTATANFTRRNLADCLLESDPISCEPPPGLAMMSMKGQALVLHGLPGSLGHRPLIAANEYGAFLTSQYPRTDTTQRAISRERAVKTPEDNCLEGAPENRFIHEICQPSVCESSTQLGHHGTCITFFFSQNKGS

SEQ ID NO: 976679 - protein, 389 aa, Homo sapiens
QGFLLFLFLATQILRVVNSHTLIKASVVGGLSAVVNPENLGKAVRQTRDSLGASRIVRKPAVGTHVGETLWSLLPKHHKENFSGAKWVACEIVVPRLLGEGCEGLEAPRGAPRRGCARGTRKNRVPIITPPHAWVVNVGWRTPNPQKKTTKQKNTQRRTKSAGVRASNKGGHRNRAPTGATNAVFPVHTQTSPSGPPQRGGKTTRAGASPPLYKREKTREIYKILRETKPPRVNPRGQKRNRERTQQQKNHNTQQTTTPDQPTEPTDQHEGHTQTTNHRISPRQDRSPKRHNTKETKIYTNQNTQTLNQLQPINTGAHGLKKETGGPERTQTERGEQQCKEALSTMETYTPPAEPPTTKARKHNSVRRKYCVHTIENRCLEQAENTRGH

SEQ ID NO: 976680 - protein, 106 aa, Homo sapiens
AGTEESERDPSFQRRPATPGARAGSDLSSGRLMESIAGEQARTEGDGGHWTAGQTALEFETRLVGESGSLVGVAVLDGCRVKMRRSAASRIWGRVRAGEKEVLDTD

SEQ ID NO: 976681 - protein, 285 aa, Homo sapiens
MDCGANENHIAGCCEMTLESVELVVSSMKEYQFHVASHMMEWAENVMQILASSGKSDAGGCKFCRRMKELDLGPYYESSYALGGSMQIPSMELYLVSLSMSMIHLIPDDESRRVVVSCEVDRKPSVDIMCQKVMVALVHKTSNFSQDYVIEAVRTDHRTSVTLSLDIFLGPKCISMNQIKDYVDVNLKSKTFIERLNVVIGRDHSKKAPHCRKNLALEVQSSERLKTDELTPWDLEGDRPGSIRTQERVHRSPPPVGKSPTRPPDPDLNWMRLKKPRGWNNGTAR

SEQ ID NO: 976682 - protein, 119 aa, Homo sapiens
RTQGERHGGHYGAIRLPRDGSGWTLETPGAFNVHIPGDHTCLLLLILACQVSPYSLVLNLTMVGLEKKTMVSGRVDRRDGASHATPVDQQDPREAIDQSLDHHRPWELGPPGLGQRDLL

SEQ ID NO: 976683 - protein, 480 aa, Homo sapiens
GGGEKKGGRGERERGERAGIVPPPPARGGATPRGRGKNPEGGGDGGKGNCGTLGGKRCAEWWGGRGGEREERGVGRRHAQSGRVGWVAERVVVAYIYSCVECVILVFLKRGGDLSKERGSRRGERGCAREGERWGCIYTPARRTHRRGPTERGTTRGRPRGTRAVVGACRPLSTKIYLIPPWREGGGCVEKKKVGGETETPKREERRTQREMKRKRGGGEHMGTGAREERETRKRRVRVQQCRPLGEERDNHLQKTPRRKEVCHPQDMTQKSSCLEHKPRRAEAKRAVVVEEATTTEKTESSRESHRTNVSSQRHHCGEEHNTNAAGDEMKSWEQRRRRSMGKTRGVIAPSAPHRCRERARETHTTTEKYSTSQRRRAEHKPRGDTNVKERAVSWENKATQAGGNTRGHRRTSLTRRRTSVCATTLLRRTVLHPRGRTHIKCGGDNPYRRATRRGRTQRRLMRGRSNTRASEANHKRKQA

SEQ ID NO: 976684 - protein, 146 aa, Homo sapiens
GQSTNTFISQRGVKVQLVGEKEGPPPFPSRGDHVPLSQRGQVQRGKLRRNPEGLCKRQGCEKSQRTHKGDLRVSPGIPHCDSVPGHMCERSRLIYSHFQREAAVRTVGEREVDRHAEGERITKRAAMASGRLKEETRENHICGAPP

SEQ ID NO: 976685 - protein, 328 aa, Homo sapiens
IPFRASENRHGTRPVYSMKGCDDGFIALLPMKPRRNRAAREESCPLAGSAIRCLRVDKASLHSSALNEQYETFIGKMIILEPRAPDGSAKLIHVAGLSRVNVSFRTKSRPEERLLRSVASLVENLSVRTRAELAKIDVNCFIEGMSPMSTGSSYTHNARFLTEPLKWSQFPFYECQRSVVESFIHMQQVRQINYKERSSGMKKKNDEAGSSCKRSGQEVEGKSPCPQSELLRIRAETSEAVSQKVGGCEPEVEVVSQNWEVGPNREVEGRGNAVHPLGRLARLGQPAPSGQGGPWPLGTREKFTRGPLPPRITNWGGQPKGNTGTHTR

SEQ ID NO: 976686 - protein, 232 aa, Homo sapiens
CFPAQEPQGRRQHGASRNGMVLKPQFHQGLAAARGTWFKQPVRKIQLDSKVRRSQEARRIVPRPESGPIRAIVRCPYRFEYHYEGARQVAVVRPGGALVVAGIHKEGGPVASAFLCDPERWAVNKSTGVPAGSDTVQRLEGVPISETHPLPQEALGPQEGRQFCMKNWIRGHPDDLDRSCPSGDVYKKEKARVITEEETEFPKLRIVVRYGRAKPGSSAYGQKEQGSRRTGC

SEQ ID NO: 976687 - protein, 168 aa, Homo sapiens
MEISGGGGHPPGVPRVAHSGGTPHLRTSPRRAAQKCVSHQEKRVPPPGSPKNSWGCPLGVSLWPSGKSRNEDGHAGGARGRKKSPPKEVDPGPQRVPLLKKDFVGEKRGGVSPHSGGGTQQGGDHGDPKEGGRQSSHLEKTPPTWSGLEQRMRKPQEHGRQQSWGTTE

SEQ ID NO: 976688 - protein, 104 aa, Homo sapiens
MLSDSGLGPSKFQKDFCSPIGKHAWNPVSRTHFSTQVEPPLRPVVTVFTWLWGQLLTTDSLYARTPARNALRSLRVGTTTTTLVRFGRVTPAPVWGTQRVHHIY

SEQ ID NO: 976689 - protein, 395 aa, Homo sapiens
MRCARAVNLLGSWVEAVWTKQCQECGQCIHGGMADAQEEARTSCIACLAQPSTRPKECATRDSRDASWTNYSNSLKPLAGLSACRRQCMCSARDRIVTHSNVYWAPARHCNAHEVTEPHFLRESRGPQQHLAAGETLRQLNDSVFETAGLTDDSCLWWVGHVMIHTALPACKPFHVLGGQVTRRTHKPCFPQASSRVQVRYSPDGAMLVSGTHDTGSVLKPKEAPIDRVKRWLPGTCPWLCYGSVDDDGKFLVDGLSLLLTFAPQKPDPHFDPRYGWATGVPALGWVAVSASSCWGPSGCGFGDRLKLWRNSGHHELPHKVSTRYTGLQPLNCQGAPERRGSPTNPLLSLSKICQGATAGVRTKTRQKKPSQQATNAFRILTGIFPKYSLKTTLL

SEQ ID NO: 976690 - protein, 126 aa, Homo sapiens
MSLAPAQWQAPSSASIPLPHVMRILGGRPPDFHPETDPRAMALTTLTTPPAARPGRYSLMAPHWGERQTGTNHSLGHGTNSTSQDDNTRPDRNSTLHKRTATTNPSHIGHHTPTTHHTQAPTDHTT

SEQ ID NO: 976691 - protein, 335 aa, Homo sapiens
GCPCPAGACCLLLPAAPCRSLHACPCLPALEPRVPSAWLPPALRPAQPAPAQPAREDACCSRNGSSCSLALWLLSEVPSVPMIPESCEWPHVPSGLLPQTAGLDAGCPRPCMLPDAKVFVTGHRLWCLLTCDARGLSLTRPHRGLLGPWGRGASLWAVSPAGSDTKEWSRTIKVVLRAKKIFGCGGPSTLRVPYPQVILLLVTGKIVDHVEQVPSAVYYRHNSSSWATQCQHRAASKRVESHESGCPGHGPQASARLRSPLRPCWILALGVPRCGLHPHLRGSVAWGLTLVANAVAVIVLPCLGQPAALTRPLPGTQRAETDVRYTSTTHAHNQT

SEQ ID NO: 976692 - protein, 321 aa, Homo sapiens
EPQDVGSHGCQPEWMVLKPHFHKDWQRRVATWFNQPARKILRRKAREWPRRAIATRPLSVSHPGHRALPQVRYHTKVRAGRGFSLEELRVGRHSQEGVPGPSVVSVDPEEAEQVHGRSLNAKCRGVEGVTVPNHPLPQEALGPKKGDMFCEELENWHPGDRTRSWPVRNVYRQEKARVITEEEKTFKAFASLRMAVQRPVFGIRAKRGKEAAEQDGCSTTEALLGTWNQSAACLGLHVLCSGEQLGLDWGLLCGIPSDEGLGLLENSKRRNGYSWVKPWCRLRRATVLCRHRQKTTHTSPHSPHYITNTTPTPTAKTKSLN

SEQ ID NO: 976693 - protein, 252 aa, Homo sapiens
ARPPGPDTWRVPRRTRSSTCGPPAFLGVFRRVCGTSGELGRGGGGVGRTCRGAHLVPPWHGGKVDLRLHDEKEAKSFLKGLSDKQREEHYFCKDFVRLKKIPTCEGDVERGGCEGGGAQVITQDKQLNEKISLLRADITKLEVDAIVNAANSPCSEAVAVDLACIHRADGPCYRRVRTLKSCKTGKAKITGGIGSGKYVSNTVGAIATGARQQVRARSVLSSLTAVENGSSGGPWFTGVGTLKRRERVATGM

SEQ ID NO: 976694 - protein, 377 aa, Homo sapiens
MHHPSQHSSPHMAGRTTASAQWQHQPAHHQAAENPQCNASGHQSLKHMGQTANTDHAPGHWRNRQFVPSHFKRGDGTITHISGTNTLLRSHKDPLPLVRQQAVNKNTQHRGNHSGGLTLHARRQHWSTNGKYPDKRCLADTAVRSQQRTQPTTRAPNVATGGRPSPLARGDDTGTPCSEPSTHERTAPHPPDTPHGHEEHATPPGPPPTLNTEAQQPTTSTSLPQSRTGGPHRATRTRDSRNSGARKGRIAAHTWSQAGSDDNNNREKNKRTREHLTQRNQGHELTRGRTPSRQRSTTSHKTTTTHMRHRTPPARRQKRRREDKRDTTERKNTGDNEEQQKRDSTELRAKHPRPATPRTHQQTPNPTDAPTSSSAPS

SEQ ID NO: 976695 - protein, 313 aa, Homo sapiens
EGAPLFIKAGPNPCLGERPPETKSGVPGGAGHKPVLGGVAPSRRLENETSTTVGAPGAQVSVASPQGQARSATISVHERKCGTDAFRGPKKRHRCKTLANRGAAILALVGSPEGPKVPHADQHSQKGVLRGWIWELMPLSTTANPSGWELSHGAWKPIYNTLSRKEITCGIMVPQRGRWFPPRGTTGGIKTWGAVNAPLLPKLVVPGKKSPLWTEIFDSLGPCENPSYGRRPPHLESRKAGGYHQQPVKKRDRNPGAPAVVGQVGDPKCLARIENSTASSTIGSDPAKPWLENCRAMDCPANGPHKCTRGTDK

SEQ ID NO: 976696 - protein, 197 aa, Homo sapiens
MYPLLPAVLDGLAACLLVPPQQWDLYVENGIVRRWKWYPSRKCGDEYMRALERLVDVVSRVTTKRGGAMYRTSCVTCEVARMVGDENLECVPVETEMNMPASYRIRSVGPDIPTLELTFFSRKIGAQLPALRRRRRCQQETTGQGEKGKHKVHSMHVEAYVPQTEPDDSTDRRINDNTSPGTAHTHHKNPKRAPHAT

SEQ ID NO: 976697 - protein, 276 aa, Homo sapiens
VLSRLLCCAASVILDLRSMMRPAVVIRYVHAEAVDTDGSSGASRLPCLPACTGGVLKAQSFLFGVYVVGKYLVDPRLYYGARGLFVVLARCPSGRVLLAVLELTARLACIPATRIALGFEQLALPVPEPGSRILNVVGSVGQVTLTMHRSGPSCFRKVYRARMPGAAATGRSPIGDACANWRRLLPLFLLGGEGPCDADPLPVEHPTFPGLTNLWTRPVLYGRSLQGCRREDQDGSRRLQILVPQVKRRRCVAGDLSPVLVPRLLVVPLKGWSINL

SEQ ID NO: 976698 - protein, 186 aa, Homo sapiens
MQCYPRQSMGEREGIEPMTHAEYQDNSRVPDHTRDQKDRVTSGNKPPLDGVGPSREHQATEGPQEPNQDSKMGEPHKFGHENHNNRIRKDNAKNKLTTFGGVTPRANQVLINPGIDGRGMFPRGELRTQTPCDSRGRRSSQAHNNSARKGAEDTEQRGTHIDDRKAHKIKRGAQRAHEKEDQPDIE

SEQ ID NO: 976699 - protein, 287 aa, Homo sapiens
KQMADDAESNALRPEGPWVALVLMIDTASEVPQDRLSSSVHPGEPAIIDAGEGDLMRMHAKHLRESESAERIKRRGMPGRSEVCASDMVKEHIVEIESNPIVGTIAIHRMLPLAPHCTRESRTMRYGIFVSHSVALRTFHQIGHSVIAQGLYYCTTVGEHHVKKPTGRRRDTKSGKPTQLQKVPNLYAYSVEETNRGGHRRSGFMDAVLDVDVSNVQVGPSRSSHVVGAQVKSLGPNGFSQSGPLSCLAGNVTCARGYRHASGVNVPRPTLCPVGRSVDECRSAWRS

SEQ ID NO: 976700 - protein, 176 aa, Homo sapiens
MTAEETAFLLEAPLPRLCPGGGAYPGGVAVEVSCAGACWVCVSPLGCLWPHEPRAVDSLVLTGLWVHRLPNEGQTECDGLLVANCRRLVTPCGHVGLCVDPELRVHLRFLLPNTFEEDCIMSLVGIIVGTPCQDDSIEAYGICRGASPGYVNSGHTTCRSLGRFPLQQRLGPNGEA

SEQ ID NO: 976701 - protein, 274 aa, Homo sapiens
MQLEIPYKFYICKLQLVWLVLGNKNPGSLRKKKKQKKKQKKKKHQQPAPNNVWAGTGTRRRKRNGAPREQAAVSSRRPTILWCNQGCETTSAGHPTYREEQRTITIDDNTRRRLTPPEAKYNRGQRGDNHKHTNNKHTTNAQHNSTSTDLKTSEIKVNHKNKESKLHYTSNIALKTTRLHYKTETTKNDKQLTRRETTQTNHSNHTPTHHHDDRQKHTTSANTKKRNYNDNGQKAGRRDKKRENKRPRAAKDSKSEEKTSTEDHTRTDRDRSER

SEQ ID NO: 976702 - protein, 294 aa, Homo sapiens
RDSQYETTDTMCKIFRKGVVSVLGPSSSPASASTVSHICGEKEIPHIKVGAPRRHPCLQYLRFALSDLYPSNEDVRCGGLPNPSSPSTTPRAVSSAAKAECLCDWRNWCVASSSPRRGCRVEDVDEHAGTQTDCVKEALPDDKVSPVIIDAKRLLSQLMLRKVSEWGMTSRFYRYISHPWHFPILRLGRSLLEDSSNILGVLHVQDVPTLYPEETRAPRVLEGELRKVRLLCPALSAGLMWRRDLCELCHNGTRQGLGELELSSTNLARTQPLLLGSHKLRDTGPSTRADPHFH

SEQ ID NO: 976703 - protein, 88 aa, Homo sapiens
MPQKTIRCITSSQNTAYRRPQIPIAPPQVGTLLGGEHTHRFFADPRQQEINGRGDTLSLEMPFPGHYRRFVRPLPQGGDIASFHKIAL

SEQ ID NO: 976704 - protein, 114 aa, Homo sapiens
MVVPARVWRSTEGAIGVLADTEGQAWQGGGNAEPGTWCGGEPASGGTEGGSAESEGAKIDRQKNRVRNEGHSKSSPTTTLKQTKGNSGKRMDTLFIRKALSWGTLQQKQNLERT

SEQ ID NO: 976705 - protein, 136 aa, Homo sapiens
GCGEVSRGSSPGGAVGELCWIPTIRGPQGQNLVVVPHLGHHAPQQTGPLRTANGGSEANSGGLAGIALPWKTRTFLVGERVTLADITCPCNPWLVGLYKQVLEPSFRQGLSLNTNSLFLTCINQPQFRAVLGEVKP

SEQ ID NO: 976706 - protein, 349 aa, Homo sapiens
DTRGLVCLKYMTMCPECGNVPTLEDVLELMKLHTECKTPEPHTDWPAPDLWPDDSEMHVASTCGVLLVRTATLSGSGHDLPESELVPPVCACAVHTCPCNDTTLLRRHLNCFVQLTRNVTLCLRVVPQMPHEIKSQGSVYSTHDEITGYFITNFFPRDTTRMWDPDTTYALIYDTLRTIIRRYEEQGTQQGENSTFPFNHRATFITLINLGNWLLTATRGHARHDKHVQPRMVGTHCDWEPPCARQYLTEDTYPISPVGFQPKSSDKHFTSADVDLPQDQGRTAHHLCSWSHSSNVPSDQTRSTQWRPPHSITHSRSIGISADPTYQYHRFDLQQPEHAQISYGAHNTT

SEQ ID NO: 976707 - protein, 90 aa, Homo sapiens
MTNPRPVPEVWQLAENGLLTLAGKQHAYSTAELHQQKERFPTQHQCLSLGCRCLDALSVVAALDGITELADAARQGRPSWRCMSAGVQFP

SEQ ID NO: 976708 - protein, 280 aa, Homo sapiens
SERACRQLPASRPVSPLFPASCDPPPWPVRSWLCKLELPAACARTADGEWPPAVLPSCCPSPCEPKPRALSLPARAAHWPSCLTAELELPRLSLAGLDHQLRELLLLSPALAGSSNALHGGSLEFSLPHSSQDPGEHVQTCMTAGRGCVHRTLMELKLLMDASWGDPTKNRPWRLTQHCSKAGGNEGLSSGHGSSIPGELPASNHTTQGKMNGYVDRHAQDHHAGRNGDLGKKQYQENLDDGPRPGLYTSRSSTLLLTDPGHHAPCTNGTATALQHRVVH

SEQ ID NO: 976709 - protein, 225 aa, Homo sapiens
MLTQKAANSVREKPSPKGAERRTHGALGATGGRPHRGFVCMRKELSPPRENIFHNSGSFATEATVGFPREKRRMTDPSTTLCTRGTKCDPVFIVGKKPPPKAPHRITIMVDRRPGKPGWSSSKMTNAAALHPQIEAPRVCGPYNNTTRGPPPRRDNHPHRRSISPNTTGPKGLDKQYTPRGTEEYASSPARFPVCPKEASHERVSSAPIPPPPGDHRGMPQQADS

SEQ ID NO: 976710 - protein, 95 aa, Homo sapiens
MKGRRPERGEKGGRLTAACACVNHQEGFHIQRSGRQGGAPRLSGPLVEENPSIFLSGRIFGPGPLKTSAFVLRDGLKSPGDPSGGQVGFDRRDIR

SEQ ID NO: 976711 - protein, 103 aa, Homo sapiens
SLPPMPSCLSSESPKEPEQLRQLIHCRVRAFETSMSDGASRSHFETMGNAHWTVCVIEMIQDTNATPGGYRAVLITTTAHCVTAVDCRIMNCNGHNNGGLRHE

SEQ ID NO: 976712 - protein, 276 aa, Homo sapiens
EQCGARCGLWLFPLDEGTAKMEANRNACYTEHPGRPVTIFYKTFHGDMQCGVHAPVLQARCFPCGSEHLPYPLWSAADGLRGTAVLHLWRPEPHGVTVARREQSQLLLFWAPLMAGSSKVYLTSKMAPPQNVTDSILVEINKRVNALTWYLSWRAGQSVRHDQEKVFRLPVQECLSYPNCPSARDPRTPTAAWCVVEGRCTLEGQSVRGPDVGHATGLWKPDSKVLAWASAAPVTEDDAGGPREVPLTVRPLLSDEGDDLWSLLGVRGNPAFKAAD

SEQ ID NO: 976713 - protein, 248 aa, Homo sapiens
TESAQNGSESPLCDGKMGTRSQLQRRGRNMHEAKLGSPRVCGLSEEHQNASIQLVMPRIPTGLHMSARAHPEMWVKDSCCANGGSATGWLSVPFLAMAEPEFVEVIGGLAADRVAETSIKEARARAPCIVYIDEIDAVGKKRSTNMSGFSNTEEEQTLNQLTGSTWMEWVPGTMFIVLAVHETEADILDGALMRPGRLHRHVYIDLPTLREKGERSQHMLDSRPGKHSRRLHIRDTAQQRHRREATKR

SEQ ID NO: 976714 - protein, 155 aa, Homo sapiens
KEAKEVKYSGPCILTSDGVAPPPTPMVDHLVASNPFEDDFGAPKVGVAAPPFLGSPVPFGGFRVQGGMAGQVPPGYSTGGGGGRPATPSTAERPSLPKSYGPWVQHAAHRVRGEPTAGKSELFRSRAIQTSLWVKTFGSVPGGQMMPGPVGGLVP

SEQ ID NO: 976715 - protein, 196 aa, Homo sapiens
MSSKVSRDTLYEVVRLSPDWEPGKLRKFLDDGGVADAALNDTYDPRRRRRRFSGHRSGYTGSVPALMFSVEWILGGYSSHCDEANGRVVYPPHGTIEALKKAQHRDTEDTWSRKLGHKKYDRCFWPQSRLDHSTTSRNSRPTGINYRQDPVPISLLHHKRTTWLEQHVDEVKFTKSRFQLTEGVLSGMYAVGSRDD

SEQ ID NO: 976716 - protein, 169 aa, Homo sapiens
EALEEPSFFTTGVMWSIGAGALGGLVPWRMRACANTDVLLSKPQKAVPVSTWTDIDLRNHWTNGTNGAFKAKELWEENMDAVTEWLVRRARLVPLSRWKLRTLSSLSRAVLDQLGVPLYAVVREHIRTEGEWISAALICKRRNLPVMKRKKFYGATKAEDDVYGIYSVW

SEQ ID NO: 976717 - protein, 101 aa, Homo sapiens
MWEKKLRGLLPFLLQIDVEFLCVREFSAQFIVDRGSRGQKVSPTGPRRRVFSQTSGLQCGVHNSKSHLLRSVVSHKPKHRGPCGLIVERNISEGKPHYRGC

SEQ ID NO: 976718 - protein, 172 aa, Homo sapiens
ISTPRHSSAAAAPRKAQCRAHAGVAVCCPARRRLRGLWAAGCAPAAGQSARCGLCGARVLCNAAAGWHGITAGMVRRDRLREDEGVAGPGGAVAVPLLAAVPATYTPLQGSPLPFIHGTSSGKFITYQGTAVSSTKTLWVWFGSPRDKLCLNHGLPKSKLQMVQRLGNGSDP

SEQ ID NO: 976719 - protein, 257 aa, Homo sapiens
MAYKENRLHNLRIGITFTGRKLQTRLPTQSKYTAQGVLGQGHQLRREIGVLGSGTFQPGQTRKTNTRGSGQPLEKSQKLSPDTFKYQGEQLTSIQVKISNKFYNPVLISDTSFRDNFFSEGLSQFREASMRGVHLARGKISILNKPRQKGYASAESVRSMAGDDGGARSSNSWVVNPHLLQGGQVRQDGAPIHTEYWGSGGAEDLGPPGGRRWGETLGSGGKPERGGRERPGGDRLAEARPSKGRARGRQTTGEREG

SEQ ID NO: 976720 - protein, 234 aa, Homo sapiens
GQSTNTFISKGSKCAGEKEGLLLPLKGITAPSQGAGQQGTRGPRGCKQAGTQTKGDPGSGKHGPARHGAPQYHPEPPWNGAGCEATRYTARARASETPDTWAPVRPVQGAGANTHIGGSRESSAVCPLGLLEESPWTSPYSRRASCHIFVSPPYPPFSDVPEQGKGAGEATRGPGQTYGGHPNKPKTLAYISTYAAVMYQPEIWPKGEYSPNMAMYRLKSFMSRVQREGLPLGG

SEQ ID NO: 976721 - protein, 195 aa, Homo sapiens
MEDILSESEIKMWMVFATKTDIPGSAKGAIRGRYASDCHRRPLLQERTGIMWKLVSVQDFHQKTIKELVWMKLMNKVIYMTEDLGLIINRFSDGQDYAVGTVRDCESRPVGYLLGVAGPPGGTCGWVISRAEKGDIEPPDEEREQSVRLPVDALGTGLRRSAPGPQQTGAWHKCSPQFPVIPHLGSCTTGEQKGK

SEQ ID NO: 976722 - protein, 218 aa, Homo sapiens
MSPTKAKPQNQGAPPAQKTPRGTQEHRRRTGGKHLHMGPRRKKVCAKHHNIGIFGHTDKPCVVHNKNFGGFSPGNSGLFGRHPADPFHQHQGGLGPKSLNIKSPSPHVERAPPRVRQHTMAQHLRAATETPQTCLRTSRGHTGPTVEGYPGGRKGAQQRPSGHKGPSGGAPGEHGGDQTRSVNTQRVVRVIYLYTPQRLATRNTAAVTTGANTHSTHM

SEQ ID NO: 976723 - protein, 118 aa, Homo sapiens
GWDCPKGQRVIGAPPGTNQRWDLANAPASSFYLKGKEFEEPLGSIDELICQALRQGSKCPGRQPHKRLCTEAKMACVHTGSRGGTTFQEAGSSHQKSLRSAQMGCGGMSSRVETIGFD

SEQ ID NO: 976724 - protein, 308 aa, Homo sapiens
NPSLFMALKNQFKPPPHCNGGAGQKQKPRNPLGNPSSCPPNFWPVSGVWVSICPVLLGLRVGGVDPSWGGLCTCEPPWRHFRGGGGTRAIVPHVVFWAQVGVVPQKVSEARGGGGATGLLRVPGGVLEGAPREGGSWVCSLSVCPQRHNGGHPGWLSTKGVSIQGGGRRGGRHSGHFERTLPFFPPETVFAPPLRTYALVPQNVRDRFCGTLWGARLGLCAGNNGSTGQVLIPQKHENLPGWPMAHVGCAPADPKGLALEHNHHTGGIRLGGLAGRVTSPVGPVNPLSADNRARHGWDGGTRLVPIEV

SEQ ID NO: 976725 - protein, 351 aa, Homo sapiens
ASPRADAAGLVSLFLIFPPFPLSFFFFLSFLPSPLSPFPLRKGFPGQGQSRLTPAHSSRAPDAQGASRTPRSHPAHSDRRTGTQAPESHPRGSKIRVHTTAHGSKHCHHTGRTHSRLALADAHTAIMLPPGFVPNKKASEPPVRHPTGDTETDPGRHHRPNNPMANEDTAGSVHHCAPMREPGAHKHGDTPRRDEHPNKHHTPPHNRPATVSPPMHGPVHWPSNAHKHAQQRCQNQPSTDPRASIPSPIVESQSEKPELATPSTKASNTSLTLHTSTVVLPPSMSVSRRTPRLRPDRSHTNRTHTQPEHEAYRGMSTTDTYRASHPRPKVVPTARYSLRVPAATQYDQQMT

SEQ ID NO: 976726 - protein, 71 aa, Homo sapiens
PLEPSSSSSLRFSARARFEASREEDRRFAIRTPSFDLCDASKVMTASCCTEDISIKINRERQGPYYWSKDR

SEQ ID NO: 976727 - protein, 257 aa, Homo sapiens
LLSDGRGCYSSLSQSCNEVIPRIYVGNCVCGSGPSPEAAETRASAMCWNAGEGRSFMHVNSKANFYKDSGVTYLGIKANDTQECKPQRSTLERAADFMTRLGSKDLAGCSSTAGKVIRRSPTLVIAYLMMRHEDGRQVCLSIVRQNREIGPDGFLGQFCQLNEQTKPTEGKLTTLGEPPTALLDEVRGGGVGKGVPSCHVSGNDTVTLLPKMHKRHLSTSGVPKQAWALCPTLGEPIKKLATAGVLDSQVAGSEITT

SEQ ID NO: 976728 - protein, 281 aa, Homo sapiens
LRSSQRLVRSISTNVRRNLAFHTLSHGSPAQGVLHYLLGQRLPEQRSDCPYPMTDHGAGRVDRDGRRRGLPPTVRTTTQQIAKVLLWVTDPQLSTETLWGTRRGAGDAVNGSSGNYSLPYTSIVRERRTLEGIEGQQMDWCAARNAFAFHNEEDNIDFEKRHPLIPTNDRLAYPPLTKQGTPLSNTTLPSPHRSPFRTTALTSKPAYELTMLPLSTPTIFGYLSRTAFVLTEANRHVHEVRYTEPNDDHHLTPALAVVPTFVDRRQSLGHQPLTSSVTPRL

SEQ ID NO: 976729 - protein, 178 aa, Homo sapiens
DPTSYSPGNPSQLASCSLMLDMLVGNVPWKNPWHTRDYVHAPNSTVHTWIHLLGATASDWPRHTDLRQDHGRHSVDSIESSGGQLKTFELARSAHWALPGSRGKFLDSPHEAKLRATNNTNMSHAHYSHSGVCLRTGDDIRVVDLTLELMYMSIALPMAALLERAHCTNTGTQCNNLP

SEQ ID NO: 976730 - protein, 168 aa, Homo sapiens
MRLTPAAGALTTNNSYQVNSNDPKGRREPERIGGPEVTKCGIYLGINTETAPVCPIPLECEDMTSSALLKPDGGLAQAQERRCVRKHSVLLAAEREVRRARARSHSKWRFAVVQTRLGGILFSGLVGPPGFENCDTISKTYEIEAKARAYILSWDTLRGRAEGFPIIP

SEQ ID NO: 976731 - protein, 39 aa, Homo sapiens
MNLDYCFLLECTGQVQRLLLRWQLGDASWAQGQITETHC

SEQ ID NO: 976732 - protein, 118 aa, Homo sapiens
MGQNTGGMTSPRETGEHCEHVSSVVRGPHLSPVLIKWTSVRIQGLPREIITGDTLKAGEREVSQGAENNCLGDSDSHGAGPTREEAALLAASGLSKERLGPKQSRIGSPRGPSEGGRS

SEQ ID NO: 976733 - protein, 265 aa, Homo sapiens
RDLGGPAATHLVRGGAPPLHAAAPPTRRVPGRPSSRVSRPEVARLAQENEPAAEDGACWAQTRSSDDLLDFSMMFPLPVTNGKGRPASLAAAHASEVHGSLRTGPAQAPGRSGDQSSSSFDPSRTFSEGTHFTGARTAASLHPHSWDRDSEASSGERGAYASFARAPHACPAALRRLLLQAELALTAPGPLFPFGHDGDPPEYYPSLLRQLPAGTAADRQPKTTQAQQGPEGPRGLSRIRVPSQASVSTYGRTAPTTRSQRPQHP

SEQ ID NO: 976734 - protein, 170 aa, Homo sapiens
MTDPGTCNGPSGYGSTIEGGQNNMRTMNHHERGDTNGRQDSKNQRGTQHNERDRTQVEEEEKTQGRKRLTRKTTEEGTCNGRLERRGPRGPKSPGKTGEQGPKSFKGRNGNVKVGEERYRENRTGWETSRERQSTNGNQRRRGEGHRWGVHQQERNGSTNQNETENSRHL

SEQ ID NO: 976735 - protein, 236 aa, Homo sapiens
VDIPKMVDAEDGRGNVPDLDEKAIMSVTCLDFYHAVLWSPEGGDSELNRICEGVGRQPGRTSRRYGETSERAGQWICRKVGSAGTDPVAGGTGVAEEQPCMPCKQRAGGLPGRYRAPARAAQGAGEVAAGSINFKHACQTNAAAHVNRACLHAHLRAGWSRDINQCLGLAMEQVEKGYEAVVLLSAILARLWRLDHLTGNMDREKRIPVPTKVRGLSGDEGLNGLGMDGTMKIADW

SEQ ID NO: 976736 - protein, 288 aa, Homo sapiens
MHACMHACMHPHVLRNVPTTNVHISVHGMTMTAKDHAMMAACLESMLMMSQPDGSLLLPCSLREPVAETMQTERWTMRHEVATAWTVACKRPGGAAATSLWSKTKQALEELKNSMLPPSHLPSHPQHPAKHTDDHQADSDQLRRDLDIDKRTDTLADQCPMRDLTIQPPHAHAPPAHQRRDGTLNAHPARPCSKSPHHGLARPHTTYSRTPPQPAPQPCLRPSPATNSLHHHYPPPPSFLTPPDLRSVEPELAPPSSHCPHNSPTSDNHRPPHHPQALPRPPSAPNTI

SEQ ID NO: 976737 - protein, 161 aa, Homo sapiens
MARVSLTLCHNLETAGPGGPRFQGVSVGPPTCVLPNLWMALELFLYKHTGVVHTLPGVLWTQVSRSIVPLAHGKRQEKALQVGAPGGVCPRAPRPCGRGQRGFPPRGEYSVWPPRGEISVVSPSSREEREEEEGSPLQSERVWARQSLSHALRESRVVPPV

SEQ ID NO: 976738 - protein, 345 aa, Homo sapiens
MKRRKSYVGHYLTGGSQKSGHKVVRDLNTIPLYTVALATVSHSVPLTLSEGNYILSWHSPVQCSETEREECSRKKKPRLTKRGARQDISAHVMMCASLSHTSVTVPMSHRVQQVAEKSVVVVFVPRSNIFPRRQIVLYKGSIHPHRLESCAYTSEGPKGGSAPIFVLGRRETTGGLITKRGGGDHRSETNIRHIISVRRTVAKCTSKTTVPCRNEMMSTGSPKILPERWIRTPTELMYGGATETRGVASEAAYLQRATVILRHDKRIKGKDSAGVQSKSRRNKRTLRSMGQHKDIIHGAKTHMVANHVFSQQRVLITAQTNCLRGPRCCKEHNNLLTGRQDSCGA

SEQ ID NO: 976739 - protein, 398 aa, Homo sapiens
MTTQQHKRHLASDISQQQPHQVRTATDEQHTHKSRSKAEETQRRTRPIDDAEEQAMSATRRGKPTATAGHPAETDERERERPTVTSQTSETRTHRQRIIDVSEATQSGTPRHKGRERATHNQPERGQHRPTRPQRTASPDTHTSSQRGGPRQQTERPRTGPVHRRTRGEAIHVSTRAKPRPRSTTSTGEASLDDSKLTAALTTAGAHTKALEDHPIPRTSHTANLTTIAEREGKSSGSINTRKRTRQITQQRSNDNTNIRVAASSIKIDDAPTRITSRRTHDTQSLTRTQPQSKGIAEPDAPVRRASSQQQLMNSQRQTTKLDEARQHSTETERKTRPENHSPRAEAHQTTSKTLRRTAVSLDRQARLTEMNYSDQLSTVSSSRSERYSGSHSSPRSM

SEQ ID NO: 976740 - protein, 316 aa, Homo sapiens
DAPLLTVPGLGPCPSTCPVLNDHRAALWVRPPLATEPDSLRAPGDGRATRACARLEQLKSSRPGDREVSQAWSEKPRVEARYPRLKTWRQMAGDRVQVVDMAGATGSMGHGTAEGRGPAPLQRAPIRCSIWETGKRWAGRASPRGRNSGTHLQPAMPLDPVVGAQRPLYPGSSDLSPDRSLTSHVKATKMTGSQGPEFLSHVRRALTRNPGNFNTGMIYDSSQCWTHQWIMRGKRGREHGAKHGREFEEHWVPDGRHEAYRNRGQTQRTKEATGKADLGSERDGTNRDKPYRDMRNGSEDWPGVSLLLSGDETKSR

SEQ ID NO: 976741 - protein, 135 aa, Homo sapiens
GSLVIQRHPGPTCCLTFRDGQVVSRGWVLTALKVAELTVSSELVNATMTRAGIVGEHAQDLLMVPPESHVQCSLGRMKLGGERVSWQFLRATLSPVAGSSVSSEPSTWHKSAVGHPLSVSTASKSQDAGARGDLI

SEQ ID NO: 976742 - protein, 95 aa, Homo sapiens
MYQEAPNKKRPSRGTPAHQTKGDAHEEHTNNRDKRPKHPWSETTPLEVNKWRQLSQPVHQKKGNNDDTARGGAQKAHDTQRESGETTRTTSIQAS

SEQ ID NO: 976743 - protein, 55 aa, Homo sapiens
ERENKSRVLYLFRPERESPRAPRGGGGGAGAGTRDRVGKPRRGTEDNGEKPIREE

SEQ ID NO: 976744 - protein, 155 aa, Homo sapiens
LVGQGGGDTELEQPPCGYDWWLRPQQRELELLAEPVAPSPAGGDELGPAASSAARSRWPRPSMSEAGEEHAMETTGLATCELDIEGRPLKARSPGWGLGLGGLLGGGLDGALWVAPGAGNHEWAPRGDQIPTAMQERGRDRGEQHVRLVAWRWGY

SEQ ID NO: 976745 - protein, 314 aa, Homo sapiens
MLMPHAAMLPCAMRGADALRELNGMTPWLRHACRWLRSPSCLPKCSLTLLGQMTTEASVCCPNGLWNVACMRGNLSACACFCPCPDGPSELRQMMLWLLPDETLPEVMLPDGQPCSAAVSGPALPVPSVLLCLHLGSGCRRVSRHSSAEGGTVPCTSPSGVSRQGSRTLEVEEEELSYALSREGSHQAKAVELRAPRELRAELGGLSASTHAPGSCPKSTGALSSELENSLVPRFPPDLISLCLRMVGVFLFLRAPELGGRLYFGAQDCFMARYSWRVVDEHPRVKEAIFKPRGIPGPYISTIEESQGRETRGF

SEQ ID NO: 976746 - protein, 78 aa, Homo sapiens
EEGVRAGSEMMLSTLLPHINVLAAKLIGVVDDRKFRMFYEKRMDMEVVVDALVDEWKGYVRCEIKVGVDTDQSKGYHP

SEQ ID NO: 976747 - protein, 313 aa, Homo sapiens
EESITRSFQRKTFVVFKLPVHHLKAVLGEARMLNASIVASVRGATRWCSDSLTFEMRSQTAVVGVQTSRAHRVHDTPPKDTCDSPELLYGVLESMRQSCACPTPSDSVVLEGNELDSAMEKVHQSREPDHFWGPHGCEGTRDHGVDRRFRYFAAVAVSVQSSGGDRQVSKKSMDQHTEAAVRDIRVELIDPQAEEQVQLASRLDQSLFPAGASNSRPKFLPGVSETQQEEPEDREHPENPMGPQAEMAYSPGPPCWRAREMHSGNGGLVWTNLRTRPSMNQMSLTRANLRYGRSLGIRRRGTWALPKLARADV

SEQ ID NO: 976748 - protein, 239 aa, Homo sapiens
ARIPCLCDRLGHSDSTVAGLTLLAVGVYSAKNATLVAGRFIEARLGKPSLVTGDAPASRCLIVCCATPSRSRRRLLTSTPGPRWRVLCSVPAWNATWVRDIAISNNGTPKIEPQPVQEPNPDVLGHQCTGKTLFAKKLAPATQAWTYAIMTGGAVRPMGAREGVTAMHKLFDWATTAGAGLLLFVDERQTAFHSRTRATARSSRRRHIQAPPLNALPVTDRTTHSNNPSHVSHGRINVL

SEQ ID NO: 976749 - protein, 311 aa, Homo sapiens
MGKNFQNGDPRGPPETPPAGERGQGPLGERRCGGRPKKRWTPSLRRRRGIGGEEGAEGKDHIFGAALGGANELLSGACRQKGHALKEGGQEKYEETNSESARTSISSPRRVRWWSPPGDNAAHLTREGGAATSARGAAPTGSEETALGGEGSEPLWGEEKAPVDPHALRGLGRTSPGSRAGGQLVPQGQHSSGKKTARLEPVGNGRLGDEKDSPPLEGDQAKSSKSATVTEPPGERQFGVSRGGAVHHERDLREKGRPRHLAKGVDAMVGTGTGRGAEGGRTEKDGKPRNKREMNCSPPGVRAPTGGNTRG

SEQ ID NO: 976750 - protein, 254 aa, Homo sapiens
MVSGEGVITNTCRVSGMTEEAEGPAAYRCAKAASTSTDLPFRHKVEGGPGGLSAKWWEINIHNIMAKGHEWQGVTHEVLLVSSHNGFRRGLTDPPILTRIVDNVQMIGHPCHSISRSRVRSQLAPARRTRIPGRKLPAANAQHGPHGHELPRHDRSGMNKTTESSMAARSSTSVGLAQRAHNSTEARNRRLQGTLHSDGQRRDHEPPEMTHARKDPTPPAHPATAPDTPQVQDKTRRQRTPDACTTPICVHTRT

SEQ ID NO: 976751 - protein, 149 aa, Homo sapiens
MRSQTRGSPHNKVPRGDRGQHAGVRFATRDPPKKQIPAVQEYSERTPPLLPVRAADDTIKAVFVASCAETPTGGYYMHLSDGDPSNEGAVIHEEGTNVKKECEHKTMITHQDDGLITSRYNHTVVGVEIVSTQNSHTVMKKATRRLHTC

SEQ ID NO: 976752 - protein, 156 aa, Homo sapiens
MRASLFKSNLRIRRSEAQILPGLCCIEHCDLYGRTRRENTMTKATVLLLAWTPRELSLRTRAECSSVRALKHYVTNGLCEDSPVPALKLQERVPWHPPLDVLPLAADPTYQTAAMTVDGPQALSMMTSGNSCSDVYRNSSRTDLAVYTTRPHSPLR

SEQ ID NO: 976753 - protein, 142 aa, Homo sapiens
MAPVTREVSVELCGALLEGTLPTVLPPGFIDRRASRKRENPHDAVVVSPNGLFVEDPRNLPEKSVVGTRGPCEDAGQLEKVPASGVEEYSGKLETRFWKLEEQQEFSAIILATAGWRQWVGTPRGGDPGPEELMVSVARAGV

SEQ ID NO: 976754 - protein, 72 aa, Homo sapiens
AVVKVQAVGAAQRSGDYERLIFRNRVPHDEEITFVVVRERGEDHSLFDTQEETSVKAFTVETSLCRHEAYDR

SEQ ID NO: 976755 - protein, 414 aa, Homo sapiens
GQRQLPDPARRCSPCPSPALWTREPCTPCPACSAALSIGACCSLLNVHPVHCCPWCLVPVTLLACCGGPCCCPCKTPCSCHGGAATGTPAALLASMCCACGQIKACTLLERCLCLLGLRGRYLLTRLQIADELTRTSFHPCADDTLPWHLATQIFAVAHPEQGCRFASLPGCCCVIALPAWPSTACCADHAHLTHLTNLVHSTADHAVISTDQFSGTVEVLVHRDSSRWDLRCCDSTLILMRLHICTGSLCPVNRQGLAVHKGIAQDTFCGPLVATGIIPFATVPGMSLTRHRPRIEGLTWQGLRCLSNVQRMIYQTFLPAIPSARHVALSCGLSEPNLHRLPDKPQGSSQTTETRCRQPEPYLRAVHRKQRETHTSTQTTGDSRRVASRPAKSNKQRWMHTGRPRGVPLVEHP

SEQ ID NO: 976756 - protein, 260 aa, Homo sapiens
SILSFSPIPGCVEPGPPHSSYGALSNSNAHPGPFPPSTGAQSTATHQSQHITITTSNSNSSSSSSSSSSSSSSSSSSSSSSITETLGPLLLEHFPTHWRAVAPTTHTFAMSPSLGSLEGPNHARAQHTLPPPHSARCTTDNARPPEWSSSLFLFQILPLPLLKGSYPMFTPPPLTRVLKGRTYPFTSRCLLVTTSFRLPLPRSSRTVCFLAQPGTKTAFPMLGPPPYRHPRAPSPRGALQRPGTQPGYQPRGSASPSFRT

SEQ ID NO: 976757 - protein, 238 aa, Homo sapiens
MSGNSLSRLIDGIPRYDTTRAGEDDTVNCTKREEVEQRLGSYFTQVIKTQRARLFVKTIYLLKHRWPGNRWPDDCNVSVSSYVDCLNTTGILEQDVSTQALWKKTSHRVHKRQQALFTACLAYDHTRVCILPPCGLGMGLKLLQAVLMHLNVKAHKEEAWARHGSPMRHYVREERARKPQAGRRPAHPNCAWRRVKRAHAGENLTVVGAPKEDIPTPRVGLPHQAHAPQRGHPLHLDN

SEQ ID NO: 976758 - protein, 100 aa, Homo sapiens
MTSDWNAWAIQKAQIYDEDYLKDTCCDITDATTRVWGHNQYSGTDATIYLHGRRTTTTDEHIATRTTAEHIDDERTNTYDMTTLTEEGTSADRVTEINEE

SEQ ID NO: 976759 - protein, 161 aa, Homo sapiens
GRCAAVMSLVIPEKCQHIGRVLNTNIDGRRKISLAITAIKGVGRRYAHVVSRKAEIDLSKRAEENSLRDEVERVISIMHESSQYKIPDMVLEQKQKDVERMENTARSVANGLERKLREDLELTEEDSEVHRGLCHFVGPSCTRAALTKTSGRRGRQRWVCP

SEQ ID NO: 976760 - protein, 233 aa, Homo sapiens
MSYERPTLAETRTLKPEMWGKCLDCINEHEWIVLCGKSQAVSWERRYSGRRGEKPGTEAEAGTVWSVGWILTLVERMDEEFTKIMQTYCPSLPRVRGALERMMAQVCAIIERVQANWRRRALTEEVCRICCCAYCTTTYQVDYEGPSATGDPAEAPQSLDKNRAKMRAKESDEADGRRLVQGKFKPKERITRESDTWSTLWHNLPTRPVTRAWYSAGNQAITTEWNSKIEART

SEQ ID NO: 976761 - protein, 118 aa, Homo sapiens
GQVVQATDPDAAASCSFRLSATAAASPAFPPALPQLARTYSGGLRPLPSVSAGVCMPLSLRCEVSRWLDGWRLAPSTLVATHLYCCLLPPARSCLAPFPGRPDRLRELDAGHSGLPWL

SEQ ID NO: 976762 - protein, 378 aa, Homo sapiens
KAELQLPPPPPPGHYGAWAAQELQAKVAEIGAPIQGNREELVERLQSYTRQTGIVLNRPVLRGEDGDKACPPPIVGHSSRGIPMPPTTFGTPPSAVSSDSPSNYSRTWPRLCLMDPATQDRGPRTTSYACWVEPDGTEQRRQRLNVGSDSRRHSCCSQEERAKQQGDHSLKDHERLEQQKRAAVLLEQEDKQETATMGTPDTSSPHKTWARLGETQLLWEPRASCISGAQRGPQVIQVEAQRRSHHDDKGTEKQQQDNQETRNEQDSKLKDPTKPTEKRKTQHGGKKQQLKGNHTAQHEGNRPNTTEDTEKKKGTRRNRERATKPTKQEKHRGPNSETNRATTHEPQTTHQRKHTLARQHQRDDQAPSRENTRHEATV

SEQ ID NO: 976763 - protein, 128 aa, Homo sapiens
GNFCKERGWVIAILGNRCSRPGRTLGAGEAPCEMNATVWRVGARVVLGDARASSFTRRAQRGQHRVRASRFMVRPSGRWKEVQMCGTYGLPSRAIEWQLLLSLLAGGLTVGGRDGHMTDGCATWVLCT

SEQ ID NO: 976764 - protein, 239 aa, Homo sapiens
NTLRLQQRHQLESYKQQKKELLQKGSTCITNTEGWVGHPLDPIGCLCRALLEACRLEEETLTLYPDSGPEKRKVGYTSTCAVVPGDPLWEILISGVLLARGNVASCVGLGQQRVLPEGLYAQDKVVRNEEQLLALLEEVELDERLVQVLRKQAGLLLEGGPFSGFGEVLFRESVPLHTLLTDTCITATDASMTGPGYRPRAESYEAANTATDISNAGTNSITGPVDSTDEATRYPRGSY

SEQ ID NO: 976765 - protein, 225 aa, Homo sapiens
GISEEAEVRIPLESSRNPGASRTSVVVEPSGGEGSTHKGSLKRGQYTEDADRKGGQLRVARFVTQDAGKTASAAWGLCAPRNTELWAGIVSIGPGGREGVEHVRWALGRGIDEVEIAVRECAMKTRSMARMDVTAMVRPFSLSPIWTHGELDFYDKASFKGGRTPTRTEGIQGDTVYTRGHTKHFTTAAQCGKVVQRLCALKNSESTECDNRDEKIAGQARECAC

SEQ ID NO: 976766 - protein, 316 aa, Homo sapiens
MRPPGTLHHTSGGQKSSQRCGTHVGSNNKRDHQEATQGVGTTPHIGEGKGPNIIKQNQRGSPPSTLYSEEHHTGVDHSTFDSKPRVGDSGGQKRDNPRDAPPGSNTPLSRFAHPRESTQRAGGSDPTHIIKQRGARATRSRESENKAVIVRRTTNKRRADKKQQLSTGEATHSRQLETQQTPLPLYREHGPGNDGDSHQQRANTQKKAEANTATKTNRGPSTTTEPTAHNCRQQQRAAKRDTQKDDRQRCHTKTHTETPENLGARRQTTSVAHQRTTPPRVRHSTRRQRETPPPLRRRKDTQPVSTHHNRQREHSR

SEQ ID NO: 976767 - protein, 379 aa, Homo sapiens
MRASSGQAETHSSSAGGALWYVGGIEDRMCGADWQRLMCTHYSQERVCNSLTFIKMYGVASTWRKKSRGNQEHGAREHLRMDTTRGGLHTRRGPGAKSPGDEVFARNSEYTWGGVHTKGTGTREASRTDGISTLADDAGDSGERIACEMAGDTRRGGGNTRGFWRESRGGQLLGTGAGETTGRTCGLVRHKGEGRGKCDSLGREPPRAGNFGAEWGIPRFGFFLGLWSWGPNEVYKHFTTAQRSPSGERSHPWGGGKTPKSGPWGGYHEAATTSYMGGRHLDMNPFREPGEPCGNRKDCKKTGQRTGHGPETGVPTPTDWRLRDTAGPHVVPIVPGAPGGGGGGNSHPGAQNDSERAEQNRPAANTGDTRGENTTNWGG

SEQ ID NO: 976768 - protein, 114 aa, Homo sapiens
PGGRSSHQASSPSPTATAKLQPESDAPQQPGSSPRGKSRSPAPPADKEAEKPVFFPAFAAEAQKLPGDPPVLDFRAALARALLREVIKCSPHVRGPLSLLLRSIWSPTDPWGSM

SEQ ID NO: 976769 - protein, 287 aa, Homo sapiens
DRSGRFCADWTRVLREPRGGVGASRSRRSLSLNRLLLVPCPPLRRVAVWPVLRERAGAPVPGIQPAVLEVAQGAADETDDLPRATVVVCSARRSLACVAALHIVGGSPVPDSLLGLVTPSYPRSALRRGGLLSEAQPHALECAPGRSSASAGRLAGGSSFRLPLCYPGALTGGWAYAGASRWCSWRGPRSGQDPSGCGAVGAARRARTLACKSGPGLQVPGLGDRGQRAGVSRAPGSASRGQPLFLYEMTLVPRGSDTEAECHGALEAQGPRGGAYGGSTRVAVPRL

SEQ ID NO: 976770 - protein, 52 aa, Homo sapiens
MDWSFLHPPGRKAHDQACRKNQENSPGKKPYGKILYQRPSGVGHLFGLGIKN

SEQ ID NO: 976771 - protein, 259 aa, Homo sapiens
QRIACYQELAANWRAGVSPPFKQAPTGDPTPLCGWTSAPHNCHINLMEVSYPKTTPQMVLRSFSIRFGRKPIPHRHLTLEKATEPHVVHRSTASPPWLLPPGSACLLQRVIPRGQGLHDGKFGPDQWDPVVRTTGASDFLLKQEDRDDPGCTTCTLFSHAGCGPAQEMKQYVTHDQQCCCPASQRPTTGGSCDASLAEEASFPAPWSVTESEMDMELTMCGITRRCGFKEAQRRTTGGLRQSNHEIIEEYYKSVYQANG

SEQ ID NO: 976772 - protein, 66 aa, Homo sapiens
LGLEQPRMTGCMTFCEPPARGGPAPERPGTLLQPGPQGFPRMSSRHTTRYHNESLGFWGGPNFTHA

SEQ ID NO: 976773 - protein, 135 aa, Homo sapiens
VNCVAREAKRRQNGVKIPVDASKPNPNDVEWIICIGIMNGIIHPCTHPEDKPAPKNEDEMMVATFEYIDRLFSMKTTKTSLHGNRWSGDHVLNIMNHAAFKEVQGINRTEWNAAVEKQRVREEIWQKVAVFLQKK

SEQ ID NO: 976774 - protein, 114 aa, Homo sapiens
SSSSSSSWAGLIPSPLPPPPVAGPAVVSVPSAEPFLLAAGARLLQSSVVHHKAAQGTKMYQREWSCREASHAELGTQPQDTQLKCTARRVGLSQSTSLQQRPAKSHYVPPDAEI

SEQ ID NO: 976775 - protein, 151 aa, Homo sapiens
MGAAQTAEVSCGAASEDTAGVVLVVGHGPNTWIRGGTVLRARRGTHSTAALQLAGDGLTYKWRGLGGSPGAEERGGPGGKRAEGGFREPPGAGRAGDSVSGNGHPPRGAHFETSGRGCWGYRKKRISGSAETSGRRSMVPEHWNLAGGRKP

SEQ ID NO: 976776 - protein, 327 aa, Homo sapiens
RERGAPVRCVLLSSSETRLLQEHAVDSQAYSTEKQDGELNTHVNVKEKIYAVRSVVPNAKQNEIVLVLQQFAFSNVDKAVQAFVDGRCNSSSKLNGNMTGTPSTHNKQTKEASPSSIKATKMLKTRWRGLRQGPCSAATTRFKTAHEMAARRTARDENRSRYLRTLQRHFVVVTTAQILRTSVTGFATAAAFLYLDIASLIYGKQVASPVNDDHRLLLVNLPKLAFICTTDSFLNWAALGYLFTATTALAILDWFVTKQSRQLKKHHCLASQMAQCTWRTQAANSLLPDRQFDAQPPQCRSWHCSEATFSGDTFQTIQIPTPVGRHA

SEQ ID NO: 976777 - protein, 118 aa, Homo sapiens
MACPIWRGAVITGADPQCGCFGAFESDIVLGSVSVHSDSIVRTSPPGGSHWSWLVFDYEDPTKRDSLHITCNSETRLVHTIEYNRLREPELCKLLTTRVRSTSLTSFRHSNNTCKKQY

SEQ ID NO: 976778 - protein, 389 aa, Homo sapiens
QEAPQARAGHCLLSACRGGRVSCLRTAVYCDVDTSSPFPSSSQLPQTLWKGMKEVIHSIQATWGLDHGGAEPGGGSGPQLCPLDAVDVHDRVRLFPLAPHHLLCAMPETVPACLAGSVGAWRHVLPAVGRAGYGASRTVGVWRRGHEVRGILDRGREADGRSPYRDYLRDAERLQGIQGEALGTELKAQRTSRLASLIITLAITNGARLLATNHVVTFNDARHPRPPHGQHITRDRSTTRDYQSGTSWHQRAASTQRSWSQREKPAGPPKSTIHITLENPCNRHSTPKNPPPTAALTWCVNRYPTPNATSIVPPSAAHPPHPLTPACPAPQTPTHIRPLDLFPITEELTTTPPALDPNLTHRAIHVPNTRAQRDTPPYPTTPAPYEYPH

SEQ ID NO: 976779 - protein, 369 aa, Homo sapiens
GRALVSAWCLGSWVPPLWVPWAMDVLPSEGELNFCDGAAVLPLAWTLDGLNGLSLLSGCSAALEAEEPELTSWELDADENLWADPVAHQRWQVDDRAVGSEAGGDRCSHLPPWSLQALHCVSPGWLTLGPGRGTLLPWTNYLPGQNQFYGYPRSSNNDKTDVQATEETTWTTGTQPAGPYRPDLPTEMTHGGTTRFLPAESFSSQARQAANSRVAKRLMTKTGDGGSFGAPRGTGSGRSPSLRLKRMQMTLMIPWSLLTPINATLHSGGPGHPGASGYPVKPISGRLELPVRTEAPVARVKGGPNGGVVFLRKEDLTPGISRKNLSGEKATPQRGGIQVSPEPGDPLGETSPMGRRESITQADTTRGAT

SEQ ID NO: 976780 - protein, 291 aa, Homo sapiens
MRSPAQRYQAQGLGAWTIQEGLLQGEDGEDQGAYPREPGEDAPQDQGKTWRRRGHPWRRRMNKLGTRVVPAERREKLNDVAGQPLRKILQARHVVVRALQDRGLQGATFNLHGQEDPRGPGGMWLRPPRWCTVGAEDVEGRPRNLREGRCPGRGGTTRGATPAGDTRGFGTRVVEHERQRLTRPVAPYPISWVFGLPRFDSFWLDLMDVLYLGNPAPFQLLESIQLEVYARWSAPVRHPVQRREWCMSPAVQLFTDAARAWVFYFPTCPVFSVVRQSGASSVPQGLCVVLC

SEQ ID NO: 976781 - protein, 495 aa, Homo sapiens
SGFRVLNGGGGWGQFIQSCVPKLEVNLWGWASAGQREMVTRPVRLGEILKRLECEEPHVVGSHSLKESERKKSSSGPKSPEKSFKPRGEASGAPKAKKLGIGPLWCGRLSWAEGGGVPPGVAPEDPQGRLGWGPHFWVILWPQPLGAGRLRETLLGVTAPGLNSQGGSYTQRALRLRLSDTREIWEILLGPCVCGSQSTSFSPHNTRYSALEAYSPKCSVAPGGLSPPHDGVPKPCVPRVVPVSPSFRGPNHILWSPGKERPGRSHFGRLETPGLVSTHEVILGARWVYARLPSVTIAPTTNQSLAATAKGSCRRRCRQSVVGPSKVNFAKRDLRGTAVLRHGFTPPMSVVTRCGPPCSKRKPPRVCGKTRLNVQQRTFGIGEPQKTTTVQQTRVRHEDSGVDNKTGAQFHHSVREAPIKFSTTKARRGALTNHLQETSHSWANMILTQATIRRSGESQITAADNLISFVDTHFIKSVSRNGHYASSMATCLVLS

SEQ ID NO: 976782 - protein, 194 aa, Homo sapiens
KGENRFYGYKGGPHQAGSVTPKEVTRETSKGHDGRRGDGNGIDMIQGRPATKCSNIDQEWAGGAGSGHSCEGQNGPLHSWPSVIGLQVCQDPARWQEEGHEAGGKPKGQFHDPKFPLGGATKGSGPRGTGEPPGRAWSSPEDSSGVQDGHDGPGGTRTSVTTITHKTLRGARSGLIFYRNTVVKAGDPKTAGRS

SEQ ID NO: 976783 - protein, 243 aa, Homo sapiens
MVPSGSLLRPVSLGAGERGRDRHAYPSMLLLFRLCVLRYKRLVDNIFPEDPKDGLVKTDMEKLTFYQYLLQRNLDRIGSYLAERLSRHVSDIVLGMWMLWRHLDQLLMACHSHSISHCRKLLHMVAQLLESGEQSFKFWNKSLSKFATIEEDTPSYHRRMILVSRSSACAIPVIVIQTTNRDRIVDLHVSTVGSNTSHHDFGHHGLSQGTCPSSVNCTLHCIMPFFLMEKNRAGRQTWALEKG

SEQ ID NO: 976784 - protein, 203 aa, Homo sapiens
MGRAPSVKQMTIIHEEWLLRAREVPAVPVPVVYRNTIPVLINGHLSKAMGNVQIDFARSPPGSWYDAYGMLFCTVLATAEEQGVLPDELSVVVRRLWVTWCAGLLWASMEYQLNDSVLLPELTCAYWQSDRSPQRKMCTDRVGHGDRGDAASASRNVTSDVGGVPAAGEEVEPWYGGRGIRLWVAERVYWEREGEVDRSEDNV

SEQ ID NO: 976785 - protein, 141 aa, Homo sapiens
MALSLCLLDNYVKEDRRHRGVHQAPYFGAEDYRVCMDFTHYSDKTHSHGICPVECFRLLHYTEVTDFAGQSCDRMLEHTVSSRHFDRTPQARRSEYATRIHSHATRFCLRDQETPSKFTKKRTLAQDLDYVANVADTIAWE

SEQ ID NO: 976786 - protein, 145 aa, Homo sapiens
MTSLTSGSEWESDRAAASFVCCPVLYLVVQGKKGEDVLGSVPEKPCINIDQSLSRQELSFPALGETESLADIVLWGALYPLLKITALTTLRSLSWPEQAWFQETEYQEPCTGELLRLVLGNQPGVLGTSGLTSKRSQPAPKKGKS

SEQ ID NO: 976787 - protein, 105 aa, Homo sapiens
MSQWRNGVGAYGTVYKAVIPTVAICGLKSVRVPNGGGGGGVLPISTVREVALLRRLGGFGASMLSWLTGPSCANIPELTWEINGNPGCLTHVAPGPKGHIWTRDP

SEQ ID NO: 976788 - protein, 178 aa, Homo sapiens
KIPQKRFIIQVSLESRGAYRYGFRVASAGTRASKSFGTRSDEGQLPAGSGSYWGWRMSWISFWEASSTYFWVIGHQGLGDGTGRKHKSGGHVTTTLYTDTDVYTSKSLLAEKQNGLQQLVLVSVGAVQSSPGGRPFTWMKTMAAFGSGATVGAGLLASRKPDRLAADPGTGMGSEAVD

SEQ ID NO: 976789 - protein, 89 aa, Homo sapiens
GEMRLFVSDGVPGCLPVVAGDGRAPGSEQRVLIRTVGPEDCVVPFLTRPEVPVLQLDRRADYLCLPAQCKSCRIFFIVVILAGSKDDSH

SEQ ID NO: 976790 - protein, 300 aa, Homo sapiens
IRSHFQDVFRVVRGTHTLHATRSDPYRVAREPQPGHPCLRASSACWRRPRSQASALTSGSLPCRGRKALKWLQPGGAGTRAQCPTAMVRLPPRLAGHHVQSSWPNRPKVHHVRSSWHSELRQTIEACPPMVWEAHGRHPRGPTAPSCKGSGLTGVGSARGARGAGRRRGSGERPEGIEVPCLLGISARLWCWWRRRRRVCSNCACRDVLALDPSPEQQLDLYHGAGRRSRCASTGPPGKAVGEVVARLQLVSRGAETRKLGAPRKVRTAGFEVDREGFDARGRVPIRRKGALGPGDPPGV

SEQ ID NO: 976791 - protein, 218 aa, Homo sapiens
GRFSEVESSLNQSFCSRRLCACLVATKAKGDLSKYPQTSRTHCASRIRGAAPPYVYAVGRGSEAMAEGSVLVSAILKVNGSKRDEAMVPLRSWSTIPGIPESVLIEARGPVASGSSRHPVEDAQEHDASQEASTEEPSGEQAQEEDPELIQPFPLLSLGPRREPCVSDSTQLVDPVLWTMVHLEHGVVYEYVITEASGGMCWRRSSPAPVAVFGVHRQ

SEQ ID NO: 976792 - protein, 74 aa, Homo sapiens
STFQGSGRVIAILVEQMSRPWSQLARSNPFNSCHICSVVHDGLGDLRSSSPGPTGQPRPPLATWQPPPVEEYSL

SEQ ID NO: 976793 - protein, 285 aa, Homo sapiens
GDGVLRCHPGWSAGAQSRLTCNLQPLPGFKQFFRGLSSSRAAWDYRVPATSAQHNFVYFNVKRGFSTQVVAEAVVLVKLSCGPLEGALCGPHTSVPLCYFYKFNGSFFNRKRCSVLISPWCVSTVCGNISAFCEYVFQGCGGPRVFTRIVLSPGCGARGFSQFHVRAPSQSSSGIKVKTRARTPPLKFESAQHGPRGGTNKRVKKGNTREEEGRQEVPKRPDKVGDPGENQCSIPEQYGRPHQKCFRAAITKWDPLRLWRGTQESRAHSLKKAAPQWWPTHKNSV

SEQ ID NO: 976794 - protein, 251 aa, Homo sapiens
MQVLSFPASQIDRQMGKAGAAYRGQKSLDVNRGSTVIINLTNLFASYKVHQLTDVPLRQALLVECTVHLGGARLINRFAGSALSGSIVSLGRQWIIPLEVSVFYQLSPYRIHRYSAYRVLSDMVCGGNSEARRTSTSESGLRRGCRTGQTARERRWPAPGCRDKPGRYRTGESPVGDRAHNSAMGQDMQPKEPPTASDEADITVHGAKPPQTMKAREYSHQPDGKTRCNARGPPRKQRPHTGTAQHCADAG

SEQ ID NO: 976795 - protein, 235 aa, Homo sapiens
MCNGGAGTKAKRQKAGWETTRFGPRAIFGLVGIWVFQSWSLVGLGVRVRGCGDASGGEHCAIGRPLGRISRGGWGAEGPLVRAWASGETVVLAPQNVSEREGGFRGTGALSHGLSERGSLREAQERGRPLSVGPKRLSAEKVERGAQQVGCTHEGGSHKGRGTGGTDYSTPHWRGNPLVFSPWGDILAPPLKKPGLGFSQEGSENPCGNLWRAKAAVAEPDYKKDDTGASDPKDH

SEQ ID NO: 976796 - protein, 399 aa, Homo sapiens
PLSLACANLKLPRLLLCPDMLRLRLLCLACGLPCVLLPDCPRWTDGPLSWCLSENATSAVSALCWATNAPCVVCHLAEGLLAPLTYCQMPAGEGLKGADIVFLRIMCLANVWTAMEGRLDLGPSRYCAVLLASPHQSDVLHVNCDGQRVFLPKGQYSMLGMTMAGVTFGELGLNEWRTVAPVLPPTLPWTGCSLAEVLGWMSTRRLAWSSGLLHRTVELGPLTKADFLQCSQEAHRIEHTNLRITFPDRLTVFSKIPGSTKMGVGPLSRSLIEGRNNFCKGQGHQMENLLEVYQKKPVGPFVSCRPTEGDKSLKQFRALTSRTSHSLAGLLPPQMCSLELIQPATLDHLSQSRGREVPVGSSLGHLTQRGALLEHTGTPQFARNKRCPEGQHPGAGDDN

SEQ ID NO: 976797 - protein, 258 aa, Homo sapiens
ESSVSHVGHPLHVILNAAAWSSFVGREAKYSGVLSSMGRFAKEERAGWDSSVGLNPLTLLVRVVGVAWWGCYPVWGHFIECLRVVDDSAVSDTPRGGWGKRPESMVSHVQPGPGSSGAIPKFVMGIASEHAVTYPLAVYVGRSSWLVEQSAGCTAGFPPYSPVFKFRDFTCWKYLSVQGQVFRGSRLSLCDGCHPRIIACALGVTPESIVDTHILVVNTWSTVGEADHLGTRCQEDYNQKERDVAPGPDGGSSGVLPC

SEQ ID NO: 976798 - protein, 245 aa, Homo sapiens
GSSSFSPNAANMVFRRFVEVAVVAYVSFGPHAGKLVAIVDVIDQHGALVRVDLCTQVTDDRPEPFNVRCSVTRFHSSQFPAQVPTQKYVQTPQKADINTRMGSPHDGPQKIEATRKESQDDTILIVFNSYEGKRKVRTQNNQELKLRTLQEGSSPRKLLPKKHLVLRVLLLLLLLLLLLLLLKFQQKRSPRSKKVQPEGSCPEKPQGQKAAAAPRSSEGSKKLQPESTCSKGIWQESISGYSIKK

SEQ ID NO: 976799 - protein, 169 aa, Homo sapiens
ADLDTESTVPNEENTWFSYLKKGYLTLSDSVVTGGLWNGDKDHGVLRVPTGCEKWESAWSYPDLLVFNCVKLYSVDDLDWAVRLPDRSAANAVPWCDSCPDGLTVHLWQQTCFNVPDMWLSRCRTELSVTCVLALVPRSVTTTTGDVVNRRTRKWLDTLGVRHTKGMHS

SEQ ID NO: 976800 - protein, 329 aa, Homo sapiens
MMTILSNLTVDIPEDVDISLSGTHSYREEAPVGTLRRDFASHQCTNSVLLGPLKRVGSGLDPKMGGGRLGIGNWGFTVLWALIFSAYNVHGDMIEWRVTTGASVNHTNEVLVYAHFPIKCCNPGQWGLLWNIAENFLRVELHISVERIRKCTNPGCVRVVFEYYYKATSPKIDSLTYPFVQVHTLTTLVGLVFHNFTWAFWISRNATNKVNKINGISRNIFRTGNLMSLKKRNCSSSADELTILKEVTAGLTGNRKGWPRMTTEEAYVGEYFKLIAVKRTYGLGPRTHKTSGGPLRAGEQDGCTAPVPTRPNPVCKRETAGPKAAKSKR

SEQ ID NO: 976801 - protein, 346 aa, Homo sapiens
IALQSVAQPLPTLALPPLMVPRQRCGQLVRMAIRCSGQQRSPVLRLGKPTGAGHGQESRVWTADPEMWELLQREKDRQCRGLELIASENFCSWAALAGLGSCLNNKYSEGYPGKRILLGEQRRWLKVDPGVPTGRRTSGRRRPRNPATGGRTDPRAPTPARPRPTVARPTDRPSCDLTDGETLGKAPQQNKRANHTHGDNVPDGQAEYSNPRTIVQPTITHLVRSPGPAARRLASLTLPLVDSSQAQKAAQTGQGPIHPEPRTQDASSPRQPPPQAAEHRQRRGQTQRQTSPRPTARRDRRPTPEGPESPKGAKRAMSETERQARVNTTPDPQNKALKARTPEDIS

SEQ ID NO: 976802 - protein, 271 aa, Homo sapiens
MNVSQPINHYNWYINSDKGPRPGNTLSPLSKRTSHVNFTAPGQCLQKQLLDTRLPGRATLHDNRSSGNYTQRRRAELRHLNRTSLTTLFNRNRGNLSQEEPMWCTRRPTEYTRRPLITYPHVTELHDPRTTKGPMRTPTTYNFDMRETNSPCPGALPQYPAGRPTEAGTAQPPLAKRIPMTENHKPPHRIATSTKAHPRHMRRSTAAPTQQSQPTCLHRATHEDNTKGRSQTTTKTITRRPSHRRTHTRYDTQQRPNHTITHPDTGTCRQQ

SEQ ID NO: 976803 - protein, 123 aa, Homo sapiens
GATLGLKNLRLEDSVQIHLPRVEPARAPSTATYKVDVIHAGPCSNALLLTWHCTPVNTDCVDFGGDHCPSSAIVLQLTVKPVIQWLNAAVEYCAADVCRSQLHHLMLVAVPGHVSLCCFAPLG

SEQ ID NO: 976804 - protein, 344 aa, Homo sapiens
VKQPSSLICAQGRRGGKHVRPQEFPEREGEEGQSTWCLPGCCRAPSVLPCRRVGQGEKSGHSAPSSYFPRGFTATIILSVVGGGTRGGHNAIPPRGLHTVHRFQRRYNLYITFPFNLLTPETESERDKTAVGKGLQGSPIVGGRGGSRGHRPQAEGAQEAIGAWGDSQRSGHGAMERKPHVNETEQEERNSDNHKQRDTPRRRRYPTPRTKSRRGESTRPRTPRTKRDTTTRGTPLGSARKKPLPHPLGRQDGRGPSLSKQHPGLTHHYPPHSNNAEAPGAIRARPMDTEEHHQLDKTAEHGPTEMTRQAASEHPRAHKSPPPYNPAGPIWEGRPPPHTTRRAN

SEQ ID NO: 976805 - protein, 84 aa, Homo sapiens
IKLGFRQCLPRGALETPVELQVIRPPRPFRRCRSRGGEYTAARISTWFLILQGRVRTLWYKKPQSWVNLLIPYSEPESVCRDNS

SEQ ID NO: 976806 - protein, 299 aa, Homo sapiens
MIGTISCKAKSFERAPESVKASDLDEENESGTAQLHFTDGKTDRTDCLAAKMRVQMRRNQKASRSSRGVSALSLGIPPTLVSGCRRSPTTRVHSRPSLREGEVSSVVPQDRFKMTMVKKTKRPRAAPPRVLWSQIPLGCAGRELWGACGMPSGAMWAVGGGRPATPGPPSGARGLLSQGPFPVGGNESAEPCQVFLDDWACSLKESSSRREYRWCVEAPKAGETQDIREPGVRRWVSVLKQGTQFPSVYGYENRRIAWVKSQSVGELSLCIYGIYIFRLTFPLCGVSPALEFRERTHGG

SEQ ID NO: 976807 - protein, 78 aa, Homo sapiens
TKELNSESSESNARKQNQAAPPPGSRTSLAATANGRDKAGGMPGLSWVPVAPVLFPVTFRLALWRDTQGQGTGNVRCC

SEQ ID NO: 976808 - protein, 228 aa, Homo sapiens
MGGGRSVIITRTWLEVQEAPRMPKIHDIYLRLSVTVILGYLVRRTSMHYTTRVLCVEAELFTDIALNRVRVTVRSLTPRMDSGSMESVAWSEENKTGREFRRLTYNYDDRSRGSGGIAKLKVCRIETCSNLGPVAGILKVTPGRQGFLTFRTTLGSLVAPPEKECVVTWYVGSSGSIDRSPRRCHRRIVGKRPQEPRTVNQTLRPLQGGRKVRNVPEVRRGQFEGYKN

SEQ ID NO: 976809 - protein, 241 aa, Homo sapiens
MGSAAEQHSTGAEQKQRNRRERRAQVPYAGGGSPEDRGDEVPRDAGALVSRTQKRGVDREGERRMRRGRKEGIITSLERGQPRARRGERETRRDRKIWTKKTSGPTLYKSIGLVHEQIYPRASLPIDRHPCSREGAQENMITAPHKEGDRPPGPTSVPRIRLMRKTPTISAVPQQVELGPPLYQKEQAQKRTKWVVTITQTTWCDVGITHLRGWHHKRRGGALQTKSVSSPQQGRGGNQQT

SEQ ID NO: 976810 - protein, 270 aa, Homo sapiens
CAMVVVCGSGGRVLRPPWALLETHALHASLPPAQILLRAAPTAVPSCQALCGQTSPSPKAGAVIGRIVAVGLAQWCDCPVMMQGLPPSSKCRWKVQGEGDQTGFRRCAQRLGVRATGEGLLAMDGTEGLVRGPRRVTGCWLHQSKGFLLDPVDLWAGITVNDDLENLLMTDVPSETKECDPIHAEASEVHGRVSVGARTVLVTGITVVDLVATHMQGWEQWGEGGAGGGRLSGAGVNQPMDAKTMVDSCEGGGAATGKALYYLNGDQRSS

SEQ ID NO: 976811 - protein, 236 aa, Homo sapiens
ACTWLYWRKMSSALRVDPGTAPDPRYCQSLLHRHRVDTDTATSMTRHDATKESKDIGNAILPEDADRAIRRLRAGLYPKRCRRQLPEKKTTTIGPCSAVSRVAIGSGGLASGQGTCAAMVSLSAQPRVLPVIVRREDRLASRSDGDASLESIGRPQRGQKRDHINLLRGRELSPPLVESMTYAWATGIDGPSFMFPLLNGCLVALLSLSTFLPSLAPQFLQGTGCSFRSNIRNGKN

SEQ ID NO: 976812 - protein, 151 aa, Homo sapiens
MLKTEEQKMRRNTNWYRERVTLIGTEDDDCGGGSGMMIEIRLLEIIERDGEEEEERGGSQNGVMAECRIMIPVIILVNAYHNYEGKEWRHKVILEENTKSRSMEVRRTKQKLNALQGARGVRGTLSARPVGNLLLEAAWVDKPNSEFARTR

SEQ ID NO: 976813 - protein, 635 aa, Homo sapiens
YLIDAVYGGLTGSELCGLAFTSPGMPVIDGGVRDWDLRMDAVGVPLSVRTECSLSGACVPYDWLHATLIHGLQGHDSTDHAVLTLPWYGGPISSHDRTCSHMWAWGTDVCAGPPRRPRGRAITSALSCWRFSLLSLAHFGRTLHVPNRDWNLEESEVMLSQALSKLLQDMQPNSPREPRRGGIGRGGGIATVTRGGPREYVDGRIFLGGRYRDEESVGFPPAGEACWETSAQIRGVTLKGRHLESERTTQMERRLRKPERRKFPQWGPQHSTENALCSQFHFVPVPVCGVPQPLKPTAAGGTALTGSGRGAFTPPRITSVVGPPTVYPLAYGGAFSWTDPTTGPRWGATGTRTGGHPPYVGHEGTVVGGATHVVTILPPPLGWRTLRPALGRLLGDHSCAFIPRCSQVYTHGAAGGGVFPPAETLLETTHVLCRHSVAVCSHTAPHVVFAGEPHPVTVSLRQPPAGRDPAGGGGCLTPNQADTADGHKDCGHPAGGNPLHRANRCTCATPPSARTGGTQHSVGVDESHPLTTSAHARATTDHYSSTTHPTHPGRHRRPHAAHELTHLQTRPDTPPLTANADHSLSTALSAPHATAPTTSTTTYSRGARADIILTRRTALHKRRRDQRRSRPATDD

SEQ ID NO: 976814 - protein, 221 aa, Homo sapiens
LKNALEKPSSQKKRSKRTVSSCKLKHLQDDNNLLKQQLKDFQNHLNHVVDGVRPEEVAARVDELRRKLKLGTGEMNIHSPSDVLGKSLADLQKQFSEILAAPSGKEMKHKLERENSKKKCGSGKGRRKTWGENCGGPTKEFRQACERALEAKNEFDKRQHEGKKSGKLENEIHYLPGKSKKYGGKSKGLTDLQVQEADDREGREFWANSEELEKKKKLEDA

SEQ ID NO: 976815 - protein, 248 aa, Homo sapiens
MLTGVTEVFSVACWCTAPRSCVVPLESWSKSSDGYTFVECQARRCAAGEACRTRPSCAPPPPSSDPPDAARGPLRLGPLSAPGSPVYPNGRLLVENLGRAPEPDSYTGRMVWGAAGRLEVELGRSGGQLIGRFGPRQAQAGGAAQWQVVGGGGEQAPKRTIILTGRRASLSCKGPRLTVVSCHPWCRGVPGIWKDPWLLVGYMRGGLTGGGPVAPGRGNLWAVGWAFGCREWPARGLGRRPPRVRGTS

SEQ ID NO: 976816 - protein, 183 aa, Homo sapiens
CLKPFGGPPGTELTYACEPFHSTELEDDAIYSVHVPAGLYLDPESGCLASDVPFTPSSPDAVTAPSEGMPVHTEQAFPPLEVGADSDYENTQSVGPTAVGLDTWKRFLELGKEEDFRPRAGKGPGMGGPRSWAIPTKQRDVILKEHEQGHTNENFRKLFAGKPGVQEMTTSLPAQETRSPFGL

SEQ ID NO: 976817 - protein, 249 aa, Homo sapiens
MGRGLQRRAVDAHRLGPWWPVQQWRQISQMSAAESPGTTTRSGSKAGVEGAQMRRGRRLGGCHKVAEAQGEARAVSPKALQTHAQKDSHEGEELDLGTGASQGVAGVGPRKATKPRTPALGRIRGEAEQGLGDERTGKARVADDAAHAQSGHQQRGSCTPGPGGAEDTPGEDSPRLNKNTLREIRPFKKRRRHVRGKKREARVEQGTNGRAQGKQGGADAPKQKPDKQGSGRKGAQGIGAPNTAGQLAG

SEQ ID NO: 976818 - protein, 156 aa, Homo sapiens
MDWKQTRIPPGGHSGDPKATRRDKNPRRKYKKTRRTENRGVPRRQDRPKYRGPPNTHDGRAAKRPHKKLKKSGRNSTRTRHQTPLRPQRAPTAETKRGTESPRTRGLYKRARENTLRGQEPTKGLSGNNLPTKFTKAGRTSQILSPDISESQYDDL

SEQ ID NO: 976819 - protein, 184 aa, Homo sapiens
MLVGEVVSREEIFLRPGSCDGSPLTSGGGDEPVRVLSSLLESMKAEIRDSLCMRIVVREVTIYPDLHRVRASWRSLEVPRTVHHPACSEGALTGAFKVLGAGGLLSRTQGGCNPDWGRSIQRMLATAWVPRGEARSEAKKGAGKVEQTQTRRTGPVVGTGPQGAPLKGARGLRTLGGWPRPHTK

SEQ ID NO: 976820 - protein, 492 aa, Homo sapiens
GERERTPESPEQPHSRRRASYHHTPWREPQRAAGRARVTITETMSSEAETQQTTGDTRPARRRNYSAEQNTKRPAPTGAAGSGGSGRPWAGPHNRERARPSRGNRPQVHPHTDSRPQRNTRETHCPAPTATRATRAQTRPPNPTPRGTRRPPIAQRDASCTIPTPNTQHHTTHRQVAPPNEKTGPVAARATKKNTEKARTIGKDSTTPTQQRQPAGTENTVERRPPPRKTTSKNRTDEHKGTRPLENHDHQNKSPNTKKQTNNAHHKNATYYTDRIKPEHNTQKRENHTEQANKAKRTHTPPAGTQPTKWKENRQEAEAKNHTIEAREQQHEPHKQHHRPQTNAQPKRDKPPHQAKHAATATNKERDNDGATHREAHKQTMQRKTNRNQPENQRGHKRATEPHQGRDNDQKQTNATTRQHSTRKHRRTGQPAAKQTDKDTTPAEATHTTTANSEHNETQRRQEKKQQQQSPTNNPPTPQETQNKTTARAHHT

SEQ ID NO: 976821 - protein, 205 aa, Homo sapiens
MRSKNQFKPPPNVTGGAGKGKNGENRWETTSSGPRQLIGPEWNWGIQLVHPGGMGIALAGGGRRSAGGDTVATGSPSVGRMSHEGESRTSANVSGDVSILGGHQGVGPHKKIMWRGEEEEGGIEPTRDSTLYEGAPGEGMHSRERPKSERGGHSRGERPLEGKCPRTEDNERGLKHRGSVTTHKGVPQHSALVTMRKYRTSRKPH

SEQ ID NO: 976822 - protein, 303 aa, Homo sapiens
MAENSAGTPSGLLGPRFRQNLFAFSASSTTRYQCGGASGGITRDFPDFVKQSLSAKWVDWMEETLSGDDGTQVIKVLKAYPFHGCGPGAIGTAGGSKYEPLGGNPMGHRRGYRWMEKSFLRFMVGHGWVVAYGKPLRGATGVHGGITGAQALGLQKKSWGDKQASGKDKTGGPATSSRTACIAVPDQPDMSPVSLTTGVVQIGQCVPQKRVARTHGGPCVLHAEEHHVCVFVASHLISRGVWDVEQPEWLFPQQVDWAPYSTFGDTGAEYKMKHSFGTANNFPNRLQNIYNRQTTQHASSSSA

SEQ ID NO: 976823 - protein, 488 aa, Homo sapiens
NFFTKKQLEITKGSCLLRGVSNPLKPTTETINNNREEEEKRKEEHKRPTIGSIGYITPRGYPRELPSCGIVRRHNIIIVDKTPVVSLNYNSSDREKPSVCASLCANKEAGLSVVPKSRRTVVRSVQPRQDSLLEGRWREFTAWAPLFRNSQISTRLSERQNSQTETLYQETQRGGPLVRRGSVTPYNSPTRGATKGGTLGGLILKYPEGQHACGEAPERANINPRGVGQFPYTLCLYQTLFWGGCGDQKRAAPILSPKSGILLGWPNHTHTTYKRWPPSSVDNPLILITMRAFPGQLARWWSQPNLRVLKASKNVIFVPKRHSPAIYSFGNRATIRIPNWHKNRLLTHNHTDGGSLHIHAVGSRATQERRSIKTNIFVSPPNSKPLAPKERTRGAQRPDTPCSNHPCGANKSAADDEKNTPRGTRHTHKHPYIILLQPNQQSHSATSHRRPQGHPTEMYDHLTTRTHTHGATDPYYGAQPHKRLERAN

SEQ ID NO: 976824 - protein, 102 aa, Homo sapiens
MRVLLALLGVLLSVPGPPVLSLEASEEVGAGALPGPSWSQEEQELTVALVAACAVCAVGGLSGGGHWVQGGQVDWHLLAVYGAWRGALEIASFLPEDAGANS

SEQ ID NO: 976825 - protein, 201 aa, Homo sapiens
MGLTNMGQTDTDFKTQRRIVQDLTRLDYSSFSTSFYVLRVVTYTKTRNQISITRQTLLYASRQPNKVTANNPGQNDSHRDHSIGPPKKGSPRTTLTLAQRNAGPTQTQNLPTPSTTGTHNHSTHELSPTPNHTYPTFQSTGLFTVHENTFTHTALHPTSPHSFAHRRKQLNRLTINVRTRHTKSRAHNPHRTTTNSVATRT

SEQ ID NO: 976826 - protein, 179 aa, Homo sapiens
MVERTSWKINVRWTESRIVCLPVAIKGIRGSLSFFLGGASSRRHRGSLKHYAIVREARTRARSSAPRLKAICRVIGDYEWPRSVWVLSCSNGGGHLPSVGAIILCQALHRPRAQRLLWGTRSASPTLVPCKVDMAAAALVLVRLIPGPRVHWNRHRTLCLKKLLIDAWYPMTATPSGRG

SEQ ID NO: 976827 - protein, 178 aa, Homo sapiens
MRAPNSRNTATTRKRDDAMNNTPTLYSNDTADLTVICCDSRTRRRTTAGTSSFENTAGTSNERSLAPSKHSPTQRKHERTVGANPNYTRPNVSVIEQERRRETRGSQWVAATPSRSVVRPTQRSTKQERARLPQARRRTSRARNDVARHTQPHAPGPVTVHCKKTDGQRVQQHGQVSR

SEQ ID NO: 976828 - protein, 336 aa, Homo sapiens
GDDDLHIAYVDLEKDFAAEVVHPGDLKNSVEVALTQKLLDLNPGAKSLIPAALKGTGHALLPRSLNSRSECDIKVAVPDAIPEPEEVIPSRLDIRVGKVITVEKHPDADCLYVQKIDVGECLTPRGCGERCWYSMSPNCIGTRRDKSIGAGEKLVAIPEYTPEDEEGGRTPDGTVRFMLLLLIGNGKNAGVVSVPCCDPSLGWLLIPGEHVFVNGFELGRPDEELNAQRRNVLRSQSWGLTFKDVRGGASAAAYSQRHLLIPGWAPVPVTSLDTGGGLLAAQNFPCFRAWVSGALRLGRPPRVPCPTGGAIGLTGRSGGSPPRHSVVGAPGARGPS

SEQ ID NO: 976829 - protein, 116 aa, Homo sapiens
ERLWAGPRKKAAGKGDVPTERPPVLRAGVERCVQHLGGRTRTAQLVVIDHDVDPIELVVFLSGPVVSENGGALYLYDHTERQDWDVIDATVATVPPGVAFTSGDIRQYIRLHLANA

SEQ ID NO: 976830 - protein, 71 aa, Homo sapiens
GASLTLSESSLRFRTRALEAFTRRSSCRSELIFDPLLCSKVMTCFLLHEDYPYRFKENGRKTLNYCPRDSA

SEQ ID NO: 976831 - protein, 336 aa, Homo sapiens
MGGGHRMKWLEMWQKLFSPAKGAPWQALGHLSGRGPSPRSDDEQQCSGTWVLAAAASGMTLLASSWCPRPMPCALGPVGCQSIVAACAMFILTRLARLGQALLLYLFTLRSGLLQFSHAHAARCALTYYLGLSRRLSATAAGATYYVSTYARWWLPPRSSRVCRCRLRTAVPGTRAGSRLARCYRRTECCYTSALSPGLAQCLGPFLCLEDLLRHRSALDFGQWRAFDGCLLQGWTNGKPTTTEQEQTQGAIIAMEPRRLNRQDAAREPRPNNNRARGPPRHYSHILSANTLLPHPTRYAQQQNAKRQAPSERQPTTNSGQRGDKRRRHSTCGIDK

SEQ ID NO: 976832 - protein, 221 aa, Homo sapiens
MPSCAVVLWSTRTFISVRLLSYLSACRQPMEDSMDMDMSPLRPQNYLSGCELIGPDNRLVDFKVARLSEHMSTRLSFEEAVSLAGWCTRMSCTLLNAEAMNYDVQSILKVNTGRTLKNRLVQTNGFPLGRFEIAPPVVLRSEVVVQGQCDELVGQHLVAVEERCRVMKMNEEEDVKLLKYHLERRAAPGGGERGYLEKNRKEYACVMEESMTDDDGRRDRW

SEQ ID NO: 976833 - protein, 137 aa, Homo sapiens
GYRLCSMYVEMSIPSGSSATLTSNRPRDVMEDLGIILVRHKSDGKALGAKATRPGHPVQVGVRVLRHVVVKTDVTRSMSIPRPNRWVGHQDPPWEILELADSVTGAPPGPCPGGWQMAGKFWLHEELGPGHAALPLT

SEQ ID NO: 976834 - protein, 324 aa, Homo sapiens
MVSDRLTRKMRAVDKSEWSMPVGGTNNMSGERRNNVAAREVGGEKGQTPRGDSERAFIMSRAKSHSKPRGKHVVAEQTCGRWNFCIGVITAWVSPVLNHIEGGPGPSLGLEMHRLEGRSKPSGEWGLTRNGGHLSQGAKLMTGGERKAREERERPKETPLHTNRGEGAQADIGPETSDHNKSGHREKETPPNDKRTKHRTTREEVIHKTKDLNHETTREKRTQVSNTAEDEMTRRTHGLIHSPPRKENQHAHTTNKDKSREHNEEKEKQQRTKNEQAHHTDKGRTQQTTKADNGSRAPKPRQQHERKEPSRKSRPHRPQQTRTK

SEQ ID NO: 976835 - protein, 154 aa, Homo sapiens
MTMQPETTRLRPTPHCTKRQTRRTPKKAQKNHSNNPRQPAQSNTRTPQQKTTQQTHNKHKDTTKPTTQHKSKAPHQATTERRKRSGEAPAHGRGETRPQATPLERRTPVASPRRRDGRQTIRDTRNSHRGEKKGRGGARRPADEREKRKQNDRE

SEQ ID NO: 976836 - protein, 587 aa, Homo sapiens
KRSSFFWNLFIKERFSQKEPRAPCSIYQNSLRNSFFSWSPIFSFSLSSGSQQPRGRWGEDTSPVAWCAATEVWRGQPRSLPRGPLLCAEVEVLPRVCVHVVGRGALVLQKQEPREPPKREGLSTLFITAPCVWAYNRSEERGNLMRSLYNLFLAGESCVAPLSICALACWQDNVEGGPRRRLRIVSRERESPREEENTERSGPEVVATRARQTSHRLRAASRSSDYTATGENNAPRVAIKALRRPEESSRQGCGGGALFNNPPKEGTTTTLIIKSNHPHTESNREHPEEQTHPVVVGEAPQSTLKGVVSSKSISHNLPQTSGVRIEARGTNKEQHNTTRKNAGISPTRSDKAANTTQHPQRKKSPPPRGCSRPRKKKNTDFPPRAGSNTHKSERHTFLTLGDGEHPTRDKNTTVVWTHSTAGGTQQAGSVGETEHNLRLKYCGYENHTQEQAWGSDKTSDETTHERTRTPRGRPRCDDHPLPKEDRLSHKTVVWATQKNTQRLIHTLAENTKTPLSDPLTPTDIPARMWENPNKAKWWDDNGTNRPPPNQGETKRADGLQHTNNHQRDNALKRERFVTNENPTKEIG

SEQ ID NO: 976837 - protein, 201 aa, Homo sapiens
ARVGRRAERCGAVLRSPLLSLNLALAVYLYPPGCSVTRTASTMTTSAKFPLETREASSTLYMSRVSRGEKVQAMYIWIDGTWEKDCAAEDPDGVVRGEPKCCGKSCLSGHFAEWPHSSRMYSSGGCPTGDMYLVTLRASVCPGNPFRVHGSPYSKSWLVNVVEYSQSDTCKGLARMSNPESSTCLRLMDMVSKSRTPGCGM

SEQ ID NO: 976838 - protein, 103 aa, Homo sapiens
MWALGSLHTHVEHVLRTRGCCITVLWGSCHPMCAGDGTLPAWRYPLHLFLPRLMGETMPRAESRGERVVRDTGTPECHQEREALPFMSVRDNTRPLRAEIPYK

SEQ ID NO: 976839 - protein, 166 aa, Homo sapiens
WKWPRRRKGRPSVAEPPALPELLFTLRCAVLYPGGCGGVLGVPWGPVSIRYLPLGRKLRGHRRRSRGIETSGATEHNGEVEAPGIWAFQAACANRECPKALNDLKIKTPGVVVAREEESHGRGEEAGRIDDLREHDRPTGMRGDRELTERVGKSDGKRHTDPQGGE

SEQ ID NO: 976840 - protein, 319 aa, Homo sapiens
YTRVGGWTSCDFRVAMLYFSYVFGRLGLCRVDVGSWSGWPFGAQHSNADPDSDWGSKTSGTGQARRAVSDSDPEMWDVAAEGERTGMCRGLELIALVETSAAELLLGGPGVLSEQQVLGGLSWQEILLGEQMVVDEIDLLCQRRRPLEAFELVNPRTSGEHVSQSYSGSPSLAVAVYTALLQGSRRIMGLELAVGGISPTVLSDVKRISATSIFFESMPLVRLNPQDWLIDYTSGTDWSTFSGHGSLLGWDQAMSLIDKPGERVAVRPSPWRRMAPPGLAQGPPLTGLHTTNRAGLTQGGPAATARFPGHTLGPRRGSS

SEQ ID NO: 976841 - protein, 295 aa, Homo sapiens
AEWSQWWPVSSPCSAPSHQGCGPVPHPATAAAIDLLVTVTVRLMTLRRSEPRLAVLSSRSSSNAVHEQLAALSQTPDRTEPQKKEKDKKENEQKKEHKKEEEVEENEKKAEPMEPPPKEDEENYIAADSDVSREGASAHEGASPLPLYESEEEDKCKPMSYEENAVRLKLGHQQAPRAEKLGRVVHIIQSRGALPEEFQALTRCEIDLRTLNPVPHLRGGWSAMSTSLFAGDQGNLKLEKVDVIAGSSNNERCLTLKSATTPVSQFLCNEARTVLLILDRSKTRLIRSPPGTNPL

SEQ ID NO: 976842 - protein, 191 aa, Homo sapiens
NPSLAFALKNQIKPPPPCKGGAGKKQKRTNPPGNHQVRPPAINRPGVGLGFDIVPRVGWGWRGGGSTRGGKGHLSPPWEKLRGKCEKGHVAARAPGRQWSGPQKSVRPKGGVGAGYLPTGAHERVTLEEANREGSNRRKRLKRCPEGKGRKTRVYYNRRGYQTGQGTGMHRHTENIERNPPPTPNGEHLCQ

SEQ ID NO: 976843 - protein, 191 aa, Homo sapiens
GLDVLEWPEPGAARGVRSAAVLCVLCVLCVLCVREQMKKLMCPVIEVTCPPATHAGPFWLLSGQEVVGGDVVECLVKPTWMATTLVYIFLVDPNFSAAHCLLVTGVLAVKQCAAPSTCENCSECRSQCLLDVGLVGRFGAVTAHCGPSLGLVLGSVSRSCCAPRCTLCPFGPPPHSTPMPLPRALAFGLFP

SEQ ID NO: 976844 - protein, 100 aa, Homo sapiens
RERGQQEPGDSRSGNRTNATRLRMEELKLSSTTYALTEETQQTNKPWSTCDLVTTVIAVILIETNVSYVSYKPGESFTRRARRLERGQGVIMETDHNEKD

SEQ ID NO: 976845 - protein, 103 aa, Homo sapiens
MRKFKQNEIGREMTRYLTWSQRGNRLTEFNWNKKHENVAESAGFKCKQYRLCAPWPKVEVNLCSEFLKGNFRANLIVDRKFKFCHGLTSRFDPTSGPPLKNIN

SEQ ID NO: 976846 - protein, 92 aa, Homo sapiens
ISLILMTLESSITSLCWEKERFLLGLNIETGLLSDRKKVTLGTQPTYEELSSLHTVFACPDAMSSKAAQNVFNVNLKEVNYMCPLINGILKL

SEQ ID NO: 976847 - protein, 104 aa, Homo sapiens
MSKSESPKEPEQLRKLFIATGWSFEINVTESLRSHFEHIGERYGDMCGNAEIHKTKRVQGLRALVTSCHWGGGGMQLMQCKVMTKVGWKSCGTQRRAVSQEKES

SEQ ID NO: 976848 - protein, 263 aa, Homo sapiens
PGPGSPSPSSGAPPVTSAAGHQPCIAQVDGRLRPEGRAPQAPPGPGPGSRQHHQGLRDEDFENEAGDLELRNEQNSQVPGAWTQVKQARQSSLMALLLHVASLQFEARTPWFSGCRSLPTSALNLTVLGLDLISDEMSSAARSVARVGGAQALQVAVWPCMLGGLPVPSGSLGVDCPGDASELAQLEACGLGWDRRHGTEARGAARARSGAHAPGGDATYHLYRRRQECCRWSTPLAVPAPPWGADQEWRPRSRGKEFFRKKG

SEQ ID NO: 976849 - protein, 217 aa, Homo sapiens
MSPRASAHATIARALAPPLRPHLGVAVCACEILPRASPMSEPRAAAITSRSNRSDQAASSEVLPDAEEHEGRTAGLVEVEVAGDGPIPGYSIETYYSIRRDGSEREGEVPVWSDPHLLYSRVSHITTLIESSLFGPRVFSRSVLAAVSYPTGSVGSPPELVAPLGPRVETSQAPGLLSCLLFCATPLPLVIPNRAASTQVFKVFSSIQGVLWAAIVR

SEQ ID NO: 976850 - protein, 333 aa, Homo sapiens
VDTLMPVSSIHRPVIQSCGCAGADVRLALFPNGDRYVEQLHHRELLMGRNLLCHPCPCVLLVRDYSNARIGYTCNQSRTQVRTRGLLGRVYLRSRLGGPKFRCASGIRKGKATLNPNTGRVHPCGVVISRSHALMSRLSHVQEHYVGEPHAVCYLRHTGQKYLLSLLVPARMLEIVLRVHGKEHDNEAEEVWEEGEDRLLLVDTYCTGETIMAPISGKRKVYGEEGLGMGLTVVRLYDGGRSRLRACVLNLHMETSTASHSSCIPRWTVDGSLPRYVVPLGTAQVGHSTRRTVAGPGRKNVNPQNAPARGRSSPCLSPGGATRTPSTVIHATG

SEQ ID NO: 976851 - protein, 574 aa, Homo sapiens
FLRGREREKNLSFSTRGGGGRARGPPPPKPAGDAGFAGGRARDPGATSGGARVRDSPRVAGERERARGRSRRAGRERECIATEQRAARPAREAAEGEEGVSNTQVCDARASASLSRERERGVTRAAREQREREREPQYDHSRASDEPKKERGRPRERLSLLARGSAPPRARREEERDDDHAPPQRERAEATITAPPSGESALRYPAGAERERERARACRKHHSRVRARVSAERRPPPTRRDGEKMLKCGEGAALPPRRRRGSSTYPHVVMEDENEEGYSTKQEEEEQHHSSSYSRVEDEDEDDKKKRGAREATKKITSGDETRQPNTITPTLREREDDAATTEEQHELRITRRPQTKRDKRPPTQTKTTLRTYEADAANKTYKKEEKNTGRARQRKDKHHMSEPPPEREMEITRSSTQNTLQTRTQRRTTHIRQQRAANTTRPAERTNPTSGNALREAVRPQTKNTNSSWRTRRQRQDNISKKTTPREWVGGKSCRQTQQTKQSYSRTNHPRVYKLRYLAWLARLALSDGRPRQHRYTHQAWTQLEQATNTHNKICDLNLVRVIGGKYSTARAE

SEQ ID NO: 976852 - protein, 339 aa, Homo sapiens
DRALGGRAGLGGQPGGPGPWMCADLRGELNVSLRMLQSPRGCDTRGRVKAWSYALMAGVTGCADLEGLEAVATEEDGQRRLPDELNRGGPGRINEEMRMDKYYRGSNQFYDSQVIKPRKSESGYETETLEVEQQQAYRPEMKTEMKQGGDPAASSRLQASQLEPDRQEFHESKRGLMRENRGRGYFEHREERRGRSPQPPAEEDEDDFDDSLVAIDTYNCDLRLQGGPEIGVVAMRHALRALRTCGQEAVPGMGSEGPGMRRDEDPRGAAPGEEPPGQRSREPQGGPDTRGPRPVWTRIGEETLSKGQQARGTQSHTRGGNTGKQGEHARTGRTLNGKR

SEQ ID NO: 976853 - protein, 342 aa, Homo sapiens
GLGPKFYKGSLEEQHLQTLQKLQRARGDPVLVRGGDVAWGMWQGALGLSHPFVSVKDGGWGAVYLSHSCGVLHKCLRGGLGARGPSHIGGPISYHRVCGSPEGPADVISIQRCGEWPQEKHPRGAVEHTTSGWGGQTRDECVPTRRDRDSVINAGAGSLRRTCVRNYHLRRAHISRNEEPVLRGGGMLMKTPRCCVAPAAGEVLLPQREQHAQRTRRARRAPCGVAPPEMLLLAERDVKQRGGRPKPPQYKKRRGLSLRVPNEEKRGALSLIGEKLWWGHTRTEEREPLRWAAVGGPTVGATPTKRNPSFLCRCGGHHPLFFSTGTYIKEGLHKPGGARLCA

SEQ ID NO: 976854 - protein, 174 aa, Homo sapiens
PPAQRPPRCEQILDGCAGVLPAEDPCVHHPGPWKIPQFPSVMMDVMLCWAPGEMQLYHANAWCLLWLANHVACSSAGATVAELQEVVMLPAADACASDPVMLATRVPQHERMCQPLPGTPDGFASLRLTISCGLAGFGAPLPPMVGLAPRAFPAVVLSEPMTGIHWGPHATVGV

SEQ ID NO: 976855 - protein, 256 aa, Homo sapiens
GPYTRFYRRSGWVADLRTAGLFIPSPSPRTLPFSPSLPPLTSPSGPSAPARLVFLDVACCCRRTAHCLDGLTFDDADLTTVHRPPSPPLRVLTYNFHPRRTDPDDVFGTTLTPDWHRFCGYDSVAFGLHPPYCDLRPGLTLRTTDLPFHTVHFPTHVLRVFRPFTPYHNAFTEPFDACTHLGDYPVISSDHTSYLYLVGHTPLLAPHERTPLFNDGNPPLLGHTTFPPPPYGDGPAFYQTSTGPTRHPTPTCFSPH

SEQ ID NO: 976856 - protein, 359 aa, Homo sapiens
MYYNWYYSVAECLVWLAVLMWGVLGCAVLCWALAAGPDVSLGCNGAGRALSWEECSCSNACMPVLLHTLCAVLQCDHDSTVLTFLHCGNDCLTDATMNTRCRQRCALRLLPTIGQWRNALDLNTCAALCCHDWLSSLQKHAWLTNDYQPPQQQGQERPARRRVDQPRQLFCGDTKLSGLNAFDIAEELVKTMDLPKGLHGGRWDLACTDETLLSAIAKTPCNTSTMPITGQLSAAVEKNPGVWLNTTQPCAKPSWLTDEDLRKHGKSLVQQVRNPLSEAPDGRQCWPTLDELALKRKSSGQACDEDENHEPQAPTSNTQPHPAPGTQKHTETTPPRHPRAPQRPQTQPPPPKTHNERKP

SEQ ID NO: 976857 - protein, 230 aa, Homo sapiens
HPHLITQPLYKVVLEAMAGTPKQSSPHHSGHPRAPQLPADVARATLTLLLDHLRLVSSFHAYNDDPRIGCASGLCVLPARQAPTRLVPAAPARPCQCSGLQAPHRGAGLPAESRPDPRCPTISRCRALLRPKTGTLHLPWQTRSGDSASGRGGPKAPRATLRRRLERCGRTSWPVGGIPVGPDNEHVTRRARRTRRGGGTRSRGFQENGGYPPNQELSAPVEEPDTGAHP

SEQ ID NO: 976858 - protein, 289 aa, Homo sapiens
FNRVSPSALRSNPFPFEGDDGFYVFESNAIAYYVSNEELREVLQQADRQVVQEVSLVDSDILPPASTWVCPTLGIMRPHTETWPLRMQRRDREGDFLGLLDAYSEDEDFSGGVNGVSIGCHHQYVCTLYAGSIKQVLEPSFRLAFPQYQPTWFLHLDINQVPVSRAGYGRKCTLCEKMAQFDGLTSIGRRRKLIKDTPPDKEQGHVKEKQKPKDELERSSKGRLPLGLRQRMLSVTRGRLQNPGYDPSHCPEFFGWMHKDVHDATLGGQLGINGAPAQKVLKYQRTRTI

SEQ ID NO: 976859 - protein, 107 aa, Homo sapiens
MIKLEFDAELEELTKHKCGTIIVNPNAAYDKCKDKKCGRKGLDFSDRMEKPRGQDMNLENMRCWRGSREMNGGTDYVKEYASVVAELRDHRGGPGLASGKSLRSDVR

SEQ ID NO: 976860 - protein, 145 aa, Homo sapiens
VRRIFFASPAEPDRSDSMGKVKVGVNGLWSYGRRVTRGLLLTSGKVDMLPSMTPSLNSTTWFTCSNMIPSMANSMGTVNGLKNGKLVHHREMPIHHLSRSEIPAKNQVGRCMALEYVVESSWASSPPWQNGWGSFAGGSQKGHHL

SEQ ID NO: 976861 - protein, 61 aa, Homo sapiens
MWIREAGRALDLESGNENVITHVSWYRTAKLAEQAERYDASWLQPLTGSHQRQGHELSNEA

SEQ ID NO: 976862 - protein, 132 aa, Homo sapiens
MPEMLVCRRPMKDLRLKHPMYGGRATHTGGTGPGDCKLMRVEPPEEGPSVMRLRVPAQATPHSGGGLGEDPSSRPDWEQGWMLARMAGRDLKEGRGREPQGKSEPTPGHRGGPERERNTEDAENTQPRHHKR

SEQ ID NO: 976863 - protein, 148 aa, Homo sapiens
ARAPQPLFLEVCNLAPVVDLHIGSVQDLAYVLGCGLDAAVPQWTHCASPHDGRKWAPPGQAAQCACGARGRGGGSREHGGAVEGVTGFGVCKRFSCLSLAAGFGSGVSAGYALSVLPVWPRVGWHCCDPILNLLKDDPDLSPIVHIEE

SEQ ID NO: 976864 - protein, 351 aa, Homo sapiens
AAGTLYTYPETLEGLQGSHRCSVQRGSGPRALRSTPLPFRPNQPHPWNFIREISVPAKGHQTIMQGVHSMCIRSDDVCQQHNCPICAHIIVQPHCRQLAGHSQSKQASKPQSGSQLGAALCCIPDLVPPDQYLGVPHLGHHATQQTGQLSTAQEEVRRILGLLDAYYEDEDINWMGERVKIGLTSQIVWPLYVDLISKVLEPSFRQAFPNNNAGFLTCINKPSSGRLGGTWNCVRQLDSKTLQTMQKTQTTPDNTTDRDGTRQENQNARANATRKQGADTETRTRNGRKATGESEDTRARNHGPVQQQQAENTRTTTRARRGQAPGNSKTRTRQQKPTKQIREREQQTRTH

SEQ ID NO: 976865 - protein, 300 aa, Homo sapiens
MAQKMDCGAGLLRGSRLRPPYKTKRLVICRRLMEAIQISEGPPTNQAHRRCCPQSSQCPTANEMADIQVFMQLPLGAKSAFKVQNAISKMAHVVSMITLRLINAKDVPNTQRKVALSAKMLPKGSKCCYDFFPGQQSLGELAAKKSEMCFNGPECHYVKCAHIATYNFSQSLNANDLVNQEGKGPLITVGMIPLKARAVDNPEPECQFRGKWDFQGDLENDHVFLAGGELSDLGDGPGQNWGPDMIVQNRRLYLMWDSEGTKGHCSGRDGMSPPNRVAKCDTKVDRREKRAQYLFPELGV

SEQ ID NO: 976866 - protein, 133 aa, Homo sapiens
MKSTMQPKAWWIGKAIAVLTSGGDAQGMNAAVRAVVRVGIFTVPVSSYVHEGYQGLVDGGDHIKEATWAQRNDDASDWAGTDDWKCPVQGHFGNEQGRIRACYNLCERVGSPISVVIWRSDGSLTGVLTPYQF

SEQ ID NO: 976867 - protein, 43 aa, Homo sapiens
MGGPSGDGTTNGLAPGTRVYAHRRGRRNPNESTVHVFSFGTPW

SEQ ID NO: 976868 - protein, 428 aa, Homo sapiens
AWQQGPRHGAMGSSSQAGCCPRLLPVVTPCPVVPSHNHPGFMPRVLLWLPVWHASWVCSLVLGLLLVCAGDGKLCLVPSGPHVAWQVLAWCDAKCPSNCAVPKPGDRLKHGPWVPLAGPMGPTEHGLGLKVLGALLLAISLAFCWAHVTGPCSLGGCLSVACPDVQCLQGATRRTIPDGNGTIPCDYMPPFNGPVVGDLGLNPCLDRVILTTGMSSKHHKLRDWPFHLASNADDPDRTGPLPWLNLQLLAYWHLDHTCMGLEEWGPSNPVEPSIVHSVGGAFLPFKIYRRPPVNGQNWPKQQGTRRSKATTRAPELRPDHSVTITSGTGFPSSEHWLVRDIPHFDLAYTACQGGQTPEKHLDRPSAEHFRPPSTAFDATIKRRNLGSRTKRHAPSLECLCLSHEAHSPTGPDYASHWHYDSTGLTIVA

SEQ ID NO: 976869 - protein, 165 aa, Homo sapiens
ESAGLMHRSSPVTLTSDLEKKRRGVNWELGGYACLCCAGDAGTPGLRTFTSQEASRATGRAAEPIRQCECWHPACSCILSELAFASLSLYGISCGTMSIWPSTIRTPLEMLCHDPCACHGIKPRQRQGSQRSNPRDTFKLQNTQLDEGPGRIEDPLSHTCIKVEL

SEQ ID NO: 976870 - protein, 168 aa, Homo sapiens
GDSLQQRRGSCAEPCGLTVLEPGVPCRMEHALCPFPKTSPAVGTVGLRYVAYNIHVNGVLTVWVSYSQFLGLYEQVGLASLTLRQLQVPSLARVTSVSPFTLLYLVPVGCSSPLITARGSARPIAWEQETFNSIPASGTNMETQQVPTEGTCPWKVCSAKGRKFWSKC

SEQ ID NO: 976871 - protein, 257 aa, Homo sapiens
CHGKIQGLKVALPVSLTVSGVLKSHQANSNYAERCKVKYFFMGILLWSSLEPVLCPDDLKANCAHEKQEPSGSCIAFLTNGVYSSVYVTYVCCWWVVKPFGTGKSFNPSDGLTNTVAVINQCKENMRITIVAKPIPGESKNLSESDNGASGTYPRESIMADIWFRADIAKNKHRRPTVSQNNPARFMQGPIKPKHHEEGKTVRHMCAHARRMASRREIEDNQHREQRPYRYQLLNTSQVPDKNLVQTKKRIRTTASE

SEQ ID NO: 976872 - protein, 79 aa, Homo sapiens
HSSVRYGRGDASGKNAADGCAGRAPGPCSNLYWVGDGGPWNSPTFVEIVIRLVNLRREYVSHPLWVLREFNPLMCFHSS

SEQ ID NO: 976873 - protein, 231 aa, Homo sapiens
LTRVWRRRRVWVPYGASCTILSWVSKRAPLTRWLQMWKSGNYTGYELWKGLGSSLENPEPRTRARRNPALSTGATPLVAPCSMEKGWYWRVTNYDCRSLDCWAQWKTCFVFYENRRGRTIVCDSPSVLRGLTGLQPVCGLPQGWLLTVAYKAIFQGSCMLQSLPRVDRHLQFYNIITEFYAEPGKKSKNELRSLTSALRVIQVMDGDAGCPVSSGGLPPRPDLITAHYIRN

SEQ ID NO: 976874 - protein, 123 aa, Homo sapiens
MSAEAINDSSSTLAETNRAPFDLAEGESELVSGFTIEYAAGPVLLLCFIANTLNIDYNKLALTITNLPSEQSCDSMSPPENLASTLYCQAKEAYVCVTVPVLYEFEAGVYPDVRIPMQVIELL

SEQ ID NO: 976875 - protein, 189 aa, Homo sapiens
LLWWASIFLRSAWARLLGLEEASLFSLGGSIAHVTRGCPGRRGWACCCPASVGRCVYVLSPYRWKAGFPARKSLASPWYFKIADVERKNKARLPDEMRSCRPWVVRAVVSSCLALVKRLPGLQAPEQCVLATMASVAWVAVASVLDVLRSGVRSAASICFSAFVRLSIDQSLCVVTVSLWTRFTVEGFG

SEQ ID NO: 976876 - protein, 242 aa, Homo sapiens
MQWAVGRRCGRGPLLLLAVAGGADPEWSSGSGWVIAELLSSSAEDDSAAGCGRYAGSWTTSWAFSRLIVELRRLHPGHVLPDEELQCGVREMRGGCGWAPLCLLHASACPEVATGGCRISDIHLISGTRSTMWREGTIKSEVFYPGGDWKYNVRPGEAKRLCECGGQTHGWCNNGRGINRNTIQVFDDAPMMVITEPKENPSNPALEYSLDNRNDLGSAPHALVETATQASSLDCYDKGNSY

SEQ ID NO: 976877 - protein, 251 aa, Homo sapiens
GGLVVGAEWCRAGPSLGRCGRVVVPGGVRCLGWTCGDGLHRERRVTMAGGERSKMICKNLREDGEKAARECAGESGKSTIVYADEDHPRRDVSISEEECRRYRAVVYINSIQSIMAIVKAMGTADRLCRALQSGRRQASYLHCPAPRGAMACSLMTCPASSGGSGLDHGVQACFGRSREYQLNDSAATPERLERIAQSDYIPTQKMCYGPGEDTGIVETHFSFMTYTSRCLMWVVTRSEAERSGSKVMEGR

SEQ ID NO: 976878 - protein, 173 aa, Homo sapiens
YPPTSGTEQESVSGNRMNGDQNSDVYAEKAKDFPVHKRSLPPTGSRLRGDGAWNPWNGATLERNLGGWPNTPKGNRKLNRRNGNLGRPYKFFAAPHPVVALSPKNGGHKGRIHPHVWGPKDFIRPNNIGRPPNSCGGQRAAAKNGLSNSKKPSRWERGLYSHQGKNNRGGEIV

SEQ ID NO: 976879 - protein, 92 aa, Homo sapiens
APMYLVSCLLLALKPVAPLRCRANHSSLMDPDETKTTYVKHVELICLMQQVNARDLPPERQSDTDIVDEAIYNVSRTEVVFIQGTMKFKNES

SEQ ID NO: 976880 - protein, 337 aa, Homo sapiens
MCNRDPVVLLLSPSTPNPLAHYAVMCISHRTWARAGVQHWQCLRGAQVAGNTASSPMVRCQGEKDSLGEEMHALQQTFFERDWAAWQCNCVPVGVCMVTTSGTSQGPFDEGSATGPYPPAASIPLETGVITRQRTDACRVHRMPDGRLAAMGPGASVALVSAPQVLPLSGPVPRSPRASRFTTRLRWREPVLGFSSLPPAGRLSGWTYGYAVPRLELLHYPCRPGFHSCTCAYNSMRNTQQAMEHSACASGRQRSHYEIGAEPEMSANLTNLTPSSQTGPHRLRIETSCDRRSTTAPPAHPDNALLLHPTPSDPPVPRSPDRGGGPPPNSCVHPGRT

SEQ ID NO: 976881 - protein, 315 aa, Homo sapiens
MLQPLHPHLLLHTQALTHPHTAPKRKRASTSLATINTPTPPHHRREHSARALPAGPQLHNARTNTTPHPPRPNPSPTPPSASPPSPAPPPPPTHLTPHQPRAHPPPRPPPPHHPAPSRHSPAQHTRRPPHPPPPPCTTPNTPNHNPHIPHTATRPPPPTHPPPPRPPPHPPPPPPPPPPHRPPVHTPPPTPNSRPQLRPTLTAHHATPPLPTPPLNTTTPPHSPPPPPQTPPLPTPPPHAPPHPSPPPSTLSHTIQPPPPSPPLPPPPSSPSFHTPPLLTTTTTTSINTLHPSSTPSSQQLTFYAPSTHHTPPHP

SEQ ID NO: 976882 - protein, 427 aa, Homo sapiens
MTDVTGQPTRATAWRTLDRGKVLVGRAEAFGLSRHAITDHATRDYVTTTPLTFFSGERRLRFTLNGPKCTGVPWRASPWELPRWGLCAGRHPAFGPEPSTKLGRTNGPRAKPYPTLAGTAAPASMRALGARRKRNLRSVCPTLPLAPRGRTAPFTFAHLARGKQAFAHWEGPRHCTYSRSPQGTTLGRVAAGGTRPGGLNHGCAPAHRTVAWCSSLQPYWAVPWEEPLARPQTANTGYPRRLQAGHPAHSPSFSPVRTDTTSGPPTRTGGIRAVTPAAARDTIPLYAQPDISSAVTHSHRLTTQIPLNLISPPHYPTLHHSPLPHLQPTTVPRPYTNSAHPPLPAQLHPINPPSLHHYYTFPTRLITLNPESYPLHYPSSTTTAVIMLPPSPTNLCPITSARHPFTRIHTLHYRRRTITLICRLLYS

SEQ ID NO: 976883 - protein, 512 aa, Homo sapiens
VKEPQCNFNDLRPVTKGRTDQWAVVGDSQSNPQGRPVVCFTTVEQRGEVVVGETPWVDLSVDSLLHVQSPLQASTAHSRRRPTRAAHSVGAAPRSAQHTAPVHDTTHTRHALTRSGDALAQLTRALTCRRYPSSADSPPTPTPPWRPTNSTRPPIATPKPRDHAPHGDPTTGSPHTLRTRRKCNLTASANNTPHSHKMPPLLTEPQRRHNATAQRQPTTQHPPALANITTRTRPASTPPPPPPNRHPHPTTPPLTTCAPTPTRPTRPPRHPQTPRPPRTPHTRHAEPSDTPPPTHQRGTLRPQPTTAHLDPPHHPAPTTLPPSPQHPSLKHTTTVPTHHTPNGTHLYTTHSLSTHTHTPHHTHITHPQPSTHHPPHPTTPSPTPHPRYPPQKPPTTHHQTLSIPPPHPPTPTTSPHTPHTLPPNPPTTNPHHPRFPHLSASHPTHTPFPDPQISQHHLPPTTSTTLIPPYSDHAFTSSQPIPSIYNILHTIPTHPSPHHVSTLLHTPDLPST

SEQ ID NO: 976884 - protein, 354 aa, Homo sapiens
ARYPMDSLYVGDCDSDVSDAEQSEKFNPAEVCCCAIRVLAADVITPRDSLGYAYVNCPGDGRRLSRSLDSHELLTVIKGTGQMPSLMWVSDGIPSWRRTLDVGNVLHHRNPGYIYKIHTAPYIDTRCASGPILSWKVVCDENGLRVDASCPRSRAPVTGCRMRTIDERTHMGECSVNDPGSQFEAQESTSVVHMAGIADAWYPKGIGYSAQLLNTRERLGLTEVTADQCGACTSAGKSGNTPVALASDWGKPNRDQLTGEQDMLRSATVAAGTVRCQSCGHNSKVERMVGVALTDCNARLTLSQTTRHTTNLSIERTNFFQNFSLVRDCHNSIHATTILDSCLHHSYNFPPRFP

SEQ ID NO: 976885 - protein, 208 aa, Homo sapiens
MDIVAINDPFIDLNYMVYMFQYDSTHGKFHGTVQAELTGSLSSVEIPFIIFQERDPSKIKWGDAGRCRYVVEVHWTSSAAWRRVGLIRRGGAMKGLSSLPPLCDAPMFVDGVCTMRSMTNRLKISQECLLEAINMSLATPEQWSVHDNFGIVEGLMSTVHGISDIQKTVDGPSGKLWRDGAGLSRTSSLSSTGAARSVGKVIPELTGR

SEQ ID NO: 976886 - protein, 215 aa, Homo sapiens
MPNEDQNENNEAKCLGAQRRPLGAPVAPGSTCEEPESILAAWRMRRLAPELFFVVQDSANFSLGTDLRKSQVGYSVKQLSCYRALNGDTNGLFTDTFGCTVGNSCWKSPCRESSHCHYWNMSPGQADWGSDCTRKTRGQNSGIRNCSTYPMQVKTLFEASFRNSVSPVRLRKEPLIGTHHIITSIQGIRPKYQLPGGLTANSDLPNPYKGIEPAK

SEQ ID NO: 976887 - protein, 376 aa, Homo sapiens
WVLMCLCAVLSELLDPCAARAPCAAHADVCVLCVVPAVLCACVLLPCLCVCEPTSLPPWATLQWLPDTYPSADCLDDEMSSNKEQLVSSVRDPLFALITILILYSSNSANECLPLLCSLLGPCLPDLVNLNEVEHHCLAMSPFSGNNDTAPLGATMCVIVSSSSHLLGTKLGPEIERAECTIRMNDAPTTGYSAGLWATMTTYRVVDHSSVYRVLSEAQEFVKRTLKRCHLLGAPEQRCRSARASSYSVIQRAGPGVPRNWKHIPVFSPDACCNWRPLPGVETGHDHATKFHTVVEHHVVVTMMIQWKLEVPRCKVIGVGPPKKGSQDGPLHVGRTSAPTVLSNVPFRMSTQDNAEYEVLSGTGRVHTLVTAVSPM

SEQ ID NO: 976888 - protein, 135 aa, Homo sapiens
MSSRPFQSRGFQEHPKEAPERAHVSHATFKTGQQRASTTRHTENTHNKPTNTPQDERHPTDQKPSEEARGHNNTRVVNQRTRGAPLVAPTHRAAIPDRTDTPPRPCGTTNAPATNYERTDTSHHKATARHIHTAR

SEQ ID NO: 976889 - protein, 66 aa, Homo sapiens
MRTNHRSKTDRQRQAKYRPPTKRGYYVTPHRTPRQHHTQVQLTAKEPPQPSAKLYTDSGTAYERKR

SEQ ID NO: 976890 - protein, 456 aa, Homo sapiens
MADFESYDDRAYEELSACGRGSRRLVRGGLVVPDSPEKDVGPHEPPVHSIRTEIYLSIRFRATLSMRIFEGSLSHYRECYGLGQSSNRTQINVKGLLLMIELRLKVAFRVNGRPCTVADGALVGADSVYYRWWTSCTIGEENHSTTTVRFCEFTKQVRPTIAQKEIAVDSSDEFYGRVDSWHSPQWDRTYKLLAVHERISTLPCTGRAAHGAKVYRYGANRRMPQRKTQGAPPPTSATPALPPHSNPAHTPRSQVGRHPHTNCDFPPTEHPKTTTERDTHEGPQGTTRPTHPHGSHTPRKQVRRNAPHQTQRVPHSNPNIRGTHQPGAVAPPGHTTQGTTPGTNHTDRTRTMTAPVPAKDARATWRPRRRAQPKPSTPHNTTEAQSQRARRNQDPPRNYAAPPAQPNNRPGTNRIRQNSKNGYTHAAQPHIETKAQTKDARHEPTATHTPPPNSTL

SEQ ID NO: 976891 - protein, 453 aa, Homo sapiens
GTPSLRFQSFFPLPVSPCTCQLLECVLDASRPCQLCCLRPVLGRQGRRSARASSTGQTPIVRLTGRGGEELSVLSLILVLLLHISLHPKYRLRMYGDIGGERMLDNAVLVMCQMRSDGHSLNVPRILSLVHHKMKSTTAVSFTPPPENECDMLHLAWTLRLQAGLDVQARRTRQETTRGTRRTDALEQPACAGTRAPTPRSAERASTAQAARQRPHKPHFARHAHERHATHAQRTQHGTLQAPGRTPAAVHTLWRTCAKRQGAEKGADTTGTADDRQRTPRDAAAHRSTVPEALKRAPLGQTAERHNYMQTRTPRYRDPGTRSGHNTRAHTATLPGLLLITRTRSPHGNNSELTRTQRGHSAVTPLQGDRPGPPGDRRTTTHARPQPRALPARRTTRHVSRGTPVSRSTKQCAEHSHHSYRLRYSEHHQSATTRMTPQQKRTKPPNPATNNSR

SEQ ID NO: 976892 - protein, 97 aa, Homo sapiens
METPSAPKTRSGTKLSLRNFDPETSRKGQEADPNQAWRKHAAGAPPKSQGDRRTTPGAGGEDRPARRDPRAGPLGTKQSDPRAGKENIGADSTMQPV

SEQ ID NO: 976893 - protein, 193 aa, Homo sapiens
GFGSYPSWCMLRKIKMMLTEHKRLLKTVDKGLQVATGSRSLKKEGPGCDSGRIRIREDTTVKERNRKQLEKEGKGYKLYEEDDPERVQSKLYLNRQVKLLAELEIDEERARSRRDALTGPDQGQTEIEAHETARWDKREWPDKQLVRNSRNGRVVQLAKLRRSITERGAKDEDTLGNFLIARRVNMEQCEVTA

SEQ ID NO: 976894 - protein, 138 aa, Homo sapiens
RIKRVEPEKLNAGRRCQQGNFAEWSRVLWGLMTNVCFPFERKIRGLFPREEAVRVLQHRMTDHGFALGQLAFLGGRRREDCAEHMNEQQRFSQDLSYYWHRYLSGQAECNGELSRLTNRLAFKHNQKRNIVYDATHRC

SEQ ID NO: 976895 - protein, 281 aa, Homo sapiens
AHGLGDLSEPAADGHARPTPASIMRATLLCPCMAMHHRQSDWRRSGITDMTQRFTSIRSDPDRDVGGSVEDLIAKGTLSHEVTHQGEVTITDEPMEAQFSRRVSSMNYRWTAQYNGEIWHRGRLSYSVFNSRLLIRGSPANLMGSPTNPSDKASVEHEALLGIRLTKLQTVDNVQSPTCNEWYLRYDIQLWLGQASPGTVSQDTVSGAPASQRRQASAPGDGVKRGTRHGLCTQGQPSTQGITFTRNHSSTTILGTEQPTSIYAQQTCWPGLRRTLMNARR

SEQ ID NO: 976896 - protein, 158 aa, Homo sapiens
MGESEEMYALKRVLRVLHAACACCVLAKCPSKKDHRREEKGSSPEGSLAQKARAKKEQAWPPKAQRGQKAPAQKSTCSKGLLGRSIGGAHNKVLGVFWAGLKTTKHKKTRGHTNAGGGTQRVIANRPMVHSVFLAPVFFVPGGNRGPLKGDRKSKAGT

SEQ ID NO: 976897 - protein, 265 aa, Homo sapiens
RAQWSLERRLLGCEVREVREAGGNLDPARTHGCPVCLSGPVLACLDWMLCVLLCALPLPAQANMQNVFCTKTSDTVCDSCEDSTYTQLWNWVPECLSCGSRCSSDQVETQACTREQNLHLHLQCPGWYCALSKQEGCLVCAPVAQVPAGLRRWPDQELKHQTWCAKPLCPGDCSPTRVHPRIFAVATDLNVVDIPGNCKHWDAVCTSTYHHLEYGPVVQYTYAVSVTRSQHTQTVQKPAVVQELLLLQWAQTPAEGAWGIDLQLD

SEQ ID NO: 976898 - protein, 138 aa, Homo sapiens
MLTAATPRMVYRHRWRTHHTAGCQPKARTRGGGDSQPCTHWSTKNANEGQTHQRDHHEKTPARNHRSTQKAHTKHDEAHISGHRERGHHTKANPHRRVYCVEEDTTSRNKPQMRQSHQRNLISRGADNETKEQPAKIH

SEQ ID NO: 976899 - protein, 326 aa, Homo sapiens
VRDGGGVRGRFWSGGARGSRTVWRTTSRELCGVEDDFHKQFAAELEVLAELEVWLSTPSPSGGPPVHLLGLTPVDCSEDGPCQEGDAGRPSPAPACILCGKHASGWLPCGMTGLLCDCLTLHAVLGPCPHAAHVIKTVLSVACCWSKMCLNLQVSEEIGWSPPLPCFLRRRDINRAQSLKDSQSFWGPPESQNACCCRGSHTGLKQLPESQSDGVPPSLEDYSTVTFNGRTSGAYLGACGDGPYVSPGVAGTLSYTSIARLVPRLNWLGWVFSLPEEEVDGKTAEPRVKEARRLRHVNSSGVDEEAHLGAYENDDAEDTTGVVSDA

SEQ ID NO: 976900 - protein, 138 aa, Homo sapiens
NPSLDLLRSKPNLNPPPMYTGGQGKKEKCPESQSWKPPVLAPPQLIARDWVLVFTIWSLVGWGVRDVETLCRRLLGGARSHLTPLGKMSQRESGEKGHLSGHGVLEDSWLVPKDTHRGQQAGVTTSIPKVNTAVQSQG

SEQ ID NO: 976901 - protein, 310 aa, Homo sapiens
ADLQAASVTGLYWKLLPGAGCCPRGAGDPWGGVAVGWRWWGDAELVLLAEKLTGAQAEACWSSRLVPGPASLRHHNRTMFPVPPTCTAPTPGQPARCCWGWFFEEFRPRVKLLLRRKLAWSTKGRCLVVGTPCLPRRRLPWYARFGYATDAPRAVQAGALWSPCEALADTVLVLCGLCPCPRGSTRGPYPAAVEQSCCCLPFKHACTSGKLVRTAVGVLAAVDSRGLDFQCGQFTASSVLSPISWLAFPWNRGRTRGRTSHVYHDGPGLLRPAPLRQCGTRRPRNREQKVYDLTPGLQHSDQSAMLLNRP

SEQ ID NO: 976902 - protein, 424 aa, Homo sapiens
MACCLPEFCLCPAGVPARSLAVLCAVRLTCWACGPLCLWPHWIYCHSVICPPASPWQTLGVLLTMLATTPNDPICPAADAATTACSCRHNLEATLDLPSGLAALGIVRSSPKTSISTKHALGPRSHTTHRANSHVNIDYTPTARLTTTLLPSGPTRTFTPLTPSVIQVGTTRYGACRTSTIHTGRWPAPTRFSPGASAALDRSTAPPATHCHLLTPVLRPGSAFGPRIRCLPISRPPWTPPPARPNSSRCVPLPPPLSLGRFAHHLDLHCGSQGTLPVGIPQQNRNSTVDVSKSAHTVGNALARTRAFPPRQFWHPASHALARHEGPQEPSPAFKQDRADHTVYTPARREATPPTREHTDTAHPTRTDTHHTAAPQDADPTRDHSTPTRNTRTHPRSSPPHAPPPHSATGPPTPHLLLPQHPPP

SEQ ID NO: 976903 - protein, 344 aa, Homo sapiens
GGALPPAKRAKKPEEASESSVRRDLESEDGGPMQGHEAMVNVPLKKFSSVMSCLMPTANGDPCGNGGYPEHPTAECAGACKPHHDTMCSGEPAARTHDDARHARDVIIDKVRDGELPTLPNWPLAFQGLEWASSEKNPSSSVSDACASMTTPWHKSGQVPRTSVENLGHALPPDAAHPLLGDTTTGGPLAKVRPHLGPKAVRTPPGAGARGPIGTRKALGPSRERSTPRRATGDSERRQGTGPMRTNVTATPPIRPRTTRGPTPRKGFPTKRRGPHRGAARCATTTGRSRPPHGGTPGSAVRPTANALHTITNDTQGGAIGNHGATKETPQGRRKETSEEHGGE

SEQ ID NO: 976904 - protein, 507 aa, Homo sapiens
MGHTLYGTAVANAAASQTPKRSSGHLGLSHHATVRRQVACQPHANAKANPKARMAQQLVRHPNSSSMSSQQQAFIKSTQAAPHFTCCTNKHHISIACAHLHKPSTTAKHTSNPQAAFIFVNQLMRPHLSKVATAPSMYPGNQTAPDGAKTTKDGAKQAQKRLTHKQNRKHMKYTLKEHLKDKLDHIRRQTNHTTPLGSHTYGPTQHLDITPRTAPPPPRPRAQHTTQHNSLTHYVGLSHTHTDHTKTRSRQAMDNHSNTHHQGPTDGNPAMLQHRETPQALDYTPHKLTQLKSRQQPPKQTKQTNDSEHTPNQEEHAYPPRQQPYATALYTHTTPLDGTTTTNTINTARHSRTHKEQEKHSAHKRHTTTTRYTTIDTTQRKPKQRKNFNLPIRSHHTTSHSNSSTYYSHYSLLLIERPFTTDTYYLKLSTLTHITYTSLPSILCKYSIYIIQTKYKLNTIKKTTLSIYSLHSTSSFNIYNVNHYTTAVYNTHTNKYTTCISSNKSTQ

SEQ ID NO: 976905 - protein, 334 aa, Homo sapiens
AGCEPPPSRAARNGNGVNGRPCRPVPRGSAMLIKRNSLSTHLEAEKPLSALWGGGGRRLGKRRDWGEITLDIISMAETTMTARRRLELEMAHKLQRLREVSVRRESELRFMLCNLAQTILPSLSLGGLICENSHASTYLAGLVMRSKQEIKRITVLSPVPATTMDDIQLCQDIMDLKQELQNLRRHPKTKRNHHTAEADETDELNPARLTTLVQTTRLPGGRLRQVERTREQAEHQDKADTLRHSQHPKTTPIPARPAAQPNPTSNPRATGRHAKDCGGTPRGPSRRNRSLPRERARTEQTQRGRNPERKKNKHKEARQQKDKNTGKAQRQKTE

SEQ ID NO: 976906 - protein, 460 aa, Homo sapiens
MPCAPSRNGMVLKPHFHNGLAAGAVATWFNQPGPEDPADCKALAMPMARRICPAPHAYGVPITVPIVAACPTGSVYQTLNVLLLPGAAWHSSPVMDAQGLCLAYHNECVGTCDPSAHITMCDPDVMCCETNVTNCEVHLAMCQTSAKRCSEQGMYPATQYLQYHHIHTNVKWPLRYRQSNGEHMFLCFECNLENIVPTPSLTRAPVFHDTGPVNTALLHDRTKRIDVIHLDGKKNATFKRLQLDLTYGPVAKRPGSIGHNGPQMTQWTAAGPKDCLHPDSNKRPSLLDLANSRPATQCLGITPRRCSYRRTQLGPGDSAPTMMLTYSYQEHKATILDTNSPGPGTTANHPCVHHDSMAPKQRSTRATQETAHPQGGPHTDTTLLTTKRTGAQMVQHANTPTTVVAPNSANPSNHTMTRPCNPTQLCTATTRSQEPSTTTKYHISIITRHNPSHKQPTQHH

SEQ ID NO: 976907 - protein, 425 aa, Homo sapiens
GRFSRLENRYEALAKQVASEMRFCAWTSVLLPCEHGECLQWLWMLLVLLLSAACCGVWPCAPCDMPGALALLCVCVLLPCVTACCPPICPGVPCPLPSCHHGLECWMLGWMPWSHVPCQGSAVHRVLALSGLGGLLSLHMPLPLAFNLHPCIRRVTLVDPPVHAVACGTVRVGTHRWRRARCRMQPWFRPWSEGFAGSCTDQFGGVLPVGCHSAPCGRSWDGRRGGDWTGGTLGRPPRCCGGAAASGGRIYNRLSPFIARGPGPPEVIEVALAAGPSYGEPTSVTALRRLRQGAGLLESMRTQILASSEISIYHDTPLRTLNYAGSATGSHILSGTCDIWGLRAPTTDNERGDCRDPQKSGTKLDRAGKLRKDEKRAEAYDRTTGTPTDRTPERSPNDAKAHTMTQQIPTTHSSMRHNIQKKNDE

SEQ ID NO: 976908 - protein, 53 aa, Homo sapiens
MITNVRQPGQNHYGSIGTRAHHTKEYAPNGPRSTTGGAALETETRSRSTTRRA

SEQ ID NO: 976909 - protein, 71 aa, Homo sapiens
MSKSAAQNHSPPNELLQRYRTILRQVAKRESLPGAPEDKRPTHGASKTDTHETPEEPLDARHHTHRFTRRN

SEQ ID NO: 976910 - protein, 162 aa, Homo sapiens
YRGVPEFIGGTPDEGPAPRKKVCWGLWVGEAVVLWLTAQDPGGQRELDLGVVELLDSRPGALCVAGISFHLSVTLKWSVGLGRGCRDTHVFLDSTWVSPGALWRVVSGLRGVFPRCHLCVVWVCRLSRGVSIGAEPRFRESFFHRGEGGEILLKNTPVAPRV

SEQ ID NO: 976911 - protein, 112 aa, Homo sapiens
MARSTTFVTIKGTPYNPLESPVLVSYRKAISAYSLQAKLALGPYCLNLVTFTGRANLTSLHPKLGKRHPKQVSNQLNLPLYHCDSSSQIPNSTEYSKKSLVALNPSPRFPTF

SEQ ID NO: 976912 - protein, 232 aa, Homo sapiens
MAGQPLRTGRLCRQHGSHVSYRTGRCTRVLLTTRQSSAITKGTTSETGASGVPRGTSDVLRRVLCDIGPLPKGFPVLSARRHGSRSCQAFSGFVPRNPSGFRGSKIPGVLLGPNGGFIPPSWCEAVCIPHIPGCRTREKVSPGFPGKEEQRLVLLQQTECFGGRLYHAESASRHSTSSLESHSYNCIRLGESSVYSSTVTTISSLLTSRGGSSLIRLHYQSSVSQSELLDLG

SEQ ID NO: 976913 - protein, 395 aa, Homo sapiens
RLRRRRPQTFVPGPSSPPFATTARRESLQVAPVRQCPRSKSEARRMLRYFAVHGRLGRHGLQPPWAHRHIGTAKSGTEHLRPCLSCGRSRSLNVHYPSGHGWHHQTIYGLVVGSTVIANSLTDDISLYKSFLQLGAGLRRGPDADLAARLCHRPSWRDRWRAGHLHHKPRLLRAAMILILIFSESARAYYGLIRSDLTLYHTAGPSSEPPANRNIMYRPPHSSVQNEQSCHIRHGAADPSKVALAPLRQCTKLASRLGTQEQGHRPGEETETHGSTKATQEHRRTKNERENRATTLSNETQQKIQKNRTTNTHQRPPPPLTTPTQNTDPTTHTQIPNPINTKNKHSTNPATTYDNITQQPQLTLHHIRSRTELSLLFSTTRTPDKPTHADRTRTT

SEQ ID NO: 976914 - protein, 302 aa, Homo sapiens
DRRGFMHRKSPGTLTADLEKKSPRRNGSKGVSSLCAAGCRSPPVLRDFTSHEASLATGSAASLLEGEAGPACLLWARIAGRLYGIHGQCLLHSPRGILGMLAGSGCLVVERRVPEIPASLRPTVVRGESCNVKCFARGAHFRMEIGRPGQFSEPYHYGANGSACSAMVSGRFLALFCLLLGSLGSLCFLFTIYWVPYRGRGGFAWNWLHLLVLWLPGLLACGLGQSHGLCVHGWNRSAADLGRGPNVRKGFDDMLHDFARGGACPVSHLRGRSLLLLRFLVLASRPRATPGRARNSLPPFRC

SEQ ID NO: 976915 - protein, 65 aa, Homo sapiens
MTTDICQIGWKHRIARRAAVWRICTGVSTNRTAQEATISPHALSADEPAEHIGGTRNLTIASEQD

SEQ ID NO: 976916 - protein, 133 aa, Homo sapiens
APRRRPAAVEAGPEDRRLRARRNPEGWFRETCSCGRQALSLRWTGVHHGARSYQDNPRSSGVWTYGKRACVLDRVSSSARRETSSPTMEMIAQPASLQQPKPRKVLESSGAEMEVSWGGGEAPLTVEMRESTC

SEQ ID NO: 976917 - protein, 101 aa, Homo sapiens
ASFGEMSLKASEGESGGSMQQRGSPSLYRWSDCCRKRVGPEAVSHPFEYCDRWTCITNWVSVPQVARCQGHRDRRCGKCDSYSSEKVTEEAMGITLKLNEK

SEQ ID NO: 976918 - protein, 324 aa, Homo sapiens
MQALRIRPREASTGAAECAQVEVVRPGTVDGFLPGEWSLSYGERYTCVFITVARNSREHDQDRDAHIWGGSNELYVLKGSMQMTRRECDPKQQQDQIEHGLLMYPENCIRRKMVIQNRLPYEMYFRMVMAIIWIEYSLAKQQFLSMGLSQGPRNDHVVEDVGPEVTPYRYSTQDVINCRMNLCATAERKSPFKGFGDDTSKDPKEDYQDQNGKSGPNVGISKGELESEPGISELEGDMRDISEGPRSKRGPGQKIRGKEDPENKTGRLDTMGKKGGTMRNNDRTNTQNKGTQGVTTLNSMRQKARAYTREQRGKEKSDIVPLLA

SEQ ID NO: 976919 - protein, 261 aa, Homo sapiens
GYGSTLIFPYTRTCGWGLRFSHNSKNTKIGGHLFKEFENGSTKKTLHNIKKWNTFTGVKCKPLLQLQASNSPTGVRAKDISYERKRGSYGWDFSNHVTDPQDKTTGFWPASREIPEHSALTRKYPATDQRLAGPHRLTKPQILSSTSTFLPLATKVTKPHVLRVDLKDLSGAIKQIPGGTSLHFNTGVKHQQPSSTTQLLISDTSLQGQISSSKAYPSFREASMRVCAIGQREILFSITMRNANASENGKNIAGREGANWN

SEQ ID NO: 976920 - protein, 105 aa, Homo sapiens
MGRDAISSCYPKSVKLRKRGQATRVRPPGNGASAGSSRPEMNDRLMKHRITAPASSRTEASQLIVRRPEAVIPRMSKEALCTENRGRWYFEHREDGGALCSVSLL

SEQ ID NO: 976921 - protein, 167 aa, Homo sapiens
GVCPSMGALLSRCRSYGERLSRDVMRSHSEGLSCVAVTVKLFCSSHKGSPPLARTDNAQLRLGLHRAKGQHGFNSSFIVRDYRWFSAVSVTKTASSNHVKGCTSLQANVLSIMARKATLIRYGFRYAGSLRCDIAQRDAYATGGALIISLTSYSVSAIDTIAKYKYV

SEQ ID NO: 976922 - protein, 430 aa, Homo sapiens
LGPSARPEAGQSCEPSRPVSPAVAAFASETAAAEPGAGERARTRQAQSQPQPQAYVPHPRTGQVAVAQTRKGGGLKSRSLATARLASLCDAVSEFFEGTYLNIAFTVTAKIGATCVDLVELDPLAAGASCGVDASHYGHTQHCDGPLGSEASPTRLCRTAGGTTMDLRRAILDEGTVAWALGPRSRHVVSAWEGHRAGCNALCQDQRGGKMRVQGMILPKRPREVPRDVHDGMTHRRAYLVSIVSSREGRRMRMVARCRLGIDSVTPLLLAVLCAIPMEKFSRRDPDVDARAAPGRRTGGGRSREYEEDNLEHTMCDFPANFGLNGEKGNGSGDTGGSEWSQKGVIGKGVGDMGTIWVEERGSDREGWKQRLVDRGRRKIGGEHQCGDIGNNIRPNGDGVGEEDIRVTDIGKCGTEGKRTHHRDVDRERG

SEQ ID NO: 976923 - protein, 131 aa, Homo sapiens
MLITPSYGLPYPLTTFAAESEAYGKQALGSPNPIRTTPLYTLSKDVFKTALQPQQFKLMDQLYHRYASNKLRGIASLNGTCHVIELLERPMCRTTPHKLGSNSNLGREYFFTTTAGHGKNNGPNTPSPPLE

SEQ ID NO: 976924 - protein, 310 aa, Homo sapiens
VFGFFFPFFGKRGSRFLARAGPNPGGPTFPPAFYPPVKEAGDLQCCRPPHCRDKKEMFTGVTAFLIISNRICCDRGGGHRRHGAGGRHDTSSRLSQWFSKTLSDLTIYTLIERTRRVGYQQYDSQRGGDSEEQPLKKSGNRVDSPAPQTIEAVNLEALAETPYAGPCDLAVKVQRRVRGHFLATVDTLSGTGKQLARETPGSGCPQQGGTTKWETAVGTHGRVDLSRQAISPPPTKHDRSKLLTHRRARGSESDITPPPTFYRISQRTITPPGRTQLWLLPPRRRRLQEKLAPLEISRRVFPRYYETPKL

SEQ ID NO: 976925 - protein, 199 aa, Homo sapiens
EGASGSAPSYGLNGYWGRPLQAVGRGGAGIGDVGSLWGLCEASRWGIAAVWGYRGGSSWRPVGSKTIGDFHAVRLMTITRCEEPGEEAQCRRNTATKRVPTEIVGRDILFTGPAVINHTDETNGTSATSGASTEYSRDVRWDPIYACMTLGLIMLHGEQRVMAVVTEQRGAGVSARRPLCRRMQPIWCLDELPVSEIRS

SEQ ID NO: 976926 - protein, 181 aa, Homo sapiens
MRPRGDRSPWRRRWLVPRLGPWIPGPGLAAGALPPSLAARSRPGLPVCWCSFTWPGCVRIRMPAVQVWSGHVSRWSRIGPGVLRDVRRGCYGVWHVAACVIVTGLSDGGPGLPGAGAEFRELRSVALGGCGQLSRRAAGALAEGVPTPAVPVVAHCDWVDGWRWRLADRCRPEELGLTAAQ

SEQ ID NO: 976927 - protein, 285 aa, Homo sapiens
MANGDGRHSMDLVVIGRLFHHGLLVYTRGKVNIVCHHTEPFVDSSTTLVYMFQLLISQPSGKVSTEHRSKGMRNGKCCSVTLDNPQSGISPVSEISSNTSMCAATAGAEYVVQSTGVYHAPHGRRLGLNLHGGMPTRGQSSCVHPLCCCSRIVTSLGCETNEKYDNSSRSSDNASWAPTCLAPWQCQSMTNFGIVEGLMTQSMPSLHPKRLVGLALRETVGVMVCRAFQNIIPALLAMQGCGKCLPLSEREAHGLLPCPMQRFMVTDWQKLLLANRRGKLKPKNR

SEQ ID NO: 976928 - protein, 257 aa, Homo sapiens
MENGTVAYGHERPALIRSRMTESQRGGWQNRLSQLPRAQGYFLLTRLQEFNRDLTCAVITGSLPRFSLGGQRNPDRRFQERKDTQKVVVDLSEQEEEKVALSDYVVLLGLTVRALALIDQAGGGYGSRVSAQGLPCVLGRRLGVFRALRLPLRPRAAAGCLCCCIGAVCGGMPPPVGCWLFMRACCPDGAKDRGPAGGKTESRQSVPEWLMLASTQRVVWGKSRAYPSLDPWLQAQPTFLAMTVVRCDLKNGLRAYT

SEQ ID NO: 976929 - protein, 284 aa, Homo sapiens
MACEKRALISCRAREDRVPKSYQRIEWQNHSRVVSPNDARIADDGCLLSNGLGEKARRSALHVGIASQVKCIKEQRHLYYQQSRFIHRVLHYRIDGLVSYDPHARPRSWCDIVRVNDEELGSFRAIVWCWNRYCGLPLQVVLAKKPNREGEPILSIVTMVVSLSTHTFITSTHNFFLLGSPQKGMSTILGATSSGECHGSSDLCFRTILGACRSVSVVCSNFVLRVLCPLPAGKAFSCLLGEPDLVLEGLSWYPTWCNPFQDLGGLASSAVPDGTSFMAGLPGT

SEQ ID NO: 976930 - protein, 360 aa, Homo sapiens
PPVPPPPYVSPRVYLQAHKTDAREHHVQGLHWTAQCPVYGLADCPPSYAGSHGELRGERQATLFDPQLHDGSCICERVASIVDVSMDSGSLVLSGIGDLPGGSSPSEDSCLLGAAGLRCSSDGLRSSFAPSSAACAGYCLSLAVALRGPVRGTAPCTLVPPEGLPDPIPALSLKLLAPLGVPTGGPRWQSVDGLASLASGPCFPELRRGSPLGTGAARRSFCYSLRHRTAKRSVERTRFPQRVPGATRAYIITGIRTPACRMAHDPKGDHERYAAHRDNGEHRGDNTQGLVEEKRFAMQMEVQSIVSKSDITGLQTGQPPKKVQARIKKARDQLINAIPTSFVHHSGAHGQYETKDHVQA

SEQ ID NO: 976931 - protein, 235 aa, Homo sapiens
WPIQFFTGVEGRGTQLLYERKPRATSPGPNRGRQSSRCSGAVGAQAILLPWGGPGPRASPTIRGSPFGAPARAWGSRGLVLGLGKSSGSQGRPLPRSISHRFRFRPGDLGNSRFWLGLGEQGPHWGASPTAGQKYSMSSSSCHHRPHPTPGSPSLKGIPEASSSLPPTGAFLMPSRLFFLGGLPLPPVGAAHSGPAGPALGLQRSSSPWSRRAEVLLRLVNKLWLFASRASGLDD

SEQ ID NO: 976932 - protein, 52 aa, Homo sapiens
MQHFEGCNPTTVNEEGVKHPTKGRPSEGQKQTEEPRVEEANTATGYSHRNQT

SEQ ID NO: 976933 - protein, 121 aa, Homo sapiens
DGGDGRGGHSCARGPWTQAELRSVELPQRTRQSPGQRRRVCGQGSRMRRTYSALSVLFPEPPRCEAEIAAVGPVVIQMPERTTKRVVGNGSHSEWTGILVVRWEMLKTVALLRISVYLTLS

SEQ ID NO: 976934 - protein, 137 aa, Homo sapiens
MLAVREVRAQACSSLSGGVDRALDGHCGPKGKVRRLGVCSTHLGVHLLGTDELRLGCSKIIALPRGASGELREPMPRVVRGHRRYGRKPGPKEAGESETAPGYQGGWEHNYQTEARAPGGDPNNRGVARSKQRGGHA

SEQ ID NO: 976935 - protein, 445 aa, Homo sapiens
GLHLRRPMLACLHPQPRQARTPLPLASCYHVACLQCCCPALPCLTPVTADHVPCAICALHGRLAGLSVDRWFPCPRYPARPQSSPKTEQLRPVPERLKEIQPRADRSSRTPAMTIRSRTMDTISETCSHACKLALGAWVCNESWAGLNVPSAQDARGVHATPDGREDLTWGRHVGCEERNDYQTLSMTLGPRTGPDRGSVLAPTDVTKVARLADCSCRHCDNHTLEQSFQKYSIQRNAQPYIAKWYHTDLLSSDHVTARYPADTMETLRKKDEHQNKKHRAKPGASYPASRPREQPSTPHAFDNRQPAHEQATKTNIDHQTNMAVAHCRAGQEYKTPQSTSSQGALLQTERRRLIDTKEVVATRQEKPPGPRTPSTTSNESATQRLHKHRLTGTTKNNQPDTAANNTDRETQNNKQKKSRHNPGLDSPRQREKGEHEHKKQKTRT

SEQ ID NO: 976936 - protein, 205 aa, Homo sapiens
MLPCVENAPCCSWQTCCAFPTDYTCTNLRVSSWSAHNPFRDGLKCQVDSAVPLAVIPSPFFQHLPFPGPCMLHLKAPGMPPWFPVDTWPSFPDSVEELSTKWTFPADSLTWCLVTVLWPQNKGEQKGAWKGGGCAPESPEAWSRTTGLLLLARKSKVGPRQEQETSKMRARATETAPAGEHRGNKERREQQTVVKTGTEKGRKEQ

SEQ ID NO: 976937 - protein, 356 aa, Homo sapiens
EDKKKNKRNFPQEQQPPPPPLRPLPPSAQPVCVPGVWLGLPCAPGPFQAKPFLPGPVPLNGRCPKPGARRLGFGSSVQAEGVCGGGDPEGSGAQTSPRAFLCVGIFQVAFLWGFPGVTARCQLSHRARFKPTTSDPENPMTQEHFCPRPCGRVGKTPQRAFQRAELDTLCVISPQSAVKADPWKRPPYISRVSLSNGGHSRENSLPVCPPRENSLPDTFFRKVRGYIVALSTFPPQAPICGDPPLKNVARETANNRCGQQGHNTQQGNPQCPRRNSFSHHTRKKSSGPSNTTRFHRLIIAPAMKRLSCGAHNGPRVPYRGKNFNQNLSPSGEPRYGSPELETPTHMGWDNMYTPLD

SEQ ID NO: 976938 - protein, 235 aa, Homo sapiens
VTPKSKYQSIRNESLIIAGGRGLWVLPPGGTACPISVHRLGPMLRSSGWVTIVQHYPVLLLPNRMSDLRAGQTGLGGAQCLRGESGRAADDVVRVIVRGLPDARVTSSTRPVRSCDVMPCELEGRAGAGIYLVVDRRAMREGERRQMDPRPTRELAVIIHHSVEGMAVDVHKRPSLLSTQVVTRICASRAGFSASRYRTDASTVLVNVICTEVTERCTLIQSCGEDITRRVKRRT

SEQ ID NO: 976939 - protein, 170 aa, Homo sapiens
QVERALYVAPAANGHVVYNVRSGVLGTCSSWLMCACVLHRARIVSYPRYMMCPALHHPAQDPYCCPTLSLLWHSLAYYRLLGYQLGDSLSLVLRTITIARGARSLTRTSQTGSRDTTIDKRARSNRVNPGRSPLLVSYHALSKLLIKPMALSAKKRIRCCDLFRNSKGIA

SEQ ID NO: 976940 - protein, 344 aa, Homo sapiens
MASRYSHNAKSRRSVMYQGIDANLVPTPYYRWGTGAVTDALAASSSGFARGMVRSAGGTAVRLGVVLDDDPGEGNDCRVGQSLVAGQPGTGKTAIAMGSGAGPGPWHAIHRPSPAVKIFSLEMSNDRGADCRRFRLVHRAFAVKEETETHRRGGGGDPYRSTINGYGLQMVGKVTLLRAHEMGTIYELGTKMRGGRPRDEVQAGNVITIETATGKISKLGRSFRKASASYTTMCSQKQVRGSGPEWGAYRKRREVGDTPCSLDEKWRSLNLANPGDNQGAHQQGDTGDNIVRNRGTNNVHGARCGEEATGRNPESRNNDRHTEGRKETCTQGTENRQAVINNNT

SEQ ID NO: 976941 - protein, 105 aa, Homo sapiens
MVCSQSDLGGCGCTSHLHDELPATVVKGSACELSAGPPSGHVDADAFLQDVMEASRYTIIGQCLLVLHSGVLEPLYLCSKWCPRVRTWLSRPYLAIIVANHAMPF

SEQ ID NO: 976942 - protein, 103 aa, Homo sapiens
MRALRNVGGVRYHYQTRCQWRYKWNVQALVIDDPSSFENEHDLGLRNKKLGARTPKDDVTPVPEGASPPDTIHIAQEDFLTNKGNRRRGELLILAHRGVYHIG

SEQ ID NO: 976943 - protein, 215 aa, Homo sapiens
MWSRLVHHRLRVQGPRFRNLVGVHEVRLSQELDVDPPYSVRLSETLLRRCSSDTRRSRSPMKVGCTPSNACCTVWRCPWWCLGIDPSVCRRVALVRSSRANRIAFAVARDLAYTDWRIDCHYVSWYDRVSLDRPARSVTLRFNNIEYAAVWTPHLACPPKRMALTGGLDLLPESFDSGPNRGLGWHGFLGWTPLRVATTRPRRSSLVLGFIPCCQ

SEQ ID NO: 976944 - protein, 284 aa, Homo sapiens
HDTDMAAERRMRGSAGPRVAPWMETLGMVEPVVSFRRGYGRLSISGGPLVDGTVAKRETQEDRQAGVYTSEVRAEVTDAKLGDEMHASSLTMLVETRVGIKMDSVDDLKVTACEAPDPIRPLLHMSLITGMVCRTWVWNLRYHGGGTPPHRGSEGNVQQGTVLGHAWHAKDRKPAVRAQGGDRVLYNGDNVCFGLISVRKLHRIGDHRSVHLSAFVCKGSIPKETAFGRYACAYCTVAAGRSYAHSALQAASRIRALPLVAATQGLYLWERVERKGTPRWHIGP

SEQ ID NO: 976945 - protein, 158 aa, Homo sapiens
CVGCLSKALARRKRAHDCMPSEGHPWPAGHRGGLPWRNRLRIALQSGGRCWGRARPIRVPVRNAHTTALKANGLCKERPVMIYRSRTGEDVMNRHGEIAYHDDKAVDHGRNCIPTEKTPKTTTYTVEHPALQVPKHKQKLRRRMDFQPHITKGEQEQD

SEQ ID NO: 976946 - protein, 177 aa, Homo sapiens
MLAAEYVVESYWRRSTTMEKAGAHLQVGAKRVIISAPHLLDAPMFVMGVNHEKYDKTASRSSSNASCISNCIATLAKVIHDERWYRGRTSGPQFHAITGTQNDCGLAPPGNCGVMARGGFQEHHPCLYWALAKGCGARSSPELNGKLTGMAFRVPLQVSVWTRTGVKKLPIYDTHTG

SEQ ID NO: 976947 - protein, 94 aa, Homo sapiens
MRWVNGKRDPGRPLTIARFVTGYPFTRVEEQGPLCDPRRMTARDMGIVPQRGLLTVLDPCHNRQGTNSTMGAKKLAKEKGHYQALRTREENLVR

SEQ ID NO: 976948 - protein, 218 aa, Homo sapiens
MAKIHDLPRAPTLGPTVPEEQTAVIMGNIFGIAFSRVLIGKKEMRILMVGLDAVGKISILYKLKLGADVTTIPTIGFNVETVEYKKHQSLQCGMLCGQDKIRTLWRHYFQNSQGLTSCGRLAMIGSEFLRPGQELMRMLAAGRCSGHAVAPCLCRAMQDLPYALKLLDDPRTTVGRVLPCVIVTGYAFQGQPGVTSVGRGLYGRLELVAEQVQNRMEA

SEQ ID NO: 976949 - protein, 218 aa, Homo sapiens
AADTVKQGVRKRSHFLPTPGEFEVSVGWTRIGTRSTDRDLAHQPDVAPTLPNDCSIAFTSDPGIHLFNQGVLTDYVVTIHLRTELTFLVAQETRGGSRRNVEADRASTMPCHGDGLEIDLLKLEPMGPLRSREIVLDDSIEMGLIDRGPNPRTECNQWHPSIAVEDAALTNCIGGLRFGSVLPEREINDSEFFPETDVWKLRSLNCYEPRLPARLSRG

SEQ ID NO: 976950 - protein, 156 aa, Homo sapiens
MRLYTLEPHDVIIVSSLMLSPVALRRKSKIYLAGEVRVNALNAAIAQVSFGDVGVPPEALTKDRRLPMGGEGGIPGRKPAWARVFIGDQRPGDEGAFVYSDISPMRTFNKVAATVSQNAYERRMRENVARRVERPGCPPLSPVWSDQRQLSPGVPW

SEQ ID NO: 976951 - protein, 314 aa, Homo sapiens
RRPGDSSAWEVNRARFQVNRNWSSSLHEEKDAPASLCSGSRSQAPRSCHGPRQVWQGVVQLGIPHAIGVCTLDLFCPRGLWEELLSCTLAHLNWWCLHAVADGLEPPKTVRENIEVEGMEGCTLSRWPVDHEHCCGARGIGGANSRGPCNSLVRSSCAPGAEGDAMLRGWCGWDEWEPLPPSLARLVAHYCCAACLERGTSRRSLEVCVTSGFGGNVLFHSELGGRRPPSVYVGDIVTVSRAGGARETAGGSGKWRRDSGLRNRGGLAGARLRDDLVDLYRGEGCWAKQVRIGRGKRGPLSWLGPCLAAGTGRL

SEQ ID NO: 976952 - protein, 184 aa, Homo sapiens
MSGNGFCFKPNVGTAHELQDVCDVIIIRIGGFNSGVLLDGQRSRTVRRFAVASKELKGGQLMIGHVQEDINLPTITLRMNLLDGCTLHQCRGATTRFSDRATGTGHAQPPRTTTHPTKRTRPYAQGTREPRNRPYETDDGPLPYVPHGPRLHPAAVEQKIATYTLTSERSTTPTIPEQEPALHR

SEQ ID NO: 976953 - protein, 76 aa, Homo sapiens
MSAANEEEEKPTGGVPKKRVAEGAHTKGVFTGIKPPVLGETEVGQEDASNSIPPHVRQLKEVLLTNSIYLPNKPAS

SEQ ID NO: 976954 - protein, 106 aa, Homo sapiens
MGLMYPYIFHVLRMGEIKMLFLLKMKSNKDLPPDSTHALKAQLSSVMCYVVPVLVWEKAETKTERLAVRQEQYFSSDIFSSVIIQGRRWADSTVGTVCLKPRRLVE

SEQ ID NO: 976955 - protein, 152 aa, Homo sapiens
AGRECPAGSAESCRGQGAAKPRRFCWENLRDALVEEAGPECTHRVTEYSGWTALIASRLKCRPQWTAMVDAEGECRVIAANGARMLRQVTLQSYVVPGLATCKGVPDLQEQVLSPYRWLIQGQNGLAVTVLVADVTIPEDDLSAEGASSSAL

SEQ ID NO: 976956 - protein, 136 aa, Homo sapiens
MAHEYVPHPRKPDRRFVRDSPSGNNGPRAEITRRRENILAEQGPRRDDLDEGPQRTDEAPHQPRRETADEGDDYHYERSVTCRDEHDGTARADGSSNLRTIEKEIDDTKKRLLGRLRSVQRPISNNPTRSDEQPRD

SEQ ID NO: 976957 - protein, 360 aa, Homo sapiens
MQVTVDHRVSLFLTTQLRRDHDTGNMALTACNRGANDGTHDLSCHMSLLSNSRWHHAPTTGDSPCDDLALLTLIPVMDGLADCQRVSAYSQPCYNCGLSEDGHAGTNITVVATVQDVHGKPSDRMAASPRAGEEAYAPALHAQRHPDGPLVQGTSYPRLHGHCADNQHSIVWTPLGRPDEGNLQWPPSESQCGDSNVNGIGSVPFAPNISSLWMPVRYTLHSERVRTAAIAEPQKVIITMMEWQQHRNVSLRGPIKAYGSPPRKEYETDTQRGDSAGKTVESTHVTKGPTKKDTDHTDKTKPRGRTRTRVDMKPAVRLTVPTNFDRNTYNTWIGTTSRRRHQEQSRCTYYGSGHESGRLR

SEQ ID NO: 976958 - protein, 166 aa, Homo sapiens
GSGGSALVFCGLSWWPSPFRLPETVASSVWCVSELVSSTGVQADDEEVAVTSASAKKEVEESADEGRALFRAMSDGPKKNSLFSLDDGQRDDPWGGGECWARDRARRNLASRRRVLCELACSVLDGTSRVVTSSTDVQSLVYPDGRSHRTRDGLVGWIRSFSLGAP

SEQ ID NO: 976959 - protein, 224 aa, Homo sapiens
NVLLSLCDASVNERLCRFSDQLCNMARQESQRHVLAVHVDPVGLCGSLPARSVGFSSWGRHGAWSQQENPVVASCTRLALLPETNEGDTQRGVRLLLVFYANAGGLTLSLIMIKRSCINGHHHHASPGVIVSLRVITCKMHSVEHASRDSNILHHSVPPSGPCLPQLTTERGAPALGSEDFANVICCRFRRLTAGLIVLNTVFISINHVRRTKPLWRKEPLSKL

SEQ ID NO: 976960 - protein, 98 aa, Homo sapiens
MRHQKQNRNEEHKKENENKTNTENTNELRRANRRRRARRREGAETRTQTVKQKQEYDNTRRRRSTNHQRSEDRTKTQQPGGAKTEKRRRREMAERTKR

SEQ ID NO: 976961 - protein, 125 aa, Homo sapiens
MSNDRRVARHINTDEWVHVLQLQPLQLLLLSAPFHSINMLQEFCNASGNTLNAQPLVTKCNMLLFMYKGSGTFDCLHVWHLAPPQEAKPNVAVNGCFPLIQAWTLLLCGVNPWLLLEMVSPQLFI

SEQ ID NO: 976962 - protein, 231 aa, Homo sapiens
AAAPLALSQSTPGPARPSHSQQNGQGEDPHQHRGHLATWTPGKSTTTGHLIYKCWRYLTKRTIENVLKNGGRLRMGNGDPSSMPVGAGQAECAEAVSAASPSDISLWKFETTKYNITIIDAPVHRDYIKNMITVYIPSADLLQRADRGWLGVGEYEAGISKNGHDAGACPAGLQLLGVKRMLIVRCEQHGLHRRLAYSENALRQKIVTGESRALHPERIGYKPRASLLTIL

SEQ ID NO: 976963 - protein, 419 aa, Homo sapiens
ARGCSDSFCSGQNPLGCFSAIVSISSQVKCPCRELPETVAYAHVVRCIYDGELKCLTGVQAAPCGGVLDQHAKIACGAIIRVSKTLTQSGLVDNELAVLSPVWCKKLRGYAMGIGQWSRRGHGTEDMRRSTIRLVDIHRCEDFHVPTWVKTLDAQIRARDRAGSIPSRRAPLDFDRRRKCLQEEGTFHGGSANGGALRLSAGQPLDFAYAVLLREPERAYLRTTSGEVRTNCLYEALPLEATLSVHDSNRIQDFYILLPWKTVNCIELPNLPPGLRRLPISKRHEMIELLPFPVLGGFREMLAQGQWGVARCRYEGEYRVECPMSMSATRNGEPPGEGTQDARGPPEAATRGEGPGSEPRAEDPSPGEDEQSPPENLEQGERSSGERSDEYSRQGTRVATVEQTTQAQEPLSSGSDTHR

SEQ ID NO: 976964 - protein, 151 aa, Homo sapiens
CGRGCERCWPEDVRLRAVDAAFLPGCVPVACGLMPLCAACCADCSVSPVSSCHVPVLALCAPDVMCLLDGPSASVSRSSACDCVETLCDATAPLLLCVPCVMMLVPGAPVMALDAWVMGSAPAARPHVHAPGSALPGFHSSNAGGPWGDVV

SEQ ID NO: 976965 - protein, 181 aa, Homo sapiens
MVNCNDDQGVLAVDAGDNNYGEAVSPMCLDRQAWRSCGAGRTTAAVASSMGSAGSSTRGCTVREVLASYPRWTTTNRPRTGTRQASHRGTSAKKLGRSCWQERRCVLGDPLVVEPKRTRTPGPGYKDGGRAKPPETGRRQSEHREARGGDNSITEQRTNRNDNKEANNSQKKKAQGTTREK

SEQ ID NO: 976966 - protein, 258 aa, Homo sapiens
MGGNVVSFKKKSGYCRGAVKRTEGRTPWRQREPSEKRVRYVTEGWVTPQYRDSLCVTEGCAEQKRRAHLLPEWGGHPRGKAEGPTPTYECPEKISRGGAGESARNMSQRGRIVPGPSKQTRGEISSPLEGEPGGVGMKRTHNKGETRLGGLGRPHKRETKKMANEGYHYVRRNGPRERKKNNRNNKAKRELGDNEVTAVALEHRVPPRREGKNNTTPKGGNGAQRWEEHMATGAQTTGSVHYSPYIKRGAGPVRTKER

SEQ ID NO: 976967 - protein, 357 aa, Homo sapiens
MGAMGSIGYGKGGWALHNNPGERAKCRAEGTIKAPRSTRGATGGKDKCKKNDPEEGTKQGEIAHEGEGNKATVTKTREEETPKKRHPSAQMKDAHVRQEHSERRGERQTNNNTTPKKQMRRTPITTRVGRRNNEEETINTTTDTPQEGENTTSEERNTRRREERSGGKRPKAATSSKHRHTHNTHCKSIKPQSNHSRKEEGTKQQHPIVQEEHPPMVRRQTKGGTKTTDTSAPNQRRGGMVVTPQHDEEKRRKDGAPPQPTTADRIDERKTDMGRGNPTRGGHTPQWKKHADVVESHTRGGRPGRQDRRRKDNITQRRRNNQIGDATRSKICEHITQQPQRHTTAVEPPPSSNKAEC

SEQ ID NO: 976968 - protein, 286 aa, Homo sapiens
WGKKPGDFIWLWGAGGLRELWVGAGSVSSSPSQGLLGWPRDGRWALGDGLHRCDRGGEAEPVWFLGRSRWWSVEVRAWRGVGGERDNFVEREVVGSDTIREGAGQSAIIAGVGAREISRAHIDETTRQRKHHPCVARREAVARDSHKRAQRELERAGEENLERTRCENTRGERRDVRGSPSYKGTREGALKGARGKRALSRYKSPLCVSSREKQRVGATKGLHPIELEPPIFTDVVSRKVVGRETSMGGGRVGSPPASADEGAGACNKTQTKRRDEPPQKLNKQTI

SEQ ID NO: 976969 - protein, 440 aa, Homo sapiens
MTPVQRGGPGALVALGWGTGGVFRGRLSAAVTSWWPCGLRGCGLGSGAEAVGALRRHGLEDKEWMPVRQVRAAWSRTCETIKSLEEIYLFSLPITEQEIMDFFLVGHLSRMTVLRDSCSVHERHDPCPVLGLPEVQRQFCMPTRWARNTVALQIGSGVLKCILEGSGEPTGPFQVGAIYPWSQDFSHLFPQMAAREALTGGEPRIGARPPPLVPFCLRVDQCPLAGLLGALCTPINSACGPKGATLGNTVYHGTLVPKDKRASMELGVGKFRVERGVEAFNAPRGSLMSLVCYPLCGGDNYIAQEANTFLDVAHEFYKERHLTEGIPCDITREASELRRAEKRREVVFTNKQLPPPTTQRGRRPCESHAQRRFVRKASQHNEKDYLLRRRREQEQAPTARGGETQHRSGRGIKTEKQKGKQQRREDSSDKKAKPARPTIL

SEQ ID NO: 976970 - protein, 189 aa, Homo sapiens
KWWMDAGAVGVVLGFPGGPGMGNRGGFRGGFVHWHPGPGVARLCDGARGLRAALSSAECEVRMDKEWMPVTKIVPAVVKDMKIKSLEELYLFSLAVLTESTRSWIFFLCGLSQGGGFEDYASCNKQIRAGQRTRFKALVAIEDYNGQCRLMGVKCSRGRVYTDFRGDIDPGNALHRPRVGRGYCWEQDR

SEQ ID NO: 976971 - protein, 119 aa, Homo sapiens
AAGGGGGVLGVAALVMCCAVRCARTASMPWSPVPPVEVEPMQPRALCATCGNNMPHVLVCHHALLPLLPCPMPNGCGLSVAWALVCCLDSPCGHEYVDMGMGQWTGPWSRRGGHARVYH

SEQ ID NO: 976972 - protein, 379 aa, Homo sapiens
MRAGGVFCCCFSVVRVCECLVMCLDACCGCSVTCAGSLNAALLGCGCAVMVPLLLAVPLVVGCPPCVLLLAICPAPMLLSGAPCCLVTTCCCLVLLCALLCACMIGLTSVHAAGLELLSLLHVVSECCVLLLAVRLCMRSFITAYPAGTCKLIMASNNAGTLGKANCLEFNLRHDWNSLLSHDPRLLFRHYSRAYFPDARDMVRYLGDFADTLGLRVQYNTTIAHVTLDKDRQAWNGHYFILTDQKGQVHQCSVLFVATGLSVPNQVDFPGSESAEGYEIRSVGPRPLLAPLLLSWVVGTLALDTRDTLGCQAFSRLSAGPGLLSLWPPLVGALSLSLAGDFRYVLGVSAFAGLPLSGAVSTFCVAACVPRERFVYVGG

SEQ ID NO: 976973 - protein, 450 aa, Homo sapiens
AAAAPTEVCGRCQMCSQPKPEPDALPLMCPPGSLSLLLLLSSGLLAALPDDLVVSREQDCTMDLIRNDNDTSGSVCEAARVIAGAADSSQYSCTAVRSLTLETPECNAHRCAHAALLRRATTIHADDAPLLAALGALCTHNSVLGRPKRPHSLLCSLSALVCLYALVRLRSAFSSPIRQCPPRALGCSTLLLPTRAPASYLCARSPLTLSSLCSAARRLLACRLHFSSLGSLPIRRSPSPGGNSPPRRVGAPSLQFRYTGRLPPPFAFLLFQYHTLTPIVELTSSTALWATAPLRRPWTSSYSQSAPRGLSLPPLASTAAQDRRATPHTPPPQAAASIFAAVFLLLQSVPPPRRVAPLPGAWTVPLLVGSQISTGVALTRPGAPLGTLAPLPIDNFRGTPSSDCRDRVCPGARSTLHFGATRPQALPDWFIRDRARFISLATTVGPGAPT

SEQ ID NO: 976974 - protein, 280 aa, Homo sapiens
MYHGIDPMGTVPRSDMRYCKAVVIAALNRDTTCVRQSARVYGAPPPSVLVESGDPARSGLRVLGALRVRSSGRRTSSVAQRWCWEQLGHGALPELRVSLVVLGAVMLGDAVRLTCCDFVLLCCRLILSPVWGDWVWDGSLLIHPAGRRGSSPHRHCARVSVLPSPCVPPVGGPCLRHLSGPPARITTGRRALGRGNRALYDICFRSLKLTPPLGEPDTPGGWSLEWRPTCRAFRPSTAACGTRSFTFAAPGGSMAGATARAQYGCGRPPRVVHLSAPVAG

SEQ ID NO: 976975 - protein, 332 aa, Homo sapiens
MWEGDLLGGCVGLPISVHSNYGGWRCVHRACNYSEGRVKVKGKELGVDGVGTCSYVELAPPSRISLCNPRSLALQCVVGLWAATSLTLWVHSTRGDLSSSTVPPLGHLPRGERPPYRPYMCTRPRCAQHKTVPPHTGRRIQLPSNLFLPRDSPSHLSRRTNAHLPGYTILRGLSAPATTVCFRRTARRHPLHHAQLTCARAPPPRERGVQPSAHTSAPGTSPPPHHNSLPALSTRCVLPARQPLATAPPQVPRDRHRTSSESEHPTSDHLAPHAGTHNTPTARPQPTGEGTNHRRTKPTQNDNHKHPQQHPTPTSANILTNKTNREHQQSTP

SEQ ID NO: 976976 - protein, 313 aa, Homo sapiens
MRYIAIKTDKDTSKEGHAWYLRPHWGTKKRNQKERSAFALTRRCAHVCSPRPPEAGTQNALGSAFARTTDRGKRLNTQPPGFPPQALLRVALPRVRDTDSTIALPRHFVLRAWDFRTRSRNRVGAVPPDARHCRERVWCVLLLGSGWAALGVASGLTENSGPAVVPRFEAMGPPFTLHHWGWYTRGPPWNLSVRHSGFPLKVPPNPRCTLAIPLGQTPEPWASSPTFISNQSMKVWRDTSRGGHTRHTEHTAGAAPISWGPLEAALGPWPEKGVKFPQGGKTPKTLLTPPLWEPPGELKPRRCRMGNCRPVPG

SEQ ID NO: 976977 - protein, 128 aa, Homo sapiens
MPLLALPLLGADKETRDSLTQLFYHALEMFLYSIPHPSSESVPLVALTGGVGMREAPVDVCERTQEHRVASDGGKAVIVLSTRIDLVMCQVPYEMAGVEEPVRVPESLYRVSSYPGCPHTTQPFIRNP

SEQ ID NO: 976978 - protein, 335 aa, Homo sapiens
AVPVGAYRCAPPDPVFDMTAPVASAVPVAWPAWCAPTPPQEEELAFVVPAVKRHIFVWVGRLAVHKYLLVMEILLPHVVVAIDKAAWPPCSMPNPTGERWIRREGSCKSSLDRGWTLNGKECLIRGSRRVDGGAAELFPTSQDFFTDMRRHGIPPNGTLILGMVRDVLMIIVKLAERMRTGARIAATLSERRSCRESLGGVHRGVVVIGVLQGRGVETLPNQFFGRQQRPSMTVPFWGSLPTGKLSPSIRLDTDGVVLFKKLVKERNQLEGDGPLRTRGLMKPQVPCHEFAANAEDLGASESLVCQVLDGKASTPQMERYFGPRQPLEGRGLGDP

SEQ ID NO: 976979 - protein, 241 aa, Homo sapiens
PAQVHTCSAAGGFSTSDYDVGWESPHNGSGTWAYSAPVSAGELGSCSLEESRSTGVRIPASCFRLVVDYQERALCSWMLIAAIESRRVGLHCRSSSLRLEFPDGRPRPGRPQSSAPLRCAASARASSLPLLTSVCLLLVRRALRRGRWPVLGTRGQGAGACCGSEPWARVCLLVRADPVVTGYWYASPMWVPGVRPVDSVLVRRRRAPLARLRPWWRCDSPVVRGLVVSAVFLVMVKGGQR

SEQ ID NO: 976980 - protein, 176 aa, Homo sapiens
MSAKYNHHTEAPGVNERTESTNKRGVHKVHAHNGTDQRTKEATTKTTCDNSNERIKEASTPYNIDTHEKNHDKAQQSQQTPRYEEHPQKPDMSQPNTEQTGGKKNKRNANDNEHQRARKATRTQNKPRQGQKGRESQKPKKKKERAPTKKQKQTDTTTNDNNKTHTKQQKKNSRAI

SEQ ID NO: 976981 - protein, 145 aa, Homo sapiens
MAIHKRPRGALMLHYRVCATRILGTLADCSNLPRVDSQIQAMRGSEYCGEEGSHVVKVHLNHQGVQNAVTCARLPERGWPFLTYTSKKNTLSISVERLPLRTSPGSEAPCGCEENADVTMRIDIVSSLEKAFYTKTGFISLINVN

SEQ ID NO: 976982 - protein, 160 aa, Homo sapiens
MPSLPGLAPSVFCAGCGRRYSRCGTFGGETRAEVDCGGPHGTGGGVKTTAASGEQRGGDKPLARTVLCDDDPNCESTIETSVYIRRPAQRNGRVRQKDFTTGAASHMVLLHKGGRSQRARTTKQLTVRNPTGIVSDSTQQTDGPAHTEDIAMGGDHRLTR

SEQ ID NO: 976983 - protein, 182 aa, Homo sapiens
MICRESRTLFASSIQGTFPKKDRRLLSSRDILPSLPCYYVVLIFMRLLAGHVLVVFSPGIEPLDLHVGSYGDRKRAGSWSRSLPLLFIVVQITGYWRPSLKGIKVKVMVALFSGEPSDSLPVGEGSDMEVSVKRADRWRIVVGVWVQLNGWNSVTLHGCDAYAWLWWVEAGIDSWKLRNKRT

SEQ ID NO: 976984 - protein, 120 aa, Homo sapiens
MAVFLWTRGVSVCTRVSSVLTVALLPLVSLCLGFSLHWRGEPALANLIPSLGEHGLSLSRLSVGFALVHLQAEELPHLLRAFPESVLNVVSCLSCTYEMLMRSLPYRITVVNYADFHMPR

SEQ ID NO: 976985 - protein, 175 aa, Homo sapiens
MPCVTSQSVSQRRRTTLLPSALDVHGCDCQSGGRHTVCAVSTRWTAVCDSSRRTQQSPVSMRLSAVVGLQVGVCEQVWRCRTRLYCSCDESQCGVLSQSSRVVPRGGACACVTSKYWRHHASRPDVARVDVQGCDFQLVSQETSGVPGVECRVVSPDGPCSKQVSGVQRVDVAVV

SEQ ID NO: 976986 - protein, 673 aa, Homo sapiens
PTRRRVAVGRSSTNVSLVLYRVSSVLLVWILVCPNALGISEQKVSDSRCVRVWYLSVKEYVLDKDHMCILRLVHVQELLDQADIGKEDDQQECNAKNMARLKTACNAVAHEERYAHAAMFAKESRHRTRHDGVHRILYALKEHDGEHCRWVRDILGEYSSEILGSSDKQVIPEREINIPIQTALLEVPMARRGDAAPLTMCHRPERRKVAGQRRLSRKGKKNRYGRRELSHAGPQLSSLEDGPSGGNHMGRKRLGGGPNSMCPEYYVGSPWALNPMWRYGDSLTGDHGSSVRAGTIGGVSSFCGGRPSYQITNRGNSLAVRGTPTGAHLISVNQRDTGRVHSGTPWGHLAPGKANAGKYNLRLTIKDTPKSPLLKRKIKMGGHDVFKEALGLGGIVYRPSEDTPPTGEENGSVGGAKRYIQNGSPVRGVPSACEKATQAMGLYRTQGPSGDFPTDSQLKSVETKIHPQREFQGQQLFHLFLPGTIGDVVTGECEAKKENDPPVWEGKEIPREQTPKGAPFGQQKSGKPVGATERFQNPTGREAAKQTADLVRTQKLTGADTEEHLKTVWIRNEQATGRRRENTREKMGTAPKWPNDSTDNHNERRTRRRCAEHQGFEEDTVNVIDTHREQNPVLSETTTTWGSHHIESAEAREEDKIDEKRKHSKRSDTNRGN

SEQ ID NO: 976987 - protein, 411 aa, Homo sapiens
WYGEPKDLNNSKEGSVQNLGRDSVPIYKFPVIDRDFKDARVYVARDAVNVVGSGELSCRIESVGGILVISQCCYVLRSNIVLDAGYVIVTSCEASILLICAPMGIHYAIDDACGLPDAGFSVEARASHSTVKRGQGVYKALHARCDLRGLSPGVGAMVYGSRKASKHRAWWDLVAIDLEVDPSALDGNLKADTDERFHRTCGERTYALRKMGQRTWCDPPVTGSYIEGGPGVINDDRITYNADETTCDSMHLYNTRPGGEHIKRSRGWERENTLKHTEAERITRGKTERHRRTAKKHPRGTIEGGEHSKTRTKQQRERAKLCWLHEENRAHEEKKDSYEKRLKKTRRQQRREATDAKERGDRSRQREGESERHNNDEEGKGQATHARAHTATKEESQKKGGRGRKEAGERQ

SEQ ID NO: 976988 - protein, 259 aa, Homo sapiens
MARARLGPPSTLINSSHTEITRTPLRKGGDDHTKSTGHKATPTATGEHGRDQTDLGGFLPPDNTTNQQATTTTRLRHQADNTRGGEGPPVAREYVRRGKYIVSTLIDRCGGKQQLEIAAQDTQQTQARPNNLTTGGKRVRAKEDGEEKQTALTDEKLARTETQPKNDHALDRTQTPRVKLCDQMTRWKAHVNPAEEPQEGTRPATEHHPDRVHPRETAYKRCKESSPRSARYRTPYHDAADIHSRESNKPWIAHLTPHL

SEQ ID NO: 976989 - protein, 132 aa, Homo sapiens
WRDVSRKVLRSQTWVPRAFLPRQAQDVVHRLGKVKTLPLTDDPVQSAVQLTDFLGYKAVYELNIDDSVTVRIWPAESNGEIQRKEGWSDGTCRPFTTSTDTTVMGCVGAISLGRTSVTYTASHSLGEDRSHT

SEQ ID NO: 976990 - protein, 356 aa, Homo sapiens
MHVFGATVYSIWAPYCDVRCGRPPSSWGSILIDPHDRTCVAHWVSVPPEEATNIALERLGVRLGRDRSVPSFLGPGRIKSLTRKPLISYGEKKAPLGERHIHKGSFTRIPTKGARGRQQAKTSLPPGTSGTSNCSLWTHIGAHTFEEQGIQPVNHWAVHHEKLNGKCCKLRNSRVTQRTVIAETRGDSELHTVHHKSFPHYWNPTRTKRASSYILAVKQRYTTTHSTYRLLSLLDYSITIYYFDLVAVDEHIALTLSSVARHCQCRLTQREAIYKRSISTQHKLTNKHNTTYSTEDNPINQKSHTPHPPDHTPNNPPRLALSGASSHLLPSSRSRPLASCAHVGSAAAMCGLAVLR

SEQ ID NO: 976991 - protein, 63 aa, Homo sapiens
MCTNIILRPREQRCCHTTKLLHVHNELDLLYHSLADSSHTIILAHRSQRQRTPRAAVSPHCVH

SEQ ID NO: 976992 - protein, 103 aa, Homo sapiens
GVSFTSPSSCWMLEPRTRCVAMRVQQQRSGGGGPLRKPQIPSSRGLAMATTDRLGASMCIPPSYADLAKLQRYFQQRIWFGLVKLDVKTKVLQWRGIFNVRFI

SEQ ID NO: 976993 - protein, 214 aa, Homo sapiens
GEGRVASSLYSEEIPVGERGANKCSSNKTFNLGEAKSHTSKKSTQSTVTIQQQHHRASEQQPARHTAAKLPAMSGQAGQQAKMRGLTIDLKNLLKTRREDLHPTKPSLLWEIFLPTSTEEEMRKLFDEIWNGRRSLHAEGSRIWLYPVWKPEPLAEMAKVDAGQVCHSVEKQLLCAYAVIGASLTVRNLPQYVCKRTAGNEALVCCGARYEKGR

SEQ ID NO: 976994 - protein, 347 aa, Homo sapiens
VVCQAVGYASGVEQQTDVGGSHEALQRWRFWMREQHGSRRWCFLDRWWSLHAIIVVDHDISSLLTIRSGIPVRQYSYFHGTAKGAQLRHEMDDVMIICKNALHSIVGKHRDQTCILPRRLWAQDSRLGVHSGLPMQSIAGRSICHLSASILTIRCALSSNRAGRLIEGFTVPMLGALSMCGSHPRLVSVCSSSSIQLQYKVACLGSRIFVHSASAMAIGLLPQDLRRTCDYYVYGLRRSGLAYVHRLFPLYIPPVAFGSSGGDDVVLGVLCDLTVRPVLSIHMALRLTEACFGLGRGRFRTCTSEPFMWCSGGSADFLRVGPDPFRTGACSGPFLLGSRYLAGTAAL

SEQ ID NO: 976995 - protein, 55 aa, Homo sapiens
MSYVHGIYARLTERERVRREDRVDELCHKAPMWGPVRIALGCPERESTILLYVLG

SEQ ID NO: 976996 - protein, 226 aa, Homo sapiens
MEQGLLPILRAILVVQRGVHVRFGNPFCGFIMEGSDTLPLDSQRVEANSIPKCASQSGKGNIHTTTAKGARLPSTSLARNTPQRIGHTVEIWRSPGSQLRQTDMGPRQITKCTDIQHTRGRQPPWMKDDTGRGTVRTEPVESQHRRQRRGRTSIRRRGNNRYGVAPNDVMCLPPNTRQREDRQLNDPTTRITHNEMRADKKKHKEHDSTDKKQTRDRTARHSTHDK

SEQ ID NO: 976997 - protein, 238 aa, Homo sapiens
MIFWELRVIHSYYFIILLHLKPPGGPGGQVAWAIIPLINQQVQLAGKVDKDVRYSRAYLKGYRYLEEYRREPRTPHLLYQRDTQRSWRGAKLVRVVRPTPGEIPEHTWRRGPEERRKLQLGEGLQRESCGETREPVGRERSGAHTAISLDTIQNTHKRVYSGGGAREERVSSRRIHLTQRHFTVRGESGRERAEEEKIVAGDTPTEGEGPQKRDSAKRGARKEIQRPKWGHPPQPRGG

SEQ ID NO: 976998 - protein, 71 aa, Homo sapiens
GQAATAVAETVESLFYLYRVTGGPQIPGVVAGEILQSFIAASSRVPSWVAYSSINNVQDPSEDPRLRDNDV

SEQ ID NO: 976999 - protein, 98 aa, Homo sapiens
MRTSSVELPRLGTQRKEPGNPRIKAANKYGADVDPPNERGSLLEGNRLCIGPPYQVTEQVMPRNCEQRISALNWRYYANVTFQVSQAESKRVVRPKIY

SEQ ID NO: 977000 - protein, 328 aa, Homo sapiens
GIPVVFDSNAIAYYVSKEELRGTYSRGGESHVGAGGELAGFRYGAPTQYLGVPHLGPSLGPTHKQASLSNAKGGRGEAEIRGACLGWLDYDTTACTFISGCAPKRSWTMGLYICSGLHPCGGSYKPRLLEPFLPRARPFVPNLAHNARRFALHAWRLNAKTRTCFAGDSFFGGEVETCVRRWSQSADYFECAFSAPHFWEEDRSHAGGRKWFTGTEKQKAREELEPGTDVRKTHGGLDTAGSMNRGRLDKNCRSKGRMACMEPEGAKDAPFLKLSAKDVPSGGSERHVNDANYTHMRDPHTVRALDQNTWAALRYSTGRSCWTKYAPE

SEQ ID NO: 977001 - protein, 197 aa, Homo sapiens
MVITGGPVWSQEQRGRGVNFLGLLPPGIKVWMRSPSFLGSGGRFLQGRWAVASLGSYKTLGGSQLVVCRPGRLSGRGSGVWRLQSGCGCGVSHERESRLGVVENTTISPSEHSITGVTRGVVGSPSVCGENRDLYLYKRYTPSVYTYDLEKDKRRERRDQTYPSHIYLLSLNYLPMCGNIFISLERNNSPRGDYEWA

SEQ ID NO: 977002 - protein, 300 aa, Homo sapiens
GPEKLRSMDQTRSAGTMTLGRFVLALMLRGAPRKMVGFDSVLNDSAPRPHAPGILTPVVRSALPLLPCATLSMLVSRRRGPAVVSPRACPCSPSQGAPLTLEVAHCTATPRPGETRVGGLPEGLARRADGMGQGDGLRAAPCLPWSRRCTPLPVIAVAHMRSWGIQADDRRGHKVKSGDARQGAGTTPWVYLAETPREKGWTGATALRTTGSGTDFVGGQKHEFERHTRKYMQSWSWGNRLLAATGMNPDEVNLIEQQVARMQSEGKRQNKPGAGHGPYPIKWSMPVAENEEMKIVVTRH

SEQ ID NO: 977003 - protein, 344 aa, Homo sapiens
MPIRPNRPTRPRLHELTPRDPEDTGATDTQGGQCMTHSCTYDGHGHMAWLGTTRGPRERGGTWGQEQDKSAKYPEWRHRTPIGIPRRDRKSLWDSQTWPETHTHHRYRETHGRKRARPWRIGRNGKATREHIRLASNGTKDKAHREIRDRHHYEGTHIMTRRQYWPHQLAYNGNWINKTHHAHQELARGTNRRSPIGQNRRKKRPPGHPQDRRDDGEKKKGPPPDEERQTKTMTTLHKAGRTKARGKHLDCTIRRQDRSEPGERNLRARGPHMQPKREHKETPRAQDHPCHSNTHIWTNTETRRDGKHTNTTTEKTQQRDSTQGEHTSANKAVGNQTRTPRQEA

SEQ ID NO: 977004 - protein, 81 aa, Homo sapiens
LAVTTCDLRPCAASALNPVRDWIETSWRCSILWPTVRGFVHDHTSRSELVCMRPLVTKCKQDFLSTAAFLTSSSAAIATKS

SEQ ID NO: 977005 - protein, 86 aa, Homo sapiens
HCSRPRLAPPHYHRRLAASRHYPGREAQARRAQEEAEADGAPAVGSRRRCLVARARAAPAPVTAFRSRGVVLPPGRVGRCLLEKVT

SEQ ID NO: 977006 - protein, 229 aa, Homo sapiens
RDLTRLVRWPRYIRLLAGERAILYKSDWTGASCDEAQFTQALDRRTATQLFELAASKYMTMRHKHRRRMQRLLARAEKKAVWLKGTSQARSSTTCPFDAGVNTVTTLVERQESSAGGDFAHDVDPIDAGLSSCLPCVVEWGSLTVIIKGRGKTGTSSPQEDLQHLVVFTQVNSERRRRLRLQLVDSYQDQLQVTDTMEIRRHWGGTVLGPKSVARIAKLEQARLNELAL

SEQ ID NO: 977007 - protein, 141 aa, Homo sapiens
GSLRSGGGMTAAAAHRSDPRRRVPPPHGLGPAASELPPPGGGGTSGRRAGRAEERPRSAARTRQEEVRRKGCGDVEVAGERMEGRERQGRRTSDGVEVDSREYMITRSTEQCGRDGEQIEGTEEDTQDMEGSEWIRNIVRD

SEQ ID NO: 977008 - protein, 167 aa, Homo sapiens
GHRHRCMRYYTKVPPVLISTPIHYTCDRDYDSCLGGPVSVYDRKDVVSGTLTTYLINRPGVEAPYAFVQWVYMTDVPSMLARKVRDHDALPRIETRMHHNLPEGRLNGRTISDHTIAKDTVRERSSLRIDGRRALTRRLGLDGPSSRAIMTICVPCDPIPIIVSGHA

SEQ ID NO: 977009 - protein, 149 aa, Homo sapiens
MRRRLSSSLSGPFHRGLVYLFVPEIAPGRGRVHCACRELVRGSDGAGPDPGVRPSAFSLLGVWASGGSDCIRGVCLMIAPRGRAGPPSRSTLPGPGRLPRSQAIVAGVVPRVLEVCWLASVARRLSRGASSPLRPLTCQVLSSPCALTK

SEQ ID NO: 977010 - protein, 164 aa, Homo sapiens
SKKRSLIFWKVLKWFHFSKDDGCPSSKTIFFSSFSNIREPQEGLAAWMWNVVDYQEPGPTTPNKSGILGEPLWTGLGWDGRLTFSGDTMSCTMVGGYCDGVYARGWARGWRRLGWSQTWSYRRFTPFSTKGPPSNWSRSLTLIRISFSLAVILRGRNLRIEIIM

SEQ ID NO: 977011 - protein, 140 aa, Homo sapiens
MSGSSRRRSCKPNGEKPDEFESGNLPRALLGAGDELSDLIGSVHGADLLGAVRRGNIAQCWVGGSCMSVSMKSFRFPLSVNLMILVQAKEPKIRSSLRVTWVSTYRLPDGEAECRLQIAVKPVVMRAVEPNIEESRTRTE

SEQ ID NO: 977012 - protein, 194 aa, Homo sapiens
MPGVLGTPCPQVLESPSLSHGRLGQAWIILRGGAPHQEDGLPMGLTSQIHHDPECGKGFSKTSHLTKHQRTHTGERPYKCLVCGKGFSDRSNFSTHQRVHTGEKPYPCPECGKRFSQSSSWSSTEDTQRGAAYACTQCGKRFNNSSHFSAHRGRTQVRSPTPAGCGRGFRRGPTCTSTRDHMGQGPAKVQPVGP

SEQ ID NO: 977013 - protein, 201 aa, Homo sapiens
HSVGVLSILVDFSQGEWLKGGAGRADRKATVGFPSIQGKKNSVGTMLRLELNGGNHSLVLGVRMHVVQVTFRTTVSSFVLEEQCTFLRVWQKENTKHLKEKHQGCLQDANVLCVRRVLRAASSLKSRGFVACGHLWPLPCVPTVPCGAGLVGPPVALLLRQFFQWGLQGVLVSHRRVGEREKEPEIVGSHPGAVPKAGACG

SEQ ID NO: 977014 - protein, 105 aa, Homo sapiens
MTNYTLNLYTQIMSPDPTPTSCSYDTTQITPHPVQQSHNYTGKLFHKTSQIHASHRTLNTDSPNHNKNTASRRAHQHTLSAHPRTERQEGYATIRKQTKKSITEH

SEQ ID NO: 977015 - protein, 72 aa, Homo sapiens
GVIYSIMFARTLTHSAKLMLIVNREYARYDHVSCHASTNEKNSASFHLVAAINVSLLIGNVKRHCDKSLFYI

SEQ ID NO: 977016 - protein, 223 aa, Homo sapiens
GGGASATVRSTRQPAQPRRRRAFRERRSEDQEWGFGRWARSEPGARKSLGAPDACPVLPWMPHRLWTWEMLGNCNLPVPRRSLLPPGPPVHCAAPCVSSGPRMRDWLPPELRLIPALACVHAATLMPPRLTAWATCMLSLPCAPSGNHDPRLLGTMDAMAYRVLVPARGPPQPRRARRLLFAFTLSLSCTYLCYSFLCCCDDLGRSRLLGAPRCLRGPSAGVQ

SEQ ID NO: 977017 - protein, 411 aa, Homo sapiens
VIIRKGRDHYAYSYYPKPVNMTEGLPVDIILASEKDEHMMYAAVCSASYLQTMSIPAGGLMRLGLLLHGAPIVLLDTLREDDQAPGLLCGVYIEVRMPMLISLVVCASSRRVSPHSCARGTRGFPPLAHTVRTSLVKPLPGMRVISSEHFPCHVTQFTANELTLTWALERVYRGLHTAREVVEDALLLERAWGLLDEYDTKGPTVQSVHARAKRSSIAVALLILVPDVKLATPIAAWRPQVAGLIAHLSIEWLTTDGQNLRSISHSKGARTPETGLVSFLADIGSWHGRLRDYHASVHCFDPKFGQKVGQGWNMLYWVMARDSHHETYLGDNTELIEVNNRKDPRGRKNWVPAELTWKQSKGQLERRNRGPPEYPYRHDSTTIVVDKKYSEPHDNTREDSTTHKNKEHHDT

SEQ ID NO: 977018 - protein, 151 aa, Homo sapiens
MFLVKVYAVVRPSYVVMRCVPSYVHVGQCNMVQAAPAAPAVGGLPCIWIDLPAVDTLVASVYLEADVGVWIVLAMDCAFLTWSWLVGRCPGFRFGGRAACSSSQRVSLGADLIFSCLHPRVHSMPRRSEGFLFLGGIVDVKPASLDGAVYS

SEQ ID NO: 977019 - protein, 138 aa, Homo sapiens
KIEKKEERRPCKTIKKEEKDQDELETAGPDKIVVLGVTKDLGKQEEWSGTVCDGINIERGESRRFSVDKATKQVHKREAPTSQGLARSRKARDMRETSRRLIIIITKKGRESARGEREREIRETERRGSASSGSGEQR

SEQ ID NO: 977020 - protein, 185 aa, Homo sapiens
LGRLQSGSDRARCMSCMVAWRTAFSWLCYEDPTCSRRSVPRKVPRNAAGGGQCANEVCLAYVRYDDTSCSSFECREAGAILAPSWYQVRITRPIGIRTGALVPCSWCTRLRGCLYTVHVRHLMRAGYYTCGVLQYGCGTRCFAYMLLVEVSPSGVQRCRWEQASLPVVDWGQRNPNPSRDLGKAS

SEQ ID NO: 977021 - protein, 311 aa, Homo sapiens
MADGAGSQIPKCALVVDSVLRDAYNWWCRGCRCHQWHYAVAPFHTSEVTWCWYYCQPSVLMASCCAICLRRRLASADTLRLRVSNVFRKMTDLLTKTGSGGRFSIIARMQMLVCSTSFNRLFSQECDEPPGVYVFLRVCEILDRCAHGQSNPFMELSFSPANLSNRTSDSMICNTGLLGKNKDEIMVMKFGTQWTWCAWVLGSIVSVWYLFEESCGCDHLFGLTSPLIGEEVLKRKEVGHWWFREGTVMSDVSAVGPGGCDWRANGPNMCFPVWAGRPQVLWLAAVREGAREREKPQKYREQGKQSLRRNT

SEQ ID NO: 977022 - protein, 197 aa, Homo sapiens
GETPPRGKTGSITQGQPHGVLRIGRKGNPWGRVPLERLANRVPKTSEKIWVLVEPRERKGWGYRGPVLSQKFSRALVVSGVGDFTTPYVATWVASSIQWGDTCERMRTLILKHTGPGHSGCPGQMAGTQPQCGSPSFHILALAKNWMGVGIGKACSVVVGNSGKEGHDIGGSAWKRLGSRNGHNQKKITMACGGTTR

SEQ ID NO: 977023 - protein, 309 aa, Homo sapiens
GRVATGPLVDPCSRTSIMICLVVTIFFNLFPAAEPAVLSSEGCVAGSLGSVMTRACPLDRSLLRSQEGTFLAVTASDGGSRVCLVGEIVRVLREERSLDVGARVKLVQASEDLLACGTSGRSWLNARFYLGVCVKYVASVVLGVAIGFGRGLDVVRTSRALIGATEPVLDCPDRAAIRGDCLHRGWLRTVIHGSDSVAEAQREIALWSAQTELSVWEEERVGTGVFEENRMIARTRGLHTPRLRPGPKMAGILAHPERAWENPLDGCDIALSDIDVGGQASKTGNRGTTEECQSGRRGNSAILLRHGPA

SEQ ID NO: 977024 - protein, 203 aa, Homo sapiens
MIAGPPLVQRARGGCLDPTAIGDEPLFSHQVFKFISMELGEAPLLGDVGSSGGPGNLNWALAGLNHMLLVWQLGRGWDIDNWANGEPGPQVPVGLPKAPRMPVGSLSAPAQDNILGDADDVEGVEADPDMEAILANNFYQDLLGTNLGQPSRAPEDSVPQYHSRPHVWPQRGNIIHVWPFSAPGQNGDSGPRYPRTKRNGVRT

SEQ ID NO: 977025 - protein, 36 aa, Homo sapiens
MDERHTRKQAWRYPSANCTPKGNQPGSGDHRASASG

SEQ ID NO: 977026 - protein, 289 aa, Homo sapiens
AVPRRLLRLGLSPPVWPVQGPEPCTVAEGLVLDVRARLDTGTKCDQPCATGFYGEGCSHRCPPCRDGHAVYPLITVASVLRVQQAGWIVDRVRDQVVAMALYGEDCAFVCAELLAADTATSSGALPVQPWRPPVPHCKRDVPLPGLQRLADCAQACQLPLRTLCDPVTGACHSRKPSSAEGCDGLRGCGCSSCSSAAALAARLLLRLAVGKDPLRAVELSALGGKKAPNRNMRGASVASALKLPGFRLRREKLPKVVVDTTILVTQSMQFWTTSGLGSLTNCLSGLLSR

SEQ ID NO: 977027 - protein, 154 aa, Homo sapiens
ESRGRAQSDVKSQARPGALAEPRSSALSYSPCLCMSARRRGGRTRSCELSGQSPRPPSASVTCGVGPRPRQGRQVARRCSPGCCALTSDIVHEHSRGTRRGRPGWECVRIGWPGFEGAKHLDNDTRTGLSALRDNNCTNVGGDCQQTILCAKAL

SEQ ID NO: 977028 - protein, 202 aa, Homo sapiens
MVEVPWHMPCVARHALATRLGSLAEWPSNGWTLWWLQCDKWKGPHARTQHLHSIHRSELTEARLLSTKDPHTLTGPHSMRNLKGCTPRRYSQTDLDRWPKGETTTTANRKQAIESTHRDTLPYEKTHDPEQNNDAKTLHNWTTTGHRPLSTTLRQTTRGGQLAPIKHDHNWRMNLTLHGGKARVHEPWEALQATDNGDKMMA

SEQ ID NO: 977029 - protein, 69 aa, Homo sapiens
RRLVLSSRARGAVPALQLPSGSRSPIFVLASALCSRCPGPCAKPWTRPADADPTACVLGRQSFALPRPA

SEQ ID NO: 977030 - protein, 31 aa, Homo sapiens
MAPLAPYRSGPQEKLGKFLGNVTGPQPPDSL

SEQ ID NO: 977031 - protein, 195 aa, Homo sapiens
MEGDGRGVEMPRVRLLLSGSAIIAALLITYCSVKCCAPAIIAGARPRVSEIPPGADRAAGSGVSDYDYLDLGKTDAYTMLRLTTLASGSYGGFASRPHYPRGRSPPSGVRVFPPGSASIRTVQLVMRPWGPVPRKLLYHLPPVYRSLILDDRGLRGFPKNRVLEGVIDRYQQSKAGGLKCQLCEKAPKEATSCAK

SEQ ID NO: 977032 - protein, 57 aa, Homo sapiens
MGKMGRRGYLLFGIPGSLGGHGGALPPGGGPWAGTEISGQLKKRWISLEASGTPCSE

SEQ ID NO: 977033 - protein, 122 aa, Homo sapiens
MNSWGWVPTFRLCAQTQCALFGAVPPIRRQACANNQRRPRVFPESGARVRTLFFSPGGVSPDHNPVWPSVKTRPQKCDGLLHKRLWLWPIRVGWAPWSEKRGRVWGNHGALCMNRGSLLGFS

SEQ ID NO: 977034 - protein, 245 aa, Homo sapiens
DQVLSEFSPAVPAYHEVPDAKECMAYDVVPLLPDVTSLPGPAKARVPTLPEWCCSAGSSSAPGMDVCLERDTASCLTICRWSCPCLHASIVRSYAMFIPMCALHVSAMRATSMTSVRCALLAPWPPDATQVCVFLCPGFVLCITFFNPLGNRAPSFCNPLWALHPLALRIVLLVRALCRIWSFGSAHSGNVTPIRLWNRYSPLIPWVGSVALAVCTSVICVYFAPLDIAASLLLFVCSFFLMCSF

SEQ ID NO: 977035 - protein, 67 aa, Homo sapiens
GTQFPGRCMEGDGGGSDGGGMSDVVPNPLFGSPFPWSAQRWSRSPVPLAAEQRSYGVGGSSVELLET

SEQ ID NO: 977036 - protein, 89 aa, Homo sapiens
GYLSGRAGWIALCGAPGELCWSRDKRYAMAAMRAQTVAIRGHPGTTGSDSMEKTGKILRIPMDIWQRKVMRKRSGSTEHTARHITDGPN

SEQ ID NO: 977037 - protein, 159 aa, Homo sapiens
MLRRVRVKEPASSRLGPTRLFGRQVIRRIAAEPGHAWEILPARPGDRVLASITGCGCGRATNSREDGPRPGVGGAEAAVKAAGIYPACAGMLVPVNPSRLRGPPCVVGMGMFRGEQFGRCPGAGPLGGQLKPQLGQRGHQKNRAPGRAAIHLDAPKTPG

SEQ ID NO: 977038 - protein, 260 aa, Homo sapiens
ARTYRGAGAADGSQPKPEPETRPEVLVPSVWVSSPVAVRMGDEMYSQGTHRTEKNDMGMGTQRARTVGGALGRTGRVDYWTEAMTACVCWDEALDGTTTTAAVSASGATRHQGKTGPPGDVLSLCPRRNCGRVTSPTYHRSLIRPLTLGPSHGGSRQSSRAVLGSLSEGDLPYPRCLALVGLRRVPYLRSLGRLPLSSSTCGNFAMCQGPSAGEGPPDRASSRLAPTFVALRFEVTLQLGVALWACGALFAILLGVSDFC

SEQ ID NO: 977039 - protein, 222 aa, Homo sapiens
LVGHRASGCQWRRGTTVSCSEVSWLGILCPGRFLCAPRSAGATSDCLGRRPVMSAVPVWVWRASYAVWATSRSLAVLPGLQAELGAISTGNVSLSTASRCVTWARLWPAGRGMAVIVGGSSHWGFTLGPMLASLPAPGELAPWLALVFARLRSLLFMLLLRCLETLPLEKRAPSIALGFRDAVICSAPLALSALLGCRVVARTHPLERGSAACAAGLCLLPL

SEQ ID NO: 977040 - protein, 254 aa, Homo sapiens
QLPSRVHHHLHSNSVRPCSFSAGSITTWAVIQCGPCSFSAGSITTCDSNSVAAHAASQRGSITTCAVIQCRPGRVLQGGYSCTTVARIIAGVSAGAGPRGGVHDHRRGKFSEAQCRFPGGSSHQQLREEVQMQASAAVPGGLHHAQCAEKYSGGRCSCRAGSITDMRRKLRCTHMQVPTGDPSTTLRKEIQDAAHAGFHSGGPFSHMRRIIQVRADAGHTGGSITSCAGIRGSTCKCPGGSNHQMLRSHGGHEI

SEQ ID NO: 977041 - protein, 68 aa, Homo sapiens
SRHRPLDPIHTISDGLKNADSIVWLPCLILDRVSHWDYSIALLLLVSADGLQSAMCIHQSLPYAPRET

SEQ ID NO: 977042 - protein, 288 aa, Homo sapiens
GPRSWGAWTRPRSAGTMTLARFVLALMLGALPEVVGFDSVLNDSLHHSHRHSPPAGPHYPYYLPTQQRPPTTRPPPPLPRFPRPPRALPAQRPHALQAGHTPRPHPWGCPAGEPWVSVTDFGAPCLRWAEVPPFLERSPPASWAQLRGQRHNFVGAPTARADPGVSTETPWHGGLRLLLTADTDQYDFVAAKNDASNGPSASHMQAGTPRAPLHWHQPTANYTRTTQPISPHPPASDRNPTTPQTRISPRPHPLTGPLPPSHHTQHAPHTNSTASPPQPAPPPPHTAP

SEQ ID NO: 977043 - protein, 107 aa, Homo sapiens
MHMEGPRPACCPAYPRSFVRNRVSKGNWITRMREDAVRLAEIIGFSVLAGYESYGDPRNRTVFNFSWKVTLVVFQAAAIRPVWKKSLGAKVSLLYQLNTELSPTPTR

SEQ ID NO: 977044 - protein, 155 aa, Homo sapiens
MRIVSGYKTGPSNVQDQRQEQEKKQRLLARVREEGLLCNTWDVPTIETTVSFEQEVNIVTTLVENKKAQSGGDVQHVAVGSHLRLVVFLPALCRYYGGSLTALIKGKARLGRLVHRKTCTSVAFTQVNSDMTKGACGLKLGGSYQDQITTDHDTD

SEQ ID NO: 977045 - protein, 324 aa, Homo sapiens
KTPKWLDDCRVQLGVCALCGALCVPCVIGGTCCVCFLLDVFLCMCASWCAGVCCACGLWAWWPDVPAVMLCCDVQWPDGPKVTLDCPVTKFVAALVKDMKIKSLEEIYLFSLPIKEISRSFDFFLGGLSQRMRRFDTIMPVHECIPVPGQCTRFNGILYAIGGLQMATVGSWVLSAPRSVCTAIRGAIILANALQSSPCAEATGRNKIAKPHTVPCTGDTAACGSCAGYASSLHPGALASVSHLCLRKLLMMRWYRMTATTPVRCCIARWATSARPPLNAISKTKCYLAPKSGMRVIYQVSIYDVTDKYDKTSKVSEEATRYTY

SEQ ID NO: 977046 - protein, 224 aa, Homo sapiens
EESEIIDFFLLVASLKDEVLKIMPLCRSIPVPAQRTRFKAILLLSRDYNGHDRSGVFRCSKGGGHSLDPVGPLMLALSSPIVPVLAECYWRGTGSVEAPNTVPWKVTGTLRVCAGTRSSLRPGAAGTRLRALCLSKLLMIGWISDEVLHLSAVGCTGTMGRFVKAKALMPFRKTYSFLYPRSSGRRLVVHRVSLSMEFTDHRRQDHTHEFSVQLDVRLQLWVQT

SEQ ID NO: 977047 - protein, 144 aa, Homo sapiens
MDAFMGGYATVAMTEGETVAARHCGDIGGLGICARRLNPMPSMEEEDVRQSRVQLIRSRESVLVARWPYTSSQKALVRLWGHAPCRGGLGAVRLVDLGRLLVAVDSVAGVPLLLSSLAGVDRRGFGVGYNLLDHTLSSLYLRLC

SEQ ID NO: 977048 - protein, 163 aa, Homo sapiens
MSEAGWLLCLRDRETGSWAAIYVDAASTRLRPSGRGSLGPGSSRRALRVVRALSPRLECLLASAELGQACTRVGRGVPRVVAYLRPDSSARIQFNGACGVAGRLLLGKSASRPLTCPSSTSPKMLSDLRFSYGHAPGSSACTVTYLAHAIVPLMAAIIGVYDL

SEQ ID NO: 977049 - protein, 214 aa, Homo sapiens
MAAHSHKNCLTTRTSHTPYYHEQNYPTHGAPPRTENPPPPASALIKTNPTKPHAGKHPTHTASTFPTTNPPETRAAPPGATPPHWARGTRDIDKTTQHRTRRNDTRILPPRAVIPCLLIITQTTKQGEVLKLHERRAPTSNQRTRTPHPPRPLRQSKQHTLHVVPLTAQYQSVRQKQTAPHYNIKPAYQRYYAHIQHTNTNYRSLNVPPPRHPA

SEQ ID NO: 977050 - protein, 219 aa, Homo sapiens
AGYVLNWTLVSCTAPEEQELCMTTTGVICAEFLVRQCICVLDTGLCLNKHVVSLALIYRLELRVLSTSAIIGGEIHTEAFGGATTRSFAVCIEDFGVERLRVLRSATRITCTRSCLVPNTSPFWGAVACCATVVHGCRCRHPPFSMYFLVSCVKLRVCSPGGSVVFSCIDYSSLFRQETTCEAARLMGVCVSGGPSLVREGGLRRRDDAQRQLSELLLN

SEQ ID NO: 977051 - protein, 293 aa, Homo sapiens
QLGGSLFLDVPPTFPPKFQSLPITPKKKGSEGKGWRGFGAPGASKGEQKPKTTQRGVVTQKLTIQEVIQQEGDRGGQRQGDRTEKGEFKSANSTITPPKRGVERKATNLGRCRSVNKGGVVVETLKEEEGKQGGGHLYSWRMETPLQTQGAAVTQTVTPLPAHGQHKVREKKSPPRVVPGTQLDPWGRWSGLTWTLGWTKQQHRGTPRVEKGTPLRDPKKSHGPMGEDQKDQRITIRQGPLSRVWEPCYITRARARVYIQNHLAQERGLEGTALGQKLSLATAPGPDRCGGPT

SEQ ID NO: 977052 - protein, 357 aa, Homo sapiens
GLTTPRLHARTFILRPRAPFPTLSSSPRTGGAALSALVHSGARGRALPLPPLACTDRDDDGRDRTHEHKRSRHRRERRLPSSSRRQRGPPTSSPVPLTRSQMQPAFCKVDTIEEDYVFIELNALARQLTDVNVNSDKTPRPNIHTHSPAHTLTTLTHHSTTRHPTLPPPALDPQMTPHAPLHPHRTRLTPHWKPNPTNAPQHATTTLAHTAQHTPHPRPTQHTRPPPRPTTNHPRHPDLAHHRPPLPHTALTPRQPNHPQPSTPTPRPTVQHTTERTQRDNQTHHNPPSQQVKRDPQGTNQSDDATPTRPDATTRAHTRPHTHRAAYTRPRDPSSADRQHTTPHTTKPGTRPTTDTA

SEQ ID NO: 977053 - protein, 214 aa, Homo sapiens
WPPWSFGFQIGEKVGYTDRMGGKFAGLHWPKEGKGSLRGGPPIPVKGGGRRNRSQTRGLGLRGAKQYSPWARADTCAGSGGTNRTRNEDVHSQNRGKDAPTDGQSTRAPGHNIVLRRIGKTPLRGLEVVAKGAMSQEGGSPNGLKNGRGAPPISKHRVGQHQGTSAPSKARTRADPPHRPKGRPRKRVPARGGPRGSTRTGTRSPASADPTRPP

SEQ ID NO: 977054 - protein, 180 aa, Homo sapiens
GRSSTYPPVTRQGRGHLHVCTPPLWPFPTHLLPERHSAQRQDWSSVMGISLSWLEEHLRWLLSCSWLVPLPRSQATDLHVPVSGWGPLEETGMPSSYQCYEIAYFSEIMREPPHPRDPIKPGGGRWGSPIALSQEFPGGCMQIESSPTVRRGHLTLSVTAVWRVRFGAFWFQSLSSVWFI

SEQ ID NO: 977055 - protein, 220 aa, Homo sapiens
MPTLVIDNGSGMCKAEFCWGLTTPRARVSFHRRAPQINQGRHGWAMGFIKDSYVGYEAPVASVAIHDPVSTPLSMAIVYQLGTDYGEDLALHLSTTMLSRGSRRSIPVLLTEGPPEPAKDNREKMTHDYVLETFNQPVTCYVVHRSAVLSLYVHLGAPTWHCLWYSGDGVMRTSVSPSTEGYAHPHTPSCRLVAGWAGAERLTVMKILTERGYSVHLHER

SEQ ID NO: 977056 - protein, 47 aa, Homo sapiens
DRRVLRPQHELTPCDASAPRVCDRVLPAYYYPEEVTYLATGNTTYEK

SEQ ID NO: 977057 - protein, 261 aa, Homo sapiens
MRLPDLRPGLPGAVWTRLYCVSASGPSGDFASSRAVRIMAVGAPCWCEVLWVAAKARSGCWDLVGDTAVSRSVWPTLLICLPESPGLAGVPHCAPSQAMSRFSPLELAAGGVRGCGAQLVTVGCSEPSWSPGEGAGPGEQQSLDVEAAEALQAGPASPRCRFFFLVLAVVGETLIPHYSGRVIDILGGDFDPNAFASAIFFMCLFSFGSSLSAELAMRLVHYTMSRINLRIREQYYSPGGQDSGSYRRLDRGVDSGEVGYT

SEQ ID NO: 977058 - protein, 194 aa, Homo sapiens
QALEWALSLSAKIREEYPDRIMNTCSVVLFSPKVSDTGVEPYNATLSVHQLVENTDEYLLHGQQRAHRMYICVPATPEDMTYYSKAVRGSEPPCLSHHEWCHHCSVSHGQLNADLRRSWQSQHGPLSRTSPFHLCLVLTLSPVVEASSIELSQCRKLSQQVFDAKNMMAAVSPARRYLTVAGVFRGRMSMNGGR

SEQ ID NO: 977059 - protein, 30 aa, Homo sapiens
GTRFCIKWAHLNGIPGERFFLLLWAGVRGE

SEQ ID NO: 977060 - protein, 220 aa, Homo sapiens
VELDQEELQLGRGGAPVAPGPRGRGVLLLAQRSRPSPRRGAFPPGLAGFRLFPFASVNRQPGDARGAPAALWVEKLPGASRFHSFSGWAPSPLSPFPGAGCSRPLRSPSFSSGSLPLPVRPDRPESRAPQSVASGMGPRLPSCFPLHYPVVLPAFLYVPRAQCSRQSVRPPSQDRSTRAFWSPFRGRSVSLPPFSPRLEFHDAEPGSSQPQKMLPWRMAL

SEQ ID NO: 977061 - protein, 184 aa, Homo sapiens
MRESDSIGIPLIIEPSGQGTEFIMNEYKDRKITRTRFLDDAFRKNLESALRFGKPLLVQDVESYDPSLNPVLKREVREQGGKDVNQSRGTRDRPWGQRRTLLAPGDQGEIPQNTGPGEPNVHITAPRRKGNKDRDQSQQQREKDESKKKERPNTRGNSTDNSGKTQQSETEGTRHTTITANKRE

SEQ ID NO: 977062 - protein, 339 aa, Homo sapiens
MSKRGRGGSSGAKIPDFHWVFREELEDQCVADKHREPKEPVYHLREGDQRDWLTSDFPLLVCSDHGEWPTVRERATIRRLRKKTGYIHAAGSFRQPTGSYSVDKSLAAVSLTFDTSNCSESIVEADRRETDEGCWTLAGPESKGVCMTFVVRCGLALQIARQGSLAIGRSPRYYVVSTHRRIKHKSAVSEWKTSTNLSGSACGGVGGATQGASGSGSKGEEGGPPVARHGEAKAAGKHCARGRLISDRVLNRAIGGGDSCLDDFGDTAMREDPPAKESRSLGSMEDTGVAVGSWGPGDKWLVLRKHTDTSSRERAWLRRALVNQGNDRHTDTSKRTQET

SEQ ID NO: 977063 - protein, 208 aa, Homo sapiens
MECASASTGPFSLQAQGHAGKGHEGKGPRPRARSAGEAGPPYTISPYSQNPSFGAGGLRLVFKLPWLTESHNWRGWGRGAPSAFRNSQQGNGGDKGFNRTKCSGSNVSTWVASKGLSRDKSPRCPGQRGSSSIYGDGKDTFNQYGHGDTRCPISCGDRLWSSQDVVPRRWLKKMWAGGKGAKNGFPKKENAPGCHGKRGGKKPPKSQV

SEQ ID NO: 977064 - protein, 230 aa, Homo sapiens
MSPQSEISEVTSVLEAGTSEGRLSAWSGWYMMQIRAPDVAETPQRLGIGHKTKNQGPAGRDGRDGTVSQACEYVTGIDPRRSGNVYAHHNMIQLDLKTLHNTRSTLSIAIGLTSGTQCRLCLSLDELKSSVRLETLCVKRSLRRAIDVMGLYRNPHDKGDNARTIRDRDSINPQALGHPIGPRCDRDPIWAQGCAFTPGATCTILIVWESGWAVNTNQQGKARLWVKGIG

SEQ ID NO: 977065 - protein, 232 aa, Homo sapiens
MLLLLLRVRGLPRMIGSGMLLWSFCWVHEAVGGMLLADTFARNKVCRREARGREIELKRRTNNEGEGTMIFRLHNEGHGDLSPFSSKDAVYHDAKVLDKGRLPRHPRPTILMSAWRGHTLYELRTVKTGSRTLRVEPELLLIMAADKRCVAIETLQGMIDACIGNLALSVHFGACGRSRRCSSDWRDAIALLRVLAVPRGTARICGLTCKCVRQGRPLGAVRSLPTVGSGPH

SEQ ID NO: 977066 - protein, 92 aa, Homo sapiens
MKRFPTENDPCVLTWTWYLRTSHEAHLLASTKERRVVLHLQKPLGFDRQQEVNDYQFRRTLLLGQEAGFREPAVGTPPVKGRVGSGRSNRCG

SEQ ID NO: 977067 - protein, 248 aa, Homo sapiens
MQSRTLSARACSAADSDRCVVRTASPRSIGMLRSQNVDSAVVACIVCAVMAMVDPRRSGRCCVVPQQYACLSLGVIAKEKEALAPERRTPKSRIRPGLVLRHLAMSGFSSQGGFGSWKGDNRDYFWVVREWERLGPSGKLEATSPRAGEGPAWPHWSESVFWVHSEDSDVLNFPEGTLGTECRALALVPLGIRALDMAVGGAAGKKVARLIPPFFQEFRHFWELCSCMARLGLSCFGKAVGLLGGPAG

SEQ ID NO: 977068 - protein, 137 aa, Homo sapiens
DRDLEPQRSHVACAEPRGVDVTQQYRPLADYHLYTVTCNSKLIMDLLGWRPRLACGQLSAIVGAVVEEFRLAGSTRTSVCSAAPILMGLPACGSYVSFKCFWIAWVAMFGWSWSCKGHARAPNWCVTCESISHAPVS

SEQ ID NO: 977069 - protein, 270 aa, Homo sapiens
MTVVTGGMSQCEPIQLGRAGQQGIVVIGQHSPVYAATIADERNTPCIDFIGNTPLSLLSCAFTLQIDVARSEPVDQRHLTTGTSPSHDLTPACGSSILLVVKKRNLQLELTARSFMMISSFLASPVELQPPPEFYTGDLHNDICVQHDTMRWCRHNTGLRGPMAKSSNACTIRKGWIDQYGPSIVHVSIALWPGLGPSQRSVEVKEYRALTVAELTQQGFRCKEHDGACEPPQAILNGGAVFPGSDVPCKGGAMSKLLNVPTRTAVPFWD

SEQ ID NO: 977070 - protein, 183 aa, Homo sapiens
CRGGRNSRRREHGGLKSTPGRRADVRLLLEQCIEVATRTAVTDCAAHPHKEDGVISCQRGTETIRRTGCTRDRWIKYWSQHFSHTNGLSLALRSGVTNHDSRRIFVGQDNGAVMGSFSVSEDFEIKSTFIKTYPAHQNRLSAIIFRVGTECGDSRTVPRATCSELRMCTRKREHAREATSSRS

SEQ ID NO: 977071 - protein, 58 aa, Homo sapiens
MQNFWMTAKSLTLSRNNTLYRFTHITSPDAETYSNVSNPPTSIPRRPNPENGRGLWAS

SEQ ID NO: 977072 - protein, 135 aa, Homo sapiens
MGSCDSDEPDIGAWKVPWKWEGASGGTGRVLKQMLVCWRAKRQPGPGATDFNSLWCELTRHCWRPSFTIRVPSNQIRARLYSKSNAMIEKPSWKSRVTGRMLHHAELTHRRRPVYQVTAIFAGIYITTSSDAVNP

SEQ ID NO: 977073 - protein, 266 aa, Homo sapiens
GSTAVPVSLPTTAGWLPKTVIQTPLASPAPVKELSRAVATCRGRGGTIRLQQRADDASSDVVGDDNGDCLARSPMKITINPIYTVWKVTYLDERQPWVTVYEGPEVETLSLDVSLEWLRSYNAAPTSEVSIDARMVSTRERRTTARCRHMPWTIPEGKQCVSSVVMDGSGPITALRDARALTEGRIASDVDEVPIEADYIAGEARGHKTPTSVSEESSACTEYLDSIRRYTRAEEATVSMARRRPVPCWSCLFTLCRLRMVMSGCC

SEQ ID NO: 977074 - protein, 391 aa, Homo sapiens
GSTDDLAGYYVAPRMSSHAPYRYPLLGDRDPVARSSPWLYIYNDPWPGTILDYYAGNPDKYEVMIYYHLQTGTTISRLPRSLTWLLSNLATLLTAPLARHPRHQLHYTDSPYYWGHAAVLNTRLLAGHHHTTPTTTPPWPHGHSHTQTCTRSHDTNENASAHTPALHIRRTRDLGNTQKNTNTHTRPKRCRKRPTPMRESMLPSSPGHLHNRHRTAQRARTRGARYPPQGLQHSPTDISQEPSGALGATTRTHGQRSRTARTQPSHSAAYQTSSKYKKGRPGPYTPAPRPLRDTNQQRQLRHKPAPRQPPTNVATPHTHQVIREHDHNAPTQPHNSRAKHAPTPYARLTTGPSNHANRDLDITTQPHSPLAQPNTEISTTTTSTSNTHTNG

SEQ ID NO: 977075 - protein, 285 aa, Homo sapiens
AEGACGPLAAEQRSRAAAAGTRHPPPGGRAAASRLLPHMTAERAQPEAGARSSSASSTAVNKYLTGEAFGFKVKRLCASSLKKKQIWTAGCSPLTGGQRGVCLRSHLGRYLAADKDGNVSWSARVARFPIGRFLIGAHEDGRWSLQSEAHRRYFGGPRTCLSCFAQTVSPDEKWSVHIACTLRSAIYSVTRKRYLRTCSCAACDEIAWTCDVPWGVDSLITLRFQDQRYSVAERDSVPCANEGAGGAPERHWVTAESVREWLRRWEAYWRAGPREAQGGGPGGRE

SEQ ID NO: 977076 - protein, 298 aa, Homo sapiens
AVAVGCDRRREAGGLIWTCAVACEPACMWTCARCVFLTVGAPEGAGVRALSTSCVGVRVPLPPAALAYLRYLLLRARLGGVQAQQRLRACTSSGVRDIQKQVREWKEQGSKTFMCTGRPGGHCTHYVSRKYKNDDKNIMINLMDILEVDTKKPDCPCGSPCVTMGQVTALLTSIGGPLPVLPELDVTSQWGGLIMVHKASSHHSHQRTGLFQHNLDLLRRWSWLMAGFVAMHSRPENSDLFYAEPGPCGTLRFLWAVKTDHSGKNPYSCYQPDGLSIWPLPAVRRAPLEAHPEAHTRK

SEQ ID NO: 977077 - protein, 239 aa, Homo sapiens
MRQFINPAGLVLMLLVGSCHRSGRFWCQISLVPEVVSLAAAIWVLFHHFQPLQGLGGPGGPNSGSLGWNVGWGIDAVYSEVPHKFWVMGANPRATPEVHGAALGKQLAVVEPVLIVGSKLLGLGQFDGIHPFGDFQLPGLLEERCKALTNSGGDTSLPGNSRASGGLNWSMAFLDPTRVTKRVGITKRNRRGIPVEPPREPHTHTEETRSHHDTNRTHPQRNKKPYKTRATPIRHKVIF

SEQ ID NO: 977078 - protein, 385 aa, Homo sapiens
MWQTDIHYYIGNRRGWCGRVGLCQLNPASWRHDSVNQRVARVSVDRHHEVDTLLRAGDDPMYMNGHRTDATAVGEGRAGTEDRNMQRRTISNRLPRTGLQSVWESWEEFTLKTIRNSMDELEVQTVAAKAILGEPFCANGLATERRIELVHTSIYLAILGALDTFTNDNKGPRPFGSTPKLTRTRTKTPWGKDRPSEVASLFILRGVPRGNQNSYAPLSTPPYALPAHVEDFGLTGSKGLNRQGSRRKVNPAEDPAEECLCNCSSLIWPLSTNSPVWNDSHSREMHLLKSTQDLGPWRSPGQQQNAEPCNSPNAPNTEHTARTQAPPGHEPHKNDTAQQPQTGKPPSAHPHRLTHNRRRDWGEKDITVYNVTHTDKRGQNDPQHH

SEQ ID NO: 977079 - protein, 123 aa, Homo sapiens
MRSIHRFRVPTRGALNPVVVAPKRLVSGRLFLPRHREFRPTASGGYPQEEHRVRAYQMRLQRQFDFGKASLKIYMPAHTSKFLTSKHLDTPRLLLASHALRVQSARLTIYGELLAQPRTPKGS

SEQ ID NO: 977080 - protein, 473 aa, Homo sapiens
MQGQSILHSRSASRTTFACAPRLDSEITTHITQHSFSRGTTGGRQPCHTPVAGHFHVLVHTQNAQTGNEEGQRNVRGRHIRQHARTRSREPREARTSHEELAGGRKRENNDRTTVEDPTPVGSSAVQRQMFPKPLDAIRVAMATYADGVGVNPCEWARLVFVGTWQGFAHGVMERMVVLGPYNVWFPWHPVGLSVWPQDGGERTTLPYGATLNYVQKALRGPVAEEGNNRYVGNRHQAYSSLVGRNLPVGDSPHFVGRIEGVYPAPWDTGSHKLDARRCGKRERLRIWETGAQSSGAPGTFVGITATVTLTGHFKAGPPLGFPHAGDWWPTELPGGGDTNHYARRVPTGQRSAHKVPRHNDGRIGSPMTPPGGDQGLGGPTGLFRYGGHAFAAWDTLIPTKIIATIAAGRAHEIPHAAKQYEVRGPHRHLHQHDTAHSVIRDTDEHKMTSRQTDVSEQSVTEPTNEKITSHTV

SEQ ID NO: 977081 - protein, 127 aa, Homo sapiens
MAPRGLQLSLTLEPVKLTAREEAGMTQQDEKNPMDFNLINCETRYLTEPKGPKVTKTGITEYRGGDSEQKPNSEQYMLRRSPVNGNYYTHCCNNLTKEEVPWIQRIYSRVYQHGSDSQCIRMQGPKK

SEQ ID NO: 977082 - protein, 213 aa, Homo sapiens
MVARQALLLAVYVAAWASRRAAAAATIAAASARAARIGSLAGGMPRGGEAPGSGQVAGHMRGSHNPFTVDLRTGRWEPRPTAASLMLSPGIRSACWSTADRCTRETCMSCTMCEQAYAGHLAMVALVRGFPERKMATDTTDRQVVPFRCLPGEFVSEALLVPEWLPVLAPGAHGPMSEFKPEASGGTGGCSSQGLILHGRACSYPVARIGSVC

SEQ ID NO: 977083 - protein, 78 aa, Homo sapiens
AETGDDGGVCTSSRLMAVVRRALNFRCSVAGPRCEVRLSEPCGVGLCCLWATAVISSDARIPLWKRLWCAIALPVGAE

SEQ ID NO: 977084 - protein, 91 aa, Homo sapiens
DKPTVMCDGVVVSCGTAVYLHSLDQLVKENVAEYGHVIHWVWNDVCVRRHMVPQIMPVKWTNKGMVVSGEGMIYGSYVDASWSRLYHTCVC

SEQ ID NO: 977085 - protein, 282 aa, Homo sapiens
EVESLIRAAGGLPEVSSWPGRERFCALEKLTALEEREKERTERTREEEERGKQPPCSREPTAKCASRGPGGRTTTASDISLGLESQHVHHSSNTSGPSCYTGVCTDGESSSPCWDIRQRLEHESFPKVPGPGRQGTEAKVGPGGERQIRTRGPVPILSEMSPEQVYQSAMLHPDARGPEPSAQEQMEGMLCRSRRLEASGRRGANRSWQNVYCVCGVGGLGFYKDAKAASAECIPREKCCQLAGPGQGRLITKSRTWFQGGFRDGKILFRARLGENELGIRG

SEQ ID NO: 977086 - protein, 315 aa, Homo sapiens
MRWQSTERTIDKDLRAEAAEMGEGLLQVCLGLVIKVEELEREEWKSDIDICLVENLRPCKYVCELSVDAPGRRDFIKRHDYRDDLRLSCAVLIVWLLVLVNLKLVSPRNGQTRGAVPVLAYTLGVKQLIVGVNKDGFQLRPPYSQKRYEEIVTEVEALTLRELVGPRKSSIMCQISGWNGDDMLEPSAKMAWSRDGKVPEGWKAGGTTLLEGLEGVLPDNRPMRSLAPGDSRMSTKREARTAWWQNVKRGLQNGQAAHLGTKSYTGATGNGPATRENPREHRHGKGGNNHRQMRQTHAITARKNNQTPRAPPRLN

SEQ ID NO: 977087 - protein, 112 aa, Homo sapiens
MGIGEDTRTRTRTKEERRRRNNKYATDDSDRACSTRGAHYRTERHKHWTEQDKPSRYHPAGSHAIHQGIPRMLQSSDPEARKVSSMLTHTTKRAGRNGQTKAPATFERTSTR

SEQ ID NO: 977088 - protein, 91 aa, Homo sapiens
VPVGYEAEQAPSVPTAGLTPADTEDTVHCCVDEVVSKGIKYTCWEVWRDECEVRVQVMLESLVVRRCMRRSTLMSCSNQACLRLSRVDHNE

SEQ ID NO: 977089 - protein, 296 aa, Homo sapiens
GDDGNLYINVKLKAREGDGIEATHIRLPQNKHRIRGDEVHYIFEVKTLRYSGFSSSEADAFRFERIPLEAEEVIKAIAPEKDVDGYRVASNAGETGYEVTSEDVCSFRCERLRDAWNSSKRQGCRIARKAVLWMVEDCSQEIGWGTPNAVTCVYGRNEGHTGPPVRDVQGLRTLSLTEDGETTEGDILRRPALGQTVERVYQGAVGREAPEGHEVGSDRGELHLLVCQNGYSRRHKGQRTVKWGAGGEDNRESTEEGRNYGMHEYRAGDGPRNVEKDADIEVEQKGARTLKDVEPA

SEQ ID NO: 977090 - protein, 115 aa, Homo sapiens
MEWPHVHISAHMIASPDWSNLLVPERAFQSVLALTVGMVGKCSWYEPSAQKVLCASWANRAGDIIAPHVFMHPQRTRLEELERRDALCGTRSLSWGSQEEQVSRRSSPNTMLVGL

SEQ ID NO: 977091 - protein, 221 aa, Homo sapiens
ALHRCTHVAGCMVLEVVGMMDSLPLSNVLEFLKEPLAHGSRLLGETLAASSTYTGLVRTSGSVKMTAIRIERADSVYVLCVHHPCVPRSCTLEMRRLARRQGTISSRRTLEGGGTFFAVRGPWLCPDQWIRQLRCIERAEDSGRVLKRGLAQETPDPENPFATLCEPMSGGIVVIGKSRAIRRVILHCKRPLLVVCVYELVTSSSENSVTTQERRRTGIAG

SEQ ID NO: 977092 - protein, 79 aa, Homo sapiens
GGLCGGSFGEVESGICSSFREGGLCGGQGPPLELLLGGAGCRDAEPYAGAERGPLLLSYFYSVLERRPSLIGWEEVGEV

SEQ ID NO: 977093 - protein, 150 aa, Homo sapiens
MVVVGQEKADNKTKRGGFHNTESLAEGSPGIIQGVPSVWGAKRRKHGGFISHTNSCVERAPFPHLLGRKGDITPREEKATSGATRAVGPPLVVRQPNSTEKSVGEETGQYAVWKCSDGLQENLWGQVGEDEKTEPINAQRTSRGDAPDAV

SEQ ID NO: 977094 - protein, 212 aa, Homo sapiens
MGEHVSGKSLRPFPTEPVNEDIVVCVREKIWDDVSSVAEYLQPRPLLYAYDDVGHAKYVYLIQNKADVCIDPGQLHGCKGPTDVAESKSDAEQVFWVDRAYALKMLFVKESHNMSKGPEATWRLTQTCSCVYDSSEKIPLQRRSQWLGSTTVNSHHARLPWSPPLGSPMSVEAQRTISLASSDPYKTVTMILSAVHIQLFDIISDLSSVEEH

SEQ ID NO: 977095 - protein, 321 aa, Homo sapiens
GEKPGGAGGGGGPPLGGGGPPLLGKIFFRGAPKVGGRGGGPPVDFLQKKKKTTLRRASSCRGGWRQNDREGKAKGGPASEHTGCPEPPDYCCVPQKGGNNTTARPPLIGGDWHYISSKKPRAGIRARFYIEDRWRDKPTGLKYRRPTRREDGASLGRHAERGSPRSKSSPWRRSKQQMNDAEHNDNKQPTDAQAGQQSRPTHGATRDQDTVRFCQRTTRLGEHVEASGGDDDTKQGQGLIKEDTRSRAAPTRRKSSERTAEEAQGSETTATQRSVAEGERKRSFHTRDAHNESVRRRSADGIRKEPQPATWKRHQERKPGI

SEQ ID NO: 977096 - protein, 75 aa, Homo sapiens
MQGTLPVLAFMKSGKSGYTHICWERRILISGAHHYIRLASAVLNTFADIALAPMEAAKVRMQTQQVDANTLRDAR

SEQ ID NO: 977097 - protein, 331 aa, Homo sapiens
ACGSGGDRTARGRVEADPSRARVVLVSGGPGGGCGGCGASLSGGSSRIIQRAPMVKRRGRCCLCRPHAAPGARGRGVEYTPVFSEMRDGGPRTQWMNFAYSDSVLGWRARSMSVRDVNALGVNAMVVTLNLGARCMEHNGVVGANSPHASYTSIDGPARWRQVSCAELDRGARWLEERTEAGLSLRVTPVCSLDRRRHDRMSTGWGRSCYRATCCVKEYSFSSVGGGTMNAEGRPGAQDSVQAYWGDAISVEAGRIGDGGTTELRIAWNVEGEVALCALQCGQRRIVTASGTKIRLKGVSHEDKPGPTGEWDQVEDTGLVHGQFSEVANIT

SEQ ID NO: 977098 - protein, 193 aa, Homo sapiens
SREINSSMIEKSQGHRGPGGPGPGGKSPVFDEGLKGCVPKVRVRAGKPLAGGDGGPPRLVGAQGLAGPQRAHKEVYMTRQIEVQASRHVCTPSLARTERPVSHTEDHPHVLGTPSGLGHAGSKSGGLRVHWPHGGARCKKGPRDRGGQDTSINHHSTQLLVLAPQGPGHLRGEKPFSENLPTWPSQPREARVR

SEQ ID NO: 977099 - protein, 52 aa, Homo sapiens
MHRESESRVLVRFVRGIELVVGVGRLPSVPMRCFGRPLWALPVAWGPSPVGG

SEQ ID NO: 977100 - protein, 344 aa, Homo sapiens
GTTTAKNEKKWSISDEAHPTGRVVHGTLSRWDTDSLCGSALLGVMYELDLVFGSVLYVAVSYTGRLASDSLEQTVPNAVHALVTLEPERGMLLAPSSIVLCGTLIECGRSSIWRDGSGLNLRCVIGMAKCTCYIIVFSRTTSRLYVPSVLMLVVPGVHGLTVPCFVRDLTILEVRDYGSGPSLTSVSLTTFYLSFHVPQEEYDGARHSDAWSLAVMADWVAAVRRVPMGLGHASPLLWCGDIQTGSSSTLVHKGGSGLTLSVCAFAFWRRPLRAHDYSQTVISPTVLILEDTRQAMLIVRDELPVCRAPRTLNHGEGHKVQSAKNRYFLIHPTLQTDSSRRFPP

SEQ ID NO: 977101 - protein, 115 aa, Homo sapiens
MWLWEKMWFTNRGDSGTPCVWGSPEGTSQYSRTIFVRANRVPCRPTKFISLTTRGGPTREVRGSLERGSHIGQGALQRGVSTAEPTTPAAQSEAGLSQRDKRKSGAHKTARLLSP

SEQ ID NO: 977102 - protein, 249 aa, Homo sapiens
MSLKEKTLPPGVKPKNHGAGKFPGALRGPGLSPGFLDRGKAPGTCVVTRLWDAGVLIPTVQQGHLGWHFRLQMRSPLGHTFGVGGSPTYLLRSLLDFWNLEAPRRGALKVFPFQAGIWKEGEGCTGEPPWSGSIGCNTAEKNASNYFKKTRRDLENRRAFRTPKAYGIRNYRVEPPEMRGAPALMRVRLICGAKAMRRGAGQAQENPGRREEMAIWTRAEEMRSPGERRETTDEMAFPPPRLDNRGGEY

SEQ ID NO: 977103 - protein, 213 aa, Homo sapiens
MMPAVSNGWTCIAGRCAGLSSLGYPGDLLKVNEAEHNIRDKPRGNLGKLSELNISRGDKTVVFDCASTLEEEVVRYCAVCRLHSLPTMWRTDHYDLLGHHCEACCIRAFDVSKLRYSGRKLAFVAYPLFSPLLVWVKPQKQVEPESVPEFRYTPVNELTLGHAVETSRYHWALGAVQPASAQHVGTLGRMCLSAVLPWDDRLEGPSVRLDGHL

SEQ ID NO: 977104 - protein, 202 aa, Homo sapiens
MPTEGCTIWSSVVTDQPSGRLHETVTESKTKKVKRKGSTIFHVLLPPSERPWWTRLSSSPSMGLDPHRPMFAADCVTPAAVGEHADGTAPEGNGDRDDNVRLRIRILSLVTIKWGRNPCPGSSSTTVTTLSIDLFYGDLKKAKAGTATLAMSEKVRTRLEELDDFEEGSQKELLNLTQQDYVNRIEELNQVAEGCLGPQTRK

SEQ ID NO: 977105 - protein, 111 aa, Homo sapiens
LGCVSFCVSSSLPQRLTHFYDWAPDLSASGSSEDLLMKLEAEPPGYSFVEIAHEKLWRTCGVDLLNQGRESGSPTQVDGPAQGVAAGVYTPCLSSKAEDRPVNGLLARCSA

SEQ ID NO: 977106 - protein, 46 aa, Homo sapiens
MLDRGQDVGEQREADNEVDDRETNRAGRTTRRKKEGDGRRNDDRAY

SEQ ID NO: 977107 - protein, 282 aa, Homo sapiens
MGRIAQTGGPWWDSTPRTTQTSGEKKLRSLKVHHGVPEEPLLLPYLTASARRVVRDHRRGAFISVERRFHYPQFTYGRPQRGPPPTGGLAFWPIFGGPFSWKAEGGPWPLGRRGPYVSDWNPFVGVTRRHCHLYPPSEEYARLEWALPPFEGFLSRLELAPVPPPPMGVASPLDIEATRNGSASFARLGAPPAKRLSDQFGIPCHLLRTPFVGLQKLYSSPSPKRSHQKARAGKSMGTTHCGETKTPRLGWNTRHRHRINTAASWSHRGGPRKHFLFCVGDR

SEQ ID NO: 977108 - protein, 113 aa, Homo sapiens
MGLANPSPLWLTFSGWVPHPVRAAEGPWRISGGWTFPGFLNSPRAANSPIRVWGATFLPRPRRRVPIRHLLARLPDIFCWSPMAAFEDTTAGWAQPYSDYYFGAGAFPHQVSR

SEQ ID NO: 977109 - protein, 57 aa, Homo sapiens
MERTVTQYTKLLRTIAPLYVPGALEMRPAPVATAHIVGPGLHGAEFSEGPFPFSPPA

SEQ ID NO: 977110 - protein, 166 aa, Homo sapiens
GRHWTQQGHAGGDSGHHSLAATGSRGGLVPPLPHQSPDPWGFRGLLLVLLGGGCWVSSFPESKLSSEMPGRMSRGPGEDGTSLCSPLRALHAHGQEAPGNGQPELLVRLGPSRLQIKWPRHPEFETLRLWSSRSNQQHVTKTCPWITQRDRKTYATSSPGTPHKSQ

SEQ ID NO: 977111 - protein, 76 aa, Homo sapiens
AGELGMVVPGVAMGPSSLGQRRPGSMAPWCSGEQRPSGYVLGMQELFRGHSRTREIPGAQCHGATLVAWSCRRASA

SEQ ID NO: 977112 - protein, 378 aa, Homo sapiens
GVGNLVLLFGYKGGKGQCGVAGYPQGAGEACAGQPQTGRRVERPVGKESVEFSQQSFISLCKGHRTTAWLVHEGVWEKRGKGPVGDGGGGGHGARGGTHHIPVATVTVGATENLQVGSSEKTRTTSVQTITKETTGQGAHTMAGRGPRNPPEEVGGATEGLCAGPPKREGPPKGRGKYKAKGPHGTGVGSLPKGKPHWGHWGERETRECGSIRKGEQGKREEASENQKRGPAQEHPKSQARKPNTQWSPEGPEADPKNHMRMVGPNMEMIREHQEGDPQGHGKNSGDKPHTRRGHPEEPTGGAQQHKGGQKWRPEQTVASHPGPRRDTRHLQREGRGHPHITHGTHGNGMDPSIRGGVKGEQEVTSTEKGSTTTSEKR

SEQ ID NO: 977113 - protein, 177 aa, Homo sapiens
MAPTQESSSKLISSQYLNNASYSERKLRVKPTLNKPNASWHSCDITYAILVQSCAYPAHTPIPMDGPEESYWGGRLAITTGNIGMDATGSCRDSDFRIVSHGSLDVSDAACVTVPPCVLAWSTKGPLQLEGPSLAACFAKTEVCLGWRARLQAAFKWLQASSKVSRGHGGVCLHFVE

SEQ ID NO: 977114 - protein, 129 aa, Homo sapiens
MCGPRAVPWGLVDNLLGVAQSMSQRSRGTRHMILDAPKICEEPPPQNNPRTDTAGPYTYTGRGRQQTHHQERATNQRLAAPPHVQTRQQPPARRSPRRCHTHQHDTRTSYAHRPAPPTTHPTAPSVTTD

SEQ ID NO: 977115 - protein, 166 aa, Homo sapiens
MADETLNNLFQTSTIPRQGGKPGELHYSVPCWGGNALFTRKKVRGGGSGLLLTPLIQPVTVEEIVPGEAMLGRGQDAHEWLTMNVYLGPSSGPDSAGVTHGSPLRGATRYGILERGQLGETVGQMDKGGRRILTRFITWIPASPWFLGLLLQDCPQMSSEGPKWVI

SEQ ID NO: 977116 - protein, 258 aa, Homo sapiens
MDDDDHEDEEDECCLARGIVARCPVSGSSVQGAREVYPTYAYKPGGMLWVPLACALGYVRPPEVDPPCGSRGPMWPRELNRLGRPARGVGGLQPKDVLPLRQGSDKCVCAGPDFCCAAGAQELRTVLPRGPFGPQVIAKPYPVWCDGVPPLAVLPRGRTMMNAICSRSTLDLLDVCVRRDDFTEGLGVPREAEATSFPTEAGGLMANLCLLMQAHGCAHRLCIPARASLKVYEPHIQVLRQGLWGGLTPLGLRWGRST

SEQ ID NO: 977117 - protein, 346 aa, Homo sapiens
PAAGARFVRHRGRGIWCFGLRTVGGFPVCGEAGACWRVAPVGVWLCWHLVPFYELAGGRKRGPSSVMTSVAVMYARAAPTVDALREIGVVAEAVYMDVPIERVNGLGSSVSYVHTCAKHRYLGQCVEMRRVQHNPLQSMAQRTLRDQGSATTCTYCEKKPFHWDWTFLKVFVCQIHTNVSGKHLCRQQGDNHRASVGIADTRGRTKFGSLRGTNWMGPKNSEGATGPPKADWKAAQETTPRFEHDTNAELVRFDPYSRRPAVYKGDFCWATGTLDFGEPTLDAFATLRRRRLTKFARGRIWQRERWPLTTSWGIRAIGIHFVARTRLNKVDLDYREGGGKMKAPNV

SEQ ID NO: 977118 - protein, 107 aa, Homo sapiens
MISQQYYSNKKHYPGGDLFSRGAHSSLMATQPKRPRTENDLTLPIGFVHNDGQTLTRLSHKKQQEEPPKLTGATLSNTQLRTTQQRSILYMTTTHTYSTTTILPSTD

SEQ ID NO: 977119 - protein, 67 aa, Homo sapiens
SLLRLGQPAECRDSEARSSGQSRDVQSVRRWMELVINFRDESACEASKQQKASAELIEEEVAKLPVN

SEQ ID NO: 977120 - protein, 414 aa, Homo sapiens
AFLYAWLCAVSTSRGSRADIELSQCRNSPSQVFDAEEHDGCLGPPATDDTSRVAAVFRGRMSMRGGRVSETALNWQNKNSSYLVGMDSPDNVNDSRRVTLTHRRGPQSMGESPSVGQIAQASASERHSERHLGEQGLTDQEYRREEPALHMVTQGEGMDEDAECTGGLKATMKRTRRLEYQQETRMPTGRKRREAFRDGGEPTEEGPKARSPTVTLRHTQGPISRYYYNCALCAHTHTGKCMGNRMNIDAKDAPKHHMGHSEKTNETKHLEKHKNTEQRHTKRARQTGQKCTKTVVPNCAPQHTDTTAREQEDETPQRKTATTNNQQMTDGTTTENKPPERKNGTEKTTNERPHKQNKRRAGTKQRRRRHEEHKTQKQKRNTTHDRKRTKHSSRKEHETPHITTNAATEAADTN

SEQ ID NO: 977121 - protein, 95 aa, Homo sapiens
MNDENIQRRTLEPRGSQKKRVWTREHRGRNTGNHTERQKEYPAHKQEETHKGIKTKYKNKTAKREYKKTEKKQEKTTQTRSTKPTRKKEKNTEHP

SEQ ID NO: 977122 - protein, 45 aa, Homo sapiens
MSKKRHSNKTDADERNERKGGKNDRLILTCSAEPPVSHRCKGKTN

SEQ ID NO: 977123 - protein, 391 aa, Homo sapiens
GRRMYLVPGEEDDLLLRGRRVLIRGPVAGLGWTLADEELACGRCYVRRLCLCGVLAVASSGLLISSELMNVLRTVHAGSLYTVYQAEGVCVLASSDGASVRIQGGELHGAWQVNRLPPKSPSASPFGPSFEKSSWLGTGAGRVHVVSVNAALVTSRVGHCGSGGLGDGGPLASRKGLDGWILRAYGRCAGLQGKRPAAGKGEMVAGGRAVHVTRRAPGRCLKQGPCVGTTFVVQMGGQLGGAVDLTMGKGNDCLAKELGFESGETRNKLDYAETYTNPSSLTSGRPGRPSERMAGPPTNAWNRPREGVVEEEDGKEPWDRCWVPPSRGPNWTKVGTLTTGDHNEPAVEGSPQNQGVGEWSTTTGEPNARHFGTARDNPYRGRSGEKGGKDT

SEQ ID NO: 977124 - protein, 357 aa, Homo sapiens
LQTCLLPHWADRVQREKLMLDSMCIEQCLIDSLGVFSLSCDQVSHMILQQNMSIVVLLSVVAVSGEYTSLLCCVITVGSFGCAVCFAIVKYHWMRGPRITNTVLYFNTFHYRHLTGANCLGDNSRTALTLISPRTRVIANCGSSLTSLPGDCLISQPKGHYTVNQGKCDVAYAIHPKLTVTHLCKRIGTRFTSQNIMTSKLRTDTHWVYSSPEETTINSTIATLALGNEIKTTAVPRLTPSMPYSPPRPTHSVLQHPPLRARTVSQLHDPPAYTRDQRAPRAQLRNKLHEHQPDNSHHTPYRPPAQHPTGRPPTGHAATYTLPCTGHVSPTAPASVHSSPTAAGAHHKSEHTTGPTD

SEQ ID NO: 977125 - protein, 110 aa, Homo sapiens
MTTYSTSARGVSATHATTSHTTRYKDHHHPGRRPPRGHHIHVRNERKSPDTTVATPANTPPTCPEAKTSTPRTPPTPSATTTVTPQRPLTPCTHPSPLQSHPTTTTQTTR

SEQ ID NO: 977126 - protein, 152 aa, Homo sapiens
MGSPHKKTKRRPSRGVYPADPGKRSTQYYPRDIKHAGKGGPERADAGEGGESPNKKQTLTYTKTTHPWGYEKMVGARWGGPYYQGAQKTPLENKLRTPQKALTRGERKIPREATWGGQPIGGDTKTLKREHPRETKARRHVHISPNEKAGPT

SEQ ID NO: 977127 - protein, 273 aa, Homo sapiens
MGGKGGPIPKKRGGKKGVVGDKIFGVNSGGKAAPLWWVPREKSEEAGAGGLINNQISEVVFAELLKQIGGQEGALKKRNSTVTCRHLENLYLENTTHQRKGTTGEVTVRDHYTTVANNKPYIQARTAAELRSGAEQNKQRSGGHYEWCGEQEVRDEQINRESTILPDNELDTSIKPVTESSEETTHNNQTPYDDPPTTTTTPRARHIKDKHQPTRRPPDQPHPTLLTQQTMVTNNRATSHTRGCNTNNSERTPNEQNAHSPTRRQPKQSPNER

SEQ ID NO: 977128 - protein, 435 aa, Homo sapiens
WGERERYIFLRGEREARAGREREGGGALSLYLSPPGGGGGGLSLSLLRERDISRARARDGERCVLSQRRERKFLLHIAARAGERRREERAPPGGRERESGVSRAEGGASGEGERTARESRARGGGSRGESARGAHKRGAGRERQTENQSRADAREPYSVRRRRRDESVTASGRKEGRANGEREDDEEEKEREREETEQRRRRRQTHPPGEESAARDKKDPALHSERESQQTKVRERERRETNETAAKRQKDQHAPHERGKQEKRQRNRGEEITTDDGSDRRGHLQQSAKNKTTRSTRNTVGEATHTSRPARPTSTSLRAAERTTADEAVAKSQKKATKNVDSRGPVARTQNTEKKEDSPRVRTDIHHGPSSAEPTPHPPRARTHHTAPPAPPRPPARPTRRQENSTPTAHHTRRTDTHSTRANIHRTHENSHTRG

SEQ ID NO: 977129 - protein, 243 aa, Homo sapiens
MAHLGKKPGKRGQASIGTRRPDAITGCQHVSKSRSRDNTSGREGGSKKVRVDRNGATNDRPITLTPATTPTKATVKGRTRHNRHHTNPYAGKTQSNIHSTNTKRKTAYRTNTPQHRPHHTHTTPTTDTTTHRTQTKNRHTITNRTVTPRIETSKHRVTYTRDPRTPDDQKETGEHNAGHKRQPQPSTHIQETKTNLNQRLKNTTLSILRSRPTQKRSPNKADTTSTPLEPSQYEQDTKDVHAP

SEQ ID NO: 977130 - protein, 303 aa, Homo sapiens
GEPMSRHPRSDRLTQGQYEAWVLSVYRSPPPAGKARGSPECKKLHVDINDESVRKVDFIISDITQIATRTLTGDEDTRDRSVWRRLSGLNRCKLNKNGSPEQYEPQFRYSEDPGVLHIPLEEPVGCKSHKSARSTSAGSCSAYIAASSAKPDEGYKVSASTHVKTLGQGVAHEVAQKWATLSTPENYDSPYENLRVEGGFSSKLRVERLGDIGPCQRVPCARCIRRQVFLHGSFEVTGLRIDNEETHAVTGESPGRDRRRMPPGKTPVNMCRSRKHKMRDTPEEAHPPGNMFPTKRNKPNAHP

SEQ ID NO: 977131 - protein, 251 aa, Homo sapiens
ARRDRRALSSAPLSRRRQPKRRRLLRVRPCCAGLVLCLAVAPWCAPEPPRRRTEVLVLRKSNFSEALGAHKYLLVEFYAPWCGHCKALAPEYAKAAGNAEGSKVPRSRLGEGGLPRRSLSWTQQVRRGAVIPTSGSSGMETRLSPKELIQVWREADDIVNWLNEAQRARLHIDSAERRSCTSPWWSPSDVGVIGFFKDVESDICKQFLQAAEAIDDIPFGITSNSDVFSKYSSDKNGVGLLKVDEGRNHFS

SEQ ID NO: 977132 - protein, 424 aa, Homo sapiens
MAKKRGEVLLNPTAIVGMSRSFSATSVLQYYFKEMRNLGVKAPHISMEKWWNYIRGRPRKNCEHWAPGGKGLQTHSALHVRHRTNNCGAAEMEKHVNNPWRQTAEPPVAPNEATVEAISKKGHLSTKASDRGETEYETPQKTEEPTILWAGHRRKDNGEQEVVDNPRKQRKNSEKTHTKETHHTTSTHTVRDPHMEGTHKLLRRTSHHPEGHNQTRAQSSDHKQKQPHEHTTERQHKKPRAKKPSHTIRPTKPRTPNRPTNSDRNHWANTERTPPRARNRSTNRETPRQTTQQKHTRYNTSGRRNTTRPGENTQGKPNTGAHNKSNKKQQTNPSNTKYHTKPAHQKQCEKTQNKTEPSTIKTKMRQQRTKEETNKTQQTRRNGKNKKQTKTERRGKKPKQHHEHPNRGTPNKALQREENPTPQQ

SEQ ID NO: 977133 - protein, 129 aa, Homo sapiens
MAQHCKSPPPMILLSSTVLHYLHLRPVWTSTPYRLHIQHYLRTSKESLCNTPRYAILHATSFRHFRSSPTPLRQGNFLYMSCQLSTRRLPPQIHGITIPHLSPPLPLPRHPVISSFLHIIRDTTQTCFT

SEQ ID NO: 977134 - protein, 479 aa, Homo sapiens
CLPFLCLLPLYSHVTECGTPAPGPLCPCAAAGCVALLPIPAAAAVCACCCDVCVCVLCSCLCLCVTMCCVCDAVRSPDVRKPDVCSLAVLALRCTLLRVLIAVPVVTFQLSHEASGAVSEDRIPVAQAIEFVDKSIFMAAPQVYGALTVPGTQSDDPDLANHRELVLWETPYGLMIFPTPSSEHLDRPVCEFISRQVVGAEEEASQCFKFRAAEGGRNRTAVQAAMWYLPKRGTMVIHVKRRPPRAHYRTWFYTRLNVINGFWWVVLEQHKESAAEKLWPFIWYGYGKHYPFWQIITEAAAGVGRSRVGNNCTARLEAEISMANSVAIPREEDKMRHGKTCGSAAYVSFGTSRWPFVSSTPWLPDQQMGPASGYLNYTPWFDDWVDVTETLLLYPYIGEPNEQVPPVCACLSGERMRHPTIITVVGSRLARRGGNSLGLEIVARHRRGELFYNAWVGYTSLITFSRGDNTRFGYELKLQ

SEQ ID NO: 977135 - protein, 189 aa, Homo sapiens
MVTRDKYWHRSYNRESSDPDSPGASCLDRAALTKECRTHREAYHLLHMRLGLWSAFLVHKESDPFQACEFKYYPTVVVDTRNWSTTVFKGALWDQGQTLCRFEQDGFYEWGAMSGEQTRGSILSSMFLKSRRRKSGSIGWLQIVLSNLCHKSWDNWKAGAMCAIFDWWEPTREDDVMFPIQYHRGFLKG

SEQ ID NO: 977136 - protein, 112 aa, Homo sapiens
GGLSEDGPGGYHGWWQQRWEVRGGMAVEEAVVLSGLLVEVWLGPAVGTVQTRRPGGHFGRRKLASFESCAQEVSNQPYLCESGHWLRGDWLLQLPTMSSGGSGWLCDCPHPL

SEQ ID NO: 977137 - protein, 103 aa, Homo sapiens
MFLHACLHRAREHADVRDTTSIGTTCQGHGFLGGHSVPRGRAPFGGSYGIDLANLWPRQSPGELVKTGTYGGSPPWPCITSWKAEYVVRNSPKICIAPSDEHE

SEQ ID NO: 977138 - protein, 239 aa, Homo sapiens
MTAVCDSSRRLRQSTVYHALTAVCDDTSRVSRDSGVHSVDCRVGLQYGVSEVSDVHWLLTAVCDSSRGLSNTPVYHDVTAVCDSSTGLRQAPVSHGVELRVDYQIEGSSAAYQCPRRGGAECDSRRRYYQTTQCDHCELTAAVLITSTGDIQTDYRVYKPFDSTVVAESQAGRLSQHPGVHALEWQRDQPERAKNKQQHRPPASDCATKYSRHPPTPETQQKYRDNNRGRTQNDDTHEA

SEQ ID NO: 977139 - protein, 182 aa, Homo sapiens
NVFPVPADCPVPHRTQCWRPGPGGTLGHCRYLLCAWTTGSVPMSCAVLGCVPGAWTQVPEPAACMFLLLVLLPCWSVAGALVAAVWALQVGNALGSLEPLRWMLRSPFDLQRCLVNLELQELLLDYSFQHLGVSSQGCVDHPIVFDRSCVQPTVFTANDAELLFECYGIPKVAYGIDSLFSF

SEQ ID NO: 977140 - protein, 111 aa, Homo sapiens
MLGFVGRVAAAPAYRGPCSEYSLPSASSAPSSALTAGRSDGVSILSRVLCGHISPSRKAGADTGLHLWRVIEPQLVENVQSMTRGTTTNSNCPGSARRGDADCLEVAQRFG

SEQ ID NO: 977141 - protein, 178 aa, Homo sapiens
MKCTSLHSLSRGRATVSSLTEVSIVKTPCSLPGTNFGWSPDGLRLPVISSTQSPVIVFLEDRRFPYELITIPARGPTSVIVVAHRVCVPDVWLLWSPLLAVGVSRFGVHRVHGHSGRACPASREDLSYPFSVWQRGGKIRRSRGLPQFHPVGNTGSQPGSPRATFLGPHKRVLLRSAH

SEQ ID NO: 977142 - protein, 73 aa, Homo sapiens
VARCLGELLAAACASRALPPSLGPCCLTHSPGLQQQTSHAETDDLTRSTKLTHPHEQNRAITVLSRALTQTGT

SEQ ID NO: 977143 - protein, 450 aa, Homo sapiens
MPSIGLEARVSTYGRDSKDRWSWFVVSGHVRASVWRLAGGVSTVSPVASCGHLPDQYVVPCLESATGRGDGPCLKVLDDYRPITRLRFIGYPWHCRGSEGDGEHRERRHPLRTEPRRKVKFCNHPSVGMKSDGHEPSGAARYRKMRRPWRKATRTGGGFRNSIGRKKELVREILPHFEASCMLYGLGSATRDATTSGDGNQMIAVWALRFWRISPLRNGDTPICHTVSLGSSSKLDSVKSLDQKVRREVGSVPFARMGGRTVTPKAATLTFGGGQNLPIEVVLPISEGAREITDDLATGSLLMKRVCKDTEDRNTFVALVVCHSAPCVCTGPCKGTRGVMEGATIVPPLWRPWDQSGLENGGPAERHQNAQELIGGAWVKPASAGLNISALGVGLWCWGRTRLERWGSPRSRWCSGRRFASRHTGLSWNRRVIGLAENRRAFRKLGPKGR

SEQ ID NO: 977144 - protein, 222 aa, Homo sapiens
RREPLVLVEVPHACSAARRAAGCLCGMNALSPAACDLEIQLNVPMSHVTLCAVPVDDWRCAALHARCFPANGHRVWHMVNPCDQCSLVASVCIVNQRGLPMLGKTESKLHSCSSTCTPDTLSVVCWILAFPCNQFGKQLSQCSNLKMIKEFAAGYNVKFDMFSKICVNGDDAHPLWQVGMKIQPKGKGHSWEMPSSGTSPKFLIDKNGCVLKRYGPIGGAPW

SEQ ID NO: 977145 - protein, 268 aa, Homo sapiens
ALVRRIASKGPSIRPPQHHANRPADASWSYGGGDPPAGKCVPRTCACVWSLAHAGSLSASSTLGFADYRLVEPTPRRGSPRPLHAESSLGAETALGNWSTPYLSAPRALHCGRDAHGAMILALRGVSTCRQDLVLADHMRVPPRTLALTYELASTRGNDWSLGHGMAMLTSTSPSVRVCTTICDPWVLYFSIRRTSSKYVVSFIRNGVYPSATPVHYACVGMAPLAVSGYSDRGARFPLVPVYPRGQNPSGIFFYPSLPRGTQLPFSE

SEQ ID NO: 977146 - protein, 196 aa, Homo sapiens
RQKKNKAVSFPTKQQPPPQPFAGCLPSAQPVVPAVGRRLPLRPGPSKPSLSCRALAGEWNGAPSREARGLGFGPLQSSKRSAVVAVRAPPKGAYAEAHPSPRRALTHALGEYIYYSGSHYVWVCTSHEGELGESRRLFITSHSLVMRYLLPLHAPQRSHNLRQLRAHHAPTGATLSGHKPRKRITPHKKARAAHKR

SEQ ID NO: 977147 - protein, 152 aa, Homo sapiens
MESCGQERQDVSLYVCLAVSVPPVMPRGEILEESVRREGDWRSGYWARGLSALGSIGTSGMTCEPLSIFNLGGLQRRAYGIAMLTCERYRALYVGLLMSLESTDKNPKIYGANITWQPIVDIPYSACNDKGPTTMNPFSELVLICEQGRDTS

SEQ ID NO: 977148 - protein, 239 aa, Homo sapiens
QGAETEPLLCVVYAVAAGRGAVTLHLSRVPLCPALCVSGPAARSHMPWLPWARPPPPPPPAWPVLSAFPCTVSVTCTASHRRVSVIWLLDGYAWVSQGGRSSQGHCGEPWGGMVTNRIVLCPAMAEAAAFVWRPNLRSRLEKPASRGVAAGSALVHSTVPGAAEFVEGCDSVGAQSGSSRVRRAVKSKGHRTMTCPFSRGCSSAVPTQQCWLTLSKCSQGPVDWELLSPHMDGADLALG

SEQ ID NO: 977149 - protein, 83 aa, Homo sapiens
GTPRQHGPNWQGPEQGAFVHRLPPGAQLHHTSTPFLGHWGKGCVGHYKTSLVVEKGKRNEMCGTGDVKLTRKGQNPPSRGKRA

SEQ ID NO: 977150 - protein, 53 aa, Homo sapiens
AAPTLPRATACRVLEPEPEPEWLPVPDCGGSCGLLAGLVRAMLHECLIHVHVR

SEQ ID NO: 977151 - protein, 161 aa, Homo sapiens
MCCCHGAWGAARSWDARWEPVPPWPCYFCGIIRGGRDDRTLYELDLCLGLRRIRLTECLTVCTVAVPSELGSARLKRLLGVTGSSMSMDLEWLAVCGRGRGISDNSHPWVQAMMLGRAVAFNNGILCLFRPQSVPRAFGHDPVEQADGSRFQVWDYEEGEV

SEQ ID NO: 977152 - protein, 289 aa, Homo sapiens
MAADYWIPCILSREVLHHDPCNDGARESWSMERLGGFARLQGPTVFVWEHRGQRVYDCPSVYLAGAIRLSGNGGEVQSWHYRSPCGTLDALTAIRCEMLRCERDPVWWLITELPEGHCHLVFAAEEVTPTVAVLASRLALHKRPAATYQSKVITLCLYRDLSGMFTTESRLGGARDELGGRSWPGGLRAWAQRLAPQWMTRREMLYGDAGLLFRPKKGNRGPDIIKTSSLNDAVTLVNIYRSKEITKWMACKIDGRTWNPMRIYQLTQHGRIGEPGDRNHTTQRAQASH

SEQ ID NO: 977153 - protein, 267 aa, Homo sapiens
MRDTLNKTNNTSQQDNPHTQETNHSQITPNNDGPGEITTIAPPAHTLINPISRQARRDHTNLNTPQRQSTTTISTQQNTDDDNSPHPERRQLTQLTIQNTQMNPPTNTYTAAKPNKSENNMHHTPPQMDNTESHKWGSKRTDKQEENTKNDGTPLETASHAKHTNDHIVPAGTTQQRQETYSPALIRVSNALFVGNSTNNTDKNTTAPGLRYHYELLAPPTTPQRRRQCITLNGPHRQRRHTNENTQTTQPVPSHVYKNKLNSEIVY

SEQ ID NO: 977154 - protein, 149 aa, Homo sapiens
MGCSLSRVVDPAVLICTCTDLRVDPPSPPVVTFDTWAAVRCVEFMAEAKDHLLFSGSTAAYSTVQCKSYGPLSLKAQLGDLSLTLSQFDSRRNYMHICIVFSSDGTLYPQLGLVHSADGGNESKRPERRPVGLEENYRSRPIIDVWIRK

SEQ ID NO: 977155 - protein, 230 aa, Homo sapiens
MPHVHLISHFNLPQRLRCPETEIRRPEFVHPIDLGPRACTRQSPPPVYICRDVIDVLPETMIRCDHSALSIQSLKTRLLPHRVKHLTISPSEQMYQCRSADMEPASLYQTKGLHDVCALPWTRSQPCSTQVSCEQWIYLLTSLFIRTMDTSETQLLVCLGRSTLTPFSAFGSPPKRNPTRLLIVLRASHARGIPRSTTSVVHSGTATFPPQASCVWVKRIKQVFTHDLYN

SEQ ID NO: 977156 - protein, 189 aa, Homo sapiens
MRCWVVVVSMRSCACDLSVALSCVGLSGKMYVIAFVPLVGAWNVKTSSLGSVISRSILESTEIREGPGTTLEFRTEGAVLIVPCVGSHVPHSCDLKSLVMFYRYACYSWKRHSIDRGWETPSSHQCKRCYWERYRTGPLDDRGPAGLKAHHASCLRTMATSMGNSMGVGLKDTLDEPEAFIPCSREMWL

SEQ ID NO: 977157 - protein, 111 aa, Homo sapiens
MSVWSASVQALKARTGHTWLAGSFQWRHVLGRLSCLQLKGWHFFTSITQWVVIVLLFIMVAGDLVVCCGHSGGVLLLRCVADVENTGAFLRECGVPDGVGGIVQRGPMLYL

SEQ ID NO: 977158 - protein, 184 aa, Homo sapiens
AHPDPIALRIREQGRVRSSRTVHRKAAGTDPNMVLTTGDLDLGASWRRSRPTPHPGLPPRCFTLTVTDFYRSCNCAPGLSIFSPRIPFDPVSPSEATILGLRDWLSAYWWWTLGVLGRRFRQSLGERVFPESSSGGDVTYEREEVLYEALLIEAEVVSPYLNKVVVSVEFSQASLSRETFCGLT

SEQ ID NO: 977159 - protein, 320 aa, Homo sapiens
QVQSPLCGACDWLLGPPVAVRGFVRVTTCDIGCFAKAHATTLLSEVAIGGSDNFYSVFEGEALREPSPVAARVYRRLLASSGSHCVWGNRALDLLGTLEHSTSRTQESCKHIRKVLPDTGQIRRVEDAVLILGQCLHLQIDYVGLFGPYSQTLERREDRRNCWARCAHGWVMSSPSTDQSRRPRVLVGRLLCLQGIEVQGCCITNDFDCERAMDEFVLCFFESPLVGVDCCSRGRGVIVGAWWWLICVHVHYLSCGATIFLLSRVVGLLGLWWGCVTPLAQLGFSLGCLSVLPVRPRGGALAALMLRGRLCLRGATSGAG

SEQ ID NO: 977160 - protein, 182 aa, Homo sapiens
AFLYAWLAPSQQPWKPSEYRALTGPELTQEVFDAKNMMAACDPRHGDTSPWLRVFRGRMSMRGGRVSRCLTWQNKEQQLLCGMDPLTKCQEQSSCDIPPRWASRWRVTFIGNSHSHSRSSSERISEQFTAMFLRKAFLHWYTGEGMDEMELHRKAESNVGDVVSEYQQYHGCHRDEVGGGFR

SEQ ID NO: 977161 - protein, 94 aa, Homo sapiens
MAVTGLRTKGVYKKLAGLGVRTHHGGLDIRKEVTQTHPQSSNTSRDEERTGRRNSARNKSLATTSRPRANPTTTSTDNTTKNTPPAHQQMDNAT

SEQ ID NO: 977162 - protein, 105 aa, Homo sapiens
MLVESGLCCCLSHELTGRGHFVVATRGGGTCMRGRQGPGMQLSGPSWVLLQGTDNLIIVPVDVGCRVLAEPSREWGAESVCPESSAKREFIVPGSAPDELWRMCA

SEQ ID NO: 977163 - protein, 81 aa, Homo sapiens
TCGDKIHVCRESEAVHLIKAVSGLLNCAQEEENMLKEKSGSIRCHGWGAKGSSQGQHADVYLKASDTMVLEGTTQGWSSVG

SEQ ID NO: 977164 - protein, 151 aa, Homo sapiens
MSSSNQGVLVYLIHQQLSQARLAGAQCYSFWMSACRGWISRRGLQERCALLRGLGQLLHAQEVGGEPPSPSGVHQGGVGCPVGRVTFTWVHTRPRAKFLIRGHELLRSPSLIGTRGWGDLSSNFSSLLVIHDYVRLQEISSSGQTHEGAAG

SEQ ID NO: 977165 - protein, 155 aa, Homo sapiens
MDRELVFMGIMYAKDATHAPGRLRAGEERIDCDVEIVAAGRFINLRQENMVLNAGQTQIERASREGIGPRRVLVGRRGGSLKIGGAFNLEMVACMTVSPRSPHDVSGSSKAMDCLILVLAHVTVSVAEERRFIFVIGLSKRVEIGMEPQDLRAIA

SEQ ID NO: 977166 - protein, 141 aa, Homo sapiens
ALSTVGSAISGGSWRHEELCDLQVVGGASGTIKSKVWVTEERSDNLPSSAGSGDKPPVGSRTFLSLWLLHPLHESITLGTRPLDIDSRSSVQTVVRASSRSDEREPVLWTVLPIHAEMWLPRLMNLKNTGLCTDVLHSRCR

SEQ ID NO: 977167 - protein, 217 aa, Homo sapiens
GPSRIIAEGSALRPCVLLFLLLLLWRYDVFVTSHAFSARLPTMPLGRRADAESLRCPESPPAPSSRDAMACSPEEELKDGERRWLRPSTAATCGCCGCWSPASSSATRHCVWVLPPGSADVAACPGSLELCPEEAGKVSSWCGMLVWALSFMALPGGPARALCAQERRLQAGAGPAMTEDEMTSCSQEFVRQEVWTAQSAPTQGTTAGPGGCLPGFS

SEQ ID NO: 977168 - protein, 260 aa, Homo sapiens
QNYSRGTPQEMGAPYPGYCPLGSGHHVSQRRMFPLQKSPGTSISKTDGMARKKQGLLQRKNEELSQLSPRALLENPWSLQIVSLQRVGDRRFNKEASWRSSKEAFELFDPSGGWKDPVQTVLGTVIEGPACQKRQAKAEVLKVLGNPKIDELKSRRVDFDDFPAMLHAVAKNRGKAHMRTTWRGPRVFDKGGERHVTGSGASDMLLDQPWREDDWEEVVTVRGRTRGRHRVHQLTGPSGTNAKRLNAAIQERSEMAARGK

SEQ ID NO: 977169 - protein, 104 aa, Homo sapiens
MVRTCCDGLWNHERYLIERSTLMRFAKFSDINPVNRSSDLKEGLMQVMPYCMFVAAAGAYVHIGHSCSFRLACCLPWCSLHIDDLACWQQPHSPCNTEQKRLDF

SEQ ID NO: 977170 - protein, 101 aa, Homo sapiens
MRPTQTKGKRNPQRKCNIAVHSTSPTKYPPPITRGIPTNERKANTYHKEIEEQTQRPNRREIMTICITPRRKLPGHKLSNVNDAVTDNPDKKQNKEPKNTD

SEQ ID NO: 977171 - protein, 249 aa, Homo sapiens
MSFARTRQRKRYPTLGWTTGHGPCTKRLSLHKVKFREADVPNVWIPKGSSVEASSRRGCKTLYHDLGQIRVWAFEFCPTWWQRKVGVIEQEHRRLMKSMVGSLTAGGSFAVSAEHGEPIGRGTEVIVQSYRRIRRSTSEERRVKRWWKKRSQCHRHPIRLDGTKEEAGTAMMKRGRERGNRGSKGREKAQSRKVALRERGGPEKARHRTGASDKQSGKHHGQPGDRPGNPERGELGAIRQRTGYNTMRQ

SEQ ID NO: 977172 - protein, 514 aa, Homo sapiens
MSASTDSDTAWLSLPTHYTRLTTRRFCLSPYTSTGTHALNCSHGNALSTERSNTHRQPPAAPLQQAHAGNATAAQLHGRRHGTHDAQTPHSLSTTTPHACAPLRTLPHRCDAADRTRTQPHAHAPTPTHTTPRSATHPPLRAHHARFRTYTARPHAAHTHALAPHTPSYPSTHRNSPAPVPTAYSAQPPRGTLSYCRRTSTNSSCYSLHANTDSALRKRNAQPFIIAPAPGTKQTPPPTPGPPAPPPATPPSPPPRETHPQHPHPPPTHTKRLPPHPPSPPAQPSRLSTTHASSTPPRNCNPQTTEPLHTASTRQQQGDRGPDTATATYPPIASTPTRTASPPWQPSREHRLDGPSSHISGLPPRTHSPKTPLTKWNENATPNTPTRPPQPRSHETADRPHNTLRTTHTEARQSSQHSKAPGPPKRRPQQNHEVDLHNTGKQLVPHPDTPPRQPAQRDPPTPQRMTTQRILHHNPPTGQHSKQPEVKQRQKDTDRYTYQPVTDRLRQDSNATTP

SEQ ID NO: 977173 - protein, 337 aa, Homo sapiens
RQKKNKRNFPQSNNPPPHPSPVGLPSGPSQLVPGGLVGLALAARALQAKPSGRALGRRWEVAPSREAPAAKARASSSPSKAVWRVVRPKRSGANLPGASWLGISMGLLGVPGCGAGRFSLGRAHTNPSTQEPMATDLSAGASGKRETPKEMSRVGGPLASSPETPEARPWSATLFRVVFEGGASRGTSFPVGATREDLLSRNSFVDVLRGSSCHVGIFPPEALIGGTRHKIGAGRAETGFWKQGAHSQGKSTGRRITLSENRESVWANTKTGLSKVIMCRRIEGMDGGPNRPPGGHSGKRFTQSSPGAAPEGPERKKHRKGGPSGNICTKKDSGGER

SEQ ID NO: 977174 - protein, 341 aa, Homo sapiens
MPSCEDRLRLKVSVAMDLIMSRESSHNHWAEPVNGSGNADKCPGVIINSRTSANKSDMVLVSEDLKNEVEIDAAKIHVMKLVVRVLGVKNTLFELSRVAEYLSTSLHKNIMGERRRKALKRFVHESETYQKSANRVQPENSNGRDHVVDHHARTSSQSVEARPETGFLSIEKDLGNIKTEVGGLPSPAKLRNSLIGTKGRLIRSMHGGVRRGPHSLSRGRFRTRQRCYQGAFLGWWRTARSSSCIWRRKATKSSLLNSRQQIHEILIRRGGQIEGRSWAVYSRGEARPDRPPWERRGRAQDGLWPTGGVEPRGHNNPPQRLEEMGAPGNGGGNTRGGRITG

SEQ ID NO: 977175 - protein, 182 aa, Homo sapiens
MLLHKNCTYLQVRSPPRRRICRLHGSSGRLHWRYDRQRCGISAKDTGVRSKRQGGCGRCPPSRGVLLFSPPVSRENIGVQAWCGARRRCMGWPEQGLARERDGNREGGEVSRGQPAGCECGRAQGRESQAPKERQPGTRREAWTDRTPAEKGAATQESPRETWGTRAGVPGEPQRVWENREH

SEQ ID NO: 977176 - protein, 346 aa, Homo sapiens
MQITGDMYSMTRRFDRRHVCAYEIILLDLTRPRITRVTEELFLSVQYGSTWCIRHWAMRMVQPQCPGPPRCTAPRIVVELSKQYRAKSTYIVASDIITAVKCNVEVGSINGIVAETCMHPIGIEKGMEPRSTTSMRGSEEGSCLSDQWIISDVYPAFHSSDFEGDAKFLVTDNWESWCEGASIADEDTLHVLCRIDTGGSFRNVADDLHEPKISAEAARGQVPVDQMGIREPLPAGDPEDGAVARALEQVQGHLLLREGYYDREEAGQQDLGEKVGISAGESLIPLTTAGGRVQCGGGSGGPKWGRNSRLQGGEAMKWAQGTRRTGGKGRPPRKKDPSLAEKAGQT

SEQ ID NO: 977177 - protein, 154 aa, Homo sapiens
MAPRGDREEELEEVQTVKDVEALRDEEELTVVQVTFSGPESLASTLGRISLSNGRPVRNWAAFSLDARTSRYQGRCSEPCVYYGPPPDERSKGPTIDAQGDRSSPDRVTRAREEGVQEKAGPTAVLGPGTPRPALEGGPGWRGRGHSDVAGATE

SEQ ID NO: 977178 - protein, 364 aa, Homo sapiens
MPGLCPMGGLGCWGLAVFISCIILPTCQHSHTAQPAHINTHGIHTKAHLANIIQHQTHFTQCRTTWHACIGSSVTTHKQSRLATYGSFTLVSLASSTFDFCAHIGGLLTPAEFKPATPAPTQHRRTLFISDVWLNSQQLLLIRLTEQRPSQNDLASRRPTFMGLGPALTSPAVAQPGDGRGFAGEIQGPRSRRHYGQRDCQTAALCLDAPCTGTSHESRPHGRLDLTSGAPCFTSTTLEVVDTASHYRLITPVHDKQNPRQSKRRQRLMSRASGATTHRRGPATPGHPGGHYQTWARTQGRAQPPRSRGERTTPRPREGEQRHPGDPSNDTSRTRATSRHRGRQNTRRPAGPSSAPTQENNNNS

SEQ ID NO: 977179 - protein, 308 aa, Homo sapiens
GGSETFLLGGRGRGPQISAPKKKTQKGVEHGAVGGRIGPGPVVAGPGDQDAIAYKSRPFGGKGIEARGNRHSKRSAVEKAVEGETHRSEPSISSASLVDATAHILDTQNVPRQRGDECNPRWVKRVLRAAPHKRRGEGRTGGANSGGNVGSTQEELLRKAHEAGDITHTQGRAGIIRGDQMCIPMIAQQSQTAASTPVRDTATSELEGCAPVSTAHKEGAEGAEGIPQVRQPGTPNGTKSGAAAQRGAEHLVATQSSAPEKEAGPRKRAREKPVTKEATPSTSAPGNPETKAAYMSHPRWRRNHQRPE

SEQ ID NO: 977180 - protein, 241 aa, Homo sapiens
MQKEQEGDNKSTDKHRMNPTKITQKNNTGGKHTAPKNTHKKKDTTKKKSKQQNEPQRKTRGHIKRDNTAKKKRRKTEDTTRTGHKTTKKDNKGKESKTNKKTTRRKKYKQQREREKKENQKTRKQRRTNRRTTRKKTREKRKQKTGKTTQNNQKKNRSKKPTNKGTNQREKGNTTSSSSATKKKRKKDTTKRRAQKKTHQETEEKNAERETKQRKTNSRTTKTKKDRGQKNAAHASRKKKR

SEQ ID NO: 977181 - protein, 325 aa, Homo sapiens
GWMTAWCSWGVPGVPWWPCVMGEPAVCFLLDGFWHVASCGPGVCWPVDWWPGGLMACWMLLLECNGLRIMDVDCPVTKLGLLGQGHEDQCPWRRSISSPCLLRNHEIIDFFLGASLKDEVFERLCQCRSMTLCLAMLHQGSQALLFAIWGLQWPRRSWVLSAPMDVWPPAIRGAIILCNALHRPRAAEATWGNKIGKPHTVPCKVTGLCGSVLVRLIPAPSGHWHRLRTCAYEGCHDWVGIDDCTPQPGLTAPWELRHGNFDCISKTYRYLNPGTLWTATGYPPRVLLTGESLANLRKHRNQKFRGHGATGTRSCAKTRRLITER

SEQ ID NO: 977182 - protein, 286 aa, Homo sapiens
DTTPGPWLCPTRYLGLRLLHSVLRLQQLLVNLLQARGADLLRTTRGQVLELTPPPALTPPLPGMTPAWALTPPLPDNPAPGPDPTSSWDDFALGSDSAFSLIQPCQLPKPLLLRYDPPCLNPAFSPSQALTPPTSHLGSTQNLDLVLLGPTHLLMLALPTGMPPSTVAPHRPCAQALSLLTPPQDSSSGPAPEPEAAPPNQEAERLPPDDPESPDHNIWTLICHWRKDPPTRANPPTPNLMPLTNSSEAASALHQTGMVGSNQVCDQATDYKGARRGGQEEEREDG

SEQ ID NO: 977183 - protein, 443 aa, Homo sapiens
WKGPGQTLAEGARWQWCEFPTSSGQVMLWCLHLLLFLLADPTWVGTCCHGCWMLGPGNLFLANGDGPCSCDCLVVPPRWLTMWNGCGDPVMSWLCLPLKDIALCVVLSHSMGAPGPDGTMDVTVSQGHPFSHATGCQLVRDRCHACHDGAVPMEGFDVMWPSSGIQCFLASQRCSNNCMPAHVVTFMTPGLLSYHKHCGLVTWQVGTCMSFQIRLLKPPCSGHCLGNLFHPGGWNPVGVCCRIVLLGHGFPPFNYGAWWLGTFGADPPGSFFSLVEPTPGPRWLVGLLLVPLLVSWLRPGPAGLRPFLRLAHTSGPETTQWCGTQSARAGSKSPEWSWGYEPPDSGRSSEEESLLERNAAGRARLPECTPETFPPQKLGVERRRMAPRDISKTDEMRECQPHSMRPQARAHKTSNSWSSNVSTQTSHTDPEKEVHTSICVVGL

SEQ ID NO: 977184 - protein, 193 aa, Homo sapiens
MEAASGYTDLREKLKSMTSRDNYKAGSREADDAAAARRADAGGDAAGDEPLTLSPGPRRKYQEDSEPERRDYEEQQLQTEEEARKVKERHHRQDDAILTARNECAENEGPALEEVGVTGQDKGQDNRWTTVGRGPPKDRQRTYEAKGDTERGPRRETARTRQGTGPPQRKYRAKKHEWIDKVEARRPGGEHGK

SEQ ID NO: 977185 - protein, 210 aa, Homo sapiens
GSLRAAGPELSVSFLVRAPCIPAPGCPLEVRLRSHRADWFLVAPEARWLGPAWSACMLPLEAAGLLAGWGRWGGVPAGASGQSVPLLSRGLRCAGCAHADRCSSTACLYSEMLTACCSPRACLWLPVLATGLSFAIASALMCWLLCTAVYLFCGRWMMDPVMDVTFAEDLLDDDERACGKKLSKVVCQGALGVTGTALRRTKQAQLRTGN

SEQ ID NO: 977186 - protein, 345 aa, Homo sapiens
MDSWVREDCAGLNYAVLVRWGRPLRQSGADGVTSPLGYWTSGQTFFDAILTHSSKCQVSVVPLGRGIGEAVCQWCVRSVAAWLRGPAPTCPACPCACEAACALKNAGPLLVGVAMCCGAALEGAALRGWHGMELVAPVVISLTPRKSTARFPAWWRKYGLLVGRGPSLPTVKDLVEGWCWVKDACDVRGRPCPLSSVVGYTDLSGVVLLACVTWYRIGFYGGYVCVAGVYAAVLIDLMEVDGVDPCADRRIREPVLVVDVEGQWSELPGATSGMFVVRNRRELQGNVKGSPGINFRKRVATRVRANTHSLTERPQTRRGHARYTLSGGRNSHKHPATHWGGPHTE

SEQ ID NO: 977187 - protein, 144 aa, Homo sapiens
AKTLRSCIHSPPLSECTIISLMTGNWGPKKLDLGGLRIAVGRLRGPAFSLGVHDPLDQWFHTGVNRKPSGSTTWRHERLKEKNKNFFGTGASRKPTFCKNTIPQKGLYANGGLFSSLGPAFNSYSIALGKRAYHVAYPPLVGGA

SEQ ID NO: 977188 - protein, 286 aa, Homo sapiens
LDDEDVEELRGSSEGGMEMRAMRQRDREAMAGAWARMRAWAPWYDSDEEDEERACPQAPQGGAGPRMDGRSDGQRMMIEELSEMNAWRDSQSAHSCALRWCERCAGPPAVRIHHRFKNFLRTHVDQSRHIASSGSAFSDYVLEVEACDEPGGELVRDLAKQVASVLVLSFLYCRAPAGAACYESLMRLHCGGGTGHVPQVLTHHNASSVRISHLPLVEELGSLRQTDLDEQLIRPSGVVTMHWVPAQVNMVTTSANSANFVPGVLFANRKREVKQGPGLIAMAGPF

SEQ ID NO: 977189 - protein, 336 aa, Homo sapiens
AHPEWSDRVPKMRLECTEPWLNPGVPVRMGTTLLYQSITYQAGEICCACFCLWTALTLSDEVTITCVPGARTLPQWTSQPSYSGIMGLQMHRSHLQAMRGKGGILCLWCHPGCLVGLCRWYSCEWRLHLRTIHSFRVNVRVFWLRLGLSHVLHGPNHSWRSGLQTIRLYERLGIRGSMNVFASEPRELQLQEQEAPPLLIRAEGNTGPGLWLPGGLLPGCVNSLPIPRGGFDWPGDPDSKYSKDSDGQSSSSQLPNGGACPRLTGLDLGGGALVPLDFGGLLCGTLKGGAERLSPWGKRVAQMVGLMLSPVWCKLVSACASALSNQSPCWVCRNLS

SEQ ID NO: 977190 - protein, 69 aa, Homo sapiens
GRTESPTPAALMLLVGGGINLNEIGDPKEGCVVEDGGWLRKNVLVVAAVQPLECFVEVFGNSLCLTLAR

SEQ ID NO: 977191 - protein, 104 aa, Homo sapiens
MNWEPRPILTLANHQARKPDEGQHQWATVDASTKGHSNVSPARSTQQRPHRDSTPRANHTKGPVTRAPQHVATTATTGTPPAGTKKPRPGTNPLHSTATPGPFR

SEQ ID NO: 977192 - protein, 170 aa, Homo sapiens
MGPTNNDVISIAVGQYKGADNIALTILVNCSYTTIFTWRRVWMTSSFAGERFLAMDRYCPVGASNRSRGNLEPSYLVGFRTSVRVCLTGHSSTVLSYSSLLALQDAQEVKLGARPVICDLADSGEGSPSNLLPAGSWGRLGQRGGYPYPREPFWWVFCWWSWPKDYKGGL

SEQ ID NO: 977193 - protein, 173 aa, Homo sapiens
VILLHWWRWKNEVAVQLKQDHAVLMSFLWRNVKAPQKEIVEFTDECCCVTGLRMDAARRAVDAGRCVATRRDRPALQRLAWCWGNRNVFVDGRASEVKTPGAVLVGPSTLSREDPLVELLSQVEPSDGSELVSACRGCERRRRLAEIRPYPRGVSREIRSIARRAFEHGGKWE

SEQ ID NO: 977194 - protein, 72 aa, Homo sapiens
MLRRIGRQERYSKQHSRGSVGRTQTTYRRSARTTHVDSETNHRRSNPQSNDRTRHQPTHMTQTHPVHHTHKH

SEQ ID NO: 977195 - protein, 102 aa, Homo sapiens
GVVQALGTAACPLRAITCPQSVGGLAEAIGGCSGCVEGEKPSSQGGKGMEARVSQWVMLLLHAFNRYPASLQSRRVDHGVEAKRAPMPTHSHPPRHHLHMWH

SEQ ID NO: 977196 - protein, 85 aa, Homo sapiens
DGGINSLSTLDTPSTCLLTYTAHILHVSPLMKDSREVRSCNMSGLSLACCKTYKLTMIVATSYFAYAHILLMSPYEYDSHVDTTH

SEQ ID NO: 977197 - protein, 326 aa, Homo sapiens
MGATPRECVPVRTEDACEGLAQLLVSLGDPSQETATRRADKAPLSAETISLTCGPQRSRGGTPQAGGHPTAPYHERSPNTFNTAGAPKNKKSPRKNKLQAVDHSKGPRTGVSPKLGATQRPSSNAQRPSPSPPSRKQTSGTHNSGLRPPRGRRWAPTTATRSHPHNQASSRQKRPHTTRHAKYPPQNKVAPPADDWHTAHKQQPPGSTGATATPKKTPRLGPPDQHTGGTTSNTPTANKTRRSPTTQQARRMQHQGTPDLRRAAPHENSKQASHTTVPPNAPNRRAYTVLRRSSTQTANHGAGQNDESTHTNANTTTNDSRTANTQ

SEQ ID NO: 977198 - protein, 170 aa, Homo sapiens
MRARRRRDNKRETERKRSDTYARKRGPTKQTKNTRRERNEKTGRTKKTKRTSKRSKEQRERKTKTETRNTHSRRKTNTDTDRETRENEERKKEEQKDNKRKTKREENNKQNNKKKKETQQTQKETRTKTKEEQTQEHKRTTQATAQSTKKKNKREQTTTKNRRIKKTKRR

SEQ ID NO: 977199 - protein, 272 aa, Homo sapiens
MSISDEVSWISWFCGAPWQMNLLLVKLDEDYVQVKCESLLDSDERRSLNYAEIAHRHDPLDLELDEELEAEPMQRDLMEQRGEMLYGGSRPRTFLPTVDRPDVGKVPARRLGYCPRVYCEKQANAFQWVLSDIPGEGMGEGSNAQVMDVYTAQVIKKQQQGMGPTSALVFLTCLHGASEYGQKTASNCASLVPDHRWLQVGQRERIRTQLKIGDSSHFGIGFFLPLGPLVSYTAVWGTAESEGEKKTGLGCKVMSLSPYGCACYGYIYLVKT

SEQ ID NO: 977200 - protein, 122 aa, Homo sapiens
MDIISEGVSGTFRSESHKNKALNAITQQTLTAIKRTPLTNIHDPSTTPVTRREQQQTTRRARRSATRDRLGTEWRNRSHQRNNMIDHTTALHTNRRTGGPHHQATQCTNQPRPDDLEMIDIK

SEQ ID NO: 977201 - protein, 112 aa, Homo sapiens
MWHHTVSDDVSMTFITSKEDWTGKEEEDPMNKLKGQKNRVLRICKATLDHPCPTMIRWGPCRKELGRASGACSTGKRRKLPGELEAVQARRTDGSMCRELARGQRAGVMQPR

SEQ ID NO: 977202 - protein, 96 aa, Homo sapiens
QAFQGSGSVIAILGTKMFLGPWRTWRGRDPFKTPHAAVGATNGLGDLREKIPRGPRETRPSCVRSQGVGSAADRENEYSWEILSLRESIMHLCGIW

SEQ ID NO: 977203 - protein, 163 aa, Homo sapiens
MVTQLCSPDVGAVARHSEGCRDGRTRRKAGFQGLPSRMGTRRSRGVPSSQCPDLRRGQLPHGRAAPGLPISGGKGPRRILYLGEPPRHGAGPTGRGLHDSIGPSGNTGRTSGPNARPTGTPLCQHKHPSGRSRPRAGLTLQPREPFTRTAGMRQHGDGTTASG

SEQ ID NO: 977204 - protein, 145 aa, Homo sapiens
GWLRPVNGGFHVGVGEGAHPCPGGVPPVKDLSRRKQCPQVGAHLVPWVLLWSPTGQFWGLVGARAMFQSLRLRPRCSPGWLGRLCARASRAVPHFGTPSSWRAKPRVSHLARGKRRRPLVRRGPISPSMDECPRGKEMVFWEALI

SEQ ID NO: 977205 - protein, 113 aa, Homo sapiens
RDELDQTRGLLGNDAIYNVIVYTHQCIVIIFFIVIPIIIGGFGNWLDSPNNRCPRIWRIPRIRQQYSFLTSVAPLSPYSVLHSCYSGGRMQEPRLNQSMPPLAGNLHPDLEPP

SEQ ID NO: 977206 - protein, 179 aa, Homo sapiens
GGARWLSPPPGMAVQLLEEKLTCAICLGLYQDPVTLALRHNFCGACIRDWWDRCGKACPECREPFPDGAELPAWQRGPQLAVLEVVLRPGSVLGSRPPIPGPVPLTLRLLTPARWLCGGSLLPGPEGRCVCSVCTVRECLPSTSGRCLDAERLKARGPAEEPGWRLPSSRVTPVAKASY

SEQ ID NO: 977207 - protein, 73 aa, Homo sapiens
LSPSAAPAGTALAPSIRLVLIASSRRRLPLQIRHHDYLPGPTSVTYEMFSARSRRSGRSPDGLCLEVEGRDGQ

SEQ ID NO: 977208 - protein, 113 aa, Homo sapiens
MGSKIEITQGINIRHRTHPDKPIMHELTLNPYATRLIGTSAAARPSIRSPAKKRAHRRPTHNDARLAHQTHKHRSNPPHNKRAHPLHTPQTGEPPNTQPDAPDSTPPGRVRPC

SEQ ID NO: 977209 - protein, 169 aa, Homo sapiens
RRCSAGPPETHMTHQPISDHEATLRCWALGFYTLEITLTWQWDGGGPDPGHGARGEQAWQWDGILSRKLGRLWWCLLVEELEDSTCHVQAVGSVAKRPLAHGEWELSSQTHQSPVGGHSLLGWFSLWSCDHLELWCRCRDVEEERAHDEKEEGRLAESRTVRSDSADGL

SEQ ID NO: 977210 - protein, 220 aa, Homo sapiens
WGWGGRGGEGGGVGEILLKRGGGGCGRKCFTKCRGVCYWIGGSRGDHGGCSCLCHLHKKTMVGVKHSGRLWSAPQHLCGGVLSVVRFARPSLFVLLQEIIVVAWRGRAHHPTTEGVVCIHAAIQTNTQGGKDGAAWTGVSYHSRFNPPSARHSTMRAAPSLDNPRYTRGRPSDVAPIVAAVGGAAPPQPPPRPNGRRLRGGSAITTHRGGRQPGRKTTSS

SEQ ID NO: 977211 - protein, 309 aa, Homo sapiens
DSQLVGDGRRRTRVVCSCRPSPTLDRLLHICDEVQLSIAAIVPRAGSPSIGKRLARQLYVVWKHGIQARMAAECTSVEVSHWGVRRMYCCAVPILQCEVGALWNTTGVPTSGVEGSGKEHCENPHELSWHAHGIGKRGTPHIRLAFLHTRIGDHDSIHPWCQCGHELLRTIELVAPKGSTYYLICGKGKIHIDTLLVVGSRSKPAKLALDSGCTESFRGTSMVCMHITTIGGVANLVTESVILTHVFTGLSTRQFDLIVRKTSPKPVMFSNFIHMIPQGNPQGVRMEGLTSPMLQATKNSLEGTLIGAF

SEQ ID NO: 977212 - protein, 276 aa, Homo sapiens
MVGKGRPTKLTAPVNRMAEDAHPQVDIATEGRSTTAFETIPPSLTRDTGTDSPKERIIQDLGNLPLTTNRKKSENAKCLTSTPFTYEHKTCNLREAYTGQTQWNKDWFYPSRRIKALGGSGIYIPPIVGTSGHDFEARRANSFVNRSSQNHNKKGRLNLNALQDVQHPDSTVICTISDSGFPPTRQNRERSAKSYSQQVSPKKITASRITTHSEKDRPWQQNSGNRAPETQNGRKGTPPGAVKQSPAKRAHNEQRPPLPPDNSGRKEALHQTTRRS

SEQ ID NO: 977213 - protein, 245 aa, Homo sapiens
GRTQVMPGGLPVPEGNVGVHTIASGVDCGLLKQMKELEQEKEVLLQGLEMMARGRDWYQQQLQTDVHVMLPAARLVPEQSHAPDFVVLQGAPAHWVLATCPRYNECGPGAWVGAAGCMPVPSLVPGPVLTPGATLALPYVHSHPGLAAGEHPHAEGAEPTPQPGGEPRRVRCITAAGAGEVGLIKPLFEGRALSQEDGGALDSTFIYILVGRVRHQGPDLGISPSGGGRPHEANHSIGGDHAEGN

SEQ ID NO: 977214 - protein, 201 aa, Homo sapiens
GFQGGRCAVCALWSECLLDENSMLIPICCGGALCVWLVLICPHRLPLSAVKRSHAGYQTIYLVHAVHRQLQWAYCSFTLRLRVLVERGGTLSWQTSLKSASSNVTVHLAAYYYAQQSNYRNDWCKFMLNWVHTIIANCVQHIQSSTQSTRISSGALVLSLHAADGMPLSLDCADSFLPPSLTTIKNKALSTENIATISTIT

SEQ ID NO: 977215 - protein, 283 aa, Homo sapiens
MYTGITRTTDNNEDSNLKKMRSETRKKETDRNDTATVKNTNRDQNRHTDNAIRKKKTRRGSKQRDTDTQQTTRERQTRSDNDETRNRDKGTRDEATNGGEEGEGRPSGERRPWRRRGQEPAEKGREHAGEGDEKRRAGQAGGGRQREEGQGGAGARGAKGGGGVRAGERRRSQVASEETRTEEAGHTGEHTEDETGNDAASEQQGTGAEKQQERNAIGENTRRPRERAEEESRGRAAAGDRKRGRDMTRYSRQRQGTAQGAEPRVGGTQRKRAESQTPRGKMP

SEQ ID NO: 977216 - protein, 169 aa, Homo sapiens
MAGEQNDSSLHQWLESEKASSKLKPQHYVLASPVHILSWSKAIKAAEASTWFRAGRARDSLLDQRLGGLIKRMSIVRGWGRLRIRLGLTMVCRGSAYTRGLERSLPTSLRERECPDNSWFHDKHEVPEECMSRELERLSLKTVTVCWFSRGFTSKNEAAAKARLSEVGW

SEQ ID NO: 977217 - protein, 129 aa, Homo sapiens
APSDDIEEVSQGCSGCWAPIARRRSSEQVWGRHEQVVELVLETQDGAEKQLGEILIMEKEVAQSLRQNAEGAGAPGMAWMLQQAGTLGFRRLGRRTPVVKGSLLQSHHEELVGELNEIEVDLEREEREV

SEQ ID NO: 977218 - protein, 174 aa, Homo sapiens
MPLLKWVQMRLNFSPGLSNANDLGKQHGKSPFTGGNGYHQGPKDDDQTLNVITAKWHIPGCLKIDPVVILDLTVPLREISSGSQGKTGSPGNKFGAEETAASTLSFLTTKLRIKRWPFLSVIVHDKLTHRQTTVALICWSVLIYGQQCYDGSRHTVSATIREEHLQRNTAPYCE

SEQ ID NO: 977219 - protein, 93 aa, Homo sapiens
MVQEEYREKTWKESGVNDTGTWYGPVQQASTLSKLKQQPNICPEQDLQLKFTKRTHTRIPLAVTAGHRSQGWAPIIVVGPWTLTIQPRTGPSG

SEQ ID NO: 977220 - protein, 394 aa, Homo sapiens
MGLVFSKGQPVPSSSLQSEYTLSELATLTERNDPSGVILKGPQSGWDKPRSAKLIPGEVSRERSDCLSRARRTIETKSSRLVEIVNRDGGRTSYGRLHESVICGRSLPRVALGELVVIVRQSGAGVCAVLQDSLGNGTTAVGALGILSNGVTRPPEVVTLLGAITRGLCVSVAFGPAEQSGRLSLDLEIKSIEAMEYPGVCANTAVQDESHSEWVSCVPFSPKEEPIIVSCGLGQAGQGMEPGNCKVKTTHWHTGYLEHGEWFPNDPLWFGGKKAGQLGSTKGTLYTPGGKKSRLPHQGVAPNVRDRSVTTHQDARRLILLDMIVTKNRALIPPSQCTTTNIRRPYTIRKTIITMNTHNNTPKPNTHHHTTHTQHNRKHNNTHAHHRHQQTKQS

SEQ ID NO: 977221 - protein, 415 aa, Homo sapiens
MWAMGGALVVGTLALPCVGPTAAPRCRFCLGIGRRETRKVVPLGGSSDRLRRKFHVHRLGPLALVGPCVLTGPMGVLKQGRGPFGCWSKRALWPGKLGQTAVVVAFRLPAMGTFNSKAPARNSHRGVDRKAGDSHTLTSLGSLHPNMKLQDPHGIVGTWLDNNTCSLAYVNPPRHTPYNVEAQVTSPYPGATNQQWVEDQQGVIERENTKKEAPHQDRGDRKTVYSSNPHMDALEPVVSQIDHMRCIKRNYKQLVTYNGDAPGCIYCEYIVDFQLRTNRVCDHTSAHEQHTISCVHQCIIRLKRVTHTQHDARSSDTLEERTRNTKEDQSRKKKPMTDIDTPYQSRPTETKLHHSPASTQPNTQTTEGLISITHTENQPQSKAENRSCEAHTSSPMSGDEETTRTPQTNMHIYLQ

SEQ ID NO: 977222 - protein, 123 aa, Homo sapiens
MDLMRKKKLYCIYVAIGRKRSTVASLVTELTDADAMKYTIVVSAYGLGCCPRSDTWLLTLAVPWDEISRDDGKHVLDRSMKTVSKRLFGYRQMSAVVADAPGPEDYPGDVSSYIAVAGESTSK

SEQ ID NO: 977223 - protein, 72 aa, Homo sapiens
GRQDLTSSSEPCLCASQHLAHTLQTGPMVWCLRGYKQFSVGITFICCVASYDVHVCAYHASGRGSISDEYCL

SEQ ID NO: 977224 - protein, 282 aa, Homo sapiens
MLEIFDTPVMYVAFQVVLALYASGRILAIVMDSGVRGSNQQSVPIYEGYALPHANAMRSGPWLVVELDRLNFMKSPLSDARIESSYIQGRAGKFVRDMSTEKLCYRSSSGTIDAVMNGTPVDIPPSCILGSRGATKSAPNGQSHHHGTTEAVSGCPVMDRLFQAYSISLGDIGIPLDVPSRSDGSQPFKHPNSSDTSFERWGNHFSEYKSTLVTATRTTVWLVRVTGYLNPELINSQGTMCQNERIATYRKNSPGTRDVPEDNIDKIQEFIRIPAEAPTLLA

SEQ ID NO: 977225 - protein, 153 aa, Homo sapiens
MRRRENPSLLYASGSLNKLIWVAMDHYYRDSSTVYVMTGMYWGDPFWKWVLENLPWYSQHGDGLRELVERGLLWALEVTCYQESWGMESWDFCSFRCGPGAASVDPIAMRRELAPHVMYLTCGADWSNEGLAKGRSFALLAGPVLDNVRNTFW

SEQ ID NO: 977226 - protein, 252 aa, Homo sapiens
HHQHPGYWYRDDTGRAVVSKLGTMQIGVKGFLDALQNQALRPAAKIIGQLWSGFSTQLSWWLTRVEVYSRSEGPGSLGYQVAFRWFWSVLEIAEASGVRTGTKIIIHLKSDCIGVVPCEVRGARCGNRSTSNFVELRPCTMNGRRMNTWQAIWMMDPRDVREWQHEEFYRYSRRMAQDKSAVHPVAIRRTHRSTSAASSTVPDMKPSMFDVSRELGAQRCTVQRKSSSRPMPRTSCQVGGFIRGVVQAEDIP

SEQ ID NO: 977227 - protein, 472 aa, Homo sapiens
REVSQKVLRLPEYMVSLELPASEAARAGIVGKVKSYPKDDPDPSRSTVTGLPGVVQRLAMQLTIGGGKSDDGRGSKDEIRRNGGGERLVNEWSENNLSDGWVRGLLWRAYVGNRLVRASRNLQSNGLSCSTSGDANGRVGVAYKNCALNLSRNGLITQCTEQKMVGVMAWTKESDYVDDGTCTKHENTVLRTVNPASVGPSSQYDDLLGCVATRKLGNLDGRIQKVSRRSTRGRRNPELGLRRWIELGESLVEPKMFGLRVTDPPGYRVPPGKGSTATRSVQGAPVMGPNPTGREKDGKGQTGGATRDGKRRKQQRPTGEDTLAIDRIYTDTIVVCVWSTADSHHRSSTNSANAQRQHSNPHHTPHTRTTTHIRPNNPATQTTTTPSTTRHAHTRLHPPQPKRTYMKTTKDRDDTRHRDGSTGPDTAANRVSKTCEQKQERKERVQSDRRQRELYDERPNQALERRKRDDEL

SEQ ID NO: 977228 - protein, 306 aa, Homo sapiens
MARGWLLCDACLARVLLRAGARIAVARTPRWGERELGAEASERDDWADAWRDFREKTMAGVAWGVSLERRGAEGIRHVIDDCKKPPSEQAWGLELLDGVLVHLAAGKKDMEESEQTRLSVDGGFLSVGDRHVDVVLGEREMRSWMDECAGRDVTGDVVLGVICEEAGSRICGACWVYHGRAWDVCDLTSIQQDVLPQLETAGMVGTEHVTYPHPVLDNSPGNCLDSSENPSWGISGRFLGLNRPPCEEQPSGTGGGVTVAIEVGALATRRGKGLKGGFGASGPGEQVRHVGYETRVVNQPLECRMN

SEQ ID NO: 977229 - protein, 317 aa, Homo sapiens
TKSEAIELEDLLRYSKLYRLGNTARHPDGEAEPGKLSQGPSCVQPSPPPRVPDPSSMPHHAPLPGSQGVQVVREGPGPITMFPWPQSCPASLHHSYREAPHVRLFARSLPKPSFQGSSPRRTSPWVSSQEAGPIRMWDSGLCRGLRTLCRHSMCLFLLLMRFPAFQPSPDLRSPRAPASVMACPSRIPAPWALRPVLPCVLSVPVFLSLCSRSLSLFAVCVYEMCQMSEVCGRGPADILYSLRVCAELLQNRQRWEEFGLQTALGVGDKAFVCVTLRQPGHKPEKGAQLVGRLPTFLRIWGAHPNNQQEGTHRRGPI

SEQ ID NO: 977230 - protein, 39 aa, Homo sapiens
MNKHKRNRSDAHKNNRGGTHTTEHPDHEPTDPPTQAPTS

SEQ ID NO: 977231 - protein, 154 aa, Homo sapiens
KINPLIKLINHVTHRSPPARSKHLRSDDNFVLTSVVAPALSPRKITTGAYSVAMLLDQTHSIGVFIIERTISVEEVNCMAGIIRLHLHAKWGPQYFVQSASSVAQSGEAVLLAVSVVVIRQETVKTSAIISSCIAMYEQSSPCIGVWSVAVRPK

SEQ ID NO: 977232 - protein, 459 aa, Homo sapiens
RERTRQRLCLAFSYFSPLSPFFLFFCCFFSPLPPLHNIPLGGGFHRGRGQSRVYTQGVVTTRPSGGPQMRESGQPQAHNTGRLESGDARPDEETEERHDRGKKKIKASHASTKSERRRTEVTREPTRGRGTREDHRKRKYTTHKTARGERKKETTIQRKDREPETQDTRPQTDRGTTPNLRRRSTWATAHAQGVVTNMGETPPEGEDRRGATPTKAEEYNSEQDGTNTRRRERAPRVTNNEGAPQERADSRRNTPGSQDAKTRGSRETRTERTDNDPTNGQLQQTRTRKTEEDKKKERQQARDRTGCPPTDDRATERTKPTANRDRHRRQPHNKTLTDKNRREPRSKRQKTTGHHPDSVTPKVDTPKETECRKKCVTKTKRQAQSTQEDNTETSKGAQAKVEHQTDTREERRREKRHNTRQTQENQDASRTKQEATSNEQAQRRREADKPEGYTQRSED

SEQ ID NO: 977233 - protein, 394 aa, Homo sapiens
MALTRLFYLGLLSYLRTSLRAEEEAEIPEISGMTVTWLSIPKRSLPRYGYRNRLEYLGLLEDFGDGGACPVDPCGPASPLDMGRKKQKCRMRWPCQVDCCRKNEIRCKLLVRGQVKGQRSVDKQNTVIVVPEGGYEMQMIREVQRADEEAMTRRYPRKDKSSLRKICITEGRRQHAKFEQLTNVAPAQYIRYTPSQQGVAFNSGANQRVIRMVETATRSNWSLQGFTITEDNSPENNFLAPATGIGFFLAERMTVNGTKAVEDPPWDCLKCDNCTRVLRVPSNKRLLLTEHDTDSHTYAPRPQRQKHSTKRNRRLRNTGNGAPNAAKEPNKQTHEKPTQRKAATTKAHHRTQEEQHRKARGRRKRTHQTKRREEMRAPQNTRRRVDTDTTDHSS

SEQ ID NO: 977234 - protein, 207 aa, Homo sapiens
MWKPETSRIPFRRAKGRPGGPRLGVGIPLIFMPQRVHEGTEHSEESLASADKGGKRHKAPNSLTLPRMAQLKGREDCHMHIAGGRAPTCRDTGTKHTRDRTTRTQKRFEETATAKRRQKSTRSPKLAGPGGSKLETDSNNNTAKWYNNAVGQKTASNTQHAVPKNCKYNTQRSYPHHPTPPPYREANTEQHSATTNNKTAREKHKHV

SEQ ID NO: 977235 - protein, 583 aa, Homo sapiens
MRYEPGIIAARQCSRRGSRMSRLSVRGPARSCPGVERAAWRAHLAADGDALEIVTRDRSGGLPLSEIELSLETSWYGKYLTSYAEKYAHASDRLRSMSQQNATTIACTPRFAYKRKSSRERSMMSDLTEGGRKEAPFACAKPAADLRAFLRRLGALTQSLCFAGQDPDGNVSAALQDGSRCGRAQRWRVLGGGRGGNEAKGNVEAIFTPILETLPSPNAPLQEVPHGAKNLSIGRDNPLIRRGVITIEIPPGSSLQDLSSHFTPLRGILEYTTYGTFAQSHAAPPLEKGRSPFSSFALCPKKVALVIYTTFTVGGHRTRVANRITKRISDGKQKQRGDTIQSPEVSTTNTRQQQTKAAKMGQHPAQRPHKGIYKQRHRHKRSHRGVPSQGNGQITQHITPKHWHTNTAQHTEQQAPQEQRLRGHKRTTRVSNQNPGTYRLETKRAPLMNTTNHPTLTPKAEQSDKSPKQTNQQQNTRGETHQHEEGQTTRTPHEPLEPQKTTRNKYLHQKSHTTGPTKDRKKTTSSSPDKQQHNTTAQPKRAETKTNTKDNSKTEKHNPTTTTNRRQRTTHQQHSKSTTNNNT

SEQ ID NO: 977236 - protein, 522 aa, Homo sapiens
MTHMAGSMPKPSLHQPLTPAQDEAPRAWMASHPLNFQTCEHPRRKQVAPTTRRSEPINGASPKHHHTHHEHGDSHNITPSGDQERHQRDMGTIGDDGIIQRLPTMTPSLIMTHRQDRESWQTIDISFLEPYKTRESLDEPYNIYILATRPGLNRETAEERGHGRRPTCRTDCRPRSHQQNIHLKDPTSTKTQNRYDHPSDTRPRATHTMSATKIANTQTNTSHARGRHPYTHHEKVTTTGTTPRTTHPPQDIEHHKAARPQDPGAWREPTAHRQPTTESRRTPPTGKQPNNTRTKTPRTTPPHDPTETTQHKTQNTRRKTKTANKTPDPDATTEQRPSTRTTRQNKEHATQAKQENKPAKKLRPNQTTTTPDKQEQKEPNKQQQQPNTIENRTSKKQEPKEHETEKKTNKAAEQKPKRQQKTKEPRRKTKQRKNNNTTDSLSKPTQQRKARKPKKTHNDNANTTREQSTQTKIQKQTNKKKKEARNNTQQDQKQKERTRRNTNEKYDKSNKKRRQRERKLTK

SEQ ID NO: 977237 - protein, 201 aa, Homo sapiens
PKARHGMTDAVFGDPAVFLEQFGSVGCALVACCCRLLDCGACMWDVSVWCLAAVCVCALHVAFTGQDLNVTMMLWRSWVASCVAPSPAPLLGSMCLCSCLSGFPDMLSCPGLLCPTMLWDSCAVLFCFHASPCSLCHPWHVLLGHRGGERKSHCFSLHWPPVLVKDSTWHAGPHLSLPGGKGANWTAMPSSGGFLRTYSMT

SEQ ID NO: 977238 - protein, 482 aa, Homo sapiens
YIGVAQKGKEALIENHSRGTGHPRGEGRGPRCPHASDQESKEAGGETTRLDMAYTRDSKANTSALLPPEEENKSPRGVVNYKERGEKSGYSVSSARRFGARRKLEGRGDGEGAIPRPTRGALKGKDNKLGGAVKKENTGQRGGHKAERTERWRERLRVETLEHEQRGGDYDPPEKNPAAHTTSGCRHTSPQGGEYKKSYMIHNHLKRRETNLPQTGTPTNKIYKGEDTKTQRGEQHKQGGGGDETKNTGTTVAITDTPESKNTHREPTRKQRSNKGHQIDGVPPRAHSWTKSHTRSIKKEPHTHNDTTQLHQRAQKTANREKQQGPPSRDNTNHQDTPTHSESSKTRRNKDPANNATKQHTPPHHKTVDQKRNKNNTPQTTQSPETTTKHEANKTHGSTSETTTTDRAKRATTHQTLPQGKHRHHTPRTDHKQPNTNPQAAAPPQKEATHSIKQKQTPPRTNDEQQTHHTSEVGDPLPPRRQ

SEQ ID NO: 977239 - protein, 115 aa, Homo sapiens
MDLGTTYSWGGCSSTEKSDNAAGFGNRTSSRVAKDTERLNAEAGKETCGLTPQTSPGCQRLRRKKIRAPADKMGLRGDSLGRQAKTRETKLPGGQVDQKNDPRIKCGRGTRSRHK

SEQ ID NO: 977240 - protein, 257 aa, Homo sapiens
NCACSERVVCDVMSSCDTRRSWGKEKYGVDLDEIKPSSAPDLQGVRLFADYLAQQYRKDEIVVEMDREISRTVDRDQYCSIPVIMDDSHLSRTEAMNPDVRPCVGKNHQWWNIAWEMLPSHEQVAGSCMKHGSRGPRPEGAEENARTVGGGCPTISQFANAWVRLEHGMVRKREDAYYIFQEMGDKCSPTLLLSMGRRLHMAKGRWEGVRACEEALDKDSWATPENGWSNLIVLLPGTWGSPPEVENPIPGPGAPIW

SEQ ID NO: 977241 - protein, 432 aa, Homo sapiens
KKPLAIFGFSLFPKKGKYFSGVHTRETGAWARAQGCPSTNYRTQGEKGGATGEGSKDPSQAGPRVSLSLAPPTSRKSWVLPRPGTRQDSKGGHAQDRQTRALWVSPREGCGGEVRGWLCVWSPHLARRWAEVAPMDWRFGALGRIKHKEKIPRGQDVCGVPNTQYGGPTNWANLPFNKGGAYMAPWSKCEDAPTWQRSKKTFSEKHPVGVPAHHTLESRLLGNTVIPRVISLNFLKKHIAHLYKGIFGPPSFKQCGQEALGTTRSGPREVGPLRRRGALESKGSIGGDHLVDAPKKMHHDLCAAQNTTRANKTPLRKVLLRKTICTSVTPKGEQAAQGPHRGDYTPNILEKRGQTRTLQARPNRQKQKKERRKQSTKAATREHPTKHTRPGTQDDDSESTHPQEKRPKDPKQRETTYNNTRRRTTRDQATNS

SEQ ID NO: 977242 - protein, 336 aa, Homo sapiens
LPHCCCCWLLLLLLHRIVASPSRARRRYLLGQKYMNKHQKPVLTGQRFTTAEKGGKREIQNPQSSRDTLVQELNEAGDDSWKLQPNFWTLQAQDYDYRRLCRHTLLISWWRRHGMLAPVEERCIDDGDEDQDDQPLVCFQRMKIMKPSETMLTVFNYTLSQEINVLRENGVGDPVRVAFSGFLRRLAEADQTQLAMLSGMLLGKCTLPRIITVSSRKLVKNGLRPFCVTLSTLRGEKRCHSVTSSSAKALTQGAELFRTKNGVPAKLPNPANGSSLEHRPATEIVWSQVFIRKSDLNKRTHRGAPTHTSDETRLTHSGTHTPKQQLISLIDSPYSE

SEQ ID NO: 977243 - protein, 275 aa, Homo sapiens
MSGERGECPLSEDGQTRQRERPQKRGERIPTVCVCPEKYAHRVCAPHNVGNNSHGWAPIQWVSLTQSGRDCVVWEQCGVHTMIRVRGALIHSETAPHTIHEELEHQGDNTDCVNTGLVAKTRPRTQTSCLCAKAVGKHPKCRKEENSTTWGPRGPQSVEKVDVQTEKRNPNKQVGQLKTPPQTEMKQDTVDPRRRTEVAKVEHHGKSPPQQNKREDKKRPRDTQNNHREKEQTTATKREPTSHTKEETVKQVYQKLHESKNDEQGTENDNDRQRT

SEQ ID NO: 977244 - protein, 108 aa, Homo sapiens
MSITRGGGVEPQFVGETLWGTPWWPPLGDATRNGWGHWRLYTKKLCGVSPHKNVSSRGGAGDERALLYPEGPFGERKPGVNLSWGVLTKKSGENQRAQVPPPSDRVAR

SEQ ID NO: 977245 - protein, 297 aa, Homo sapiens
RKRMAKSVCAMSAGSTSTGCIPASTVSSSGVAQRTSYSRRMREAKTRQRWPSDLMYGGIYVLTVPRDYFYDIDMELIAKEDHRTQLGQMPGGWERSFHTLGTQLKNGELELAEAQPEKETDHLRTGTIGLQLVLINTWEHDASGTAVVAWPCNPDSAQFLRETSSCLTGYLLEISESPQTPVVVCEMSSLFHGVLLWTPGPRLYIPYIVAGPGVGPHVEAPSKVYERAEKPTSSVIAVLDVVHRQCQVDAHGEAGKKAINGLDHRPDFQAGWKQEGYLPSLQGFPHKRPFGPVGSRA

SEQ ID NO: 977246 - protein, 168 aa, Homo sapiens
MCASENSAGFLTHIPLITFEVQAVITLWGAIFLDPGYLLEQRRRKIVDFSSIQCDLLGRLLGCGLYPSGLPMPMWLPFRGAKGVFPGSSPGQGRVTGLRMISHLVMSSPDLLTGVGMGGFHGSHWGLTRPSSLPQRRTPRGEAFLKLSIIMGGAPFPPFFWDTQGIGL

SEQ ID NO: 977247 - protein, 192 aa, Homo sapiens
MRAGVGEREVRVRSLCGNAGKRHIGGPIIRGTSQWPKASDNEGYTMTEDFYKLLALVTIPAGKMWSYLEGCRAGPRSVRIRRLKAVPRTHSKGAEKQRIRVPKRLCGSVAATVQPVWTNHQGARAATQAPHIDNFATPIQPDRRKHHLNPPQGQSTTHGTIARTRFKPAGVHPPKPRREKHEPETRGPRPTL

SEQ ID NO: 977248 - protein, 106 aa, Homo sapiens
GNKVSLGHPGLGCTGGSILGLTGGVSASRVFTAISLWLSALANVGWEIWQAPATTPGLIFWDIFRIRSTGVPPWLGQGWALRSSCDPLVIHLASRALPRGGNFQGG

SEQ ID NO: 977249 - protein, 155 aa, Homo sapiens
MSPGVDDWRSTWDVPLRLALEYTEQTYEIIEEKTHLSRERRYKTHGCHNHRTHPTTTEKREHQTNRETKLAQYRRPQNTIKGRKNQQRGGEQQQRRSQQQESPEHAHPDSTRLKGERESKQTRQQEKTNHRTEQRTTHTTPHTPQKETRQNTKQQ

SEQ ID NO: 977250 - protein, 104 aa, Homo sapiens
ERKIRKLEKATQELIPIEDFITPLKFWDKARELVSGGRCILLRRLTRRALLSDRKWSCVQGMQRRVTMERDIHLGAMLEGQQEALEELELESPKLHAEASQAGS

SEQ ID NO: 977251 - protein, 220 aa, Homo sapiens
MEGSSTIRTFRFEAKASQIMKIINITAVREMNEPTDDRMSHVVYCIGVVRVTSGHPDRPRKCCGKNVRFDADEYDSEQGFGRRKGLGCTPENEGNSVNEASYEGKYRSYGSDIGERELQRSTCRCSTMRHRGRRVRLLRRKSAANALRWLLPGGCPKGESSPEGKDLQKIGDQLGIRGDETGQTVSGGDGNLESLAQVWSCSPVGGDRLCQLTRCLPVKK

SEQ ID NO: 977252 - protein, 170 aa, Homo sapiens
ALLNSVPPPAPVKRGMRERSPRRLSPKYLQPRSPEECKMFAMLQSSSLSPPSLDPTLDSRGCIQTNFCISVISIQEASSDWRGLYVYLMGPSNWCVSANPKASFHDQLQSAETLILLPNLLVHGAATVGVAGSGCWYWNSLWQALSLAYARNPSLKQQLFSYAILGFALS

SEQ ID NO: 977253 - protein, 268 aa, Homo sapiens
FRSLAWQSLTHRRDAQGRQGELEVHTYFLKIIQLWMMIRNVSFVGADNVGSKQMRRSDVPVAGKAVVLMGKNTMMRKAIAQGTWKTNPASGRNVLPSVSGGMWALCSPGGPSADIRDMLLANNGAQLLPVLVPLHPCEVTVLRPEQLVSGPRRLPFSRSLGIRHKNLQGTMEILSDVQLIKTGDKVGASEGTLMNMLNISPFSFGLVMQQVFDNGSIYNLKCLISQRKLCILFLEGVRMFAVSCLQIGTQCCISTPFYHQRYNESWLL

SEQ ID NO: 977254 - protein, 47 aa, Homo sapiens
MRPEHRDEALIHPTPANGDRFPLAVRLTSVELGHFLHVSLITTPITN

SEQ ID NO: 977255 - protein, 221 aa, Homo sapiens
PPYSFFFFGLKTLFGAPGGAGAPGGEPGGGFWGGGGAPGVRGKWGKQRPLFPERGGGPETGGGGLQKGLHRGGPLGKISPGGMSAPRWSWWVHPHANYPTIRGNHFSDDTGCGQTQRRSGPCGAGEMWGAPPPQKPQRGACDHLEEEETPGGGAVRQNICVPPQKKPPVWREGNTSENYFCGQVMMAPKEGGVCPPLGSTLNPTKPEVYQWSSPKQRGLNR

SEQ ID NO: 977256 - protein, 462 aa, Homo sapiens
ALVLSAGLLTGLVRDSRALRAGLVVLVSLAALNRPFLTSTLDPLIPDTELALGQQTPDHTEQPDVLEIHRTTLPLTELRLPLRSAPMRRADTQTLRLSTLTRQEQSTYTTDSDRGQRTRQTTTIEGSRSNQHRQWRGRNGDHRAEESGAGSSNRNAQEQAIGEGTIKKERTRRPHAASKQIEDEDSQKKQSADPRKVWSQEVGRAGKSDDEREDEQLAERGRSHPKGRVEETVSEGESVIAGKGDGRESRQGNNKAHEERKGANTGNARRDAGDRQKEERVQTERRGGEARGNSDRGGQGQRDERETKRWARTHRGGGIRKDNRREGRKTKRGKREAEERTNNERGETQTKRAYHGLDTTRKNDELTRYRQANKNKAKKTQDEIIHTERAGGRAGGQETWRQRVVREEPRRRDGQRTVELDGASADEALRRRAGTDGGGAKGARYRYAGERGEGDGIRRTLR

SEQ ID NO: 977257 - protein, 200 aa, Homo sapiens
MDEVSVARSSARQIAPSCCASRCCSHMVSGGQCDLPVALAMLPDVPAFCQDEPCCARVGLCLVSDGAGNGCRVLWSASLRPFAFLLRCKAFSQAFRHPVSLRADEVLPRALGCRRDPTDPARTAWSAASFGSCGTPLCVLIALRTELRPAPAASVVCCPRGWRVPVDGGWGLNFEGTSNEGISVGDTGGFRPVAIFQRWA

SEQ ID NO: 977258 - protein, 301 aa, Homo sapiens
MPSWMDLDSKPSWADQVEEEGEDDCCVTRVAPQGDPSWSTVVDQSQKPELSAVELHLLRAPKEVINGNIKTVTEYKIDEDGRKFRDCCVDLHGIEHPEGLAKVLSRGGDELEEFRRTQSLTPPEPDVCSTNVREYVSMTYISLSEALELPETEEDPMNKRQGASKISSPAASAQGDTGPPAAPTQDTLGPMQRSWPTQLGLSTARRRSCRRELRAGCKATHNPRPRPLCPSRLRDGAQRAGTSCTPPRSPHNAPSVSHLAKTACDRPGELSAIRRNSDIPAKQPGPPGCHHTPPRQRPPAT

SEQ ID NO: 977259 - protein, 152 aa, Homo sapiens
PRRSTQPGGEGARPALGTGTWSPFPYRTYAPPAQPAAAGLGSSSGWFLSSRGPRALETQRRLKRRGAPPRLRRTVQVWGLLLEPRGERPLCDGRPLSRPVRVRGSPATAMGSGPLSLPLALSAAGCCCSLLSLLTVASGLRGLSTVYFERLF

SEQ ID NO: 977260 - protein, 219 aa, Homo sapiens
MECIRERVRRGRVPMLLLRVPNTAYLMLSGEGRGSIVCLVVQSLLSLSATDGLAEELTWVISEVERAEGPGVDGCSVDSSRYGSSHLLTIGLVMLVGRNNAIVLTDMNSPDVVGQAHQELSGVYRARGPGAANLTALLITAEPGVEGEANKSRRVAPGVERRGERNTGEIGDEHKRQRLHARTRARRSERDRLRMCGGPHAADAGHIHPTPVNGRSQIM

SEQ ID NO: 977261 - protein, 214 aa, Homo sapiens
VRGLSGRYRRGRSAMRARVSPACCGRQPMRSTATCDQALQFVPETQVSLVDNGLRVASEQCLSAHCTVGVWIDVWQAVLETEKNNGARLLIGASGISREQRIGLAVLLEKEVESMVAILMPKNREQQLLIKALAQGIWRKACGRSVGRHSRRNVYVLDTITGFGEGNVTVTPAGTMQRRIDTMYSRRMTVRCNSGLAESIPGQALPRTGRALPQ

SEQ ID NO: 977262 - protein, 340 aa, Homo sapiens
PCYKVFKGCIGAALACPSQRCKNPLCLVCCLALRGLERNGRGRTNLSGEREGPSCGAKTSVVRKLEFRGGVGAYLWGCEGDGADSCAVWWSQRCWVSGRERKGRQINESSGKEWHVDGAYTGTLNLLHHGPLAVRDRRDVGNGPSRVMLLQSANFDKMLRRECMNLVWGGWYSIQIPRGYPDRPMARRMQAMLLASFPGVPDAPWASRESARNAQARAAPESRSGRQMGRYPGVCTQGASHQLKARLMDQEDTGRGAGGSKLRRGKHEAVRATLEVSSRHRPGRSAEPEGIIGQRPGRMGPEYGGPAGGGGEYPPRGRGRKAKKGGHGRGTRRKTPREDK

SEQ ID NO: 977263 - protein, 369 aa, Homo sapiens
MEEDATADGLRWERWIRPGGCGLDGPGLDFASDRGGRRRTSDDTVFTAPTGRTNIRNASRLTRRVDTTLDQRHERSTVDYGCWQLDQLTDSCVTMSTPLHPLTPQPVFATFTTRGHDASTHLGPLRLALPHTTPGDGTTGTHLWPLPDGIPVSHTYHPHSLDQVLCHHIMSSHRKIGTLTYRPENTVNTHLVAWCAQPPIDGPEHHSCPLDVDLPDTLMMQRKGAETWAGSQECEGNPDGTRRSGSLSANTPDLHHGRYLQRLHGPRRLLIDAKVASNRVNQHNTKRSRRLVSTDHHTHSKTQYNKQGGQQAGPPQGDYPPGTGAPGCETNAPTQTNTPERKPPGDNRGTPHPETYTLGATRERPKGSN

SEQ ID NO: 977264 - protein, 140 aa, Homo sapiens
MRKSCLKVTEKLLEVCTVITRNIDMSTRDDYGLVSLLVVCIRVEIRDETIVGAISRDYGTEVTGRYVRAQEQAFTSILGRALYNECNEDRTKSCTMSRTAHVLLAQLTCVVRVLDRNYWARNFIVDFEIGHFATCTRDKG

SEQ ID NO: 977265 - protein, 364 aa, Homo sapiens
MSKRPNPISSSRLLRLFLGFNLSWGLQHAAGSTLVGGQQPQGAEGQQRARWDTAKEGPGPFSSKGENGGTPGAPPDKGQRLGWDTRLDEIRMGALAGKQWGYANLANKTTGHTWRRNPSREAEEWREISPPGGNQGHHSGSVQLAGQLAREPPGEGLAPDPHGQKRGGHNAVTHVVQATAVALSRGTTKLRDTQTRGHKLCTITHTALHNRACTHGGNTHTTSVASKYPHKRARRDHPQGDGDIHIGGAPRNTQDEYVSDMTNQGRTLPPLAGHQRGPPALQSKQHKIGNHYSGAAQRKQVTPTEHHRGRGPTPRVGTHHKKDPTIIPKREHKKGHTEITTRQRGGMHHEVDTHNAAKTERKQR

SEQ ID NO: 977266 - protein, 417 aa, Homo sapiens
MDEHEHSNNPHTIIYKLVRPLQGWWLHIEELGDQRRKDKLHTTRGRGAPPYVEERKIVEKTTKTGESEEEQQQVSQPVAREQANNSRYQASKQTLLPTCKRKKTSNKQDSEKRPNPSRGEKRHSPPHNQPDQTSPVCNTSGVDHIQQRPFLSPEEETHRPRTTKHEADTHRHPVQTTARQDTKSQHHPPPTPTNNAEIQNKKNTAHNTHTRQQSLDTNETQKNHNNKQASPNNGMNKHDKTTTNAAVAKTQTNDREKRRRNQQQPDKTGENQREPERQTSRKARTERTRKGAKRGGDRNNTHTLKAASRDNSETATVAPAQQTTTTTDNKRPAKRQERNHHKTTSRNQARDQSVQLTAASTPLLHTRRNAHITQTQQQTNTTSLGYAQTKQTQKRDTNDDERREREEPHTQRRKTPT

SEQ ID NO: 977267 - protein, 249 aa, Homo sapiens
MRSNHKNRAVNRRVWVTHLCGVAVQGRVRHYVALRKMAGVRVSSHYTWVSGYDDSGKGPGGIDVKPELVRTPLRTRSKGVTEGPRTTGGDNPHTYGQGVLRAETKTRGDLPHRQPGGHRNTRATHTTMSATPQAAPTRTQKSNCRTTDKTERRITGDYIVIQTQPPRTTTSTPTATPKAAHPHKDATLDDTKGTPRPTRPTQHNHNHNSATEKPPSTPHNPNPPTSKHPTNDPYTQVPPTSPTPHPDPP

SEQ ID NO: 977268 - protein, 302 aa, Homo sapiens
MGPVVYLETPGIWFKNSVGGVLSHLFPAGKWVRGRVNRRAFLTISFEQRERVRGFLQPRAEPQICVEGDEVWARGTQRAEEDISPKSAISQYTEERGVKHSELPTHIFTQSGQGVRELPVTCVLTCGPVRIQCAHCWLSLCVGLLSLYPQLSHTSLKDISYTGEDLSHTGVDAQATRGTYISPIYPSRAGATHITHRGTHSAPQREEREWHRKGIRRAGKRVPERQETPNCYPQRRVPARVRRGYQPAGCECGYTHKRGRHRSRRSTPPHEGGPPKKNHKKKCVPRKRRLPKSYYSISTLLT

SEQ ID NO: 977269 - protein, 238 aa, Homo sapiens
AWADVTQQAGLVKSELEAQTGSPNLGRQEWDRGRRQLQSFPKLRTAPHPCAQCCSLWWPWQVWLGCWVALAVALCVRQHARRARQGAPWRAPWGLRGPMVTRTFEYHGPVASAHGHEVLVQSGQRVHAEPSRVSSVSSQFSDAETQGQDPGPTAAFPYLVRGLPAKCNMDISIGTHDAGIHGGSPAERDACQGVEASVLTSRAKLWHRQGEGNQKERILILPMSMPHKTDVERDFSEE

SEQ ID NO: 977270 - protein, 241 aa, Homo sapiens
EDKKKISVTSLKATTPPPTLAPRCAFPSCPAKLGAGGLVGLPCAPGPFQSQAFLAGPCAGESGRCPKPGSPGPEASALFNSKTRRCWGWAPRGFRGQPLRRALSVRGISSAVAFRGVSPGWRECAGFSFGRGQPILFNPMRPIGDGPLAPGCLGGDAMKTPKEECQRDRRHRVGVYPAERVRRGRAVEGQPIIPREPRQRGQISVNLPPPCSILGKTRVAKIFLGVPRLLRGSGVFPPKPL

SEQ ID NO: 977271 - protein, 110 aa, Homo sapiens
GDLYYEGKEFETRLKEKKPGDLSDELRISLGMPVGPNAHKVPPPWLIAMQRYGPPPSYPNLKIPGLNSPIPWRAVPLGTMLVAGANSPVDETGKPLYGDVFGTNAAEFQT

SEQ ID NO: 977272 - protein, 173 aa, Homo sapiens
MKVRVDANSAVTGPINGEDDSNEECNARAAPSTARTHRGGTRGAITRNGEGETPKGEETEPPFVRAQTRKAGVPLTSGRAKREAAKCNGQRQEPSCGSTRYTGEPPQDYMNKRPRMGGGNKDGTGGPPKVMGPREKNQRGGESDRKKARRRSARQHKRHQCKTNNWANNDTRN

SEQ ID NO: 977273 - protein, 239 aa, Homo sapiens
MVVAMGTCNGRSLLHFGLRRSTLPLEHLNAFSVPGPLPLFAGPYTHDFSVLLGLCVTLLLSLKRSSRVEPVTPRTPGASSGWEVLHLDPGGSFLQGPTCPKSALVNTWGKPPLGVVATMTGAFDKGGRLLRTPTFSGCLRIPPPSGGRRLCHGCGAVPPKGEWSSTCCDHEDPLLSRAESNSATQAYDNQVNHQELRESDKISRVRADEDRNTLVRRKNDVYPHVQAYNESDRSFIHKR

SEQ ID NO: 977274 - protein, 308 aa, Homo sapiens
LSGQGDPGSNPNKRQRQPPLLGDHPAEYGGPHGGYHSHYHDEGYGPPPPHYEGRRMGPPVGGHRRGPSRYGAQYGQHEDGSQELEYGVKPKACGRWCYGLDQSKMKCELSVNVFDYMGMWKKVKMMKSKHGGGLVEMADGYDCRPGTLAHVINKIPCLGQKWMSVFSKSGQNIMTVVRKYRVGRRVLQGTKEFSELRQQLGIYHTTEKGQPHRTRIQDNPRQVMTIFKPPVEVNDGDNPGDLGMHMAAEGGIFMVKVYSRNNDTEYVEGEEKPEETGQLGHEQYRENERAAAKRQRDTRQEPQYRAET

SEQ ID NO: 977275 - protein, 160 aa, Homo sapiens
LGGGGEGVKKGGKRGGGEGGGIKKRKKKMGQKRIRSRRESYAEGQKQRAGVPHHTTRGRRAGASPPAVDAHPRAGGDKHPGWLSRANTQILIETIEPLPGMRSDGRHPIDHQQRGAAREDTQTTTTHKEHAGPTPPHHPTTTTTTQRPDGRHAPPTKVRS

SEQ ID NO: 977276 - protein, 336 aa, Homo sapiens
GRGVDTQMGLSQWSGVHERRGPECRASWWQCMREEEEEEEEEAECWRGVLSRGRRPHVVLNPQPALCYEEIRNGESRSEASGCVDGAGKPGAEGGSGALTGMGEQEHSQQKEEELRRWQWSPGKASSEVGKSGRSWLHRTDGACSPMEVGETLQQLVRQDRTKLARGKLDVNDNAAMKEQRRRARIDNARDMYPLKVYLSGGPGDLGARRGPGAANEDEVAERGQYIPQVKEQGNCNSEAAHPGSERNHRRTERSRGRAGPSTPEGPEDQEQQSCGQLTHTREGDHKWRTRTVQETVEREPRRRRALFKGHRRSADDQDDRREPTRQKERGNGRQQ

SEQ ID NO: 977277 - protein, 516 aa, Homo sapiens
MRDPGRVLEATAVPSGLRSSLDPTIENRQSSHDRSTDNDHNIVCALTCSQGYAMSRDGGTVIRVAYLISVAIVNVEQGLRGDDALVIDCNLVNYGVTYVIYMHTCLYTSVGDLVDFASPTGLRLEIGIRPTREACSIRALMGLATLRGRSRNRFEYDSSLKWALDQEEHLTRKSYTSTRDPSSDERYEFSRGANEDHSRFPIYKTFPLMEEGDLGSIVEEIRVPSAPYHPGGFNGFTPSIQTLNKHHATLCYIQTWARVAPKRYGNYAPFGPRTCHVPLTQQGELKHQMRTEGHWTSAEKAELRSGDLAKNLITEKEIYKGTGTSGIHRSSGGRRRSRKTEAVNQVSTGEQEGHKGWEPQQQRQSGLRARGKKEDRVPPGGDTERQGDSTRRGRKSCDTGPCDKHGNERRGAPNEEPAGSRRRKTQRRTKRHIKQRSQIGATKGATVIQHSGKPSKPEEGDTEHRLPGRDGGIYRPPSALWEKQGVRKQTTCGGEVRQQHRERRQHCSDASDYRDR

SEQ ID NO: 977278 - protein, 109 aa, Homo sapiens
MDTKKNVLLPDLSYNRFLPIAHGGAIAVLGTEDGACAVEKGAMLRVDEAPGEIPQVSGCINKPMDVATLYEIECDEMHFARAEPVAASARANTLLEEKLPNGSCGRKLH

SEQ ID NO: 977279 - protein, 212 aa, Homo sapiens
MGKIPGVADNMGDNERRCHRIGPPAINTIVREEREPSIIPLRRDARRSSDPVVVDPMRSLYNTMDVTAGGSIFVVVENDQQMRSCNPTWCRILDDATQGEVLRDVNREIYDTGRQIITVTAETSKDLEAVCICSLQGDLCVSVGEDLRRQPLTMLMDEHSNNSRSYSPSRDEGDVSEREYPRKDVRPCVAHEGKERGEILTQGYKAVNYGQG

SEQ ID NO: 977280 - protein, 80 aa, Homo sapiens
GGGRTEASGCRSIHVVPRPCCGCPPVPAGRAASRTEQVDLLSAKRTFVAGGIRPVVILAGTGRGIIGAGSMLRAARSRCN

SEQ ID NO: 977281 - protein, 147 aa, Homo sapiens
GQPSGTPRVGASEVHAGGYVRKKQADVTCAFFLRVLLLGDSGIDLWSRQGSPARARPDIDRRAGLRLTKGANAMVTVSIYENSDVLLRVVWAEEGTQLDLRVVASLTRTALVQSFGCYTRARKLCCGKARAIARWSTRRCLKLESAT

SEQ ID NO: 977282 - protein, 217 aa, Homo sapiens
MEVHHPVAVAKFVVIPGNELDKGVVEGNASPSVKGGGVGVAVKSEETTWVLSVAQDALGGGPPTPVFTTFLDVITNWDRFSLKGGSGPPWTRGHGGTRKAMPVSFRKLKDDLAKLGAQKKAGMIVWKAPGPSRQRVSGRGHPKSLGGRDGMDWGKSLPETQAVLAALAGWSPWCAGRLAQTERGENQGTHDNRADRERLWPQDTPVEQAQNDMLPQK

SEQ ID NO: 977283 - protein, 432 aa, Homo sapiens
KTVYMKGNLLTGKLFGRESGVSQDGRTTGDPPSWRMWLVRGGWGVDYLSIRPDLHTRGGQRARGGPSGAPRAPRGRGPNFLAGCRGRLEWCRARGYPDSVGTLLEANIRVGQSKHIDEQYVGEGTTLLRSRALYPYNPNQFNSGHEGFLLWPRKRSQRDLGAKGVLTVKGMCKRIVAKNTKYNISSSFRATVRGPEAVCDLVTLHYLSPSPFTRVAISLAAVGLTVLRPPWRGPKPGGLFPKSGGPVRGALQTCVRGTDSRGQKSGKDDKVVTRWNTVVHEKEATQKDPRDKNSGKDPHKIPREGETHTPRDTQVPKNPPPGDQPWGAGPLGRPICGKGAPQRGQDRPPGATLSPSTQTGRGKRTPAGANRRVAPDHNHTNYGRGESETIYTDAACTINFVNHSRSSNHEASEPLGGQHNFCQNAETDNMTT

SEQ ID NO: 977284 - protein, 183 aa, Homo sapiens
RTPASRTPLSNKSPSVPLGIDRAPCTAFPDSVPGACGYQFVKVGVQPQSSQTFFERSLMDVRSRVSSSEPACARVVMSRVANCLCTMQSTITRGGDPCGFNASAGALSGGRPKTVVASNSRGTCTRVSPRVPYDRSRTGQRSGGSRGYATSGMCQAWAEVTTEVTTVTDLRRGAKVVRVAASD

SEQ ID NO: 977285 - protein, 337 aa, Homo sapiens
AKSLPWAPYCLQRMNRNKSYSLDFEGSPPCGPIAPHRATILITVSVTLTYGQMAQSSTVTHDYTSAHDCQPPLPQVTGISDIAHQPLLHYISRPVPPEDMQCATPKAWHLKRRDTIPELPSFHAPQGPVGSIESSLNQVFIRTSVVVKRYTHTRHVKKRTKAFKKPSTPPPSLVLRNHFHATTATHVRIDPSDLQHHMHTEHSWQTLPTALGTAFQPKSMSSLYREPDHPRRLILQHTQPTTTITLCVHHGIHTPQLCTSPPHHSTTPPYRPATPAPTHHQQTQHPLAPTPREAPPWKSPPGGQRHNTAAPPPINHHHHPSGPGSKPRKLTTQSNDH

SEQ ID NO: 977286 - protein, 118 aa, Homo sapiens
MAISVEYIVRSSLLNIRPRVRRFYNVIALSDAKLTRAGVDKRVNNVKQSVVRSPYEGERRPPHVKTRNLKTEFNKREPLKENPKRIGETRKKILWYPPFQFSNFWPPRKRKMRLKGDA

SEQ ID NO: 977287 - protein, 136 aa, Homo sapiens
MSPPGEVYQVEPKRERGVAAGRTSTNTRAHKQTSAGGTHIGALVTVTRHTRGLNIVGGPRSKTWSAGESGRHRTDKTHELGNPRVTQNTLREPRRPPPQHHPPGFANPPDLSRGTPPLRTAAAASRTCPATQRQTA

SEQ ID NO: 977288 - protein, 126 aa, Homo sapiens
GWDSASRAGDVKLSRLLPACEVGARPFVLLDRSVRTPGRGSPLEKTELIQKAKLAETGRGATKGTLGTLQDMACVARCQETDAYACPHRRGGADRGFSRCGHTMNDGSGGRGGTWLDGSLSRHSKQ

SEQ ID NO: 977289 - protein, 118 aa, Homo sapiens
EVAHAEPGEDLERTRAPFQDTEGWSQVLIPTLPPGHVYLACRYVQQDAAESRILLQAQWLSECPQSVRGALWLPQWARTSRGVGPRRVTTLALSSRTLPCQRSKLTRGLVTVRTNSDP

SEQ ID NO: 977290 - protein, 145 aa, Homo sapiens
MATTPGYAQSGKTQTSGQPVGGTPSRKAKTSQTVPPGILKALTRVAPMLPFVGTHLLDRPAPKGHKVGHMFHHCHQPARWALQRDSPHMGLPALGLQLWHTHSHAYTGLPRGHITADEPHNPATQQALHPGPKPRSRTGHRKTHG

SEQ ID NO: 977291 - protein, 228 aa, Homo sapiens
MRKLRLIEVTWLARGPPGSVNPLVPCPQGQLQERRYLPLSRRRREMSSNKEQRSAVFVILFVASSPILDPLQLQTVPNEVFHYGSLRGRAVRPVNLKKWSITDGMSPVLGNKTHASRCQQCVSCQQLQPPAWATKLGPEIERAECTIRVNDVPPPGYSADVGNKSTTRRGHSSVFRVLSEAQEFVNVTLKRVHLLGGPEKMQKPRAARACDQEAAGVPNMGDLRSPAM

SEQ ID NO: 977292 - protein, 112 aa, Homo sapiens
MKGGREVAKSHQKAIGGVRSRTPSATRIYRSHTGASASRNIMEGPASAPTQSIDATVNARGPHPCHTDSHAGAPPTAELPALATGARHQTKRAPPAADPTRAFTTGAHQQGQ

SEQ ID NO: 977293 - protein, 334 aa, Homo sapiens
CVEALERRLGELPADTPRGGCCEKSSLRPPPLAFSTLTWLGPFPATHYSTLCKPAPITGTLEVRVVGCRDLPESIRVEPYPLNGVDLGHPDQAPPFLMAPCPWAFTSECGSLSGGAAQSRSREHQVKSRTVALRVDITPRGGGTTCLENTQCGPPCARETKTLLISWTRGKGHEELRCGDVLGRGPRARTVSPKTSLDTLAATSGTTDESLTVQLDTLERAQDCPGERKATDPGTPVIAEALHRQPHGETRTNPTAASKGQEQPPSPAGIDIEYRKVRATDRRATPDAPGTRRVYARSSHGSRRNQRNTGPQQKTDIRDSHKRSAETQRATRRH

SEQ ID NO: 977294 - protein, 244 aa, Homo sapiens
LQSWLPSYAAAVCRVSPESPELNCSRKATRYNVAEEELEEDDDEELDDTLSERLWGLTEMFPERVRIRGRSHFGSSSPSCVDSEQCTRVVPGLGPCASRDQMSVYESLVSFPLSFEMEIVVNTGRNEHAWSCMRRRSRYLLVSPNDMVSSGTGHCHGVLYLLDFLDQIYDWLLHVLSCTQVGIRFSKQFTCKLDLSMDISSGMFLLPIMLTCLGAHCDAILILVREARRRWGSEVLGFILQEEL

SEQ ID NO: 977295 - protein, 215 aa, Homo sapiens
MSTHAQHISCAWSRGLAWSMTGPAERRIGRAVHSTGRIPSSFRKESVATSSPSCQHLAPAREELPPKWSWPPGSLAASRSPSGSSHRSPKHGGHKRCIAPCNSHRTNPIGRRVAQARWQLALPRRSHATLAGEPVLRSPATHGRHITREALSIETCTNRNKDRDTETDRRLATPRQPTVALPQHTWARIRDRCPQPHRLPKPRRAQKPTKRPRTK

SEQ ID NO: 977296 - protein, 203 aa, Homo sapiens
GRFNAQHSQRWCSSVNSEDYMYRRGTLVPGQGRCSSPGPAPAHQHFEEWDMAVLEDNVDGGRRSSLVQDWLMGEEDEDMDACKTLCETVARARSARVAVNRVQYRRLAGLASELLRLYGTPGEAPLRARDVPFGRWFVSRGRFRVNDVRGISRDPPLLCGQAQIQGRTPAPWVPVILWACMCAKTESTCEPSPGGQAQHRGGW

SEQ ID NO: 977297 - protein, 294 aa, Homo sapiens
MAYKDVYHQVGDRPDSMKPLPSLRVWRAVILVHAENGDWIAQEQKRILEMGIMGSRRPCGEQPESWSAEAVCRAITIAGRINCPVYITKVMITAVQATSSALARKKRAPSFRRAHCSHLGTDGSHYWEPELGQGMRRFVTSPPLSPESSRSASYLTFLLACEGLAGQQADGPLSLQSAQKAVCKDNFNLIPEGVNGIEEWMTVVWHQGCGMATCMTIDGYEVTQQRCSRTMIGAKDGRRERIRFRGTSRTRKVKAKAKARGGDKHKKRPPSDTTPETEHERSTTKTEQHDNKRT

SEQ ID NO: 977298 - protein, 150 aa, Homo sapiens
MMAMMAPETPRWPSTGSRWMDEGNYTLRVCQLPQGVRPRDDLAQSHSQKARRTIAECPRRSRSASDPYRTCGPSASTKEGRPRLGRISWLSSLDWEAKETQVSGTHVRELSLSPGSSPWCPLGRADGVTVTLQSGRMRAFDGTRPDTCDL

SEQ ID NO: 977299 - protein, 482 aa, Homo sapiens
WAKSRGVSQKKIQKIYKWQVELFFLKWQILQNIFFFTGWVLFGWSGSGWSGKMLVYLGPDLGVSLSGSPQRELSCGECESVGQSPLGRTGSRAGDPPVCVCDTEKGSLWGVCVALSDGDKHARGGVILEGVVGSLLFYKRNNIYTHRDTYISITEEGGALSTTLGGELHNLDTQYSAYKVWFCGGIIFKKKRVCNIYILWVARPMCASQSVQNSRRQRRGTATGGVCCVAPPLGGCTPEDSVAPAGRLLERRYWGVVRDQIGVFSGDLSWGDEKASRTMRTRGVFCVSGSESGRRGPSWVLGENPLGSFLGGPPSHHGDVPQKGRTHYGWAAKHSWACLSDNQRWSLVLPAPKRARPRLGVGYNHFHSRKTLGGGPNVRTTNGAQRGHSVARGERAPLWVPKKNFISPFPHLLFIPWCGPRNTLLVGCCLPERGAPRGVAREKNYHTAPWGDTACKKTRQCLPGGGNTQKQHPVGGETLLKQ

SEQ ID NO: 977300 - protein, 297 aa, Homo sapiens
PRQEGYGWYRVEGEEELEGTVFDRAASARSELASTRGGAGRGYGTRLTRCCQDAHRWTPDVNAGQRMTLRMPSIRGRDLVKGRTIRYACDPIRLHPVRAANRVGLDSVDKRDVACIHSLAKAYRASALLCPAVAHETAAGSITIFNNESSGERWAASEQASELVDERLGLALDDLLRETLFLSDILRVRVAMGCPEYHVSVDVSRCFLSADTKLKGRVTRKGDLHPLTEVHGDRFDQQATSEGPRHGAGPMIRRRRDASSLNASGGLTPYVLQGDFGTHACNASVSSPNGFPTSYRP

SEQ ID NO: 977301 - protein, 167 aa, Homo sapiens
MWENWEAERWEAAGPNPAQEHLSPGTVSWRDPAQPAGCVSAKGVSRQVLADALTHGRLDADGTRAWWTATSRSIGKPSYAEFLAPGHRPEVYESLQDGSLGPEFLGVELSTDVSPERRPQGTCSRRLGDTYRVIDTRKTERRRAWAGPTVTYRPADIPPSTRRRKRI

SEQ ID NO: 977302 - protein, 117 aa, Homo sapiens
MCIPEEKAWEGHNDRQRSKVGELGSYTLGSENSSKGQKGLLGGSPGPQVAKGAFRNNTLAQMSSEAKGWPPEGGLNTQTGFGVRAEVPKWRGGCLSESPCGNGERGKAFLGEPTKGR

SEQ ID NO: 977303 - protein, 124 aa, Homo sapiens
WGINTNFMEALRLVLFLRHSLGSPETSSPGGSNETHFGLASGGISWRMWVEGCRVCVGGVPPPKGVLHEDPVATPAILGGQQFLLAYILGGTPGQPSRSGLVKFGHLQPPHQPQLCGREENNLL

SEQ ID NO: 977304 - protein, 106 aa, Homo sapiens
MVMTDSQYEGMTACSSSQGEHHFSWEAMQENLHGTRRSPPVMAPERKKGSSCLEIIPLVKMKNYQHLPYAQQEAIEEPLSLHPPECISPSWYILGGHQPKGLQSWL

SEQ ID NO: 977305 - protein, 155 aa, Homo sapiens
MMRECISIHVGQAGVQIGDACWELYWPGTRHPAPMGRCQVSKTIGGGDDSFNKSSSVSTGAGKHVPRGCVCGAGPHSAVDEDSALDTVADRLLTSPGDSVNQQDKGRMAGQVTDARRDVALSWTKGRTQCDPSDALERVIPTRLAMNRVVNRILQ

SEQ ID NO: 977306 - protein, 92 aa, Homo sapiens
MSRQSRHNESTKAHNKGTQKTQREYTRERQQGTQLKPELIVEAVRKLYAMEPGGRETSIDISHTRGYTKQHDSETHTQDEHRKRYPTARQSS

SEQ ID NO: 977307 - protein, 349 aa, Homo sapiens
MGQKRRDAKGHPIRFTTPACVEGIAVGPCAVNEDHVEEKGLQPQDGTAHRKGDPERQRHSDELVLLALAVVILSDETVSGRPGGGPGCHSQGRWAGDSPLSANIEGSQYITQSGEEYPPFQLKVRTCPGESSRGNFSLDIWLRGPLATNKRPFNGAPLGTFGATYWGDVWRIQIEGVEGFPQLIRVKGQPQGGTAHIRVSWDVSKFRTPRGRPPERGSAPRHGVNTPPTSIATPHRPRPNTTDGGTRKHNRLLSPGVVDVTRHSEDKQLPQAGRKAKYSREDTPQPTGETHKRGGYPRGTHGVNAQYTMVCTTCQKAEEYTRAGGESQTPTNAVTQTGNPSATTLYQNA

SEQ ID NO: 977308 - protein, 312 aa, Homo sapiens
EAYSVSHWGALLQRPMYRPSGGPSNECLRCTVCLHWFWPVKCPGPVHPPGNPMRNALAGALPICSMLALVDLFAGPDSALRGSRGSSWAAVWERATCRIISGLYSATFHAGFLFLACISADRYVAIALSCVPAGPRASTSRAAPYLVLRHRVGVVTVPERCLRCSSSQDGLAGKANWTAVASSSLEGLTQRVTGASAVAQVALGFALPLGVVVSLLRAFLGARCGRMWPERRRALPVVVALVAGFVVLPLAYGSPVAGSGDPTGARQRMACRTQDSPAGAPALPSPGLNRLASGWFAAGLRGGPRPPGPAPL

SEQ ID NO: 977309 - protein, 220 aa, Homo sapiens
MVGVRVFIIIMLVYRLLKNGRRGLRSIDVEALRLVRIPFGQGRRGYREGLGYGGDKLTCRAKGQCWQELTPEGYYSRERLETLTRKPTHNTRRNTTRRQRQTPTAHPDEATKPHRTTQQEDNMKYTDTPPDTKTHTQTAAGHNWAKHKPRKPQARTLTTQPATQKRPQQPTHDHHPPHQPPPSHPPQPQQHTETRPYPTSHAHNKHTNQKNTRTHGQRRI

SEQ ID NO: 977310 - protein, 184 aa, Homo sapiens
ASFNARRETGVSSSKSLFSNVLPKIKIGQSLPSESSSEPPLLSEYTQSRLCVLRQERAGYRALEQDSSLVYTALALQGDKAKTIGGLDTIQESAFEKFKTGVTRAEDLQCHRSICDWNHWEDEDVDQVVMALCEEVPELLTVGTTKEGTGFEKLTERLPISSDAFLPFSEDNVDRAAKEWSSAY

SEQ ID NO: 977311 - protein, 204 aa, Homo sapiens
KGSWWKVRQRESRDRTGQEGGWLCDGESKSAVVPLVNAEVWAPWAWLPPVVQSMPLPPGDGGLHVALATIHDHAARYDSVDSPSIYAGINEDEWYWRCWIQLSHDVPRWCCSSCRGAESHLVRMTRMVPRRGQRMLVALRNVSVPRRCCTDSVPCIVLEWAPVLISQRVLPFVLDSRVVLLVRETLCSLFCCQGCVDLWLFLFF

SEQ ID NO: 977312 - protein, 296 aa, Homo sapiens
GRFRHKPTCVSQQDSQAIRGVGQAAPGPGSPQLPAGPRSPRRAHPGVPLKPAQEPRQGPRQSTRRTRIEAPPSLYSCDDCGRSFRLERFLRAHQRQHTGELAFTCAECGKNFGKKTHLVAHSRVHSGGGLRLRGVRARFSQAAIWRRIGATTPPIGLRVSRLGKAFRTNLLAGTGIHTGEAYVLPDGKASAEVNWCRTAHSTRASGLRLSDWDEFRQKSNSSPPKSNREGFWCATVADFDDEEEILATEELELDGGRLGRGGASGEAGGARAMGGGTRGDRGAHNSQVLYTGASSG

SEQ ID NO: 977313 - protein, 216 aa, Homo sapiens
MANGVRTRDVLYFLFLVFLRFLKFRGEVKSLDVLARSEIFDTPQGKQMSWEYAVNCHVITWERIISHLDIFAFGQFSGAGPLKALVVIRVTVSAVTTQYYLGAELSSVFMHLRPQFCRVLVGSKSILDIRVVQGWHFGGAWVSMTVFRDERLTLGKASRHIHSTHREDQESCSEVHSWVVEPMCDGLSPNILFREYLRYLLMIIWGDWGETLLEEI

SEQ ID NO: 977314 - protein, 213 aa, Homo sapiens
MDTLLLGSPEMSHARCLRSEQWSWWPVVYRPGVCSSPCPHVWSGAVGDPGVLVSRMEEPKLFQGTVMSGPEGMRPESWSPVADMALEYSGHLHQFAKYPCDVCRLRGRHDVISLTNCGYPASTQTLFVYLSLRRQLTYEKSSSLTLGKSPRPDQTVYPPATSLSYRKKTVLGADEPEEESIHRALACPQDPLGAGRCVVHGGEFWSQYRINVT

SEQ ID NO: 977315 - protein, 102 aa, Homo sapiens
DSVWPNGARVTASDSLGLAPSMELGKLEVSESGADLVIGVQEAVKNRGACVQEVHDLLRIRDQCRRIVESVARMSSQCSGDRQQHIVLLLTTGEQVPFWARV

SEQ ID NO: 977316 - protein, 69 aa, Homo sapiens
MSTDCAPNRGGLGGNSSHKAGTSENLARGRYSGKDAKQVSGPLEQLGRSGMQRRRGADVSRAGAPGEST

SEQ ID NO: 977317 - protein, 302 aa, Homo sapiens
LRMPSGTDESAGRTYLCAPGPQLCLDAIQWARDTKKCVRSPSFRKTVPLITVPRSLCCTQETFPTERLDTRGNLLALRLSWKVRPPVSLSVLVEGRGIGVLYLLMKKAEPVRLHVPWALLLPHDVEHATALVAMPGARSDGRERCMPLSFKGLRTRSIRLNMNAKIAPKHVHGTKEGHDVIGGPSERGRIDNGLSRNNGAENGFLGRYIEGFKLGPLLHSMDIELIGSTPTLRWDRIEKEISSILGLGSFGTKRQFAESTCAGIGLALSFGVPRVVEGAVGVTIYCELLHGERRATIEVGRS

SEQ ID NO: 977318 - protein, 589 aa, Homo sapiens
VSIGMEFRVEERERYDWGGELKNCWALLGTHDAGHGTGELRVLTRSNLCAYRSVVDGDRGRSMADLNEQIHPKQRQDLSRTKQLLDEHVTIPEDSVDRDLICRSIVQERCDDLGIDLMRDIKCLFDSLDIRITRRHQSCCTLRGEPRGTGDTGLWVPPYDTLNWGRLRQGCPKLWQGTQWQTGRGVPEQILIWVAETNNRQYYLCKLTSGPPKPKGNKIRYSMGSNTPTWGTVEHTNTFGGHNRGEKSYRRPQPQYQGCETARIGGRMTGEHRPSRDMRRALPEPPCGCTRTPVGLQKVHHTVTRVGTRAKGAISSGSYSAGHIRVGLPIYFGLVCRKSKKAIRIGRLFSPPCTLGSLHQSPALRKGDPRRCGHWQPLGCGHQIDCSGGTSIRRKHPHPLQAMPTAPWRRSPPSPRSLYPKDRSPPPGDTELDPGHEVPKPQEVVPRTVEPISESKKMAKSAGTGTGFAGPTNLRVERYTQKGHSGVPKIKHTTYVGGRQRGETPTVSKKQPASVRYKQVRHAAGNTLRVSMRKRKQDVPPQTGHTKEFAPTEVFQASTRRAHKGTANKGDIQQRKTKPSQTPIDYDSP

SEQ ID NO: 977319 - protein, 36 aa, Homo sapiens
MTVGKSSTDRCMHKFELSDMSMYPCKMARIFIGTFK

SEQ ID NO: 977320 - protein, 285 aa, Homo sapiens
PNRARRAGMRRREDGCARCDLCDQCFHVRPIGHQSTVYPRDTASLPLLTRTHLRQGLHLHLPYTLSCLYVPVYARTGASCREGSVTSKLRRACVAQPHGAPSSTYTRKEDPYLSCEYCVANAWVSLRYVVRGGPQGLRRDRCRRNWLISDVHDCELRAEGDLGQKEHQHVYAQHNEDEGTVWIDGGALAVSQGTSHGGKLARERVGLQMGYALGVENSPTGKFDIARPCNRSRLEQGRFAEDIRKAPSNTLVGSTKGDVTESGARDGDFRMHSPLEGGPQLGPPD

SEQ ID NO: 977321 - protein, 69 aa, Homo sapiens
MNKQRIHRHLSCDPIPRGPTTYGRGDHKQHGRSHPPFVGDNAVHRVRSIAETNTNPLAVCTLGPPSGAP

SEQ ID NO: 977322 - protein, 155 aa, Homo sapiens
RLSLSLVRGRGREAKRNGVVQAGASASPLGHTRDPLTSVPQTRTLEVLNSSPAHPRAAQARQAAGPGRRRCAQGVGQLGSGGGSRARQEAGRLQSQSRGLRPGQEGRPRSSKTCAATGRMKPAWSRCCGRRACSAGQREAFCRPRGQAGHKGVFG

SEQ ID NO: 977323 - protein, 78 aa, Homo sapiens
LEAAAVASAAGAWPYSPGCGGVAIRGLLSVLSPVLRVTCTFPVMCECCCECAGPGLPCPAFRARDVTVDVTIYDDWGT

SEQ ID NO: 977324 - protein, 274 aa, Homo sapiens
MGHQRAIMAHMTVEEIYKDRQKFSEQVFKRGLLRPGQHGHQLWLATLCQDIHDDQDYLHSIGEGSNSSSPKRCTDSDEAEAKETMLRDPGKLKPRQDTVSASEPELTSTMAKAQQTITNLDGTAAYDIRRSNTPTKHPALALAYPASTVDKTNAAELTDHPAQVCRACVHRDPKRDAAQASDEGAMRRVGTDRVPGTCPAVSTQTLVAENIRRAAPKRFDETITISQSAVRAQLTTIYARGPRTEFLSTISRAERKPTEHSVRSPYPCEYAHTH

SEQ ID NO: 977325 - protein, 132 aa, Homo sapiens
MHGLVCAHAIGAPVTPDVMPEMLGRAVTSVLLEGTLVDTDRTNMWPMLFEVPLRELCHGAPTRMNDDTGRDCDTLVQVPYCPPGDWDCGPWGWSRTTMPHGPVDHIRSTALDQQRAHTPLGTAFPRHRFGAG

SEQ ID NO: 977326 - protein, 310 aa, Homo sapiens
SPGTAADYLAAEMMPGSLHCDLLQFPLQEFILAMGFFLVLVNGADHTWLTKEQSGPVTSGCETTVLCLVNMEWLCACSIVHDGPRVSHKAEWMPQQTPQPCCCLVYLVFSLALHSVFQMVAGGSGLQLRPGLRGPWSCAWLCLAPQGHPGCQLSLRLVCRATLGHRWWLAVWILFSCMTPLVHPGWVQSGRVGRTSAARWPKSCAKSAHWHVGTFLYNHLFLRNPCSQELEQFLSKGSSTVIICSLARFALVTLAWFYSKSRGRPTDGHCEIAERSPVPLPSPNSRRKRREPAPYLSDTTLAANINSRLR

SEQ ID NO: 977327 - protein, 119 aa, Homo sapiens
MLTMSNSRRLPLGHHNQRHAGLRSQRTHLTTREENMGKPPRKITTANTKHRCTKRQHGRQHHNIGDARQNHHGASATNQTHMPQIGNNTVMTTNAHWKNNPNTPTISTLPTKKAHRAQQ

SEQ ID NO: 977328 - protein, 147 aa, Homo sapiens
MYAKFSVCQYQENTVSVFGPQVGALESVRNCRPVLSKVRSNVCCESETVGVCTRCVREVSRDEERPHSYVCSPEVLVQLAELKVVPPLVDIGVDVPLPRDRPRGVYNHPPPPLSCRAFDPSITILYWEARRDIIPRKEQAVHDSVAP

SEQ ID NO: 977329 - protein, 122 aa, Homo sapiens
MARGRNEASEAGGSSKAWMLDKLTGVLAPRSIHRSPHVDRVSPPHHFDLRKRLKYALTHGRRNGRRRLGSVARVLHLKIADRGKRSSDTWTSKRYACVDFMGFVTHAIGARRAGDDISGLSL

SEQ ID NO: 977330 - protein, 208 aa, Homo sapiens
EFCWRQAPYPGGEGTTSWSTPRASPRWELIPLLPAPGLRDAGGALLGAVTAGALLSVCMHKVDKAKRRHGGENVVAVLRAHGVRFIFTLDGGHISPLLVACEKLGIRVVDTRHEVTGVFACVSAYVARLVLWTGVAVCWQLNKHGTLDRQPKQRLILLCEELLRWLSPQSVLLGGAAALCCRTGVRSRLLISLSLFRPLCKFCVSVRK

SEQ ID NO: 977331 - protein, 116 aa, Homo sapiens
WSWTSEELQLGRGWSCLLSRQWPARRGVLLLAHLLSLPPALRRGAFPARPGCLPASFHFPGISCRRACDPDPLLGGEASRLFPVSLLLSLWLPAPSLLFLDWLSPPSCPLPLAQAP

SEQ ID NO: 977332 - protein, 255 aa, Homo sapiens
MVGPGGRHAVGPAISSYCVGLPAAFIPCASARESGASPVTSEKRLDQHSAARRRLETCVPFARREGRTSVATGWLRLRAAVSRLGEIARTLRGRSPGSKFELASTPCKFGVPAVGTGFDSLVDRHRMLRMRGADVMRKARAVLEGSKGWSRAVRIRWRKDPLTVGTQAPWRTRRGLSHRTVARCLKRLDLMARKYGDRIVTRGSGRGPWPWGEVWNTKRSGYPTRVLRGPLRVTGGLRAIAGKCSPNPVVGVVSM

SEQ ID NO: 977333 - protein, 204 aa, Homo sapiens
MVSPRMCGVLSQSVILALIVLPQTRPAGVFERADPVFRAGSMARGAPVVPAAAPGVPRARPASSRVWSEGLRLSRVRPGGVASVQPRGLLVLELRAGPGLATRMPPRDALTAGLGSFSSWFTEQGPHWQRVGSPSYPGWIGPMCRVEAARVPSLCASASYWETPSWGLKTGQVSMGTDFDGIWCHGAAWLDIGDCPIVLLGVSG

SEQ ID NO: 977334 - protein, 87 aa, Homo sapiens
MEKETHSPAHSSTGQRHNFHGGPNGTTEPGQNPPRGTTNHNGALTYRDHRDYMTPLGRDTHTGGVKHCCLWTRDAPTPGRRQGQIGQ

SEQ ID NO: 977335 - protein, 350 aa, Homo sapiens
VPQVGPDRLEILTTMSCHIDLCQVGENHPDDFDPDMEDGNDHYKGYICLEYWRAPAQAVDAAEESAERLTELDEQHTFRVTLFTDFDKVYEISDEWDIPEKQAFKDLGNITYWLEEAELQRSVTVVNLREWETATCHTSWNALYQRPLSSKLSETRHEMDMTTIMCSWGFLYEAILTLGLSLFIYTCGAIASNCARARRHHTPSRLQQISAHQTGVPNSPGPSTPVALNPRPLALNRQDTPWEGQRRDGNPQAPINAHWRASLPRRSPTRSGILPRSPRPQPTGGYCAQVGQQRTANTLRNMTPGNPSPSTDTPPNANMRPTNNSEHLWDKDTLRLRGITTPSARATTTT

SEQ ID NO: 977336 - protein, 149 aa, Homo sapiens
MPSTPLPALDLYRAVERLTGADGTLPKAILARQAVDWHDRRCHWCLVGTPAELVLSDDCDGGSSDQRGYKNVYNALIRITREEGVSHCGGLSLYMARASSSMCQSLYPSSVYWLGTLALCAFGASRLSRLGGCDVHWVWAATGAVGGVP

SEQ ID NO: 977337 - protein, 168 aa, Homo sapiens
MTEQAGGETERRRDETQPTQRRSRERSREGHQAAERSETETRDRRERQHGEEREDGQRRQTHKDASTRRAQDVERQEQGKERNDGTASSKRTSEKKTTRARREEESTHTRSTKRDDEKHNEHGIRHQNDRSSTRERGARRECSLRDRKDEDDKETHRTEAHHSGRGDK

SEQ ID NO: 977338 - protein, 186 aa, Homo sapiens
QETSNSLTRFLIGQRQWLRWRTYGEQGSSSSSSSSSSSRQQQQQQQQQQQQQQQQQQQQQQHAAAAHTDNSAAAFIVDDVRSVVRAQHAFCERRGSGTTQRRRRARACIRSQQLLIAADCLVAWSNGRRLLLHARPARPLANSRPTSDAARGRSLAKQSRDEVAGGRTRRSRVVVDQIRIRQACMA

SEQ ID NO: 977339 - protein, 103 aa, Homo sapiens
RECPGLVRNQDKVCAAWSPLASRLDPAIGPLLGRRLDPACDLLRTPGPQGSSWCSWYSGSPWPQEVNVVYQVWLVLWVNLVLWALPALLGPVVLLVLWVVLES

SEQ ID NO: 977340 - protein, 69 aa, Homo sapiens
SRLDSLWMYIERSMDELISFLKDETFINGPSDTGDPSRKRKCSSRVMKIYVNLLCFFTGYKIREVFSNL

SEQ ID NO: 977341 - protein, 52 aa, Homo sapiens
MTSPSFTKPSPIIALGICKLQGDMGAAGTQVFHVEQALSVLDIPNYAVHGVR

SEQ ID NO: 977342 - protein, 86 aa, Homo sapiens
CYCAHDRLKVYADYEDLMSSVKIESEIQHVHESKGHGNTMVHKNIAASGKFSSDRTIKEYAQNIWNVEPSDLKISLSNESHTVHGN

SEQ ID NO: 977343 - protein, 121 aa, Homo sapiens
DHTLEADRTLEIEDRTDHCFLLPEGQTDIGIEKGARQTGKEVAGLVTLKHVYEIARITAQDEAFALQDVPLSSVVRSIIGSARSLGIRVVKDLSSEELAAFQKDRAIFLAAQKEADLAAQE

SEQ ID NO: 977344 - protein, 84 aa, Homo sapiens
ARLPLSRALSARSAAGKASVSRSNVGLSALLCSPPLAPPRDPLASSGVHCWLGPGLSVSTQWMLSDKRLAPLQPGHTPFAYDST

SEQ ID NO: 977345 - protein, 105 aa, Homo sapiens
AGHLLLAQVRSPKGVPSNRFQSLLQSHHQADLFLGRPCRHPNPVTSGITICCHAGLQSLCDGLNGTSKHSYQFEGALRLGRNHVDKSLVEHSTLGQPGDQIHSLR

SEQ ID NO: 977346 - protein, 55 aa, Homo sapiens
HTLVLEDPLKSTRLQLNDIRRSARSSRCRRNLSREACTDNGEYTSNRLHVYVLWK

SEQ ID NO: 977347 - protein, 178 aa, Homo sapiens
GAAVCMSKKNSELQSEYVPGEQRWSEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYMVAPSAEAMRIWMDVIVTGAEGYTQFMNYTAVGLLAEHNWRFCIRR

SEQ ID NO: 977348 - protein, 102 aa, Homo sapiens
MGCHLGARNVQVIRDSLLQDGEFSMDLRTMSTGGAPTFNVTVTKTDKTLVLLMGKEGVHGGKINKKCYEMAPNFGVPSTDLVCPFPFTAPHSFAPLSSPYTH

SEQ ID NO: 977349 - protein, 123 aa, Homo sapiens
IDQLIHELGVAGELEDGHKPGADLLRGKDFVFSLLGLVHRRDSRFPPEAELLLLRGGILLRCSLDLGHAPLGPYARGPHYDAGFTLLVPMFSLDGTELQLDLESCYAQVCLPEMVCGTPIRDD

SEQ ID NO: 977350 - protein, 121 aa, Homo sapiens
KLILEYTRLSLILLRHSQMEVSNIREEHAIAHALSWSKSVCCLQSRLMALLGLALKWQLPQGLLPPGMTIDLFRGKAAVKDVEEEKFPTQLSRHIKFGQKSHVECARFSPDGQYLVTGSVD

SEQ ID NO: 977351 - protein, 102 aa, Homo sapiens
FCGLDELWYRTPSSGVLSTSQQRLVLALLTSGPPRYSYFHARLHAQRSWLLTLLKFENRLRSFRPQDLYIIRFTGENCVAGVRRVCESASYPEGNFGGNQLL

SEQ ID NO: 977352 - protein, 49 aa, Homo sapiens
KRGIVHPLLGPDENPTPRSDDRARQVFYGPPPRAPSGFALPRHSSPSFG

SEQ ID NO: 977353 - protein, 117 aa, Homo sapiens
SIDIAGPLSVLLGFSISMIAFQTLGIVHYSRGARSVQIWVAALVPCEIAGFTSPRLLEASRDHLTGPWAPQSQDEEMWLAGRSLHCICPELSEQLASLRTQQCLFLRAFLIIHNDYS

SEQ ID NO: 977354 - protein, 31 aa, Homo sapiens
MTAIETLLNSLFKVLFNFPLRYLLTIGQGFD

SEQ ID NO: 977355 - protein, 137 aa, Homo sapiens
MTDGYQYERRHETTDRDDVAGHKLTFLRLMSSEASQNINYSSKNSVPYVDQQTGNLKYRPCSSRGSNEIEIRAEGNSRFSYKYTVDGCTSHTGAWGKTVIEYKNTKTSRLPIIDVAPLDVGAPDQEFGFDVGPVCFL

SEQ ID NO: 977356 - protein, 86 aa, Homo sapiens
VRLCSTIRVVNSSREGHRTDLWELVVPRSLQAIPEAYASDAPMASTGTIRPIQRHNKVAQFCSTEGASVDQFMLMDNSTTDSYSEG

SEQ ID NO: 977357 - protein, 56 aa, Homo sapiens
MPAMVRTARARDEWVLGSSMSFSKGVDGHNGHVRLTLGVNSSSRGILASSAPGCPS

SEQ ID NO: 977358 - protein, 73 aa, Homo sapiens
LAVPLLYELKPVTKDRMEDIKILSASPSPTHIRGETASATSSPCRDSQESDGRTNQSRKRSHRTDRKISSKKP

SEQ ID NO: 977359 - protein, 53 aa, Homo sapiens
IAGPEIQQDEYHPPDPIHISHGSLQSRNLNWYSILVEVDYILSDLPESMGHIW

SEQ ID NO: 977360 - protein, 58 aa, Homo sapiens
SLSTPAIHMVLTEHEPFKRSADSELKALVVLALNEQRLVSWVNLICSNRMRTLRRRFQ

SEQ ID NO: 977361 - protein, 43 aa, Homo sapiens
ARQYHQGLKEKKEVVEEAENEETPLLNGNANEENGEQEADKVG

SEQ ID NO: 977362 - protein, 73 aa, Homo sapiens
GLQHQLTCSCQAFPPGICPTAMGNVCLFGWQTEQFLWAFGAKDGAKETCLNAAYLCTVAVPVYPLISQTQVAT

SEQ ID NO: 977363 - protein, 33 aa, Homo sapiens
MRDVWLVSRHPASGRSKLPLQALGLTLNLTLSY

SEQ ID NO: 977364 - protein, 39 aa, Homo sapiens
RCARVRLVSLKEAEFYDKQLKVLLSWSHLPRHVWKLRET

SEQ ID NO: 977365 - protein, 62 aa, Homo sapiens
QGGPDSLGVRDPGKLQGRLIKNSQREIKRLKGLLTQQGSPYTRPTENSNLEHLGHETPKEPS

SEQ ID NO: 977366 - protein, 79 aa, Homo sapiens
LCVLLCDDTEVQKVMEDCMRLHVKFRVLREENKQFTEEDGLRMRKTVQSNSPISALAPTGKEEGLSTRLLALVVTCFIV

SEQ ID NO: 977367 - protein, 80 aa, Homo sapiens
SLEGSRQRDMLVPLDWKDELLSGIFSVSLYIYRHEALNWAINIRGRSLMASLRILDRGLARSPFATRITPRSAAVVTAPA

SEQ ID NO: 977368 - protein, 82 aa, Homo sapiens
EGLVDLDGDGVYDAVDQSPSSVCARGICLSLQNEFHPLNQGMLSTWLQHVVSIPTRNWHKCYCVGVVANFLNVSADFLNNLL

SEQ ID NO: 977369 - protein, 54 aa, Homo sapiens
TDALVTADEGRSEVPQEIYADIGGLENSIAWTFWTLWSFLSPILRYYEEMGIKP

SEQ ID NO: 977370 - protein, 35 aa, Homo sapiens
RTRSLYRSPVTAPHGLLQLPEYPTCLFTTDRSPRP

SEQ ID NO: 977371 - protein, 45 aa, Homo sapiens
DIQIAIDLAGEEQHAPPLSSWPAAPLTTMSPDEATVADQESEDDL

SEQ ID NO: 977372 - protein, 74 aa, Homo sapiens
RTRSVYRMIIETSDTEQQTCVDSAKMQDSNRPLMWTKVIRRGGTRGVWETILCPIMHCNKEFDNGHLLLGHLTR

SEQ ID NO: 977373 - protein, 72 aa, Homo sapiens
MVVLTRQGSRLLRQGSASQEQALSAQTSCGDEPYWSRKFNAVTGSCSCDSCSIKWLWQQQQHKQLSYIIIGI

SEQ ID NO: 977374 - protein, 120 aa, Homo sapiens
VPGMQGQTRFQCGAPTFVKHSDDKPYVCNVCHRALRWAAGLSHHALTHTAATPSFCRLCNYKAKQKFQVVKHVRRHHPDQADPNQGVGKDPTTPTVHLHDVQLEDPGPPAPAAPRTGPEG

SEQ ID NO: 977375 - protein, 73 aa, Homo sapiens
QYPSMLACLPVDVYTPLRCMPPLDKFRRHSERAADLQISLSWSLVDVYSPLRCNASLYKFRRHVSTVLTSKYR

SEQ ID NO: 977376 - protein, 73 aa, Homo sapiens
QYPSMHACLPVDVYTPLPCVPPWNKFRRDMSSRRRAPGFVQLEPGRRVFTTAVHASLYKFRRHVSTVLTSKYR

SEQ ID NO: 977377 - protein, 73 aa, Homo sapiens
QYPSMHACVRVDVYPPLLLHASLNKYRQTREEPRGPPNIVKLEPGRRVFTNAVHASLYKFRRHVSTVLTSKYR

SEQ ID NO: 977378 - protein, 141 aa, Homo sapiens
NEVLKLISRTCSIQLLQVPVAVPTQMCAALADGLLGGTDNRVPISMECPEPRASTPVFGGILSLINEHRILSSPPPSWLAQPNGLYQQHGAGLFDVTRGCHESCLDEEVEGQAFCSGHSCDPVTGWGTPNFPALLKTLLNP

SEQ ID NO: 977379 - protein, 94 aa, Homo sapiens
MHHCNAASLNKFRRHVEHSAELPNIVKLEPGRRVSLTAVHASLNKIRRHVRHRADLQISLSMEPGRLLEDPPVPEHCIACLQVNVYSPLRCMPP

SEQ ID NO: 977380 - protein, 126 aa, Homo sapiens
RTDPSRTSAPSSGSGSKSSQRVSTTITSGCCCLSVVGVVQTPSRLLPKKPTAIKTEGKPAEVEKMTAKPVPADLSRPKSKLTVLTDPLTSCTKEVGKAALEPQIDHITEPIRTEKEEAEARMRQAS

SEQ ID NO: 977381 - protein, 73 aa, Homo sapiens
MNSFFLSLYYFIIRPGSFSTFTQILFYCTIHINFIVSSDRPEGQQDAAEAQHPQGPHGVRPVSLKSPSIAGTH

SEQ ID NO: 977382 - protein, 115 aa, Homo sapiens
MQNKPIDDITLQTGKVLGVTSDGEIARCKQLICDPSYVQDRVEKVGQVIRVISILRHPIKTTNDDNSCQIIIPQNQVTRKSDIYVCMISFAAHCSSTSQYIAIVSTPVEPKEPAK

SEQ ID NO: 977383 - protein, 75 aa, Homo sapiens
GESRDPSDQEVPGGYMATRCSATKALWMFKVMCSDWAAAFLGSRRVAYGYLGYPVDLIFVKGSAVVPLALISIVG

SEQ ID NO: 977384 - protein, 84 aa, Homo sapiens
RDRGTGGQISAGRSLYTGLRSIRRSLVVPAYEPFFKLLQEVHPQVRKIGVFSCGPPGMTKNVEKACQLVNRQDRAHFMHHYENF

SEQ ID NO: 977385 - protein, 101 aa, Homo sapiens
TTLLIWRLSGAVPLSAVCSFSVVVSLVLGAAVPACFCLSPSQGFVLSAARVQCPKPASDHVPPLPCLQDIAHAQLHYQRGSLQPDPIVLPRHLLLFPPQDT

SEQ ID NO: 977386 - protein, 168 aa, Homo sapiens
AQLMMLLLRPPRRRKLRDPSVHAEQGGWNVELHAEQDNTVHWLSGVRQQCEQRLAQSLRQPVQFVSGKIEVGMMLPPLILPRFKTDIAVARQRLGQGLCMPFEVAGSSGELRMEPGTAPVGIQPLCFETACGVLAFSEPGPQFSLMGECPVTLEPAGNDPDAWFWELS

SEQ ID NO: 977387 - protein, 192 aa, Homo sapiens
SSCSEVTELTADIQVIDYMHVILTRSHISKPSTMTQLPSRSFVSVPKGGRLMVLNNMKYGVIGIIFIQKIFKNRAVFKKKNKTRKAAVIIERSHSKWGRGVTTLHGHARPSCSGVFTWSHVCVSPVGQLLVIPPVAVGVDNLTEQKAMKSLGSHTGYIGIFTSVYEVYFEIHSHLRMNTCLPCISLLVSKIV

SEQ ID NO: 977388 - protein, 142 aa, Homo sapiens
MLPMDFEQEMAMAASSSSVEKSYELPDGQVITIGNERFRCPEALFQPCFLGMESCGIHKTTSNSIVKSDVDIRKDLYTNTVLSGGTTMYPGIAHRMQKEITALAPSTMKIKIIAPPKRKYSVWVGGSILASLSTFQQMWISK

SEQ ID NO: 977389 - protein, 119 aa, Homo sapiens
KVKKLQLSTRKVETEMETYQPTSLCNMKDDTGKGTQVSVEDSASRMDTGVGCLSTSSHYANRNADTFRCLCRTRCQRLLKSQRRGVKKSCISVPHRQLSQALHAMRDSSETWALLLDAD

SEQ ID NO: 977390 - protein, 143 aa, Homo sapiens
DTAVHLILHGDSMRSPEPSRLEDSYYLQWTDSTRRRSIRNFDLHLRYLSGYETDFDCAYDLFSEACVREYKGFERTIFVRAKTEVSGPISCFFSLHHCCCLEEQPGEQPPSRKQVNHITYSCGGGKWMVKPNGVVLKFGDKSP

SEQ ID NO: 977391 - protein, 55 aa, Homo sapiens
TDEEEVSDILAVKACIIDFHSPTYLILGTVPVSRVWLGRWNYQEELDEHVAKHMY

SEQ ID NO: 977392 - protein, 88 aa, Homo sapiens
MRMKRNQNQKKKMNHRKMLKNCNKVNHIIGETGQSLGEGTAYIFGVMQQPWNYLMAVMDGSDLSWMENLPPCIQVVVRKVDLTVQKAE

SEQ ID NO: 977393 - protein, 112 aa, Homo sapiens
RICEPDLHLPLSLYKKLLNCKACLGRLKGVVTQVKEGVSKSCLDLPGEDVEETFCLNFTICRESYGVIEQKKLIPGGDNVTVCKDNRQEFVDAYVNYVFQISVHEWYTAFSS

SEQ ID NO: 977394 - protein, 70 aa, Homo sapiens
MTLIITKYRECPVAVVDCDVISLPSALNVKVKKFNEARVNGGSNYDSLKVAECLVIYISDAHEWMNEIPT

SEQ ID NO: 977395 - protein, 104 aa, Homo sapiens
MDDIQIRVVAVPRDFPSRCSLDPEILMACGSVFSEGSPLIEQEDSSPSHDRSRPVSASSTGDLPKAKTRAADLLVNPLDPRNADKIRVKIADLGNACWVHKHFT

SEQ ID NO: 977396 - protein, 115 aa, Homo sapiens
MDARPSCLCAVSPSMQVSATLPSPPHHTRLLPPGHLTSVCTCVPQEALTSGFSSWAVVIQSMPGCPQKICGVLCSPALGVTTVDPQHFSCLLLPLVAASKLNQLVMFLQPFPFLA

SEQ ID NO: 977397 - protein, 147 aa, Homo sapiens
LKSNHMLQNSVNLKHLLLKGKRRTRYEAEKHPEVLPAEKASDPASSLRVAKTDSKTEEKTAASAPANVSKGTTPLAPPPKPVRRRLKSEDELRPEVDEHTQKTGVLAAVLASQPSIPRMFLRREFPWKFNWNNFDHSLTYKPIAVNC

SEQ ID NO: 977398 - protein, 32 aa, Homo sapiens
MSIEKTHTHTIAAGMVLSLVFSYWQGILEVSK

SEQ ID NO: 977399 - protein, 32 aa, Homo sapiens
ILPPETQTLLTATQERGNRRAAIKVPVTERHI

SEQ ID NO: 977400 - protein, 84 aa, Homo sapiens
MSTGRGYAAECHVIESCQDSPQCDRVNSININQVSITFAGGPGRDGTIDFTPGSELLITKAKNGHLAVVSPTAEFSVIKAPTGP

SEQ ID NO: 977401 - protein, 124 aa, Homo sapiens
HLRCGSGHIKLRQRLYIQPHLSGTGELSGEETQAGMGTGVTVDTGVGCLSTSSHYANRDADTFRCLCRKRCQRLLKSQRGGVKKSCISVPHKTAVSGFSSCERHIRALGTVAARSLRVAPSFST

SEQ ID NO: 977402 - protein, 73 aa, Homo sapiens
MVREKLEMNILEINETLRPQLAEKKQQFRNLKEKCFLTQLAGFLANQQKKYSKIYRLTIMKVMNDILISLGPM

SEQ ID NO: 977403 - protein, 106 aa, Homo sapiens
WNLEGYYTYRRRDFSYCRPSLCSACYRTYSFHAAWPSDGWTRCPYSHQYSDRRQPNISDQQVSALSYSDQIQQPLTNQRRMPQTFRDPATAPLRKLSVDLIKTYKH

SEQ ID NO: 977404 - protein, 127 aa, Homo sapiens
MTNYRFLVVTHSWGGAFSRPWMSAHSMCCHRGAVLQVACRLLDALEFLHENEYVHGNVTAENIFVDPEDQSQVTLAGYGFAFRYCPSGKHVAYVEGSRSPHEGDLEFISMDLHKGCGPSRRSDLQSL

SEQ ID NO: 977405 - protein, 61 aa, Homo sapiens
LRVSGGQQVLKCRRNLSRQACTARGEYTSTKAPSLRSLEVSTVLKYRRNLYREACTAVVNT

SEQ ID NO: 977406 - protein, 80 aa, Homo sapiens
SLSDFALFSLLHSLGADDFQYFLILLSLNIFIPIFVIFWAELLDKVLCQSTPLSQLFLEVLPLGLVRLIRSEEGLEMLIQ

SEQ ID NO: 977407 - protein, 123 aa, Homo sapiens
LRLQNYWAQQAGLFTMSARKAMLAHPEVDYNLQYSHYNGTVRNQLAADQAQQRQAIAKLAEHYGIMFFYRGQDPIDGQLAQVINGFRDTYGLSVIPVSVDGVINPLLPDSRTDQGQAQRLRVK

SEQ ID NO: 977408 - protein, 106 aa, Homo sapiens
RSIHDVIRISAMAPGSQASRYSLLGFILLFNLSNYVLPIDEGFEATHSGLVIQRKDIYSLNGHVTFICVCLKNNGLGYSVYDSPFDVDILQRNQVMLYRSNITWFL

SEQ ID NO: 977409 - protein, 117 aa, Homo sapiens
WIAQDLVCTHRKCIHTHIKEPRDVFGSQCGHPVICAYTFDTCVHTHRQKHRDVSGSQRGCPVISAYTDTCMHRPIQEQRDTFGSRCTPCDLCVHVTHAYTPTDKNTETCLEASVDAL

SEQ ID NO: 977410 - protein, 44 aa, Homo sapiens
MNRQYLKPDAVLHLASMGPKLCSLYHHVHSTLNSQSYSEHQPSS

SEQ ID NO: 977411 - protein, 79 aa, Homo sapiens
MYLQAWRAPLLIKAKRPQEGDILLEEKRLVLVRRKSSISLAISESCSFEPMVSSFWISSFSSFLLRVCLSPSLPEYLWK

SEQ ID NO: 977412 - protein, 133 aa, Homo sapiens
RPLHPPYFGTKFKHPEGKTKRGSKLTGSQPHRKPDYNKLVLSTLRRGSQGCARPGQAKQDDSKRILNVVAIRSPVMCLESVDKGRDESYELCKRMGEAEGHKQKYWRERPGSQEAAGTCQVEASCRQTRKEAL

SEQ ID NO: 977413 - protein, 95 aa, Homo sapiens
MDQDDLGYLHGNLSLLPGEPWNYSLALVNSSNVRAMMQELQAFLEPALLTYGLTCASGILLAAERFAPTKRWHIDTILHVLTTAGTHVRDDAVDR

SEQ ID NO: 977414 - protein, 108 aa, Homo sapiens
MEVCGLSLHEFSRSEYAVCALWNDIRCCRWTNRTAVMSGLYNSQLNIGIRVAFVNKGRWRHEMAVLLGDVYVVGGYDGQNRLSSVECYDSLSNRWTEVAPLKEAVSSP

SEQ ID NO: 977415 - protein, 109 aa, Homo sapiens
MANPDIKYINQESTTHTATPTPMEELGTDFYKVQKAEMPFHSVSSEDNLPTIECQNVCALIFLHKHCLEMSQKQMLGIKVELIYSFKILKNAEKFQFRTAAFFLSELMT

SEQ ID NO: 977416 - protein, 80 aa, Homo sapiens
MTKMHSPPGHKDIHTYSHINPSDFKSISSVSLSNIYTFRFPLHGIRVNGRDLWELWAISCRNRDSFSNWDSICSLSSFSS

SEQ ID NO: 977417 - protein, 95 aa, Homo sapiens
MRHADNDRPPRRGLDEDRGSWRTADEDRGPRRGMDEDRGPRRGGVDDERSSWRNADDDRPRRGMDDDRGPRRGMDDDRGPRRLMMMAIISIRVPS

SEQ ID NO: 977418 - protein, 72 aa, Homo sapiens
TYGPWANAGPNTNGSQYIRSALPRTEWLYGKHVLFGNVKEGLNIVEAMERFGSRNGKTKAGRSPLLDCGQLE

SEQ ID NO: 977419 - protein, 40 aa, Homo sapiens
GTITDLIKVLDSQTMMVLVNYSSCFKAKWEMPFDPTRYII

SEQ ID NO: 977420 - protein, 100 aa, Homo sapiens
MCCCWCVCHATRLSPERRVTDAIIRIELAVLSDDVAQFLDHNSVLLIPKMAGHPSSTRGLEIVDVAATSLPTDAGPFLKIGHAFPVFVVIEVTLGAYGPS

SEQ ID NO: 977421 - protein, 43 aa, Homo sapiens
ERREERSSAHRNGPRGPMKNTLSRRRKTAENEEEPVSSGNRKG

SEQ ID NO: 977422 - protein, 77 aa, Homo sapiens
PVVNQTHDEAERDKSRLSIVREAAELLNHLVTFLCESHQLGPQVELNGGPLMAGYRRSNSRRSMLREMGTTQGQEGS

SEQ ID NO: 977423 - protein, 74 aa, Homo sapiens
PPGFSDQPTRFTFDVDYRVPGTSSEFPGPARTLGYLPGLPTRFRVLRQLSRNGAPSGLLGLLSTPGTHQASPPD

SEQ ID NO: 977424 - protein, 166 aa, Homo sapiens
DALYPACAVCQRQPIAVYWSIERDCPNCCTPFGYRDPGVLPWGRSWRRRRRTVGMESQRPSQKSPRHELQDPHPSRELPWPMQARRALMAKKCHAEIQVVYGSGTKTDRWARLLRRSKEKTKEGLRSLQPWAWTLKRIGGQFGAGTESYFSLLRFLLLLNALAYST

SEQ ID NO: 977425 - protein, 72 aa, Homo sapiens
IAVPEYPGYPGNPSTTYVQGPGFAISTKSVTDSVPVRHDINRQCEAMYVPLPLITKSSLRNEESHLFMVFSY

SEQ ID NO: 977426 - protein, 143 aa, Homo sapiens
RIPASTVGSSFSCIGWSPVTIMTLIPALSDMCPRNPERPPVEEAIMEISPTEHSSSIGKSIIVSVRLEPFRKSICWHAGVAVTKDSNSEAPQLQIGVLKGVFQLLIQGLLLAVEEDRAATVKDPFWGALHHQQVLGLRCVGDN

SEQ ID NO: 977427 - protein, 138 aa, Homo sapiens
TLEPNTVADERRPRKDPSTLQIYPPPRTRSRPLVRGAERRLSATPHFELGGTRENESYGFCHLFLPDEQFPEGFQFDTDDVNFPMLICAYVGLISMIEPPRADVPDAVSKCEVLELSVIMVTGDHPITAKAIAKGVGR

SEQ ID NO: 977428 - protein, 35 aa, Homo sapiens
CLNLSPGQCHSQGRQFIFTISQLVKSLTPMQELVG

SEQ ID NO: 977429 - protein, 40 aa, Homo sapiens
QEEWQQLLRVMLLVAQEIEMQNGQPCSKKMGRIIRERGSK

SEQ ID NO: 977430 - protein, 149 aa, Homo sapiens
MPLVYSMSAAVDKQLAEIVEKIIIINDKGRLSMEDIERVLQDAVKYAACGGEARVQGATQVLTCFPVPLNMKAPVEDEKLSRHDQSMRPEQKILDKCNEIINWLDKNQTAEKEEFEHQQKELEKVCNPIITKLYQSAGGMPGGMPGGRR

SEQ ID NO: 977431 - protein, 155 aa, Homo sapiens
IAYWYTLVSLLWTRVREIVEQDYYTNVARRRSSKDDIDRIAQEAEMSNAENETQKYTVSSINPLVSYAFNIIPTVEGLHPFEVKHYLIQDQCMKQFCTECHVLIHCLDNNQTAEKEEFEHQQKELEKVCNPIITKLYQSAGGMPGGMPGGRRWVP

SEQ ID NO: 977432 - protein, 168 aa, Homo sapiens
IRTHGGVVRLPSLLRLYANGILNVSAVDKRYGEKRTGLLSLNDKAVRARNDIERMVQEAEKYTADDAKQRDKVSSTQFTGVPHAFKHVKRTDVKHEKLQGKINDEDKQSASGQVYMQFINWLDQAIRHAEKEDFEHQQKELEKVCNPIITKLYQSAGGMPGGLPEDKR

SEQ ID NO: 977433 - protein, 111 aa, Homo sapiens
ESSVHICNKKSEPQYPSDVGPIVCREATEAWLRDGRLMLNDLPSPPTFEGGEEVVSFRGRGRERGFGGANHGGYLNAGAGYGCYGYGGTSATVGDSDCATDCYGYHDFGSS

SEQ ID NO: 977434 - protein, 52 aa, Homo sapiens
KLGDVLVDVEDTGTTPAFRQKPVVFCIRREENRVLISRDLVELDGNGDNLVG

SEQ ID NO: 977435 - protein, 158 aa, Homo sapiens
RKVVVVRVLQAGSRIGYIVSVGMQGSGVTDEMHRYECDARVKEGVEVTEHRFFIRASIRHSDLITKEASFEYLQNEGERLLLEAMDYLKVAYNNTSVRTDCNHIFLNFVPTVIMDPFKIEESVSYMVMQLKEDGCGKLRVLQAEVKIKIRQNTTAVPF

SEQ ID NO: 977436 - protein, 161 aa, Homo sapiens
MLFLMFLVYWYPMLGERSSCPDSSMVILDTWFGVSFPSSKESFSPVSESQYINVSVVAPRVTVGLAAVFIHRQTLDRFTVTLDDVQGIAGVVSVQIVDVPGQGDTEQVVLLPEAAHAAGPEPWSPMENVLTTDSTLLSKSWKYGSPEAESKWVLSGLRLIA

SEQ ID NO: 977437 - protein, 109 aa, Homo sapiens
IRIELVPVSSASRIIPLLSGRLGRGCGGTQATQERDATEFSKILSALALPCPASSGHQISTQCVTTPSPPIPQRDSSRGDESQGPWGPSVEKGAGRDAWESTQGQVQAC

SEQ ID NO: 977438 - protein, 107 aa, Homo sapiens
SRGSCRGVAGCKAGGHGISRSSWSGVLRRTYPSLRSRVLGVLGACWVITGSEQESERQAGHESHSSIVAREGNPSLLWISPATFQGRPHYIIRLNTAGRSAGSSRKL

SEQ ID NO: 977439 - protein, 103 aa, Homo sapiens
ASPKGTCFCCSMPHYFGVIGLRHHFAIHDPAVVIIMDGLLELLAVQGITKIKVLTIFQQAAVVAISAVQLDLDVQQGLILLGLALSLCPGLCQLCLKVQQDPV

SEQ ID NO: 977440 - protein, 37 aa, Homo sapiens
MDVYCFFFSITKVMTITVAMTTPATMSPMIAPLFEPT

SEQ ID NO: 977441 - protein, 140 aa, Homo sapiens
MADIDNKEQSELDQDLHDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEED

SEQ ID NO: 977442 - protein, 154 aa, Homo sapiens
IDPKEDKSVGRAPGPYTRKMQTLLRILDKESLSENPTLEYLFYRENCGNCTFIQYSDVDFTGAPVQRNYLSSIPGIMDYLTPEKERVQEDLGLLQYHICGEEEVVFQEEQLQTQNSAIVKDDEGQEDYQFDELNTEILNNLADQELQLNHLKNS

SEQ ID NO: 977443 - protein, 66 aa, Homo sapiens
SERYPGLRMTRNQNMTGKDDDYGNMLCMRRRTAFDQVTGVHRKENIQNSKFITKEQEENVALKGVS

SEQ ID NO: 977444 - protein, 137 aa, Homo sapiens
MVQIINILITRTVILLNLLTVIILLFITVYHLGILAILCPLGWDGSTLLTRSSYQCFAWCGSLLARCGNCFGWCSCLLGRCCCCLLAWSDSCFLGWCGNCNLFRWGNDHLLCWGSSSLLAFLLRYDDLFSTAIIFFI

SEQ ID NO: 977445 - protein, 76 aa, Homo sapiens
MHRGVLVTLLKIAVLKSMHRGVLVTLLKITVLKSMHRGILVTLLKITILKSMHRGVLVTLIKITILKSMHRGILVT

SEQ ID NO: 977446 - protein, 164 aa, Homo sapiens
QEFKDRCFTFLSLVTHHPYLWLDSIYLQMKHENNYKAHMGPAYDEHLYKCESITIYGELSTFLSTAIYAMVPLLEEMERQISYVTLVRPIREDAAIIYHVCRGLMKRSFLLLHLAGTPPVPGSLLSFQVTHFSFLKILDPRRSLFTLGRNLCPCNVYPPSFLST

SEQ ID NO: 977447 - protein, 41 aa, Homo sapiens
RSHAVDKIQNTWHGGGVTDYRDGTDTNYYSEKGFPKSGCKL

SEQ ID NO: 977448 - protein, 110 aa, Homo sapiens
SRECHDVIPGCMMNEAWVHQCHHVWTMVGERLNGTDPEDVIRNAFACFDEEATGTIQEDYLRELLTTMGDRFTDEEVDELYREAPIDKKGNFNYIEFTRILKHGAKDKDD

SEQ ID NO: 977449 - protein, 90 aa, Homo sapiens
YISWQSEHILQPLSLSNYGTLLHQCNTPPYVLQDTWSNKTLNLGCLGPRFLTFFISGLSYNILADIIFFIEIEKFADSANSFGAQVGEAL

SEQ ID NO: 977450 - protein, 46 aa, Homo sapiens
MLWSIGLAISKETAMPYKCMRSLISSSSFTQQCPPEVCPTSLARRQ

SEQ ID NO: 977451 - protein, 92 aa, Homo sapiens
KTKLADRYATQRSLNQLVRSSLTSSKEELAESSCRNQSVNGKAPLATGEDDDDEVPDLVENFDEAPRMRQTELSQLLKIKPEEVTGSCYFIL

SEQ ID NO: 977452 - protein, 116 aa, Homo sapiens
MCLLYGTGRGKAKGAEIKTTNEVVLAVEFHPTDANTIITCGKSHIFFWTWSGNSLTRKQGIFGKYEKPKFVQCLAFLGNGDVLTGDSGGVMLIWGKTTVEPTPGKGPKGVYQISKQ

SEQ ID NO: 977453 - protein, 112 aa, Homo sapiens
LGKVTKGLSNSAGFLTMPTLDNIPFVAYLSQDVVKAAVAAVLYPEEFMVLLDSVLPESAHRLKSSIGLINEKAADKLGSTQIVKILTQDTPEFFIDQGHAKVAQLIVLEVFP

SEQ ID NO: 977454 - protein, 181 aa, Homo sapiens
HHHISAEDKATISQPPRGVVGAQRVLQMWQGRTAWTCGERQQALKDWTEPWEAGRRLRRTEDEDAAPGWSQTLPTCPAQELRATGLASYGMRGSWHRSPLPAVVLPSVLQTALSPLALCQAWRRAVPHGVPSHRLRNQEASLVPKGVPSAWYPGPLENGLWTHLETAELLGLKTTPGGLLL

SEQ ID NO: 977455 - protein, 83 aa, Homo sapiens
APPLSSRDACWGSRDSALAVCSEDTETEPSLMNGAEYQAGRFALSLRKHCFGVILGANTRPDLDLRDPICDDFFQKWQDMAES

SEQ ID NO: 977456 - protein, 82 aa, Homo sapiens
METDDNIRAIQLSRDGQYLLTGGDRGVVVVRQVSDLKQLFAYPGCDAGIRAMALSYDQRCIISGMASGSIVLFYNDFNRWHH

SEQ ID NO: 977457 - protein, 87 aa, Homo sapiens
MVCTGASVDHGVAGSMLHWRQEVSHRLSAGHDSRSQAFVVSRGLQMMSKVFFRVSRYQALAVLWMSQQILNVDQCQFRFDWACVMDL

SEQ ID NO: 977458 - protein, 80 aa, Homo sapiens
MINKATSLSTLGRHKPVIPLLNFLPPPAENPKGQKDREAPLSRSVFVLKIKIKRAFALLLHGRFLSSLSSPEDTCVADVP

SEQ ID NO: 977459 - protein, 93 aa, Homo sapiens
MCQKSYHRALLARGRHAFISTSLFDHSMSALPIIVKQNVTKRWIVHPLIGNVSWDETVVRQVSFTLLMMCCCHGNPAQYERNRRFRHLVYVLG

SEQ ID NO: 977460 - protein, 141 aa, Homo sapiens
DTRDAGRRIMENNADVLTSRHRVWSYTTTVSDHLQNLRLVVLDSYENILGVCLRIWIRLATGPRIVSRLAAQYECPRVLSLLSMASVPKTNKIEPRSYSIIPSCGIQAARACFEHSNFFKVNASGPAGHSAKSIEGAPRGK

SEQ ID NO: 977461 - protein, 106 aa, Homo sapiens
MKEKWEDMESVLKDLTEEKRKDVLNSLAKCLGKEDIRQDLEQRVSEVLISRELLMEDSDKPLLSSLFNAAGVLVEARAKAILDFLDALLELSEEQQFVAEALEKGT

SEQ ID NO: 977462 - protein, 91 aa, Homo sapiens
WRADNQGLQLTSTQDKVASVINIHPNTTHSTGSCRPHTAQLQHNSSTIKYLDFVFAVKNENRFYLKEVNISMYLVHGSVISIAHNNLSYWN

SEQ ID NO: 977463 - protein, 79 aa, Homo sapiens
MSMIVQYNQRSLYAVICEWHYTPYLEITASRSLNNRYLRHQGHCAQASDTCLEWNNLAQEIPCLSKCICNCTGMNIEVV

SEQ ID NO: 977464 - protein, 137 aa, Homo sapiens
YTDDYNVIDCDPIIFIYLLNCSYRARVVKYQRDGPNCMQDNQGGAPNYYPIQLWCSVTAGFCPVSQYPIFCINGEIQTGNDYYIIQVWAFYVNVLNEAQRKRLCENIAGHLKDAQICIQKKAVLNFTDVQPYYGSHI

SEQ ID NO: 977465 - protein, 92 aa, Homo sapiens
QLAGFLDFTYQEFRIQLFVFEDKMNEPRVDQRYSQPWMVEFQSASEVAFYIDQDMIQIADTKVARCNGDVFIRQIHKFEELNRTLKKMGQRP

SEQ ID NO: 977466 - protein, 121 aa, Homo sapiens
GSIDIASVFLSMYTSGKVYAASMNISIGRFLIKSECDKILAVIAQVQVLRDQLCKHCTTINIDSTWQDESNQAEEPLNIDRECNEGSTERQKSIEKKSNSTRICNLTEEESSKSSDPFSLW

SEQ ID NO: 977467 - protein, 83 aa, Homo sapiens
TGPFIAGSAGTPSSNSTRWCHVADTSKPYGNFLLATKIHTGKGTELCGETGKVLTIQHHADELFIVDTTIAVLMPCHQHLRFG

SEQ ID NO: 977468 - protein, 39 aa, Homo sapiens
RQQAYHNHEEPVKDDELSVGLMVPREVGAETTEQKYTPR

SEQ ID NO: 977469 - protein, 92 aa, Homo sapiens
MPWLVRYRNYQRICFTNYRTALHHHPRNRERAINLSILSVSGPGEVSRVESNEAAGSTPGGALPSIPLSFSFATILPPEPKDFGFPDCLDYK

SEQ ID NO: 977470 - protein, 97 aa, Homo sapiens
NPSSRSEASLRLLALSQTRRTGAFQFYPVNPMIRGLGAETISTYSQTLNGKEARLAGVEPGVECECLVGHFWEAELALRDEPNAVVKAPDADCLDYK

SEQ ID NO: 977471 - protein, 62 aa, Homo sapiens
QREEEEEEKEPEAEPLVPPQVSVEVALPRPAELEVKKVTKGDTLTRRTVNQQKSEFPITIDR

SEQ ID NO: 977472 - protein, 94 aa, Homo sapiens
MVAWLNSASAELVKKILCDEQQRELQALYALQALVVTLEQPPNLLRMFFDALYDEDVVKEDAFYSWESSMDPAEQQGKGVALKSVTAFFKWLRE

SEQ ID NO: 977473 - protein, 77 aa, Homo sapiens
MKNDESEEEQSSSSVREDETNVKMESEGGADDSAEEGDLLDDDDTEDRGDDQLELIKDDEKEAEEGEDDRDSAHGED

SEQ ID NO: 977474 - protein, 74 aa, Homo sapiens
MGVLGPLSIDPNMLNAQKQQVQFMLKEFEARRQQHEQLNEAAQGILTGPGGVSLSTSQVQKELQSINQKWVELT

SEQ ID NO: 977475 - protein, 133 aa, Homo sapiens
SACKIGTNPVCEDCTRVSVTGFILLVIAASRAYRILIIIFLSEEDEDVMSACFLLVLVLREFLFFSLTMTAFFLDEVLCFFFLLSSELSSASDDDEPLCISLVFLFELKFLLSLNSILFSLLSEELQPSSFME

SEQ ID NO: 977476 - protein, 127 aa, Homo sapiens
SRDGGLTNDSSYSKFRVLVVHGRYVRLVDADLSGYFLSNERESGMLTSYASPERSASPNFLEGQVAFSHPRLSNNRSVMPLDVRGCTRATLTGSACAYPTPAGAGNPLNPIRDGDRGLQLFPMNEEF

SEQ ID NO: 977477 - protein, 92 aa, Homo sapiens
MIQLELSTVRVKLLIGSAESCQLSCVKFACSQSYQIVRLVFRPYTQVDDRFARQDRYGPPPEFPLASPCPGIVHHLSGPNTVRSCSTSPSRL

SEQ ID NO: 977478 - protein, 135 aa, Homo sapiens
KSSFQPLRLYLFQLHSEVFDWNYFRDLSSFHFFLTKVPESSIYNITALADQCLQLIFFCWILFTSWGRACTSIEFADNWMNNFFQFLLLSCEVFNVSILVAFQPFNLFFYSFFHGLLIFRGKFTSQLFFISNLIL

SEQ ID NO: 977479 - protein, 44 aa, Homo sapiens
SRASRIIDELFQDRFFTRETQDTYHYLPFSLPQRRPHFFFPKSR

SEQ ID NO: 977480 - protein, 53 aa, Homo sapiens
MVVGAKIQTRTLKAEVEKGSMEQQLNMGQSALRDGRAPFRRDGRWPPMPSAER

SEQ ID NO: 977481 - protein, 72 aa, Homo sapiens
DHDPSTPLTVTCGPDRSNLGYMLARKTHGLVVANQELRQRLGMDALVAGEEEETKGNEVRPVDGSAESAELR

SEQ ID NO: 977482 - protein, 71 aa, Homo sapiens
MCLRVILAIGADSVILSFLSLFFIILDQSSWSSPRSSLSSSSSRSPSSAESSAPPSDSIFTLVSSFFTELL

SEQ ID NO: 977483 - protein, 106 aa, Homo sapiens
MEPLGQLEKLREPSFFQTMAVEEGPPARQGCTGGRPAGVLRPARVPKHGCGRSQCRAIGPCRPGNDGGGQGASQLGAYHHIPGLGVLGQSLPPGDSARPRPTRPAP

SEQ ID NO: 977484 - protein, 99 aa, Homo sapiens
HLLSMNSSRQLSLQNIRDTEVTQRKGQLKSEARHARPCSTYSPEVWLDHVDRIRSAAPVARGTPAQTTGSSLLRALYPFGDEVYFDSQQGDMQLLLNDD

SEQ ID NO: 977485 - protein, 149 aa, Homo sapiens
TGTCKDMNVITWRFCFQEMEKDFMILSFSGKKMKEIAMKDPMTEIKQLTGSTNRHDQRHAGNKPIKDQLGSSFHSHLPELHMFQTEGKIGNQVEKSINSASLVSTSQRISCRPKTHISKNYGNNFLNSSLLTQKAGSTHERKIFPVWRE

SEQ ID NO: 977486 - protein, 98 aa, Homo sapiens
LCSWIERSQAPSDDLIPYRVTCRTDYIEVMADVDGRRARGRAIGRGIKSQAAGRPRRGREGCRFGLILIMHASPREGGQRPSACISSRITTGIQVGEE

SEQ ID NO: 977487 - protein, 102 aa, Homo sapiens
MMHLPPSQIAEGALCLALQILDTGEWTPTLQHYLSYTDESLLPVMQQLAKHVVMVTSRTYHAHDCQEQVCHIEACYDQHSTTAEYCTSSRFSQGCGKGVTCK

SEQ ID NO: 977488 - protein, 113 aa, Homo sapiens
MEKARYYIKIHEPNVPSHHVSYIIFETERSLEPGSIHKRGHDPLSQQNFMGTSEGSWSPAHFCMLGLSSRKGSWALRTQWPLIQGRTLSMMCLACFSFAFSPQALGHNVSARE

SEQ ID NO: 977489 - protein, 47 aa, Homo sapiens
MQTARIKAKAKRDAKRISHSGIWGVLIGPEVVFAPPSDSHVSVHLIQ

SEQ ID NO: 977490 - protein, 43 aa, Homo sapiens
KLLHQCALSQRRFEAIHHELLQSELTELRTTQVKTAKESEGSL

SEQ ID NO: 977491 - protein, 75 aa, Homo sapiens
ALSRSDMRRGYPDVLRSGSQLPVHGMLTRGSEEISMGSPSDRSPLSPGASAEAGLLLFFGLSNRKSAGYRCILTM

SEQ ID NO: 977492 - protein, 113 aa, Homo sapiens
MDLHVVGGQECCRARCILQAANSRDPPLWILLIYTRFIVLSASFRSDSLLQFSVKFINALHVGFLRLRCWWQMTESLLDAGPYDFFPKSHRWPLAFRVLWFWYPSSQSPVGMH

SEQ ID NO: 977493 - protein, 172 aa, Homo sapiens
HSERDKQHFQGEKKNHVIRKQRRVRASHFHVCLFPAALAPFVFLLFLMAFIPSFVLVCFQSFCLPSFSFFEEVVGSLEEGMCGFFSLFFYRILIVWFSVISSIPERDKQHFQAEKKNHVIRKQRRVRASHFHVCLFPAALAPFVFLLFLMAFIPSFVLVCFQSFCRPSFSFF

SEQ ID NO: 977494 - protein, 34 aa, Homo sapiens
EEARGLLGKNYTWGGLREERRQISGCGQVVMGLN

SEQ ID NO: 977495 - protein, 64 aa, Homo sapiens
MSIGIKMRHRRGWAQQRHDNDIDIIKKENDTFTRQVHATRGGAAYNIMVLEAKQEIPASPFHIK

SEQ ID NO: 977496 - protein, 126 aa, Homo sapiens
LVHLLACSNIVKYTATQPFRQYRVLAVGRLVLCNTRWNSVFQQGMKNKILILGLFEETVLAAFQIATALEWVLLLGCIPSNLPGGSVPSPTLFSSSYMTKSEHSSSGDRPGGYGLEKETYYKPPVL

SEQ ID NO: 977497 - protein, 108 aa, Homo sapiens
WLFGGYRTAVINGIMIVLGTASCNRKVGGTLWSFVFVYQYARMMLVARLYLSPSFIRHWGRGILSAAVFLDSLNPLLCSTGVSCAINASPQDLENNLNSKSNAKTLSW

SEQ ID NO: 977498 - protein, 105 aa, Homo sapiens
ETVMTGAKYTAVDSPYPGADALTSSGELACAFDIPAYLSIRVLISYAGAVEGITQQEILGVETWFSSVNWQDQCGLTCEHKVDLLPISASVQFMKMPAQLPQPLT

SEQ ID NO: 977499 - protein, 55 aa, Homo sapiens
MHASLNKYRRDVSTVMSSKYSLCMEPGRRVFTTAVHASLYNFRRHVSTVLTSKYR

SEQ ID NO: 977500 - protein, 68 aa, Homo sapiens
LCISCLRGNNFHMGPESSPVVFPSLMAESFYEVVFGYGFRDPPVAFFFFLGFSPVNYRGVGSYLFVDS

SEQ ID NO: 977501 - protein, 116 aa, Homo sapiens
MRALANNPTKAEVLKVLGNPKRDEMNVTVLDFEHLLPMLHTGGQDKDQGTYEDYVEGLRVLDKDGTGTVMGAEIRHVLVTLGEKMTEAEVEMLVPGHEDSNGCINYEELVRMEMTG

SEQ ID NO: 977502 - protein, 101 aa, Homo sapiens
SDNSVRGSTALRCTLPSGAPKSSVQSGVQSMELLPAPSPGSMVQVEVSGQLILTNLSLTSSGTYRCVATNQMGRASCELTLSVTEPSQGRVAGALIGVLLG

SEQ ID NO: 977503 - protein, 147 aa, Homo sapiens
LLRHFFRSLNVSRQDTQCKTLSMGQMSKTWAAREHGSGREAGQQEATTPTIGWVPLILSHHLWHIVLAPKSPDGAHVSDQLPHDRGGGQGMVLHVEDHVVCVCKDVIIPVEQKLELAHLVSCHCKNRTCLSVRLTKESWQSHCRMSP

SEQ ID NO: 977504 - protein, 203 aa, Homo sapiens
VQRTHEAELGCGAGARIQARRGGHLSIQNMTTLLANASLNLHSKKQAELEEIYESSIRGVQLRRLSAVNSIFLSHNNTKELNSPILFAFSHLESSDGEAGRDPPAKDVMPGPRQELLCAFWNGDSDRGGHWATEGCQVLGRKNGSTTCQLQPPEQLCDPYGSYDVEDWKLTLITRLGLALSLFCLLLCILTFLLVRPSRVAHG

SEQ ID NO: 977505 - protein, 69 aa, Homo sapiens
PYFRYISTLIINHLSTGISGESTVETSPGYLENQFNVEEFSFQELSRHVQKEAKFCSSFLIGVYSLNAS

SEQ ID NO: 977506 - protein, 154 aa, Homo sapiens
MTLHADTYLEETTGSVESDVKSCKWAAVLSGSQAGWAGQGDLSLSFRKYISTEQFPESSWYSANMWQEADHGACITIVDIQCHYAGQPGSVSVLQSNTSSLGKLGGGRHEGQVLPYLEPEGLPPEAGPSPPAGQIPKRKLEAEVLQPDETLHGI

SEQ ID NO: 977507 - protein, 38 aa, Homo sapiens
SGSEHSVSSIVTCVILYEVVASQNRKDAEAWFTSRTEE

SEQ ID NO: 977508 - protein, 126 aa, Homo sapiens
MISGSRVRFISYDRPGYKLPTKGIKSHQQVSLRRVHPLLSKLYGDPLASCLAPALQLLLKSLEVHIRCHTEVKAGAHGGRYHVIGHATLKLSQVHGGHGPLFQVGVRLQPLPFLLPECQDGVYNLV

SEQ ID NO: 977509 - protein, 104 aa, Homo sapiens
MPEHTYRSRNNFTNTYNMKSPLLIRLHYARTRAPKRVHSNTLDIPQPSPPKNVTDAQRQNGTKCEGISLLAQNTSRLLMLLLSLSLLQATDFMSLCLVGPMEET

SEQ ID NO: 977510 - protein, 162 aa, Homo sapiens
RHGCADCCSLGGVRTGDMQVLAPVVGDSCVTLRRPLVPVVGVWALERGTGRVVDVGSTSTGSLNMTRKVLAEPSQLKPVSFWPKTVLLIGVNNLDVHLVSVGPWMDPYSPNPTTKMRLLTENLMRSLVPLQPQRLSTCWKRLMLHSFPRRQQRGRSMNSTRG

SEQ ID NO: 977511 - protein, 144 aa, Homo sapiens
KGKGEMLSMYIQRGYSWLPLLSPVSISCASLRISMVRLEILVVIPKAWNKEVFSGPRPVFWAGTVTSHGAMAPARVSSWHLIGQQHVPDLSEVLLGEHKAHIPPDMMQQFLQSWVVFQVPSDGLAHHGVLAHQHHSLPAKGHAD

SEQ ID NO: 977512 - protein, 37 aa, Homo sapiens
HSQVAPTHSSSRICCSDALDEVQSLLQAVGLVVLPAD

SEQ ID NO: 977513 - protein, 137 aa, Homo sapiens
PLRLCVGSSSSRKTLAPDVHCQPLSTSVILPVGRRIILIVFLRVLLAVWPLSLVGQCDRSCLVKPWLDVLLTVGDSLILLHIPLEQDDVNFRVLHPIHQDGDQLDQMGGQDFLADGLLGQRQPELTGLKGNVLIMVL

SEQ ID NO: 977514 - protein, 172 aa, Homo sapiens
TTHGHKPQKRVTVSYPYDAITTIREEVMYFKERFYMRTNPFYPEVELNYISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMNDGFFYFF

SEQ ID NO: 977515 - protein, 67 aa, Homo sapiens
ATLPVFISSIILRRPLMLSSTYMRIRPVSVSNLVRKSSAARRALSICRTILEFSTGGTKNLVPQVLE

SEQ ID NO: 977516 - protein, 129 aa, Homo sapiens
TLEDQPAARYALMQRAPEAREQTIANLQTDLSDGVRLIALLEVLSQKKMHRKHNQRPTFRQMQLENVSVALEFLDRESIKLVSIDSKAIVDENLKLILGLIWTLILHYSISMPMWDEEEHEDAKKQTPK

SEQ ID NO: 977517 - protein, 102 aa, Homo sapiens
MDQHKLTRDQWEDRIQVWHAEHRGMLKDNAMLEYLKIAQDLEMYGINYFEIKNKKGTDLWLGVDALGLNIYEKDDKFNPKIGFPWSEIRNISFNDKKFVIKP

SEQ ID NO: 977518 - protein, 31 aa, Homo sapiens
MSLWVGEYRQRFTNIGKMAEEALDCKSKDRG

SEQ ID NO: 977519 - protein, 149 aa, Homo sapiens
CCRLTDRNETQLTVRAVIVRSEATGHGVATESGEVLNPRYEVGEVIFDAADAHAIEEVNLAYENVKEVDGLDVSKEGTEAWEAAMKRYDERIDRVETRITARLRDQLVTARNANEMFRIFSRFNALVVRPHIRGAIREYQTQLTKRVKD

SEQ ID NO: 977520 - protein, 103 aa, Homo sapiens
MVLRCLFDILISRCLREYAWSDTVERVRCELLRMTVKVRCLALQQGEACLVLCLNPPLAVHQQWAAAILGPFPETPVLDAFAFLTVVGAEHGHRASCHPLHHS

SEQ ID NO: 977521 - protein, 99 aa, Homo sapiens
IGAWVCGVLCPTRMKQSISTVSLEGPEWRAPAVTRGWLGQYEALSCWRSRQRHFTVILQLTSRDAGFYWCLTNGDTLWRTTVEIKIIEGEPNLKVPGNV

SEQ ID NO: 977522 - protein, 72 aa, Homo sapiens
ARGLPDQVTLSNNSNIVTLKPIIGSMPHRIQATGCIEVRGEGSELDQKARDGDVAEKVLVGRPELLTGFWKS

SEQ ID NO: 977523 - protein, 68 aa, Homo sapiens
MGLMPVAMALMKQVCSSDPFPGLNPRTVPSLSCNVTLEDFYGVFSSPGYTHLASVTNPSPDIGCWNPK

SEQ ID NO: 977524 - protein, 126 aa, Homo sapiens
HMWYPLVVYDDCAYKACGIIAARYSDSSVYSLVDSSWWSRQDLEVIWYDFCTISSLTQLYQQCVECQAHNNAQCICIYLRQKSPLNIRTIQIQQMMLPTGVVFLSFTFPKQSPPTTNVGSVHVNDY

SEQ ID NO: 977525 - protein, 79 aa, Homo sapiens
LLVGQRLLLWAGQVHGGLDELRSQVVACQVVTGSRTGAGVPYWAWIQGISGERGDPRQGKESQWDKPIALSQSIWAPEQ

SEQ ID NO: 977526 - protein, 91 aa, Homo sapiens
LWPAAYGTLLGVSSHVGQTYEMFSWFLLATCQALAASESPGLCSLVEVNELFQQPYAPIPLVTYDLSHVTYQMHMTNVHPTLHPVCVYLMS

SEQ ID NO: 977527 - protein, 130 aa, Homo sapiens
VLQTRTNSCRLAKSSLHLDVLYDVMKSKKPENMAKDTRTNYVDILGNLAWIFARDHKAKEGLYQYKNICQQVNIKSLEDVERAYLKMAEEKTEAAKEESQQMVLDIEDLDHIQTPESVLLSAVSGERHSG

SEQ ID NO: 977528 - protein, 44 aa, Homo sapiens
DLILISQKSDDDRDKLHMPPGRKDSILSVIITITYKEVCDFIDP

SEQ ID NO: 977529 - protein, 64 aa, Homo sapiens
DGNLYRQACTCSGEYTDLTRLQVNNIVEVNTVLTVSDENLSSEGMHRSGEYTSDLEACMHARVL

SEQ ID NO: 977530 - protein, 121 aa, Homo sapiens
IWKTLIDLADLDTVLKDTDWLEDLDFLERTRYTGRLGFGGRHRYYWKTWISWKICICWKTLKLLEDMDFLEDVDFPGRSGFGGRPVIAGRLDLQEDLIYMEDLELLEDMDCPEDMDCLEDV

SEQ ID NO: 977531 - protein, 120 aa, Homo sapiens
YSVPPKEDDKAIKETRDEDDADYKPKQQIKTEDTKKEKKKKTSKQEADGQHLTKTQESSIKINKVPEPDNKKKKPKKEEEQKWKWWAEERYPEGIKWKYLEHKGPVYAPPYEPLPEISRG

SEQ ID NO: 977532 - protein, 177 aa, Homo sapiens
LRLRSTHIEHLMSMSYSEILASTRNMKFNPNFLDIKFLSTFQEMPTVLQGSAKLHVTLFTSNIIFCCNMEEDLGMWVITCNFLQFNFIVTCQDIHSNFCCILYLRHLLVRHFCKYCILEVHPTLALKPFPCLLEQANPVPRAAKISSTAGAELHFNCVEWLTLRSLHSGIDCVTYHN

SEQ ID NO: 977533 - protein, 65 aa, Homo sapiens
KSLSAHCALPDAWRVPRSSLGSVLGPTLGFSLWAQAGVRLSFLYPSAEGPVHALQTNNPVSAPTK

SEQ ID NO: 977534 - protein, 103 aa, Homo sapiens
RGQLSQTLPGIAYQRHSLVTALSDHPHHSINLHESWSVQAQQNLRSDYPKPRQRQQLYVAELKGEDPARVNVPVIGGHAGKTIIPLISQCTPKVDYPQEQLTA

SEQ ID NO: 977535 - protein, 87 aa, Homo sapiens
ILEHPLNRLMQHDMFKVSQTIKPIMQCQVTGGPACTGYPMEWTKKVITNIAWSGYVSSDRTITKYAREIWGVEPSDLQIPPPNIPRD

SEQ ID NO: 977536 - protein, 80 aa, Homo sapiens
MAPPGNMDSEKQGPPVAGKVFGEKRRCKVSKKTNARWSRQGRVCLVAGDVGGRDLQVVGLHTPDLRAYSVWSGTENCREH

SEQ ID NO: 977537 - protein, 120 aa, Homo sapiens
SITQRVHLSSRLRRDADARSYDITRAVNEKGWAYGITIPPDHKPKSWVAAEKMYHTHRRRRLVRKRKKDLTQTASSTARPMEDSQDQAGWAYAPLIGWKFHWKQRSSDTFRRNRWRRKMA

SEQ ID NO: 977538 - protein, 128 aa, Homo sapiens
MPRETFLSSNRAVHAYSDSLQATYSHQESLCSCLRSKLDCKSYRLRDQCISEHIQFPKILVAPSILISSPVMSKGTLSSAVRTTRKTTFKREHSLRHTTHDKYLGKDQLALPLAVPTPIFTIKTTIDI

SEQ ID NO: 977539 - protein, 120 aa, Homo sapiens
MSTELVQAGMHRNGEYTSTRLHLYIIVDVSTVLTVSDESLSRKACTAVVNTRRPGSMHAYSGTEGSIYSRPGSSLTIYGGQHGAHVSTELVQGGMHRSGEYTSTRIHVKRYRDMSGDLKY

SEQ ID NO: 977540 - protein, 107 aa, Homo sapiens
MSVHVGTQKQHWHDQCGSWLGEENWVCQQQGISEVIKSWVLIFGDEVPMDRAPYLKVHHLHCKYTFSSLRVSREGRGSQSSDKVLEHQGRAHSYKTPHQHASPYMAR

SEQ ID NO: 977541 - protein, 86 aa, Homo sapiens
VVITDNTDGGQLHKVYWPGYIPAEIYTFFIDILLDTIRHEIAGCIEKAYEKILFTEATRILFFNTPKKMTDYAKKRGWVLGPNNYY

SEQ ID NO: 977542 - protein, 65 aa, Homo sapiens
MSACHVCWTLTNISVSVAESCWTQWITMPVLQLDIVVVGTSAWNSVDALIDAEKIKTWPKKLLLK

SEQ ID NO: 977543 - protein, 117 aa, Homo sapiens
FFSLDAFLLTNIMIPEGYSHYYTKDLAQQITLCDSVAGLPWVFHEQCNESNKGIQVVIALGSDHGGIGSRIVLLLSLSSVTDFNTHFSTQTTEPCYEIIGLQYSLLHLSNICRESFG

SEQ ID NO: 977544 - protein, 36 aa, Homo sapiens
NGSELLSRKVNELRKQHFATFIALQEIQQTALLAIV

SEQ ID NO: 977545 - protein, 55 aa, Homo sapiens
MYKGPTITAQHMLIFQEDEICRNKSAELQAFGLGMNPFIFPYRISAHQVTKVNHY

SEQ ID NO: 977546 - protein, 105 aa, Homo sapiens
TLVCSNLAYTAEAHDVCVLNRISIHSDPFCKAIEGLNARNTCSALIPSHFLLAPVSAPTGTKHSNSWLKPRENQTDNTLPLQTKLSPKWWLGNNGDRTTKILRDQ

SEQ ID NO: 977547 - protein, 101 aa, Homo sapiens
GSHAAILIHGRCGIPYRADSICMAERGPTSLRLISQLAFKFLMESRSLSKDWPVRLSYCEPRLSSSKPQQTVSVDHCGALTQSAETQYLSSSSRNFRASSS

SEQ ID NO: 977548 - protein, 141 aa, Homo sapiens
GNTQLPITSPIIVHTMHMTSNQAMINIKAHMMSSHIMIRSMIPIVNTSSPIIHKGQSTAIRHKMTVVMWVGMGQIIEDMAGHREEVEGVRDDDKDGRGPITGSSGGDRGGFKNFGGHRDYGPRTDADSESDNSDNNTIFVQ

SEQ ID NO: 977549 - protein, 140 aa, Homo sapiens
LCGHTRATGQQNKRDINNDEGRKSKEDKNVWFHEAEKYKADDEKQSGTRCHPRSHFSPSAFNMKATVEDEKLQGKINDKDKQKILDKCNEIINWLDKNQTAEKEEFEHQQKELEKVCQPIITKLYQSAGGMPGGMPGGRR

SEQ ID NO: 977550 - protein, 36 aa, Homo sapiens; identical to SEQ ID NO: 787339

SEQ ID NO: 977551 - protein, 107 aa, Homo sapiens
RRAVLGPGSGNGSRPGMRKSWALNQMWGFERRRNRQGYKFPCGLGERGHHYEGAHQETRDDLVLRVSPAGPLHQPLRPVPDTRVCIASISRGGPRTRASQAPAVLGQ

SEQ ID NO: 977552 - protein, 95 aa, Homo sapiens
MMAWSEPLELVPLHRYWPGSASYVQVLNVCSDRPCEELTKNLLSEPFMRALSSESVILYQAQSVTGGTDSDLQTSMAVSPSLMCSDDFTAFTLGG

SEQ ID NO: 977553 - protein, 71 aa, Homo sapiens
VRAIIIDLNFGMHWFHKEILFLCCAHDFSIEGFFISTYHSLLDFVVNSYHTCTRGAEKEEEKKVIDKWNLS

SEQ ID NO: 977554 - protein, 52 aa, Homo sapiens
GSSLTIFGGQHGYSRVDGTCTREGMHRNGEYTSTRLHVSVLGPSARISRVEG

SEQ ID NO: 977555 - protein, 51 aa, Homo sapiens
PDKIIHFLYRTNFRQPCWLQPFGLAFVLGVVIVTLNIHSRKQTHRCSVGNE

SEQ ID NO: 977556 - protein, 55 aa, Homo sapiens
MPEDFSKLSSVLHKALQNTRKSCVSSAWAWASEGMKSTADLHQKLGKAIEMVANP

SEQ ID NO: 977557 - protein, 66 aa, Homo sapiens
GLKGYRGDEGHRMSYVYRVRSTARVGDQLFIKVNLLFNTENKLDDRFPNGTAVAGLWESVPRGLFG

SEQ ID NO: 977558 - protein, 168 aa, Homo sapiens
PGQVDSRTINSPFGSPIWMYNDEPVHQAKYIFLLKVWRPISSMTFPCLLPLNRLHISYHHPHPLLFQISLTPSVLLLCSSTLSCIVNRAINGDLNPLELRARLSNSFRRSFTFIVYWIKLRPMGRCRNIFSFTIILLFFILFSISLLAFTLKLLDHMLLVSSGEGFPL

SEQ ID NO: 977559 - protein, 37 aa, Homo sapiens
WVNSDSCDSTGLRLGDFKPGKKIPISEGGHGSSVEMM

SEQ ID NO: 977560 - protein, 97 aa, Homo sapiens
PAPSYISAHARLHNAFSHSCEYRFLSGIHICNMINVKVLGSGLECSRRLVEDSTDKHKFCSPSADPDLSAGGRIRYKNFDGITFITWLVRLTICHAA

SEQ ID NO: 977561 - protein, 141 aa, Homo sapiens
QRTPALTHQLQLLLAGCQPPPLSLGLCTQFCLCSQLLCQAGALLFQLCHIVPWMLPTLQRALSLLELLALSCSSVGPVRCMHLNPACVTLHAVASPLVNEPPPLPCVSSLVVVPRSSCCITLMGALLLLALLEGPASQVSL

SEQ ID NO: 977562 - protein, 36 aa, Homo sapiens
LLYWISLYDRYYSIVLVEEKFDHIISNTENQEKKKI

SEQ ID NO: 977563 - protein, 55 aa, Homo sapiens
GSAGLLSKPGITTGYALLLLFISLRKIFFRNACAHSMQSLQGSAGIGHISTFNQH

SEQ ID NO: 977564 - protein, 34 aa, Homo sapiens
ALICQVQITGTDQTYPLSQALQPGTSVSPTVLIE

SEQ ID NO: 977565 - protein, 252 aa, Homo sapiens
APGRDWVLDNPPLPGSNAPSTPDRVDYSLAGALNAGYKETRASERDRDDGDSMTGLTATSRRLRFTGTAKQWRWLRETEPAAGQGDPPRLADVIPGMSCERQRLQARINVTDNRRPEWRLRGTNLATGHWTTDEARTPPTDEDQTMSAGNAREQTNGMPKYDQDTPDRKPHLDTRSWTLDEDRTRQNGQRREGQELTGYVGQGKESKRKRRDRKREKQPRQTAHGHRTRQGTQRWQARTVDQGPEAYKRKTR

SEQ ID NO: 977566 - protein, 167 aa, Homo sapiens
MAEARSGGKLIFWITMKRKSPRLAREREHQLHAVRRDDQGILRCPSIGVWIPGNLTAGSRERPCRAISGTSEHSEQSLHEVRAMRCIPQGHPGHGLSLCQANVRGWARQQVYRSLVHPTMQIRALSTGPVCRIHGSVLTTRVEHEPYYQISKRKYEQQFANVHCCSR

SEQ ID NO: 977567 - protein, 126 aa, Homo sapiens
TPSYLVSCPHAAPGSASCFRGGVSDSRCSPIVNLHQSGRMAALGLTQLLTVDVLLEVQSSFMVVLPVLSIHPRERSHPEVASWPHLGLPQACAPGPADHAALPSSVRSSLRAVLSAASLEFSRASR

SEQ ID NO: 977568 - protein, 74 aa, Homo sapiens
HASADGRGSGSTSNSSSLAVFTTSVVTSSTEIFNPSVIHEGGINFFPIPVNADILTFFHESLMFLISSRMVIIF

SEQ ID NO: 977569 - protein, 39 aa, Homo sapiens
MQQDAKPAADPPDYYPGRPNTKRGTDTHNYPTDGKKHAE

SEQ ID NO: 977570 - protein, 211 aa, Homo sapiens
MPQEKDFQIGHCFNKIKLTPNADNNVSYPPRGISGREATVHYQRMTRTEERQKTGAKTHLRIRTQEKKSKHRHTHKQNTNNSKTQNKNTNQTKHYHNGSHPSMVAAPPRTPHPPPPSLSHHTSASTSRRRTDSYPRRHRASACITQTPWQSAKNSTQKIGNNRYRRSHQPGGVAIKHTRPIPTRTLMQLTLLNTTSMSCLKSRSCSCRLNE

SEQ ID NO: 977571 - protein, 38 aa, Homo sapiens
SYFCRGKGGGRYKRSSRWEQSICGFLAALSEQGGSEHK

SEQ ID NO: 977572 - protein, 193 aa, Homo sapiens
PGRVPKLLSKHQKHQAIEAEHDASAARTPMRLSTWCESLIERGACAGSEDAVNARLAALSDQCAVLGAKVSGKEPETERKPTSSRTSTQGSRTLTSWLSEVEALLASEDYGKDLASVNNLLKKHQLLEADISAHEDRLKDLNSQADSLMTSSAFDTSQVKDKRDTINGRFQKIKSMADSRGDKLNEPIASPVL

SEQ ID NO: 977573 - protein, 363 aa, Homo sapiens
RRLAAAAAPQMSWLSAPCCWLQPADAPIPDDHLRWCRSAPVWLSCNCVCAVPVDFMLQPLTIITWSMLGMQWHALAATVPRRPDPGHQLVMMHMMLMTHLLRHKNLHQWCCHDHLTLSVSSAWVCRMLAQLPHDDSNGSGNTVIHYDPEIQGRHAQQPCMCGPQCTGTGAQKMRMTKAWDLHMDKPTSLSSTPHNGSSEATLAAQIEHPAIDDIQTTQTAEPSQRDSPRDPGLQKSEPGASKGEQDAAGRQDKKTVDREKHKSRIQGITTQIHMQGNIVTKARAKDSENSSPAAISRHPGTPTKPTGKASTRQSTHERARHEHEHSPQKTAARSNQRRIDDGPQLLSVARETTVIPTYPDRNH

SEQ ID NO: 977574 - protein, 322 aa, Homo sapiens
MTPPLSEAKSAAYLSERADRRGPGDESRDSLLEYHSPAHCRPLTDAPCTPRTLSCARNYATYQNMPYQYPAHDPGAEDVTLSDTRSTRIDGNLATGRILCCTMSPHGTDICQTVLYVHSRPAEPPRKNTDRTHNTPARQLTRLHRTDDEHPRQIQSGVEHTYITTDDPNTIPGPATPERAQHHNHNPHTTTSTNKTRDDRRAKQRNKATAPQQHTPDRRTTTEPQNPNTPQEKSTIREQTKDTSHRTPQRHQEDKDTQHNRTHTHQQHTTPKKPPNHHERHPHPHPTQTPTTENNWTPQDHKLNQGTLIKCTTIITSNANKV

SEQ ID NO: 977575 - protein, 168 aa, Homo sapiens
MGSHYYLAQPGLELRELNVILRALASQTGGLQVMSSSPGPQITWIMDQRDRCAMYSKLKPPTVPNSGPVFYHILPLLVRARVREAQGKMKGLEKVNPTADLKTKIGEGNTQLRGQRGPRGRANMKEGKCTTDIMPTSGHNPSKGENQLGTLNGESTTDRGGKEQRRHK

SEQ ID NO: 977576 - protein, 257 aa, Homo sapiens
MLRVKDPKKSLDCYTRVLGMTLNPQMSFSHYEVYIYFLAYEDKNDIPKEQRCTKKPGRSPENATLELTHNWGTEDDATQSYHNGNSDPRRIPVIGDIAVPACIQSLVKGLKNWESNLRRTLMMVTLKGLAFITDPDATRIAHSESKQNWTLNVRAEHILLRDPADRATTVFQIFSVPAASWADLITARIHIILAIPYLISAPTTTCSHLVKRSKKAEHRRIRRTELHYSAHHQKTSTDLTNIERHPTNSYRKYHTTQ

SEQ ID NO: 977577 - protein, 253 aa, Homo sapiens
MDSRERAENSIQTGTKWTLNDEKHIQEQLQKNGGTEKKQSKKSTSPQEQTESKEAKATINEGHKHGTTNQRHCKPTERRKKTQKYTNQHTQNKNNKAKNKETRKSQKKKPNKDSKRARHNRHPTTNKGHTAERKRTKDSTKTASRTRQSKTDHEIRRHTSKNVTTWGTSDRNRKKNMSWIELVYSNYTSYETDQTTSQQVHTWIGLDKTKVSTKAARHRHNKRLRSINKNHKKHEIYKENHHSMATHIKRTSR

SEQ ID NO: 977578 - protein, 299 aa, Homo sapiens
HASGETVTNLVFPLGSVLGEAQEPALTPERKTLKASGPNPWRGLGVYESRLTDFPGMLLEPSAKPSASWQSSITNWISEYGCKLDMGSEVSHSHSIYLKKARILHSHVDRRASGMPGMIYKDKKLCNREHKLTAHRPNAARRHMAYLANTAFKKCFEPRLGEVAQACDPQYFGRPRQVDHLRSGVHDQPGSMTKPVSTKIQNWPGVVGPCLQSSYPSCLRGLRQDDSLTLGGRRLQRAEINIELKLGDNERTRPLLVYTIHNTHTQKGGVKTHEGPFQSHFYKGPIGIKKQRANGAMHR

SEQ ID NO: 977579 - protein, 80 aa, Homo sapiens
TEQLWPGVSRGVVVTHDNHQSILPETHGRKQDVYRSTGNQSECLIQFKDQLDNMMRLPTILCEPGFITIDVGDVCAHLRS

SEQ ID NO: 977580 - protein, 112 aa, Homo sapiens
MTKQRHSRYTPPGVKTHTCGPILCSESQVNTQGTDRRTPAHRSVLSMPQSIISPSVQSLQCVSPITTLRTSHHPLAHPQHRLHTSLGHPITTSSPTHETDILPHHIPQLPQR

SEQ ID NO: 977581 - protein, 217 aa, Homo sapiens
MRRISSTNSKRMLAHGMRYTTTQPVPTGGSDHSTGKCTRVLQTKRDVTGPTEAQHHSNGNHKKRGPLHQQPRKHRPSPEPQVAAKAETTAAIKPWRPRPLHSRSQWKHMSHFTQQSSGGSDHVKSTAMEAQTHCIMKAYSGGHKSTKPPDDDGLHLTNSTGKGTGKGPSTTRQPMCRKSALVHGNLLPKIRSRTTLGGKRTGHWSDLRSSPPRGIKS

SEQ ID NO: 977582 - protein, 93 aa, Homo sapiens
MGVDEVSDLLAVGFHGGYRSREIPRGLRRDGERPEILTQAKERGLSNTVGTTGQALPPRGNIPHKHRDTGLFQKRYSPIPYIPKKPKAKWTGV

SEQ ID NO: 977583 - protein, 332 aa, Homo sapiens
MCSVPLKCLHRVSLCPLWHSIMSSYYEPQTCVSSMGVLNDFRGTLVAPSHRHAVVCCGKASHIVPRFLRLWTLGWCSDYAELWIGRMCLVGVPSSSFFVASGLALALCLVRCIAEHVFGVADPPRAYAMCRQIIRVNWVLCCSVVPLDHSLHEAAGWEAGPLRSFLVWEMGTEKWEVRCARTGGASVAAGVYLALRFYDAVSLILRLTALVCMGAICSGGSQDTSALMEDVLFCDIMASNRVLTLGCTVGRIACARRGASPGAPTYRSGMGIPLWGAGARGASPPSGGTKSRASGGLEPQLPPISDPTNGGIPRQWASGDVYPPCVCTEGVT

SEQ ID NO: 977584 - protein, 219 aa, Homo sapiens
MEPGPPPPCVQLYAVSVWGPWLRSCDDAFALCTRPTWKPEDVIESRFWGMLRGKPGSGRLGDLTDLPTYEHIQTGLSSKDGRLPRTVPALPVEPLPVPDRPRELQLEPVPVRVVWTRIESKKAVWLYKTVHTIVCHRTTAVCILSELNVPISGVSIEPDTQARKQVKCPALECSVHEEAVVLPSRLWDMGAEVLEEPGLEAEGDHKAPEPGWYRTLKRK

SEQ ID NO: 977585 - protein, 569 aa, Homo sapiens
MRLKWRMTPVQGGGPGGPELATCGWGIRGGFPADGFGEVAVSGPVVCGPDGPGGLGPMAGWTLRMVMACGFPDVRIAPVTQSSEPSIESNRTIRMNQKISFVIGSIYSPFFRDAHNYIGYSMDDFNLEVCPFLIGECGLCIRSIVRVDEVCPRDSEEFAKSSQVKTASETRLVSPSALSTASQGVFRLGYFVGPDYNSWGRTYQKLCAKLVLEVLGVARLKMCACQRDGVCALSRAKFPGLGAQYIPFGGQMHLLDIQGHRACIACEWRRNDMWVGKRNGNRGMNGASDQHVVRTIWPKGGLGPMVAQAVVGGHPFVAFGLIGPPIRPEGIRAKVGVHHLGKLLVSFRMAKTPFGLALTCENWRLDVQIEDCGASGVITNSLCHFAIREAIRKSSVGMGLCGGLDQYPICETSTIYLLKEEVPQHHFFENDSPIMSSKGNRYTTSLKHFGNGPRKTTLCEYGPNECLFPTNRESPEDRGRNYLGEQYPRARKKHPDETRVSSSGDRTLREVPHEEWGLHQKEEEEIQRTNNQQNGKLEELRITNERRSKNEEVAHMMTTERGATTDHNR

SEQ ID NO: 977586 - protein, 345 aa, Homo sapiens
MVEADLRGVLVRSSWLNRYCMGRKVVVVGCDGINICGNFYKKASKKYLGLSLRQADEQLTLPEVALPYYPGAPRPSSSGVILLARYAAPINRASEDRTVWNVLKVLDGSQHPTTMKKRNGGSCLPSKVVRLMPSKKVCLSGRAWLTRLAGSTRQGQTSPGGEEERGKGTIHYRKKKQLMRLRKTGREERGARELTRITQRSSRPRDSWCEPSKDLCKFLLIADVMVVNDWCAFLCARTTTSQRSCQWVEEGASNAELKAKLTTNGNIQMRGCPSIECVPESTSQVGNEDMDRTVGQLKNSGRSHDARRRAKLIEMRENSMHTGTHEELRANTSVETTSVGRDEYT

SEQ ID NO: 977587 - protein, 56 aa, Homo sapiens
PESMPYLAYTLGCETTYIVGGEQNWIPLSTYSHEVDYDGQLGYTDSSGDVTLQHTW

SEQ ID NO: 977588 - protein, 135 aa, Homo sapiens
QQVPYATKGIQWVGYDDQESVKKQGCMYLKDRQLAGAMVWALDLDDFQGSFCGLGICASLSPMPIKDAIAWNVALLFCNYMRVGAKVVPPSRLWLHAGSGVLIYLLLLDGLQAVVPHSPSLGAYCDEVHYKPLSI

SEQ ID NO: 977589 - protein, 102 aa, Homo sapiens
TNYNMYIFSKSRASSSTGMVSLPPGLLILMDLLARDVREGTDKHVHPSLYIGSTASWTSIPLTGTLSHTRAVSTCVLPLLSPFGAIAETPPAFSMTLVILDQ

SEQ ID NO: 977590 - protein, 581 aa, Homo sapiens
KKKKNTHKHQNTPHTHHKQPTQETPITSPAHHNYPPPLPHASPYTTAHLYHTTPTYLSYSLLHHAAPYSHAPTLITTPPYTTLPLFSTPPPPTAPHHPPTTPPPHTLTPHLPHPTTYQTTTTPTTPHTPSTPHTIISSPINPLTPLLSSPTHPPHPPHPPPSPPTNHPPTTPSPTPLPTSTPPSQLLHPTPTPPNYSPSPPSHTPPPPHSYPYSSISPPTSHTSPPNARERPAPWTTHRPHRRARPHTDPPDHGPHQHTSEPVRTTRAIHTHQPSHNSATSAPPPARHRAPAPHPRHHRLPRPCSCGAPAHPTAMTRPHKPPHAPLPATLPHRAPTPQPPPPPSGEPPPRHLLPSHHHHPPTHPPSPRNTTAPPTTARPLPPPPTPHPHTPPLSPQPPPTPSPPPPIHTTPPTTPPSPYPLLLPRRPHPPPHPPPLTTLHHSPLTLTSPPHAPLPHSLSPHHHTTHDAPPDTLCTPSTPFTTHRQPTHPHKPAHRPPNQEPAQPPPHPHHTPATPNSPQHHPLHRHSPPLAARTPPYSLEPPTRPPDNARPHTPHHTHQYRPHLSTTHVPEQPRALRQPAA

SEQ ID NO: 977591 - protein, 150 aa, Homo sapiens
MILFTELRTTRYHDPRTDDVEICSCDNYRDESLAAHGSCPLEHIDAKHDKDNSCCITQRSHTPGRKKLPKIAHDARETQGSRNENQTWRSQLERRSIIQAFGAYGWRTTCLNPRRMITLLTMNYHLRKDPMARAQSEEKILNPTHQPHTV

SEQ ID NO: 977592 - protein, 197 aa, Homo sapiens
GRVGRPTRPQQKVGSRTKESSVEVEKNLNVWVLDKVPDAAGLSQTAQQQDTVAQPRAESSQHEPQNSRHAQRAPARRAHTEYRQTTRKHQDNNTRKREKKQSRKHNQSPPPLENDKRPTTHTPRQTKRKNKKENTNQEDRTEENDRANTKQRPETNNTAHQNTGTQAADQNQTAREKDTPETEDNRATNNDRQQGTT

SEQ ID NO: 977593 - protein, 297 aa, Homo sapiens
MCWTTIDASMWLVVAEEPDALCAIALEHATLPSTVIGPGVNRPEDGAWAPIYPIDTNLTCVLTITKPGLTFVPWTVIVTNADVDLETNWKWLASTFGTCHDTLGYMAATPKVTAAQLRSNTTADRHTEKEFAQASKATKKPRREISQDPLGETPFEVDHVGTTRVVVPWITLCPKPLAGNGRYLARQRVEWRTTQELVETCDSNSSRSQCRMVRNDQQKGQATKDRCEYMSRETSGDSRRPPETIGESPGKISDWALIHEDTVPSRKGQDMGCIQFSQVNAHKNSDNDGQRDTDRYS

SEQ ID NO: 977594 - protein, 130 aa, Homo sapiens
MPSLVLDRGAALFLYYFFFGVNKVLWKVPSPPKRGAHPHINNPSLETNPSWQINPPARWKVRHRRVPIRKRRRSNTPDNSSRHKTSSAGQATHTNQGQSNNTQTERMASSWTVQAPGKDTDQTESNKEWE

SEQ ID NO: 977595 - protein, 280 aa, Homo sapiens
GTRWAQLFCESFSKHLVNELNGVLHSFFFLSILLSALTQTPHTSLVPLTERCSLHFAGATLNTLCALSHRALLKCSSSSPSSTHHAAWRSGGNVVVVTTHYTICAHTSVKHHATPSTVTVELSYYLLSSYCAVRVAIYNRQFTTPSVYTLLWLKTAPVDSEDGLNVCDPLDGRCVWQQRAAHNSYTKIVPTSVSLCDHSVSSPRKHRVCGQESVYNVRLLYVRRRKSVYYSAVFYTNITHLLRVDSLLIYLWRGIQYLLFSSKGPQGLQIFLKHICVLVL

SEQ ID NO: 977596 - protein, 158 aa, Homo sapiens
MTTVSTSQVRQNYHQDITRPAINRQINLELYAIPTFTSSMSYITLTAHDSEIHSTELSHNTYFFTNLMRRREPIADTHLTDLLPTPNRPGDPHSTLQAYPRTPYLIMHLAPQPHMTSHCTHALQICPKQTMNYNQPPAPPTNLATCTQHTPQTIYTNN

SEQ ID NO: 977597 - protein, 170 aa, Homo sapiens
SKRVLNGTPIWARQYPPPCPLIQAQVPPGELSSEKAISPRTRSNERWGKKGKGDTPGKRGGKMEETPGEKRRGPEKLGQRRWRLVLAHAPISCPFYRGNYPSGHPTNHQNQVLQLCGGYMPGLSIGWYCHHYRGAQWIDVGGLGYPILDGDQEKKPKSQQDLVSKGETAL

SEQ ID NO: 977598 - protein, 255 aa, Homo sapiens
MPSSEDQAHREREKQEDLEHIYTRSPEIGCDTGEHERARQTQASESRYKKPMSTCCATHTGTLEDVILIPTGKTHYLIGEAYYRGYRKQGPGRQHPLNTHKKGETLTEARREWNHLRPLPVENEEHGLGHPGKTKAPNRRNTEGTTNGAITNNGQRIGQAYTITKSKTTTPHHKDKERDRGSTKENTERPVETYDPGERTERPSRTGPRGSKRPPKEGDRHRTVTHRSDAKQQHKTAQEGTNAADTPTGDKATQI

SEQ ID NO: 977599 - protein, 104 aa, Homo sapiens
KNTFDPQKKGFILGAGKKKGGKLGGGGEEMAMWWHGRRVNGLSAWSKTQSRGPTRYGNYKPWGGPSVCGIMVKRQQETPLSGRTRVCGWGEIARWTHVVTLTTQ

SEQ ID NO: 977600 - protein, 333 aa, Homo sapiens
MAFRNCLPNEEISRLYTTTRKAPDGCGPLRATTTPSHDAIKLFTQRAAVKPATSLPCYASTSPPRPVAAFTMRSSTMEPPRTANTQSHVVINQIRSCHDIVQDQLQSTKGVVARRALLNRGVSSEHSKGSTMNRDGLTYAAWHTTNYYICPVHALIRNAFTSVNTSHVTEITGGSTYLIVVQRFNGLRAREHLLKKCLPFSEGRRAIMMDEIFQTGRKNRARPRVRTMAERGRSGTRSRARDIGVRQERTLDADTRVAENREALIMVREPRHVTELLGPMRTHRPEAKEHVGCQEHKTRGRAQESGNDPLRRKHENSRKAAAPQSKVQQRTDQ

SEQ ID NO: 977601 - protein, 221 aa, Homo sapiens
ALPHIPIDICCRSHPCDGQTAQVQSHPPQPPCPGHAGFMPPMIWSIVALYIDELPTTDGDIFLQPCDEQDVCDGSHALDTRAHRIPQEVKCPLLSAQATTQNPVSLYYLVHSQTSDHRIDELQYRNLTTGITSPERQPLPSTHKYCPYQCYTRLPLKSYPGPHIEHLRCLCMAHMHRNQQNAIETVHNAIRIRNQLYILIATSTPNWYQTDLDTQRHHSLL

SEQ ID NO: 977602 - protein, 102 aa, Homo sapiens
HASLVLECSVSSVYKQQPEVTAYSVYVVSAELAPLRLDFPDTVTQVQERQRGLGPHGGPGMPRHHPSPDTVLLPPSWIPDPQHSWRETRWAPYPEPYDRSIK

SEQ ID NO: 977603 - protein, 106 aa, Homo sapiens
MRDHANTFRDAIVGGKWLPLITPHSHRDSRSDIALRRELWGGLNKGIWSWLPLCGHPSWLCATCATCPPPRFVLKRYPDDSVNNMWLVLVATPRGRRVIIPIIVIG

SEQ ID NO: 977604 - protein, 177 aa, Homo sapiens
ATESQTPNAEQGAQAKIASDQTNCRCPCRTHVCCCMSRPMADDYLAQLSLEPNNQDPGHKITKVHVDLNWGLRAVGMYLTRRDSHCVRSDGSGLSEDDVLPILYIDKGLSIDCVDYYLLGYEPRTIDPHQDSEHADGTVTPHDILTELFILARVKMILQQTSYQLMVATHGSTMINS

SEQ ID NO: 977605 - protein, 165 aa, Homo sapiens
YASHSILEARRGLIITSKALAPFLVLIPMRHNYNKCPSWRTTKRPKIAHCILYTSSHSRLLGSESAPIVLQCPQEKHSRMGNALASNGQAKGALLYTSSPRVLACASLSILPMQRRQIYEAQHQQIGISNPCSSRTCKAAYVPLTSVFDDLRSQALANLRALAPH

SEQ ID NO: 977606 - protein, 83 aa, Homo sapiens
MRKGAPHPLRESQEKGEPAGHVMEQPGEHPWGTDKDKHTSTGGRKHRRATSMRHGTSDNRCGGAPLTSTPRRHTIKQKRPEEK

SEQ ID NO: 977607 - protein, 249 aa, Homo sapiens
TFYNELRVAPEEQPVLLSRGPPESPKGNREKMTQIMFETFETPQPCTLLSSAVLSLYASWPYHLADQCMDSGDGVDRNDMCPSTRGMPIPHAHPCGLDHGVAVDLYLSYSLYEVYLTVAAGAYKLQQLRSPDAGKFWLQLHHFMGMHILVTHRSVPLGTFLRQRTHWASTGPCRLPGVTSPWHAHDDYQTVLSLYRARVHSNSNLCQNRTTAVSQARHSWRRQLPLPTTIYRFHWRHLVRSLFEAIHRI

SEQ ID NO: 977608 - protein, 115 aa, Homo sapiens
MVKRNTTALLTGSFVRALRRPAWSAPRVACGLSGRSGSRQRVLPGRRLEAFTTMLPWESLSAWVRPLDVFVSPASGRHGSVLAVHPLVWMRERACPWDLSLCRLARGAWLCSTSL

SEQ ID NO: 977609 - protein, 243 aa, Homo sapiens
TEVEPEFGTKVEAQFDEPSGSLSIDDPSWNPEFEGTRRSECDKRDGGYANVARGYSLFQQLVSDSYYKLNRLADCLAGIHAVLTEVPRGPNSRRTGSGYIALKACLHHQVHRFSLISTVDMGTPGLCTQLKEAMGGSGLVSPIFDGGNGQYSLNRVETPYRRHKNVLGVRTGYTLAAIGLPMFIRLNAAVVDMAWLEIVVEDDNARDNEGGKAAQAPSGVSTYTSIHTRGQKYISQVGGPKGK

SEQ ID NO: 977610 - protein, 268 aa, Homo sapiens
LYYYRIFTVDDNLLPVGKTVVILIETPDGFLYKRDISVLPTTNTDLALSWNIPELVNMGQWKIRAFYEHAPKQIFSAELRRRNTCCQFEVRVEPTETFLLHQMTQSGLEVSIIAKFLYGKHVDGTAYVIEGVQDGRIRRFLMAHSLTRDSDRGWVGDSSADPETVMMGRGKAYNANALDGEDPCMSPTHDTSMHSGRDNGKGKSAQRDPDVTNPEYRYHLTRTSQYSFKPSQAISTMGREPPRRISAATGTETQRETNARRTQKRRGT

SEQ ID NO: 977611 - protein, 79 aa, Homo sapiens
SEIGVYPGLTCAPQNVMPTYERVVKMAEKETPTPYYLPEEILPLIINAIPAIRLVNVTECCSSGVFKVCSDIKYVVLLL

SEQ ID NO: 977612 - protein, 329 aa, Homo sapiens
EEFVYEDMEALCSVLRTLATDSNKYRAKVPGKLKEQCNGFTGSDPRFTLSLLFELARDLRRIVDDMEALCQCPVHSGALTRNKYRDQRLIVGTSALLSASVLHSVEGGDVPKKEYVRLRLGECSSMERWARTGSKRPLKEGAEVRGMHTTSLIEQGVYYRDIFAPGSCAVAGCHCPEGLQRSTLEKRLYEAAASETGPRLDSRVQKERGTTFGERQGTRLRARLCYWPRGAVLNNKNDTAENERVAQPSEGHSTSFESAKTITRHEEPMHGGPDTGPDLDWRPEALTNVKAGRGPQVGLKGTRTSGAQNPAEANPRGIELLYNKTANTR

SEQ ID NO: 977613 - protein, 195 aa, Homo sapiens
EAAPCARRAVPPALPARSLARPPLPRCLTCHACCLRCGLPLRCALPAACLLLPAAAGCCCCYWALMWLAGGCGAARCECADSVLPCPWTPRSRLWQAVGAPQAVLVAGRRRGGGMGPEGGGGDAPSPGTCRIAAGNGFVSGGTPREARRSLAGLRRVVSRLCVLEHVCMSTFMQRSVIAAPRRALGRERQEGGAR

SEQ ID NO: 977614 - protein, 214 aa, Homo sapiens
HVVVRIMVIVAGISSLADLQTGAMRCSMFLRAQDLTPVRGYVWCMLLDQVLCYVERSQAERRARTCWGHARARLLLLVVVVGSNLPSPTPWYGGLGLCANLRFSRGVHMMLRFLRVLQDLLVSYPDSAVGTCVVAGSSTSLACEKNVEGLVCAHGRTSFLRRIACIGRMFNPYNKGVVGRNGVSQEVGIIAEDVDRKLKPSSCPVDSVQPWWVP

SEQ ID NO: 977615 - protein, 304 aa, Homo sapiens
NKGAIKSRELSVPQSRALRGTPVPPQLKKHKKTNTSRTQKTGQRRERREHRNRHSDRKKKSRRRKKRTQMIQRRHAHTHPKTSTTTDTQTIQTHNSKKNTDRKKKDDITQNHKRGHTRRIKKSANNPKKTKQQQKEANKQQAERTKSKEHHNTHKKNTQHKQDDTAEKENRETTKKTKTKQKKKKEKKQTKTKNKKKMTKNKTPKQNTNKTTKNTTKHNKQKNEKKKQRTEQRTHRTKRRRRPEKDKDKKEEKETEDQQRAQQRDEKGKKQRNKRRAKQQNKKTQKQQKQTNNQNKNKATKNKK

SEQ ID NO: 977616 - protein, 113 aa, Homo sapiens
MECRRWGVNFASSALSIRLPTFHLVHPTAVVPLALLGKAPRVLGATRGSLPLEGPPVQEGSSSQGHKGARSGPQVPVPFTEASQKKGLQRCALQVKNRQLRLEKLTSPGRKET

SEQ ID NO: 977617 - protein, 619 aa, Homo sapiens
KPSRLQRQREPCMQALQAHTEMADARNWLEALVAGSVHPPPCSRELASATVHATDIFLAWACNVPCTGTAVRGQRVPASKTVQQGVAVASETPRASKRRPVPPSVTGGIPVRKAVNTRFTGVGSAYTGGGEDPYTFREARKRQHGIQRGDFNGHFHGRLLAEGGPRRNYAVNFHTSHITGSGLWSETLTPIRRTKGAPKVRHDGRTPNLRTRGVDTPFYMPPVRKCVDPERKDNIRSGGEVPYPYDVSTPADWGLTPLYGEHLLEENMGGNKTPEGNTGPPILSPFNADHYGWRHFQPESLDELAVSALCIPKLSPPLTTRGHQRFSIMCRSTYLRFACEEHEANRPCIGPPPLVVLLCKGPLYWATPVASLLGRTKKVPLKGVKSSKKGRPTSEYPPWEGRYNIPPSVKRRNRQARLQALFPYTSIVSSQGPFSLPRRVSVERLETTDVEAPLRRPPQGSLGGEPHTLWRTYGHARAKSGKSGPTIPTEAPCAHWAREEYLKGELMALDGPPSSGAPIARHLKSPRTSAPTKNNCRSTHGDPPVSAHLPPPLPSRTTIRGAPAPSATRLPCPRAKTTPARARRPGPPTHPAGSTRQRHTTPCQPPRATPHSPHNTAPP

SEQ ID NO: 977618 - protein, 69 aa, Homo sapiens
GSGGGGSSLNRPPSHLPSQYPSNESPEPPEAAVSSLGTAAPALEAKAPDLSSPRAENTKCLFEGVCLET

SEQ ID NO: 977619 - protein, 256 aa, Homo sapiens
MTFKVKRDGGFTIGGPGMGPESLWTLGDLAWPGALPKVAGRLQGGGGHHGPGAQDGSFTFGAFGGERVQRGGSSSPKRGEGLGTRSSELFKTRSGGEYFPCMGHTTCTRGDLPGTGPPHKFQGDPKTSPGVGAKTLSPIRGGNGQLPLEQRKPTGGAWRGANNYFLVNIKVPRANKGRRLHAGRQKKGGGAGTEYTKKRNKDGGEDGSQKTNTTRLIKKEGGGRPPTGRTSDETIRKKRGTDAPHPDKSPSSPVHV

SEQ ID NO: 977620 - protein, 264 aa, Homo sapiens
MRGAAGSPGTGHTGPGEPIGENLGGANRGNEAQENPLETPTQGGPRQPQRLPAGYEKHLHREGGPTTGAGGTHPRRGGRTTNLTPRDTPKERASKHPKEETHIPTQQSRVPENGTRPGQNRLTHSVSIPQMGAPTKGRRHPPSVPHSIVYNNHGKRSSHPHRLISHYNNRPHPTHAEAYDRQYTPHGHQLARRHDQTSTHWDLTTVKHIVASHTAYDARNRPRLRYVARDQACSQEIDTTLTIAVCPRLFFCFPLSFCRRTPNT

SEQ ID NO: 977621 - protein, 74 aa, Homo sapiens
AHAFRKCSSSSTYGTATQTLGGSALPPPVPTILSKTTVNDLVGEVSFQQRKNLNEKRIDNKIKESKFIVCKPLF

SEQ ID NO: 977622 - protein, 102 aa, Homo sapiens
MWGIRGEYRSPVERQLQSTVRLPGLGTDGQDAARRGHKGRLVTVGDGPSVAPGGGDPKRGQGANGGTPSRTKQDTMGTGWRPTGAHGKPARRDHAHNDHQGR

SEQ ID NO: 977623 - protein, 121 aa, Homo sapiens
ASDLCGIYRYRCRTTSIIMTGSYGNYVNVQTCRDCSTSYGIEGTYHVTKCVNYLQRVLLVILILVAHIRKTNNLQPAVISKIFSCSDTDAFISGGLPQNLLRHHCVIFAVDHHLLDIEYYN

SEQ ID NO: 977624 - protein, 122 aa, Homo sapiens
MACVYLQRFNSSGKRRCPYLERFFTSKRLGMCRRDMLEGTFDGRWNIGEQVHARTRERHVVIPTLRHEEVHPVVSFMWRFSYGGVGVITAHSAMFYGMHIDACWYFEQDLTQPSKLYLKVQV

SEQ ID NO: 977625 - protein, 79 aa, Homo sapiens
STLSTDEELRYFIKPLTQDTLGKWFYEVPQFFISRMSCWDAWLDDLAGIRGQRPLGTTLVLLICVDVDPVQLSSMLQIM

SEQ ID NO: 977626 - protein, 136 aa, Homo sapiens
MEFSPYSHRGPNLVYPWVALGPMGPMETGPGHAALQVNLTHRQGRATTQGPLRAEKPRMGVETQERSTPVCGAGPTPESPIELPPASAPQGDLKRRDKDVATRTTAGQRRNSLDKQAENDETHSNEERFNCPQTAH

SEQ ID NO: 977627 - protein, 375 aa, Homo sapiens
HASALQQPAPALWPYGPLTSALVGTPLCLGPLRPPNDGLPAQVSSRLLVPPLGSSGCTEVPHSVKSQQHRRELGLGQGLGLKEKEEAVVAAAAGLEEASAAVAVGAGGAPAGPAVIGPSLPLALADAIARAWAPDPPVGGRPTAPAPRMRHSMNLLSHAVLETRTHSSQRHPPGLMALEGTQSPMRVNDNEAQGKPRELETEHTHSRKGSHTGQDPRQLNMGCKTDSGSSETICADEETEDIKGNAPSARNTNTFLKDKDDPATSDQARPRKQERGITNQRKEGASATRTGQHEVSPKQERRHRCRPETGAARENRNKGTRREQAMASPDHRGRAQQRNTSAHADSEQDHKNNPHHAEQAAKSRREENSRHITGG

SEQ ID NO: 977628 - protein, 351 aa, Homo sapiens
PKWCEMMVAWCLFVSDVCIFWAVCWVSVANTRDLLEPTSVVRLLWEQALYLCQYSMEISREYLFIFLQLESNNQGLIPEKPLTRCPVPHSGSSMADPVVKGWCAEYNRNAEETRDGIVGAVVQWKLCSEGAQRATKRPLAGMSRCRVVAPPVVLYGSVQNKVCLNCGRLCGAGRVASAEVPTGKIPGRPVQDDAWKEKTRKNEIPGSKEPESMRLRDDGYEKNGRRKNVDKYNSGPSKTSASCPEPGTESIRQGCLLCRPVLPESVRVTRRDQVSAQQARKIRGSTEAGLGGLRSAQNRETAGLDVTMRHQNTTEERKGTNPWAGEGARQRDKGKAERKVTQEKRDTEPRL

SEQ ID NO: 977629 - protein, 171 aa, Homo sapiens
GDSWVLSKRRQGVVRGASRDRLGTHVTVGRSFAILFDYDAAAIRLGLSALEQEQCTIGAPFPLGALSTLAAGGRSRRGRPRTATLGPGTDKRGPFSPASLETYTYFWTSIGTTVRTLGDTAHTWRQRALTSHSHAPTTGTWAPQDRSSNSPWSPVHALGTDALPFLAPLSF

SEQ ID NO: 977630 - protein, 307 aa, Homo sapiens
MVAYLSDAVALCCYIRGGVSERVVGRECKDFCPFVGSSLVKVRAPWCVSVAADARCPPRGFSAPLVLFSVASASRPPSRCAPPPPPYSFLSLGLSVRRVSPFPHAPRRLSVAAVRCPLRPLSSSLLGSQSYLSRSIKERGAPPPRPSLSLSCTYTPLRLLRARRRRPAFRSTTHPPSTWPPPLTPQHTSTAGENAATNHSYTPALDYTTQSRTMSLYAQHCESRESETATLTRKHLLRSSPGPSAPYSLRDANTINYDVTHSGDRLLVLMYERTENIHDTTQYKRITPPRTPEEWLDEHKTHNMQKQ

SEQ ID NO: 977631 - protein, 134 aa, Homo sapiens
MAIPNAYRTRKFYGYIQLRKGPKRSMAPTGYYDPSAERHEKLFTKEPLKPARSYRSTLYITGPTLALTILFYYEPPSPYASTHLVNLKLGLAIDSRQLYAYACRVNPRDQGETSKVKTSALIGALRAGGESNLI

SEQ ID NO: 977632 - protein, 114 aa, Homo sapiens
TEQTPIPGLEDPPLGQPAEKAPRGRGKLTSHLEPSLLFLPSRLSAPFRAPEVQGPPGSCAPAGPGTPRNSHQEQAGWHGSTGEMAEDASRTHGSSRPCLAACAYAWMVCAWAYR

SEQ ID NO: 977633 - protein, 133 aa, Homo sapiens
IASHLLGSTSISLTPHILPTMPRRNNTIGVHYSYSHRPQHPLPLSQYCAYGILVFAACECMRWAVSPYVGLHILLIDEYGLMDIAVRSEHVKAYSNAKTNRPANNCITYARDMTFPKDSIDFEVKLLSATHQR

SEQ ID NO: 977634 - protein, 316 aa, Homo sapiens
LVRDREQSSCYYIRGALAHMNQNMREGHHNITMKDNCRCEQSVFRSGRGEPRFIAVVATWTRTQFDACSIMLTPGSREDCDAVGAGGIEQEGPEYWGTMADTGSMKGPTLQTDRANLGTLRGYYNQSEDGSQTIQIMYGCDVGPDGRFLRRVPVIDAYDGKDYIALNEDLLLLDLLADMAAQITKRKWEAVHAAEQRRVYLEGRCVDGLRRLPGEREGDLLQRTDPPKTHMTEQPISDHEANLEVWGLGFYPAEITLTWQGDGDGPNPGHETLWINQWLNVGHAPSKKWPGCSCAYWKEQQHCIYNRRFRKTPTDI

SEQ ID NO: 977635 - protein, 90 aa, Homo sapiens
EAPEAFGERSLESHALPLVSVLTWLRRLCRGELYPLGPSSGDPGLLCPAGLQRYVVAGVGWTTVPMASHFQRCVRAVWVSLLDVLVAREV

SEQ ID NO: 977636 - protein, 127 aa, Homo sapiens
QQPWNVWLDVRSTSYSKLECSHGPRLTLEELPREPTEIQKGVGLAGPFNSSRGPFSLLAGARSSSSLYMAINVLRESPDHLQLENTRHSQGLSDRSGSMKQCGCLSDHPTFPALRQQPRQVLHIQTR

SEQ ID NO: 977637 - protein, 431 aa, Homo sapiens
MDFLQKYPLPLIPPTRGGERGRRLIDIGLPSSEEDTRKESELLGQVSQELYRRRFPLMHSRKRWARQEVGYDDLSCRSPYHNVCTYHDLSVGTAPLHAQARMNNAAEARWMERTHGLCGRRNLESNGTGRTLVRMHWGLSHAFREPEVWQSAGLHVVALVTPPKPSRRSWAEGRGWWRSGSHGRGDACTCEPSAEETHSRDTSWASVAPLGFKREDGHRMSACDSQSSRNITARRMWEKSSQGYATQSMAKDGQVMYDWEPLCEALGMPWVGPGERERHWRPEARPSSAGRKGSGPIVHAQLGIGQRRGDMTPGRRSDNENERSQQGTQDAQVGAVAASERQRGHGHGRQKPEGGTEAGEGPQTGGHTRGRAEVPKMHRAPSVELRATANKARKRCEPEDHITHKYRGYSRHARTAAGTQQGTTIDRTKAH

SEQ ID NO: 977638 - protein, 364 aa, Homo sapiens
MKDTQNTNTTLDTNTTDTGTKEMNRHEHDNTKRQRTETTHEMNRTEEKRREEKGRDREERETEKYEEEIKSEVLVIIIIENVVESQGGCSSLMLMVVGVWAHVSVASRQYRVRLKSSLYMTMRKDVEQWSGYRFGITACGKVNALVFALKEGYGVLDNALVPEIRIGVVACDGRFALLEQGLCISPCMPRLRLGLPDMYDSCCPFSLTPFSRIRRPKDSVSLPILMYELAAFSLPLAKVVRSVPSLLNTEGKQVQQQTMVMRAHLRTTLDSEPLRTETISTSGGLSAPSVMSRLPNNAEYITDTNGAELLAPCTEPEELRAQDVATSSTDWNHLASGKPVYQPTRRRVGKTQTRRHTQHTLPED

SEQ ID NO: 977639 - protein, 200 aa, Homo sapiens
TRCDFPYHREELIGFQDHALIIMFLICCPSPVMAYYSSALDKENTELILRSREALGNRSQSELILAANRSRSPQRPSHRLTASVLRVDRLRVKRSLPVDHQNQMLAYHMCTEPDEYSELTAVLSRSGSVRYFLASLVASGTQASCDVLNVDNSSSTPVWKRPISLIHKLIESPRGTFLQLIEAVPRQLGVKKADAIARDV

SEQ ID NO: 977640 - protein, 275 aa, Homo sapiens
MEVEVEREVHNWSKGKRCRMIELVDSSEASAVHVGQVVDCKLDLFDTARHAAKGKAFLYAPYKRPGRRLVEPVIRRFVGLATEGDVYALCRTLEVVTLRMHRDACRSWRSHGAGIGWPSVRYGGGVRSVPSLATKGLPLCSTWIVGCTRLLECLEPRRGLRAVWPRRPSEVNHPFAFGGVVAAQKIGYVVARRFGPGPLGATWAALIRRCCPSLVLPKWAELSPASPCCMCVYRNDSTGVGHVRGQGWHCRGNGWGWRVDLVGTLFGGVVVARWC

SEQ ID NO: 977641 - protein, 138 aa, Homo sapiens
MASLLCCGPKLAACGDRPQRLGSDHVDNARNIFQCPFRCVDVRTFPSAEKDFENGPQNIYKLYEQVSYNCFILAGLYLLLGGFSFCQVRLNKRKEYMVLLGPRRVSPLRAPPLFKDSLRACVTPGRVHIPCRAALVWD

SEQ ID NO: 977642 - protein, 275 aa, Homo sapiens
MRRTHASRTRGSTHASAGSSSAASSSLAPPPKVPVPGAEGPRVPLRPPSPVRVRPGASGGHCPRIELDFPPTLSACLSVPQLMTSLSRFLEKTYYPNFNRHITHCILVQKLIGSSPHQLTRELLRDRRHVSCFACECITCPDILEPHSSKLHSQLYTHVCIEGGSTIDHACRSTHGLGRYYSKFTQLTYDGNHDTYQSGSPGRDTKAFSDFPGVNHEFNPFMEQSIRELISHEYPGSTSDPSLSARVQVKKNRRREYNNRPQHEKHKRVNDTQQS

SEQ ID NO: 977643 - protein, 363 aa, Homo sapiens
MEQEARRNQKTDSITQTTRDPDKQDSSTHNTTNKKTRSQQESKDENKRANQDAEPTVRSNTERDNTPVQNRQQNNGWYPTDNCCFMYYILTQNKQQQEEQHTHTHTPHKQEKTTAEDSRQTNSTMTATDRRVRKRNIKNSKYEKREKNRHRAGSRDNTKEQHTKDVTKRLNARGIKQKNIEKQNREVVEKQNENKRKNRHKKQNISKNKKGEQGDERKEEEDKKNKTKEQQRRHTREEESRREREQESTKEQDKKQSMKKARKEGPTEEKRTETHKQRSQAGQGTNETETDRHERQRRKRKRRQRRRKTQQSTTHNTRTHSRQQRQRRTGDADTEARRTKRAEKRDSQDTKRSKRERHRETRR

SEQ ID NO: 977644 - protein, 314 aa, Homo sapiens
APGTRASMVLLPGPPLESTFHQSLDDRYAADQAAAGRTGFCARLHGGAYDQQARRRRTQLEARLLAVDPGNSLGQMPPGQAGGSRRGPGARQLPLAATVLCHAAERPPFCHLTSGSESRAPRTQYSVALAARTWRTSKQQHAASTVLHPGFSPGQSCLLSSSCWHWLEDTLAGLGGPQKPSPHTEPDSPSPVLQREESSERESLPESLETDSSLGPPRLTGRRPPGGDNRPRPDLHSAPWEVTEGSNRRLPAPERPRTLPFPTSVGKPRGPAWARAPGLRGPRGNGNRKVALKTESGEEPPSPKPPRPHPGEIG

SEQ ID NO: 977645 - protein, 107 aa, Homo sapiens
MGQPVACRGRMHPGRLESDEDICSALARGTLSLPPWVSLDTVRRHILEKPGMKKVDEPVLVGMATEPRASCKGQPDNLGVWRISQVSRHFNRPFDLGLLAPTRNREH

SEQ ID NO: 977646 - protein, 47 aa, Homo sapiens
MSLLFTYRLRRYERLCALSTTHPRSVTRRVTHTTCRLMALPTPTRSA

SEQ ID NO: 977647 - protein, 270 aa, Homo sapiens
GSWTRLGPGTRLSLARMPPPLPSRVDFSLAGALNAGFKETRASERAEMMELNDRLAQLHRRRFCFPGNSQNKGRWLSELKPDCCGQGCPTNAGKTSTMAERARCMRVCGVDSTQRAKQPGARDWKCMTYREQVLSTKWSPGPELVKGHDTQSRGIETSNTRKGLGERHVGKRSACGLPLIRSEGNGMDCNVLPLCPVLDPWDGCDTIRGRSERMEDPACPGTDTSPSDGEAGFGAETPKAAMLAPEQRGSSVGEAFDCGPKAQGPVTGKD

SEQ ID NO: 977648 - protein, 377 aa, Homo sapiens
PGVSIEDPLDQDDWGAREDSSQPRCRNPRLVGDDLTVTKPKEDANGREGEVLLTASCIKVKQMGSGDRGLFRACKLAQANWLGRHCVSQSYGGDWQIPSLADLVVGAVQLGEIKIWCPVVRFWSAWPYVANQLLMNWNEGCWARMAKFAWQERSEMPYGQSKRLGRQGALAGHLYGYTDSLPIVSATGSSRPPEQALAEVSRASVVPTTVVEFVPASLELLQKAKHPVEPVLAASSFAVVYLAKSCYRRPQLPPSGLEAWDARVISGAGHRAKSRGVRGQNKSASDLAKHTQGARPQTTRAPRTRPPASDTRGPKSANHHAARRYRASGTRSDSRATQREQATPHSTTRDTQMYTTAQMHKNNRLTDAQTINRAHRT

SEQ ID NO: 977649 - protein, 164 aa, Homo sapiens
IEGVFTNGSRVEVEVDIHWQPGQGEGETAAPGFKVPAEASDEGIGISANEDEPGLGQEGDFSGVGTIGRRRAMVCWRPRKGATIVIGGWYRPPLRKPGGYFAGPAQRILDDQFIIPPELEEEVQEIMKITGATAAAEAHNPSAQPRLPGHYQLDQLQIINDTPL

SEQ ID NO: 977650 - protein, 138 aa, Homo sapiens
MEKGDPDPKNCASASLWCWGAARDVSVELGCACRSIGVDTPVVPGSSARCRIVHHMTTVRDSSHHLGAVVDHDGTITAHTCGIMEVVITYFMGDDRGRVAHALRQEVGVGCGKLIDGGRKEITFLSGLIIRLKDVLFP

SEQ ID NO: 977651 - protein, 37 aa, Homo sapiens
HASVKSRVKPSWPKGYLEGRQSQACCPVELWEEEEQA

SEQ ID NO: 977652 - protein, 111 aa, Homo sapiens
MGSWNWGGAATVMTPHDGSSRKEVVSEDSAGPPRGTARARGAGRREGQGTKPPSLRAEREKGTGEGYSITGAFPIRGEETGVHGLHGPFKPGPKAGTGVHASGKNAFGRNS

SEQ ID NO: 977653 - protein, 202 aa, Homo sapiens
VGAVGAASPPPAQGCVSGSSAMPDDLQKRLACVPWPGPCEGAELRLLCHPLSCLGPLVEQCLCAGRHCGLPWPGHAATRELGPGLEVRAGCGCADGVRWAGRDPADAWTEVTRTARCRRCAAKPGWRQGHQTRLRLAWREALQGPTQRGLDTDSPMVERTLQAPGCVTGLGGEGAGADSWATKRQHHVTQEKNHERTKDWKT

SEQ ID NO: 977654 - protein, 249 aa, Homo sapiens
REEHDKEERIRRGDDLRLHDGNRGEQEGDWWARRSRPSWTLLYVFTAPRLLSPTTDPWGGPGTHGLLPSPTGLLLNSDALVACPLVPPAADPWGGITAPHAGTSGGHPERTCMTPCKDTIRWTPKEVETTQNRYMDKDMSSSEGTQTHLGSPTGRANDTQSRSRGDHQGSRREDTNKDTSSNPRGEQHGDNRGTHILRRNPPWSSTGDHPHGTKRHPRTPKVGHPRTRQGAGGEKFTEATEEPRTGKLH

SEQ ID NO: 977655 - protein, 70 aa, Homo sapiens
MCRNKKRGPPHKRQGRTHNTIRDRSKSTLVDNNTGPADRRNNRDDNAEKKRREKKNNNTSKRETTHKTGE

SEQ ID NO: 977656 - protein, 313 aa, Homo sapiens
SGQVLGDQTVSDNVAPGKVQSGKKVASIKESSNVLSRRGGNMIIQSISLVTIAKTERGAQTLLEQPRRSRTKTNMRMPYSEDQGNQRHELNGAPQEVCKWRPLSGPPGKCKACAEHRPAVTFLRMASADSALRPGLAAGLGVPETRASAFYLLDDSGDRTRAPVRGGTDRQRERTCAGLSCRTISDVRPAVIDELFQDRFFTREPEDTLGTELPFSRGPGEASTVFFRKFPQSVRALMRFSPCDRTGTCHASVPVLSSEIDTRRAQEGHGTSTSTGPAFKNRQQIPTKRDEDRTVVAGELGTNSGRPVDEGPK

SEQ ID NO: 977657 - protein, 270 aa, Homo sapiens
MSKSLVDEAGSGFIQMPSQAAREAWLRHVLWHLCRLDIDSPTITARATLVIIVVAIGPASRIRWQTLKEYDDTSGTCMWLVVDFSHVKAHAVTMGRRIQECCAQARKEATLSEPRSYYRSRRCVDSEKHYTGSLRLQNLAFVQGAAGPWQHGGELTDTGANLEHVTAGLTPPRIGSKKLIAQTIPREVGPNEATVLATAIGSANSTPAYDSNKLAYARWYKHITKSQTLQQNRQRLPWIRLEEESNTLDMATLRILGKKSGEGQHSRVPS

SEQ ID NO: 977658 - protein, 109 aa, Homo sapiens
TRRQIRRYQKSTELSHPEAGLPEVGEGASQQRFAKCDSERYHEPHAIGALLRRLAEAYSVVGRVLRVLPNPCCATRDSIIGDVYRFTAANTNNPTVRVAGSTGEQRALS

SEQ ID NO: 977659 - protein, 240 aa, Homo sapiens
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLVALRGYYNQSEDGSHTIQDYWIGVASGAPRGRDNPRGVYRGRDAIRRDKDYIALNEDLRSWTAADMGSQITKRKWEASHAAEQRRVYLEGRCVDGLRRYLAEREKETLQRTRPPQDTYDPNTQSLTMKPPEVQRPGNN

SEQ ID NO: 977660 - protein, 241 aa, Homo sapiens
PRVVPACGTSSLSPEAHDVARSALNDRGAGSLDGTTGHGKHAGIPTNDRKNGRSSLWGSFRVGLLLRGSASKACEPGKPGIDFNMRLSSPWCRAPATEEPGTRAIWCVALYVKRLDVGDRNLFSINPITNAQAQCGNASGRRCIQPDDACSRLVGDAVAGDASAPSILEEAITVIISSQAPSGQTNPLRQCDQATGGRQLAPERTRAPTVGNKGRFGPCEDSNGVYSSSLRDRILRPEDRR

SEQ ID NO: 977661 - protein, 137 aa, Homo sapiens
ATVNLKPGEWLPECEAEVAPDAKSFVLNRGQRQRTILCLQIQPSVQRPRRRQHHRVQQQGRRGLGDRAVGGCLSLPAWEAVGEVCINFEAGNLMRRSCQDGYRIANVSRKTPVILEAIELHGMLTVSSRSECVAALT

SEQ ID NO: 977662 - protein, 161 aa, Homo sapiens
LCLHWTTSWIAWVYWRLDTAVRGSGVDYTCLSSPTKLDVYLLPGHLPGTIAGTSAPFSMRAVSSLGVVPVAPELLDRAKQRGTDRRGAKLGRLATLHPSMLVVGSSCLPPCPMKANPPALGTPRSTWELPCIFSPLELLPSVSGLTTSPHQVWGGSGCPEG

SEQ ID NO: 977663 - protein, 103 aa, Homo sapiens
MKKRKKPQGIFWRETETHIRARTGLDSTDRQSHKDQSPQWEKQEKHEYVHKNNTGKYKENSQNKKKTQTRKRQKNTENLKEEPHQKRHTQKKKKITIDATPKR

SEQ ID NO: 977664 - protein, 169 aa, Homo sapiens
MGGPEHKSHPHSSRKNEARHANVAQATIKTDNEQADSTKQKLEHREKHTEDPEDALDEKHRQPGAARQTRRTNANTQQEHYNPQLRHTRKKHSKQQKHLGYHHNKPNHYRRTNKTNDTRTKERNKENNHGTHSERQAGTERTTPENRPRNNQRETKSTKPNNKTEKTRT

SEQ ID NO: 977665 - protein, 82 aa, Homo sapiens
AGPRSSRFYSTGGGADTARAVTLTRLEKMYHACGEPIELYRNAEGHGQWLVSTANCIHAVMDLRPPPCEGTSRTVAGTQDQT

SEQ ID NO: 977666 - protein, 138 aa, Homo sapiens
GSVGERGWHRDPVHLGPPPLGDTELRRPDGQGSLTYLLSRRCHEERHRSVVDGECSVMTDSDSALTETSTLLRQARIRRGTACLLMSLANTTSTAPEGVPLALLLRDHYIEGLVAREGWRDEEREKSTYGRLEMRRRE

SEQ ID NO: 977667 - protein, 163 aa, Homo sapiens
MAQRGGEEGERAHRREDEGETDNEEAEAGRERAEKEKERRRERKKWAREGACREREDDKGSAERGEESGEKGREEKKRERNAQREERGRRRTEKDGEAAREDLEGGGASRKGRRRRKKRGEPSAKRGEAARGREEQETHEEEERTKRKKESGRDKERETRRGR

SEQ ID NO: 977668 - protein, 563 aa, Homo sapiens
DAWVLDAVVRDAEGTEHTLYDRVRENRTMVLSPADKTNDQGRLVVTVGCAKQGDVWCRRPLEEDVPSPYPSNHRPYFIQNVSDLSQRAPRHTCSQEPRRHDTDGTDHAARTHTRTVRSHEKRTEHSRKGEHRTTTSEGDAYATRDRPHTITHACEPPEINTITKRPHIKCDVIGPCHERRYRHGTLTRQTPKLTTDTKSDTNTHLLVIAQGTMQTTDQHKETTKEDENNADQAKREKATEHSDKKVNQGNKTERRHQTADHNRQDTSHDNQDIRDDNAHTEERPPSHSYDHPRRMHYHRAPRSSSSGSSISCKAEQRHVNYWSAHGTDMHHNVTHTHTPQNPPAAAERPSTGTTATKTYHALTPARPLPARAHAHNTGDAHIQRQDTTQTTHTSNKQTDDNKPRNATPRTQRPTEITTTTAHQDQQREHSTERRRNKRKRQRHTTPRQATSTERETRRTNARSEPNKWMYDIRRAGTTKRGDDSAQHQRGQTEERQDRPWRKTPEAQRQRRGGQQTEQPYEGCAEKQRGTSERQTSARGRLRGARQADRENERQAHNKWKLLR

SEQ ID NO: 977669 - protein, 119 aa, Homo sapiens
MEGGEGGGRRGGAGEGIRTEEGRERGEARRRERADRGRGRPGAEGEREKASGVSEGRERGTEQGSRRRRWGADEERRGKRGTNGRGVEGGGGGREGRRQGRGTTWRYTKHNPIESRINN

SEQ ID NO: 977670 - protein, 136 aa, Homo sapiens
MLGGRSHTVKCNQQEAQNCKRSGTIETMRRLVAGASRNKKAAWGPAWPQLRGEWLQCGPTLHMFLCRDSTTSMIRGLQYFTQQESHQYAQVARGTPPCGGNEEECKSPNRSMVPILYAGVARRDNHPGDRTNRRRD

SEQ ID NO: 977671 - protein, 39 aa, Homo sapiens
MGNTDRGLAYCTGHGLDHAYGWSQLRHYCNTTWVEPTSQ

SEQ ID NO: 977672 - protein, 192 aa, Homo sapiens
REGASLCSTLTRTTCGGLETTVLYHLPYAPLASVIPARSFSEREGVCPYGLHPEQGYMRHMTLDGGSRRMGRFTRHVKTLSPLRSPIRHRASRGLNPMTPSMSIGKRFKNKWMKLFSSNASYDALKVAESKRLTSLYSPASFLGQRHMFSVLPLKDDKLDIKKSSYKKLSNVPAANAAGARLIQVKELSKGV

SEQ ID NO: 977673 - protein, 475 aa, Homo sapiens
GAAQQPVDEMPIAGNGVALLLGVQRKEQIEIGDMVVAGDVADPRLNALAPGGKPGDDLDRREDPRLSRGPSDPGERTSVPVGDPPLTLTTERDLVTPLEDAVGSDVRRRSPLGSALLWIQGVTTIIVMAPETDARCRIELGHVMIYYEFLDVSRGYRTIEGSTAKDAKPGERERTRGPQEELEAPMGRNPPGECFLTLLGTHRGHETQENNVCDRTLRAYAGEHNRNTMRGARYNAASHGERDVGDLGAQGRPRRSSTLGPRRTRKTGAEVTHQCSLCPRFTAEPNDRATQGRICRVDTHSVRRRNHHRIHKGRRHRLTKGEQKPPGPYPSTHHIVRNTAGQNTAQCAMCGTQPAIPTNTNGTSNSDKMNTHTPTSDGRRTGTHQSGRRAERREPSTKEVCHKGAIPDLNGASCAQGKSVLRHTIRYTVVYRHLGICHMRRLTDQQKSHTRGERSSPSAEVSGNEAQNSNGQWHT

SEQ ID NO: 977674 - protein, 147 aa, Homo sapiens
MSQTLRWRRPTASRPAPGMTIREHPTREAPATVQACPVLSFWALTPPGRVLQCLGPGREALDTLSVGARTNALRTLRSTNAVHGREAACQVNGHSVRGGGGQGFQARCCARDILTVVCSVCPSVTFLLTKVEERKRGISHGVQTPPQ

SEQ ID NO: 977675 - protein, 97 aa, Homo sapiens
MRTQGLNREPGGPTPIYTRTKHTAAHRRIPPAQKDMRGPQGVRKHDRHPTSHKPTGAGQHNNDRATTRTPPTSHDEAQHGRNDNKNPQQKTVRQQKK

SEQ ID NO: 977676 - protein, 270 aa, Homo sapiens
MTTKKPIPHSLVPGSRRKVLSLGYTPSMGGAAANKTRTTEWGGADHPRGGKRTQQRGKSDHLAEKRPLNIYRQRGKRVKPRLPETSGRDSCGIPRVKYNTRGGTGVRPPVWGKPHKKSAISCQPGGGPRMGVHKNCGHFVGTAGRRQKAAKTAGEQIHPHCRAPKCGAQHEKLDQRVLLRKPHGGRCAPKWVGAKNVRGAQTTSVAAQRSVSQKTRRGGGIHTRLPSEPTPLTQRRSALCWGRTAAQQERSEATWETPRDRGRDSQWQKT

SEQ ID NO: 977677 - protein, 527 aa, Homo sapiens
YHNPQGTYHYYQLRVCCPERIRHTKPETLGEVRGVADRKWSDVFVSEIRGVTATIQWRGRILCRDECEHRVHAPELGVSCSTGLTLRRTDIDTLRCVDGEDELSHGPRAFDEGVHVDARKVASPSPTNEPHQGSKHDSGNTRLMWAMRIQLYACPLVENRTTIVFPPHTASSGTGDRSNVALSESHGVNAWLYRYTHGTSGIASRRRVKPPTHILTYASSPSWWYLAMQPLTTFGYARFRARLDQGRPAVVERDGGGFPLAPRKALSGPIPISGFRSRLHVKLMRNCEGPRRDSPQSSGIGQLNGMELVSPVCVKLPVDAHLRNMHLGPAWFSTPLEQWRREEPNDIPANVVSWADIEPIWNQEENDKIGTWGNDIHSNNQRIALQQRVPPTINREEHRRLGAMRQGAAALPQRAPEQHGQQGRTNGQRTTGPGHVATHSTRDTEEAEKTKQADWGGGPRTGQTPRKRPATYRNRHGHRSRQINNRQTGNIREENTGSRPTPAHTRLNDTTQASSKQHTRTQQTEHD

SEQ ID NO: 977678 - protein, 127 aa, Homo sapiens
MEVRNPLFDHAALSAPLPVPPCSPACTAMTWSADRRPPAPLTSDVPPVGWWHGPGCFPLKTCFDACVLFGLGLVAPVPCGPSCQVRPPEPFVPWTPPVSPCTSPCCGLDHPRLDGGMENRRAQERVG

SEQ ID NO: 977679 - protein, 245 aa, Homo sapiens
MLSERIAKVATFRGKDLTLTLPGEPLYARPWPRLSPRRGRLGSDVPGGYCTRSQRHVGTRNRRKWPRGYRGGFPGAPLPWKFGSTTPGADALNHIHDGPPWHPTSPRDTWTGLDRSVEDRKQCPVISFPPEETGPPQIWCHGMGRHAREPAPTRLGIPQRISAPNPRAPATEKKVPPRTPGEEKATKMSGQPRIQAARERPPGSPWGLHRPAPSRRSLSRRGAAEDDTKFTGRWTLAKGQKRGDG

SEQ ID NO: 977680 - protein, 71 aa, Homo sapiens
MSFPAALRTRALRGVHENESYRCRYQNFIFDPLPDAVGELTALLMGIYPYRIQKGERPYMSKGSDDTDKLV

SEQ ID NO: 977681 - protein, 149 aa, Homo sapiens
EDAPGAQRQDCGGPGLASPAPPIQAPDPVPPSRITPGSTDASLERSKTHRQGDKHVPREGDRNARREITMAPICENGPVRSSAVSWIQMSTDFYHHHCSQPPPFHDESPKCKISISIPLNQKIYHWIEEALVSVKRYERVTEERNRNVE

SEQ ID NO: 977682 - protein, 296 aa, Homo sapiens
MATHNSVRQVRDSRSLWHKKPQTNHMAICNYTELVGDVNSCSPRWPHLGRTNLRANPRPHSTPSTEVHDNISWDIKLGTQNMRYTLPLTKHGQINYTRTQRHKSMDMPHTKCGTATRHITTTDGWTTRRDAAGNSDHNPQRVMEKTCSITPNSQRIPTQHCPPRKAHTRHTHNGRNINPAPHGTHGATGGPTGAPVTCHNTVCADVAPRETKVARSNIPPPVDDATAETDEVRRTPDADDAPQDTELASQAQHEERRKRTRRRRTHNSNERHHTTTPHQPQATTDDTVNETKKRKH

SEQ ID NO: 977683 - protein, 241 aa, Homo sapiens
GLLATTYREEVVQSRTADYKRRRAGRVLIDLHQQPPPVKQRMNDLSGYGRNGETRDWPQRNLDSLDRDLRCVPSVRTSSRSACYARDRSHGSSEEESPWTRGELLVRVSGGLAVRESVSSPGSPVLGRSWVLVPRTVCASPGMTGGVASGSWGVGGLAPSGYAKSHVAMQRMGPEWLPITVRKTAKHGHGDRTPHGFATFAIAGPRQYDIGSRLVPSRRPWEALLSACVNAQEIDTTKKPT

SEQ ID NO: 977684 - protein, 110 aa, Homo sapiens
MTTLDVLPPPLKSSLDRKYVPSCLELLRLFLPTTRYDMIDCHISVISSNALPLPEDGTTRRIVIRLDPKRTHNEIGSPVPLYNTKGCEVSSFHEFGPYNMDVRPVVPIAT

SEQ ID NO: 977685 - protein, 241 aa, Homo sapiens
MGRTEDRGNLKKERWDPHIIKNRLGHTREKLDVDRQRNLQHDGEGTSAEAHNTQKGDKKTPYTTDDIKQTIVNKGDKRPSGSRPPIKDNRDTPPPKGAADTKSGERTCTGHTDERRDQQGAHTAKREETPIRHLPRNDRPKNQGTKLRRTHEQETDAGGNTRESEDRTEHTERQQGDSDAIKKKKRSKMGQNHGAKERKTRTARSGTPLGENVPHIKTEGETTPKQENSMRRERLRYESTR

SEQ ID NO: 977686 - protein, 89 aa, Homo sapiens
PHPTALGASLWTGCCRHPTCLDVAWRVAQSLSNPWRTGFPARGKLLQEPARSPVKLCQDDCLVGAQPISWSNRYISITQVLVLRYREYK

SEQ ID NO: 977687 - protein, 57 aa, Homo sapiens
MLATRSTLEIYANRHGVTTGHTQPITCGDIRHPPYQQNHAVMNNDEDEAPHQNSQND

SEQ ID NO: 977688 - protein, 74 aa, Homo sapiens
LLKMQKLAGHGGGRLWSQLLGRLRQENHLNSVETAVTQIAPLHSGLGNRTRLHHQKKKKYSETSISGSRQGPSN

SEQ ID NO: 977689 - protein, 109 aa, Homo sapiens
MGNQGDPMTPNCSFPPKKRSNLLSTLLSLSGRIPLLGYPPIIRSARLCFNGAFKPTTSFKGKPLRERRKLETKLDGNTWLCPSIWKHITAGGAIAFEKIPKFSFPPNGA

SEQ ID NO: 977690 - protein, 43 aa, Homo sapiens
MIGPWPFDSAGRGIPVTVALLNPCGNGIISWVDFEIKWAYHKV

SEQ ID NO: 977691 - protein, 445 aa, Homo sapiens
MLPKLDSIAQGTQTGALQWRCFVQQQNEGSLNRVWTTGHCLYYALMECIGTMPATCRAQKFHGKVTSSFSTYSDIHLAFIQEHIGMGPAGHRVMPPVRGTLYLGQETQLEYSGWDVCESGEAKFWIRRGLSPGPCGEFHNILLSRLGFQLDWVFGLPSAIQNGPHLGTGMSIGQRKWPKRVLGMRLHTMETSNFQNEGGHWHKREAMGLGGDSLGMNFRGNGPLMHKAPRGVPSKNWAWFGIGRGATIVQCPGKELPYHPWVTVTAMETPKKSIGGLVALDGEAPQNTRAERKPEEEPPGERIPRSEEPTSRPGDKGKLLATCPPGHNQYQGIVPLIGGEKKGKTKNAVKLGPEERRHPPFGEQAHRKNVRTETDHTQVDNPEHWGATQATDTKPPSFWGNTLVEQWATAATYQGTVNPGNDEEVEPLSAATHKSQRQSRLGLLK

SEQ ID NO: 977692 - protein, 41 aa, Homo sapiens
MAMTTYERAQDIIGYRIVRLKNAHKPITYQKAQACTPLYPH

SEQ ID NO: 977693 - protein, 237 aa, Homo sapiens
APSSTGPAPMAPPMSPSALSKQGSGSSHAMEVQEKAMALGQEMIPTQVQSPMSQSVKRSRSGEGEVMCALCCNGATSEPGTPGPGPHSLTAQATRLQGLPRHVPLMDIQPYCYIERGCMPRMQLHWPAQGTCSHEREHPWCPHTHGLAMDHYVNKTEGDRRHGHMGATIHTSHMKGPEDTKTGALMASLRAEGHMEQHRTGVPPANGLIKHLKLGHADSSRSNGTARTKAEDSHEAG

SEQ ID NO: 977694 - protein, 145 aa, Homo sapiens
MEKTLATQGLAALRPDIRRAWENGQHGIWASQEKERLEEKQRDSRRERANGGGRVADEVVLTQGINPYTGTPDVVVCGDHFDDGFLRMARFLLGALDAPGARNRYVDKVGILRVAVVALSRAPNFYDGPGEGTLVGVPIRSCDHP

SEQ ID NO: 977695 - protein, 508 aa, Homo sapiens
IRVHPVPKMTPDDSQCYEEVQAVLSIPRPLSPDSRASSLSDTVLLPKAMQVSGTCKQQHCVECTSKQDISLLERLIGQNSQDVYKISMTIPDCIHNCKPTNVRSQETYALIYTWTSSTIDKTLTYQIHTPLNILKAQNIMHSKSLKAPHAHTTTGTTTRAQATNARHNAHHPLKAQQPATHQTRPKKHSAHSKPRTPEPHAGDKTPDSPHTTRPKSDAQMATQRHATHNQRDTDHTQPHPSLPDHARHTDTPHTSPTPQTTHHHQHLYCATAPCAHHPHTRTPRPTAPPHPAPCPGTRQPPPLPPPPQRTQPTNAQTTPTHHPPATTPLAATRQQTTSITHHRTAASTPINTHRPRPHTQATNPHGAAKQPNTAAQRQRQGTQENDGHPQPPTAHTRRSAATSQHSANTNGTTRPTHDTSHPEPATTTAQTNTHPARPAREPTAHTSPPQTHHAHTEETTNMNSKPNAHAEPRTAPNTKTHMTTQPAPTTTNPRNHPTHHSAQPADHA

SEQ ID NO: 977696 - protein, 333 aa, Homo sapiens
MRLACARLRRVCGDGYRGTCVARLLGPPTRNTWGAMCCTWRGTGYAREWNSAHLQSLGTARASKSIGPEPYVQTIAKPQRNRKRPHAHVSLVVHWGGSIGMTAKRTLEGYWRCRGGPPNGHTPGIACVRGSGVRERTGMGTGFREAKASPGEMAKALGPSGNAVEGCTNGWRHGLVDLVGEPKGHQGKHVLSTCHRLALWTIGHGISARHSWQWRKLDWGENFGGGPKGPHPFCQGWNTAPGQPNGCVYRVGMPKTMNVVGDRTALRTKMQTAMERGRHMTQERAGRQRPLGVPRRPRGAHKGRPVRKAHNVGHIYRLRVGPKELGPQRAHMW

SEQ ID NO: 977697 - protein, 115 aa, Homo sapiens
APVWIATRLTLHASLLELKETIDDRSGKKLERWPYRFLKSGCHAAIVDMVPGQCPCVFAELSTRLSTFGSLRCLVNIETGRVAVGVIKAVDKKVLLRAGHRSPYLCPRLGSEWLA

SEQ ID NO: 977698 - protein, 223 aa, Homo sapiens
SNATSPALAYPCMPGTGFLCQSIADETFSFMLDWGRWQRDASATAGAYCQCGKGPRLPEAVLCHQSALCCFGVSISKVLDEVERRQWDLLLHSVYPFMTKSHGVALSQPQGKTITVNDIPAQELAHECCIELLRQDQWNYKGWRHSGTYMSSTIKTLDIPEMPHRHTLRKIHRHYTGIAAQTTRRYQQTEESQEYRPPANPRPPTHMPTPNAVTELEPTSDVH

SEQ ID NO: 977699 - protein, 279 aa, Homo sapiens
MANSETGVIIRQMQWFICFITRCYRYVRNFCVGRCNAVGSLCVRAAVPPFQVCAPSLSLSLAARRFSAPPLSFGGLSPFSHPPRPPPAVSLYSARGYHPPCAPRLIMCPSLALLPLRRGALSLVSLFLPCRRILCSLLSPARTTRSLFCSSLGRASFLRASSHSPAPVSHASRLPARVCFYALSDPTYYTQHGCRLILTELRPARSSLPTPPVGAVQRPTPPRAPSSLPLSCLLSADPPSPPPRISSHFVTGQHTQKNRPECSKQLVNMACRSLTSTLH

SEQ ID NO: 977700 - protein, 180 aa, Homo sapiens
IIKFNYDSEKIERITFSGKNYYWTLVIRPTVYWGREGLGRLNLSYFLFWKMIINRNVPFPVWIYNRSHLAQNGSGRINHNRKCEKLVKAKAHAREISQNTQSGQHRTRWAGNLEVISVILGTMGLHGSHGSRGGTPMVNWKFPLFINKVAFSGHSSSIFQLAWVLPGEENTLVTGAYIWE

SEQ ID NO: 977701 - protein, 261 aa, Homo sapiens
GARGHRVPLTEACKGSRIGGHDEDSDWLCWWGLTGMTVVMAGQVLGDHDGSQYHELQEIVQVREVSTSHKEIPKLLSTGGEHEINDSSVRKKTTEERKTLLSNLEEARRKTEDALKETQGDQRQQLKELPGVCNETMMAPGNECKRRTETDRHEEFYARVCRSGSGLVGRQLEEFLNQSSPFYFWMNGERIDVLLNGRTIGQQTAHAGMSWQDHFSRAFRIIDELFKDRCLHPGSPGILAITGLQRGPTEAPFYLPSPGWQ

SEQ ID NO: 977702 - protein, 97 aa, Homo sapiens
VGADRRDCELMSWFIVEAHLAQPCISPSTNIQPVVLHSKTREGKRQQGQVATGRASGAIQTKDGQIFLSYVSTCESPTSSCAKSQGRGIVSKTSGTS

SEQ ID NO: 977703 - protein, 103 aa, Homo sapiens
MGTHPTEKHTATENTKIQGDTRTTTPHSEKGNNATGRTQTNTGATQKHEARAKTRHPTTDETSAHNDINAHRHNKQHHTPNAAPNNKDKNTATANNTKANNNP

SEQ ID NO: 977704 - protein, 91 aa, Homo sapiens
MALPMRGPRVGVKLCKKETQRVWFSNLGSNYYRGSRNLYGRNGADPTERSEDSQGKHPPLRTGNSRPGEKPTREHMAQNHRGNKHRAQEKG

SEQ ID NO: 977705 - protein, 380 aa, Homo sapiens
MDDDIGALVVDNGSGMCKAGRFAATSDAAPGPSFPIQSWGAPGTRGVMVGMGQKDSYVGDEAQSKRGFLTLEDTPFEHGIRRPTGYDHGRKSGTTTLLQVWLRDGSRRSTRVLRDRGHPVKTRRTTRRATMTPESCCEHLQDTQTMERRYPVLCYIPYTASVPYALVIDDGHPGRQGSPQTVPIYEGYALPRCHPCVLDLAARDLTEYLKKILTERGYSFTTSAERGRIVSELQEKLCYVGLWLRDKDGTDVSRSPGKELELPARHVITLATHPVPTRRRNTHRTFHPGMEPGKHQEKHPTTPKQKARGQPEQNTVATPTGNEPTQRQGHAPTHNDNTRTNNGTHNVHQPTAAERPHPSRDHSKDAPHRNNTTDTYISAP

SEQ ID NO: 977706 - protein, 168 aa, Homo sapiens
MDARCECHLKASYTCLHTLRLGYIVDTGCRAGTRVAPWGQSLLQCGLSVCECASRIAWTIVNIAALIGCTEPNCDHEKLAENCLVLSTQNPQEVIQCPFYCVYLIHRVAVNMGIVRYKGQKGDSYWREETVEKFLGRVEKTTDVFGWGKGGLRYDWDPGENRVGGPGN

SEQ ID NO: 977707 - protein, 295 aa, Homo sapiens
HSSPRKLEKVYDPKNEEDDMREMEEDADCACVEHVMKNVDTNQDRLGDPGRKFLASTQRKEFGDTGEGCETVEMHPAYTEEELRRFEEELGCPGGRAECLRPSVLSQERDGSRAVPGRLEAHEERAGCRLCCIMEHAEAASKSAASKAMRSRGAHPEGQLMFQPRTHDDVTVPGSSRGPAQVGGHFRTEILERYLRLRCPASVSSGDPQPLRIPDAPRRLTGRWMKWHRQLPWGAGVMLGLLGPGHGLAFTRICCTQDGRFHFSGFKFVVLLLFHEGALSRSGEAGSAYFRARPT

SEQ ID NO: 977708 - protein, 229 aa, Homo sapiens
LSGLPGASAMRPLLVLLLLWPGGWLAPTGRQQDPHASALGHPCAFHVHRLWATMAAMWLAWAADGLATGRDVLLPWWLLVDDEMAKGGSAWDCLGTSKWDPGPAMEMGWDPAWAHTVVLPGELLECLRDPAFSSQGRSEDAGVPPPSDAPLPFRPRAGELSRDITDAVTVQVHLPGCLGVLLLRRPCHRLPGQPASLIWGTIGELHCLFLPVNRGVAQASLRSRVGGHC

SEQ ID NO: 977709 - protein, 282 aa, Homo sapiens
MERRRITSADRRSYVSSERDDGGGAWLLDRRLESWHPLSLARMPPHTPDPGGFLPGLGTLNAGFKADPVASDAVRRLLELTDRYASYIEKRFAVLDTARTRRWLLADSSLRAMEPTKLADVYQAELAELRVRLDQVTAHSARLEVERDNLAQELDTVRQKLQEKPNLRPGSREQLVPIDTEADEATLARLDLATEDLRSRGRTDDPGSFEGTIHEGESGKLQGGKWDRQDGTWWSIERSARPELTGALEGRSATPGCKNGGPNMTGAKIETDPAVKPNERCR

SEQ ID NO: 977710 - protein, 441 aa, Homo sapiens
MKDGHHERVETVGPNNGTVAPCAQPYQCTEPTDGTTNDLRAQGTTCDGASTERAMHRSQPPTQGRDPTLSSTPQTHKGPGEPIATRETHEGARAQRERPRRSENGDRTLVRAHVGPTRTNWQHIGNRPRHRSAQGHQDERPQHRAERREPRRGRHTRPPSAEQSNKHYCSGRAQKPHMVRALEYFRTRESMANRTYDLGVVRLSRSSPTLERGASTTETTAVADHMPRTSQTSGFRPFLLALRVLGKLPLVRDRPLLAYAVSYGALCFIRHSLDLDIPITAAHQSHFTTQLFRVYTHAEIRLLNSAITDYKRVAPPPSLPHTYASVSLFHLARGEDEATQQQPEPADERRERTGARDEGGSRAADERAPPATDERVTGDKTQARRRRDADSNARRAPTRSDRRRARPADRSDPRAPTRRSKTDDGRTERPRREQQPQRRSA

SEQ ID NO: 977711 - protein, 167 aa, Homo sapiens
MNVLAHNQQLPTTQLCARHTTGQNHTHTNVIDSVPIDQPRTHKDRTIKKRSITWQANQADIMLVEITNLWEQTSGGGDQPRRTHTVGTASPPTVKHPLPPTKTKERRELDAQINANVAEPAHNTVVDQQNDANSQIKTETQNKRQMPSERLRHCIIARSARPKSDAH

SEQ ID NO: 977712 - protein, 335 aa, Homo sapiens
MAGTPHGDRWHRCNRGIPLVPGCSLHLLHLAWQTNLQHGCRTWRPTLSVIYPYNPQDEAVPEQDRTGKVYLVAAPIQDYCSSWGAQDSMRPQHGTGPMASKCTDHTRPTLKSRHRRRSEHTNETGPDTAPTHHRREHKRHGHYRPLEHSDKVATLTIGPSGQHATGTINDTGGTRHHNPTTSHNKQRQRHTRSKKKRKNPDDTTDLGQQIPRNKDKSHGTPGANKQVQPRETTPRTGRPTAQPNSQRNRNNTTLHREYNQERHNTKPHEQKAQEQTAKRTQPDRSQRQRQKATKARGTGHAEANSGSQENGQNKEQHSNKEKRKKREEKTRLSHD

SEQ ID NO: 977713 - protein, 297 aa, Homo sapiens
MRRNMDKAQDRNATALQPSTQAHPSRQPRQAHSGQHNHTATQPSGSAKPHSGPTHHRTKRTPATQGTHTHRPPPGHKTPRSTPAQTTGDNTTLTRAHHPNTTQPHAIHPPQPTPAPQGPGTPDETQPPARPTTSHATRHHPRQQHPTAVNATPKPPPHHPHPASSPDTRGPQDRQTRQRTHPPTTTAKPQNTTDERQGRQGRKTPRPHPAQHKTTRATRTTRTNHNKKRENPQRASKATLTQQTEETNKKKKANRPQTATPRTSPPQTPPTPRTRQTTDDHTASTAHHTDRRQTQAN

SEQ ID NO: 977714 - protein, 383 aa, Homo sapiens
CVPPGRRSDHMESAHWAITWHRYRCPMRELLCGTYYGIPMERRVVIQYECLLMAQTMETSRGDQRSCSGGCTWYLQWLVDVVDVGGPHLVPKGAEPVDVHVDMWRLTRLYRLRVRVEAACASVGGRLTWCQRGVRPAWYMPSNRSARVDLRRLDASEAAPGAPWRLATYVREPRPHALLVMQEGRQNVWHGHPSKIQRLSPESPGGYPHREDSRALTRQGRGAWRGMTLGGGYAYVKGQRTQHVSQGDIAPRIRFKTDGQRSGTNGIDASQGRQARRRRGTTNLSDKHLSKLEGTRDTERRGYQPPLEVDDETPYSGGAPNKRGEELNTGAQVTGHREEMTHSGGDSTTMVASRIGSLVEQWRVRAGQKYWEPWRHDSGHYTG

SEQ ID NO: 977715 - protein, 197 aa, Homo sapiens
MTLNPGLAILQVNGVLIYGRGSKISFSSTIIFQELGRGMKGLVSPKVYYKYPFLLAGGSGVELTAYGNSQDLCDTGLEAKQDTTLRVCTWETSRDHLGERQCSAGRYKIRRGAGAAILGRPSILGRLRQGRLLTREGVVGVTRSPWTLTCGRRDLVFKQKTKRARKNPGGQLRPHLTGHKAQNSGGNPRNADRATGS

SEQ ID NO: 977716 - protein, 290 aa, Homo sapiens
MPYQYPALTPEQKKDGFDIAHRIVAHWQGHPGLQMSPRGMQIAKRLQSIGDREHRGEPGGFIPASCCMTADCACEARALGVSSLFHETLYQKADDGRNLPPSYHNANGGVVGMKVDKGVVRLVGTYGDDYSATGWMGCLSRCAQNTEGLDADFAKCRSVLTDSWNTPVRPSDDGRPPCLAVFARIWRRRREPIGEPDIPLMGDQTESAQMAEKEQRRQKTGGPHIYLKAWQPKGTQPAAQTTPEMHAHAGAQARAAHTGAKRAPPQTRPHNTTRPDPRRATDTDPKPHTG

SEQ ID NO: 977717 - protein, 311 aa, Homo sapiens
HASGWEAAPALLPTQSQGWLRWGLVWLCRAPWLQLVRGALWLLGAAGLRVPCVCGDAHVGLVPQLDCWWQPLLAPSDLPTHELLSLIQESPMIHDLACSCPPVTHVNNDGCPLSLHARGPDGAFPFGRFTTLATVGPPSRRVVGLGGVESPLLVRAMRGLGGIPHDYPYPFTLPHLNDSGVGPPFPLGLGAPTGTTGDRTRRRPEREERAINRVDASPSFVRITTFRRADTPFRGKGREHNVACYRRGTKSDPHGATRPGTPDTRHVNVTHPEPQLCQVAGANRQDQCGPTAQRLTPREYHAPPYSFLWHQ

SEQ ID NO: 977718 - protein, 406 aa, Homo sapiens
SGLVRGHPLMTQMRPWTFSSTDLHGNNLFLCVHVHELLATRWGWSTPCNPNAHHSAAVLPVEWTFDTFNAALQDDTPVCIHAALLVTPGRSCHMPTHAISHTSDATLLDRPAMTTGLPRAIPKTRHHPGWECPEHGPQAARAQPPTDQSTHETQTRQRPRPKNRTPKRLIGDTSRATPAAPQAGAPMNNHERHTRYRFVLNVTPPSEPQAALHKELNQSVHLVTKPKHPKEPINNELILGDIATMSHRCIPPSTLAWTRCACRTNNHLVKYKMYSLPTKHQSLTTRINWTSYSRKHDEILLHPSVHHLYHTAERHREPATREQATRKRHETTPNEANHMTDAHTDPRHTRRHAPTHRHRARTNKRTNPRGRHPDTQGPTAGLRRTRTARRNADKHAPPPHRSPHRK

SEQ ID NO: 977719 - protein, 208 aa, Homo sapiens
MRGSNYDWYLLPQGWLRRRRGQGLCRSQLSEMPKCFRGSAGHVYSGATGGPLLVLPPSALGLGRLATRLDVRSTTVCGTDSAARSCLRSSGTFPARNPFGHAACGGVVMGLSQNTQRDTPAGQQRTHTKEHGEGGPGKEAAQGQVAPCIESYRRNFAGKSASDSESRARKKKKRRGAVQKIGAVGNTMVGKKQKKTTNGRGKEEEKQQ

SEQ ID NO: 977720 - protein, 124 aa, Homo sapiens
RRDSLRVIVRWILEFDHDESVLSRVLLVNGRICQYDRGPGCCRGRRVGWHGALYNNSVKTLMERTEWKYGGPRCSSVWSITYISVVTHTYESYSVRGTSVKRDSPERCAERMHDMSVLAHHRTR

SEQ ID NO: 977721 - protein, 199 aa, Homo sapiens
MTARVWCGQRRRPPERRRVNKRQDTRAQVLTTAFGWRKKQCRRGNHLGERNRKRVGGAHCVAQTNRQTMKAPEGKNINVEGYGGVTTKKEIGQRDRKLAAQAYMAHNSTDGCSKSAKENNATAQTTEPKGRLHDDHNKQTKKTPNEQQTHHHEQNPAKTTTPHTSRKHTEQPEQRKTSKNAPNMNNRNKNNTDAKRTTK

SEQ ID NO: 977722 - protein, 67 aa, Homo sapiens
GEVAWQADRGLRGEGWDGTSLGDPVLRNVLLASQVAGLDRVPEVCALGLSSGIYPPVGWEWEVPRGK

SEQ ID NO: 977723 - protein, 276 aa, Homo sapiens
MLVMAPRTVLLLLSAVLALSRVPWAGSHSMRYFDTAMSRPGGGSPVSSQWAYSGRPRRFVRVRQARPRVRERSRGRGIRRRRGRSMGPEDHRIFKTNTPDLTERACVNLRRYLETLMMQKGRGSQKSPLPRMHLYGAGERLRARDLGAPSPSWRGIEPKVRAVNGRAHAHLHSAPWKPRDPLALPLDTGGGKTGGGSGFNPKAGQRWRRAGPGCGPEFKGQIRPEPWGGGHPFRFATGGVPDGNYLGRHRDTRLRLGNAAGPLAKEEHVVAQATPI

SEQ ID NO: 977724 - protein, 70 aa, Homo sapiens
MARARLLRRIEDRELRRVYQHTLFEGGETRVVAVSETTIGVIQQPPSNSRWGGGHKSCGATTYSSYSSDL

SEQ ID NO: 977725 - protein, 564 aa, Homo sapiens
ASPFSGALQLTDLDDFIGPSQECIKPVKVEEKGGKWRGQGIRIEDDEELASKLTNDGGTRRLEKAKVSLNDCLACSGCITSAETVLITQTEPEELKKVLDANKMADTHVTHEAGRMFRSRAQSRASLAAPVSAESYRYCLEYEPHSLPEIGVHIRLRTPDVSSMGTSVLLVRATRELVQEIPRDRPTADKALPLVGSDCPGWICYGEKTPGSSSFPNQTAGRAQVMGSWPGIVAHRIIEPGQVYTTGRRYRKGGTNRVQTDTTEWQGPQEQEGREHKNPRRCYGPKGERSRMYSGAARISKQTTKKQYADKTKKTKTTTHKNERQNKTTKKIIRRETKKRQQANKRHGSTERGGERGEIGGAKKLDRRAEEKERKSNEEKRRGSGSKARRRDERRSRRGKEDEEEEGKEEDRNKKTQAGKERAEKRKAEGERRRRDARQEEGEEADGETKKTSEGRTNKRREKNRDNRDDKDENEKKRKENDEKQRTKRDEREKKQKRNRTREERDKRESTGNERQNEETNTARQQRDKTTQKPARKTPQRQAQQIDTSATTSSEREKHEDTQR

SEQ ID NO: 977726 - protein, 353 aa, Homo sapiens
MMGPLTHLLLLLEEGKLVPKWPSAGSCGALPNVGLPLAHRAHSGMALHGVQWLFGWTPEELSDAAMDPALLPSSPQISEPGPPCSLVDNMVTGSDVTLWLHRAHRDAGVLGETPHCTLGMPRSLPEPDQLQRHGDLDEFRAFPNMHPFTDNFLSLFMAELFAPPRWLRRAVGPTLDPGDLLSITDCLSGLPQRLHGPPSLLCATASPPVVYGLMTGEHATRVPAGGMKTLHDSRVSVSITIDPKEAHSVVSPFTNGRKVHAARDMDQTPRGYRDTQNSEGQRTRTGKHAPKTRYEVRRRHKNTCDDRETPRRQQWKLSTTVQRTPRAAPTPKTTKAAALTAQAPASPGYPPLS

SEQ ID NO: 977727 - protein, 302 aa, Homo sapiens
MTRTSTNPRRPGATGNSQEDKQHARQQAQSSTRTTTRDTRKAQTTLHTKTREAAHREPRRKHAPDEDNTSTQSHEKKERTNAQPEHTLWDPQTQTTHNRQTHQQSRAKTTTKHDNTAQTTEQSTQKGARKEAKRRKGTKEREKSQSSDKAEGAGAGENNKKDGGDGGHEEEETEKRKAAEAGTNGDERGRERQEGTGDRGKEEEGEKAEEDTKRRRKQKEQTMQETGQGEKRKEGGRQARQKKKRERRQNERERGRAKEQQKADDEKKEDRTRRSERKENAAKDRDQEEKTANPRRRGDAEE

SEQ ID NO: 977728 - protein, 359 aa, Homo sapiens
QETPMGDLHDDFTCAEPTSKNVQFVFDAVTTVIIKNRPVRTCGSSSEWAWREDLSGYSGRNRSSIFVSLRQHSLMGTMGEQERSRLTSAGSARPSSSPSVLSLFSSSPVSPQLQNVKGKGLTRGLTCLKACPCHEMLVIVAMCTPPSGHLYLVFNPIVLFCDDGEGGTVLSLTKDAVWRGPLLLQPGPQLMPKTRPMTQTKVHMLHGRLLPKSPNPIRHRRNPKGTNSTKKRETPPALEHPKTNWVHPGNFTTNEGQRRTTMDSTRSRAPSTGNRHTPQTKERRPRAEARHKKLTVDDYLRNAKRAADPEHKHTGPDDRLAHTARKKQRDKEQPVTRAEIARGIAARKKAKNHSAENKN

SEQ ID NO: 977729 - protein, 282 aa, Homo sapiens
MTQTQQQKKKDAEATRAEKEREQRAGTRETTEGEQRERRREGGEKGERSNAKREKERREEKKDETETRKETNKKNEHRREADRKEQTRASSREGEKEKEQKKEKKREKDRKAPRQQKKNEKTRTSKKQQRTKDEKTQEKRKESKNTREKKDKNDKKDTYVKIREESEKNRTKTNTDTTRKANTKHNKQREAERQRSERKRRARNTDREETKRQEKKQQRPQKAAQVRKNKEREQQPAEKRARNNRQNNDRKRQSKRQQEQKDTTGTTKTTTRRKERRKKQKK

SEQ ID NO: 977730 - protein, 359 aa, Homo sapiens
MPTTQVYPVWLWKRLQLREWHLYPCLPAHYLRSLDGLMLAAHSRCLIVPPLARHLHRLPPPAPRRCAAVCARRAPSPSSFPPALPSGPSAAAAAPPHSLPPPYSRPPPHHSSPPHRLPTRRCAAPACLAPPTSPPPPPPAPPPLPCRLSPAGPLATLPPVSRALPAFATSPLPHHPRPRAPSSPPRALALHPPASRPRLSRPGPPPCPARPSTLIPNPPPPPPPPPPPPHRMHNRPDPTPAGPLPYSPSEPLPSPPQPIVCSSNKRTNQHRSPTTSSQARPPPPPSHPSPPPPPPPPPPFSLISSPPPPHPPPLSPPTHSHPTPPPPLPPPPPPPQPPPYSPPPPTPSTPSPTTHILPT

SEQ ID NO: 977731 - protein, 105 aa, Homo sapiens
MSNPKTAPIKHQGAAAAGSEGTPTQEGTPQVNGTTTPLAVRPGAHQTRKAEQSAAPAPGIQTHGAGKRHVWYSGRCPRAARRGNPRNRGSNTGAPGAPPPRPTTA

SEQ ID NO: 977732 - protein, 475 aa, Homo sapiens
LCQLLWSSHLVTSGGGRKSLEREEQLSLRKSRSMPAPVPHGKHAMLPASSIMLYPHALMEPCYDGPSDQTVTTWHQLVTHALFPMILVKPTVKNNCPTDGQLTNYTLFKQQILPTIQLSDSALCAMASGERRTYNGPWRVGRPGLLQRDLQSMLTVDTNMVLRRSCSLAGACTWGNLLCHSPAPTHAWSHTSTNSLTTLHASCTHMTAYQRRNTTPPARPPNHYLPPHKNAARTQPILPPTRPHTHPPPRPQTPAPYTTNAPTHPHHNTHDPVTPNDQSPGALAPRPTQLTLRSPQSHRHPPLTPTTERRNHIRQLSKSHPSHAPPQPPTHAHNTSPRPPTPRQPTPPAAPPRGQAAEWQHEELGAGTPSATEGPPPDASPRPSTNSRDHQQTPTPATHNAPHSNAPTHNHRNKTHARFQPRHSQIRIPQQHHTTPKRTHTPQLTTHTTSPIPTPTTTLHNNPHHIHDIPTIHHT

SEQ ID NO: 977733 - protein, 223 aa, Homo sapiens
QVGSEVQSGKCESSVLGYSDTCLPDMGRLEGQRVVESVAFCVHGWEIGHCHWQGNWRLRRPPGRFSIRPPDSWDARSGADVVSCSSDPYCLQIKRYDHLEARAEKSSREKRHRGESRARCVLPRKDSSYVGGECHAERQISYGPQRVNVFRRTAGSNTMCGVHEKLHLVSPQSADPGVSSREKDSLPAVEETHTVIHDANGLKVDGFLAWIHHSRFKKANGAN

SEQ ID NO: 977734 - protein, 72 aa, Homo sapiens
AWIEYCCLIGDTKSTERELASRRQHYKLPVHLISELGAYTASSVVPGSGRPCHSSKARSQPCAISYNPCKCA

SEQ ID NO: 977735 - protein, 119 aa, Homo sapiens
MRFSSLDSDARCRVLDAGAEKDMNAPWEKETCGYPGERSCLSNQPGKTIRLGLHTHVKPDEVPRMEAGFWMDRLLMFVSVYHECFLYEKIIFVRLFLVPLLNVAALMGRMACYGISEKT

SEQ ID NO: 977736 - protein, 130 aa, Homo sapiens
MGKVKVVSQRDWSYWAPGHQGCILALGKVRYCEPSMTPFIEPQLHGYTCANMIPAHGRIPWHQSKAENGKLVINGNPITIFQERDPIQNQVGQMLALSTSEGDPMDVNNTHGRRLGDHKTEGEAKRDIII

SEQ ID NO: 977737 - protein, 236 aa, Homo sapiens
MIPPSGRHSMCTVKAENGKLSHTMEIPSPIFQERDPSRNQDGAMLALEIVVESTGVFTTIGEGWVLIAGGSHKGSSSLTPSADAPMYVMGVNHEKYDKSLKIISKDSCTHQSAIATQDKGQTTDNISVIEERNSMNNRPCTTHATQKKEGIEQQTRKQERAEETEERNTKNNKTTDTTRNMTKEREEKDKHRTGKREQQTKRTNRQYTKNPNNKPKQLRHTEKNTTTRGKTQQKRP

SEQ ID NO: 977738 - protein, 362 aa, Homo sapiens
SWTAPFPALGWTIVVQELPVQVQEREVIKLCRPELDSAGSSTVDFEISTISSLSVRQLVCVVCLPASGEEGHQFIADKLSILSKCCHAMVALIYPFAKAATPTSRMLPSAMVDIVCSPTPFLIGLLLQLLALVRELTLEEVLVVDLVQQTVPQTDGRLRTPYLPRKASGGPGTHSGTEEPSWLVEQDAGPLDGKATGQSPGPLNEEESEAKERNYTRSMGDTYVIEQQWGEREGETLEEERPPAKLAPQRAIGNYRRVTRKLKRYRGDTKKGDCPRRRQRQEKGNAQHPEKTQRGHQRETKAERGTPKRKSPEKQPTQEESHRTSEKAGAPKRHTETTPSIKLTRQRDAAYHREAEKRRTNA

SEQ ID NO: 977739 - protein, 82 aa, Homo sapiens
AELVAFNRAACVCGELLERVGTGSSLILTGVEVDAAMRLTKVGNRMTFFYKLAMNCHRSFEHAESSAGHQPFPTAKGIMRSQ

SEQ ID NO: 977740 - protein, 505 aa, Homo sapiens
MQRASVKLQMCESLMGPSTPVPIMEDGGGGSSTSRRPSRGPIGRVLEIKKHKTRDTDRRGFTERGQVRHWAGRRAHMQIDEEKRRSDERTRRDGARARRPQERQMDTTAQPHDRTRSTQQDPHHHTNRKQSHPREGQIKQQPKARPRQQGTDTQPAPRGEHSTREHLKTTHRPRTTKHKGPTQRESPKKTTTTTRRHRSSTQHPPTSNDRRHERRQTQQNTHLAPNPPGDEDTRQHKRHRARDGNDANPNADRNPNKQHQHTKDMHTHNKREKKNNKKKQNKRKEPHKGEGDHIPTGQYTDDEHKRRQPQEAGKHTDANNEREQTEHDNKTNHKERKSSRPRQQGTQQRAKKQKTSKQKQEQRQKQKNTTAARKNERRKKQENTEQTEGATKERTGETQSTQRSHKKQKTQRKKGGTAKQKKTRDPAQREDNHSAAEPDKTRESRTASTPTRAGHAHRQRRRKRQHTEATEHAQTKRTESAHSATRGSGEAHARTQHAKHRRRTG

SEQ ID NO: 977741 - protein, 185 aa, Homo sapiens
MNDTTWNEETSTRKRGPRHTIEAANDKQVAPPQRQTRQCNTTNTEKKQDHDNDATTSREKTNKTLEKQDTAHRQRTKGQNKKTKDNKGGGRNTPEAPPHHPATQPRKKKRGEEPRQPQRPPRRHQHVDRHETSVRHTNEPHENGEEQRQHDHRPDEKNRQLETTATTHADQKKLKRRETGSKERY

SEQ ID NO: 977742 - protein, 330 aa, Homo sapiens
NRTVPFCGTFAAFFTRAFDQIRMAAISESNINLCGLPLRRVSIGEDGPSQMALEDLAMYGQSPHQFVFYPSDGVLTEKAVELADNTKGICFYRNSRPENAIIYNNNEDFQVGQAKVVLNETRNDQVTVIGAGVTQHEDIRPLTELLKKDKITSECWNPEPPYKPWTENSSLDSARANKGRNLNGRTIIYEGGMGGWFQMQEEGETWHHVNQQGSHRENKTVGAERARKLVSTGHAPARAVEGPSPKGPRAGMNRGRQTNITEIRARGTRHQPREHYNGHQTTQKRVQTPSRPKAKTRRIKNTRNNTATRHRITKETRREPETAKRKDETK

SEQ ID NO: 977743 - protein, 269 aa, Homo sapiens
METSNKSHDEPEQIGNQDEMKTNDRNTTDQKTSTNMRNQRSNRMSNDNPTSTNRMQEKSNTGKNRKTPGKEKTMHEQDNTKEKNKNKHQWRTTEHKEKNHTTKRNQHNTDSEKTKLKNQKEQEHTHKLATKENETQDKKEPVTQTNASPTNENKDKQETMPTRTRTRKNPKKHKRRTNPNKRTQKRHNRTETDQHQKKKKRKTHNTKTEEKKKRRPDEHEGTDTERKKEHGRDSKQERQKNRQKKKNNQTKHKQTRMNKRQRKQKKDKT

SEQ ID NO: 977744 - protein, 126 aa, Homo sapiens
SRGCRRICVSENSGLLQSPCGQGPGQARATLWTHAYRVSGQHAFCIIAHTCARTYLSALTKVARLGVAPVVHEMPLSGHNAVTRRVSLTYRIIIDTDASWHGNSIGYVGSSVRSSHNSWWNGRDCA

SEQ ID NO: 977745 - protein, 362 aa, Homo sapiens
AGPLQPRVSIIDELFQDRLRSPGSPRIPTTTCPSALPHRRPHFFFPRVTDICRASLSAPSRPYEPLNFHAMYQPFLEMIHRGSAGHGHTNFHSPDIPDNHEQQNTYEKATMTGLCAGRSATSTTGCLRMKDKCDKCQGDLVLEELYHQQTTSQAKLLRELDELPPGTLRGETRKYKELLKVTYQWTDCYTQHIQSLTWKQQTRRTTTTGMTRESKTSRKEKDQYTTLRGNQGEPKQLNSERTYPEITEEGQKNLQNGNPHTGPDNRKRIQKNAKSRETGRKKQENNHKNTETKEKETEPRETKYTPERGGTRGSSTRQDRARQGKERERHPAEKRQAQKQGRKDKRENGTPAQNGREEKEKT

SEQ ID NO: 977746 - protein, 165 aa, Homo sapiens
PDLKNRSVSGSSIIDIELPGSEQGDLPELKEFVDLFYQLAVTMRGAGEGPGRAVVLADSVFLEHIITIFESRTLDFRGFVRCYRAIRVVGTCEDKGIPGLPHWVWQPSRDGPTSNFQSLARGERQDQQLDLIPLCLFASGVVDNVNLTVLMPRPCTLLLYCCVIS

SEQ ID NO: 977747 - protein, 117 aa, Homo sapiens
MGVREILLSTEVEWKKIFSLVAASFLLPQQKKTHTPRRGKADTLCGYVGKKVEPLSLRLNFCCVSRGRENHRETMGNGPPRDIILSLFLYIGPTTEYSYNFFSKALCGGKIVGECGL

SEQ ID NO: 977748 - protein, 376 aa, Homo sapiens
GPRRQRRSRAPTTHTQPRPSYRLFVRDAISAPPPSAQTQSHTRPSRPMVHQGPLVRRSCLIARSVSAVPGHRRDRRDASKPEQRTNDVRSDPVTIRAVGEQQLSHRAPCRRASYSRRVRRCRRCTAIAASVVARCEPLRGGQGMCRGRFARFPAQDLWSETFLLLRGPGSGPIPRANADVVHRDNKHAAIGKTDRKWVEDALAPRRASKWDPGVYPETETATNRHAKRSADLLPHWDRPTAQAKFKAIPIGVRAPGKHSGHRDRMSERAAPKRAKKCKRGSIGGGRNTFRKREKEARRTEPGQGRNGVGAAAQRNREGMQKRQRPIEPHKMRENRTREAPKELVTRKGRSRRTAEARNRRPPIGAPPKGKPTISNS

SEQ ID NO: 977749 - protein, 108 aa, Homo sapiens
MVSASDSLLENDRQQTHMLDVMQDQFSRASKHHRRALPGPGSSPGSPRITYQYLTLHELQHRRSTILLSQDSESSAGCMPYLIGTSHLNLQACCEHLSLEMIHDGYRK

SEQ ID NO: 977750 - protein, 120 aa, Homo sapiens
NHLLWEMSCVRCAPTSRNLVLVCPPARQAPYDAWLAARLRILLVGVFWPYSLTPHVFSPVDVHLTCNSDFAVVVAAVRTFDVHGASVISRIYGVHASFQMLGTTHGGPTLSSLPYTSDNL

SEQ ID NO: 977751 - protein, 117 aa, Homo sapiens
MGYAGAILGEGPLLSCGWWPIFGHNIHLQKDIKRLQGSNHNISHGGIKWWITTSRVLMCRGRGLGRKFVGYRGEYCAFCRGTNFFYSLGGAFGVKITGENKYSKSIHEPSVSKYMIE

SEQ ID NO: 977752 - protein, 351 aa, Homo sapiens
MVQVNIVYQSKTYIKEESTICNRNSCSTLPMLQIFQETHRTRSGHRQVSLYVLTIPSTSYIVFTNKVLQALYHSFTGKSRCCVDIPCLNTASALTYIIKKLAMSIFIQTSYPNQTGISCITTRIYGNTTINNKKTINKINNRQGRRENEHTRQATKLPRERERTSRETMTRRLTHPRPIPQETKTHKSEEHHRKKKRERARAYKKRRHHKKNQTRSRPTTTAKRTQKTVTRNKQRRENNKTKARRHKNDTRTKQTIIHMSGKKATRSTRPPQTQQTTRSARSSATQHTHKPARGTDTHKTAVSSDSTSTSINHNKKSRQRTQAKATTTQIKRKQNTFQHNKEGSYIQSRRT

SEQ ID NO: 977753 - protein, 106 aa, Homo sapiens
MIHMSYYSLYKTMETCEDGNESMSIFYQEFCRTSVCEWTRPMHSHNNKHDHRSMRDISHEQKAYDVNLMRQKDRCMEDSNNVQTNTYTTVSDGLPHYNQMSPIDSQ

SEQ ID NO: 977754 - protein, 121 aa, Homo sapiens
MSTLGNFQECGQLAAIWKFGTTVSTVHPSGKANATGGTMPKIGALHFSADAFLVATFREGHFFTSEFWPVFQANEGTFNTVDTGQNRSFTSKRRNSASTGFSPVDNHDTMGLLLGRPFVSP

SEQ ID NO: 977755 - protein, 304 aa, Homo sapiens
PLPSDSSIRLFHASSRLSAAATPDLIPTPVAKRYFLYYFLFSRHYMTSWQGDPVAGPAWNFIPVTVPHTSICMSTIQNLQSFRPHMHDCNVRDDRHNIPRRELQDYNSVYRITANWNGQQHDHCNFTYVSKGHLATIAIIAPNNNETSVAISFIPKQKHNFGRAHMRNLAGHNDTTPMHTYRGTQCSNNTAHITPAGTHTRTHTHPFLDPTHSVICEQRIRAHPVHTREDRRTTTRQYNSRLNPIDTLTHTAPMQPPPPRPHPVGDSNPCPSLPPQHDHGSPTLNSTPPASCAMDHSDRDNTGP

SEQ ID NO: 977756 - protein, 196 aa, Homo sapiens
MRRHASERERNKTRRKNKTIKEASKNAKKHKINKKAETSDNALRNKQKRTQHRHIHYHYSPTRDEARTKRIDKRTQNQTKHTKNQTEPDIQKNERKTKNTDTDTETEQPEPNNQHSQSKQKMKEEKERNRERKQQKTRNQGHKQDKKREKEEPRRKNRKRIRRHRNGKEAPEESTYKRQERHNNTNDKQQTTQKNT

SEQ ID NO: 977757 - protein, 411 aa, Homo sapiens
MPEGTTPVGKEIIDRVLDRMRKLADLVTPGLQVLLVFIQQLLVWCALCSVFTSLLMERLSGEIMARSPMLDVHPFTQHPRFPRAVVEPVEHPSSRNHTHPWSHLHQCHSMVSTKAGPSHAPSSLSANLRIISSGLNHTTTAYNLAFLQGNDLVYLPIHLTIHCDYLTATALDTLTDTCTSTFQDRKAMGGHINRHANPTIPTGPNILPHCTIFCLQKGLNHETSFPGSRQDSPNGHAPLEPTPNTTDFGANRYTHRTPETHTAWTSRTIEGTQNAKNNGTPAKQVNPSNKAHTTHTARATTTSSRGTVVPPRSPQKHDTTPTHPPTPGSHGGHKNPTRIHTTAERHSRTPNNRPKPHAAATRKRRAKRRETTAEQPTKTEASRRSGRRTELPLHARPAKANNREHPHQTQQ

SEQ ID NO: 977758 - protein, 84 aa, Homo sapiens
PTRRPRVLTTLYAQLLSDRGICQPEQQVSVKTTPKRQNEESEKTHINIVCHWTLYDSGKSSHYWTSLIYNLLVAFDNKTPMTNV

SEQ ID NO: 977759 - protein, 104 aa, Homo sapiens
MGGAEFILRQRRAGRAAVYINNSCGGARGNSAAQHAGELLSGGRQKDNLSYYCAGGGRGTTYCVRDTTLYPISEEILYKRRLGGGEIYYKSFRRGGIYRGGVTQ

SEQ ID NO: 977760 - protein, 88 aa, Homo sapiens
GGSRALAPSTMKIKIIGPPERKYSVWLRRLLLLDRRVLHLPVSMWISEQEYDESGPSIVHRKCFQADYDLVALHPFLDETPNLRRITR

SEQ ID NO: 977761 - protein, 440 aa, Homo sapiens
TYSKTLLHYVRMQAHASASPRHSALSQHNPSTLERWVDCLNPGVRDHPGQYGKTPVFTKNKLGVVEHACGPSILGEAEDGEDCLNPGGRGCKWAMITDPCTSSLGNRERQIPGPMPPSHGPVIKTKWGWSVVSSQSDNHSQGMKEHYERQEILRHSTGLYHGCTTPQILYYKHTTPWPSHWLTTAPDEDRRTTIASRPDGRREHHHNKPERRMSKEARGQRKNPPPQLEPPKTMERADKQNNWHTTATKHKYTNTQQTKHNTHDTQHKQHPPTNGATNPYKQTHHAKSRKKRDHNIRHRTTTRPPPSNKNKTDKKQENTHKDDEQETTELKRIEQEKTGHTPTQQEDMTEQGHNSTHSGARATRQPHSRGDNTGSAESSARSQDPVTRQRRQEQRQTRRQQHTTRRDRRRTEHKTAENDHTQQQTKRTRARRERTEDRAT

SEQ ID NO: 977762 - protein, 72 aa, Homo sapiens
QLHEGPAEMMPDGGRAELLYLTLLPEADSLRVQCLCECAWSCAACAEHPGPWYAPIDVTMQLLLICAPDNPG

SEQ ID NO: 977763 - protein, 424 aa, Homo sapiens
MVGDERRRADEMEKEKKSSTHAPPHHRERKSHIISHTNISPSQHHYAVSYCSRPRAEQSNRLKRRPDENQHEEERRDAQTTRRTQPAPQERTHPHRPNDHTHRKDAYRETHHAHPYRPYNKTYPPLPSRSEQHSETILKYAAHQKPATQTIRTTRPPNGVHTEQHSSARTTSPPTAAHERVHSSAYERAEHDAARTTRGPTHGERRRRARDRSRTNRASPYRREPASGARDLQQQEREARRGQASAESPAATPPRPYRGSSRARHSSRHAAHSHTREDTQTARRDQRKADESKHAVRGVEPVSDIAVAKTMAHHDGGSRNGRASMRQRIGGAQTYREKRYRNARPLSLASGHRGESLDREQSDRSTGRRCHQETSMLRGRGAQSDSATHMSSRQTKFDIAERSASERSPISISQTRTPSESARR

SEQ ID NO: 977764 - protein, 379 aa, Homo sapiens
SHHGVSISRESAPSSLIRKLPNTKVIQALLSTMFTGSLLLPSYKASEYLRVSLSAFSDGLCYGSTFACKPQAVHGTSRQLSGHQTYPYTYSGVSVPPKRKYCHMLAVQDDRRLGCAKPAALDTWALVVDCGVDLLSVVSPVYLSDGLLRVNIIINKRITKVRKITKRSGGAGDAIGNIALTVGGPPRSGPPRRNPTYLCFAGRNEGDARTNKRERTQIDNKAEEEKGGAGGLTNSTMAKTNVVKKNAWRPRRDHPWGENEDPWNEPKDGENARLLSRRHSDSHRKEILINVPDKGVEEKQHKKAANQKVGLTRHTLIEINSRGTYEQGTTRTSENREQKTKGYYQRRATLYRKQRITNKTTRQKDQTHTHGKTWKQQQE

SEQ ID NO: 977765 - protein, 324 aa, Homo sapiens
RVATRSNHMAERESLCVTLRMKLCYRRPGLRARDGHRHASSSSLEKSYELSDVQVHSPYGNERFLSALRPLYPAFSFLVHGVLWHPRHYPSTSIMKCDVDIRKDLELPTHVLSMAGDHPCNHGHCRQDAEGDQLSLEPSTMKHQDRYAQSLSARYSVCESAAPSWRSLSTIQPDVESSKQEYDRVLAPPISPAKMRSKRTYDMRRVHPLLTKHENEDKRDEIGMEYSETVTVRGQSDTANCAANRETNWTQSKRTEAHGRENHRRADEPRARVTLRVTTQKRKHERRKERNPHSRSTQDHGTREQQETTKHRTEAKDADTATRT

SEQ ID NO: 977766 - protein, 189 aa, Homo sapiens
MWRRRGPEQRAGRGPRWGCTAAGWELAPSPRRNLQRPSIRSEGRSWTEDQTSPDVKAVGHDQEQTWRNWPANTSRRSGRILSSVCSSRTCVQPLAWIRWPLDKGIRSEHAGAWGTSITKLGVTLSKDVPGQLKASDMDGLILCEEPTINQVFAREGASSTIDVSQDDLIRRHQTKTKGNLSHGFGIIPV

SEQ ID NO: 977767 - protein, 428 aa, Homo sapiens
MQGIYANSTPHIQRRRKERSRAKGPEYTCIEHEREEQQGTQKDDRRTGERKDRANTCNTRQIHECNLPGMDDTDTRTTTTEHMENVIRQQQTGHTEQRHNGDMTIETSTPEEYAQPWADTHIWARYHVTTRGDKHTRGHGYNHHEETEETTLTKHPRDNYQTTDTHIRKKRHQQGHRRNTGEHKQGIDKPNWSHNETPNRGQRSRRIKRTERQTHETHERDQSEKEKPQRTECAEADNHRSKRNTHNKKAEITTDKTHDNTEANKVHQTTTGEIEPTHPRNRTQGSNNTRAQHENMRHNETAKEATTHKREENQHRNTKKRMQYTRNRDKEHTHTVKQREKGTAAHIIRDIGATRNEQQGRPRLYTTRLSTTTVVRKRTQHRKQCRRNKTPQRTNPGEVRHTENKEHKRTTKEEETNERTTNTSGVAT

SEQ ID NO: 977768 - protein, 105 aa, Homo sapiens
MQPNQVKDPTGGHGHVTNHNKTTLDNNGNQDYVIRDIGHHTINEKLQQTLNIKKKKNHGTKAIPDGEQRNTQLRIRKLHTDHAFKTASNTTSRDEHPCDRNITSQ

SEQ ID NO: 977769 - protein, 402 aa, Homo sapiens
DHASGLTTSEHRHIYTVRDRGGAIFWHALNPSYVFRSLGPWLPGQCPFSHPRADPRVFPLSRLQHRSQMGTWYIAVPWVQGLLTPRSHIRCDLERKRTGRDRQKLPTQPDASGDLYSNEQPADPAGHTVPETGKSVTCTGEAHTRIPDQDVTVALTSTLNYQLNPSPYKSRLNTISLMLSTTRTVTAHEPALRGPASLGYRQRKLQVTQLTRHWEMPQEVTLTPGTTPTSGEETTGTRETTLHRCNLRRGWLQGARQRTMPAAEPKHMGHKGTTQTLARDDIDQKQRPRKRTHTSNTGKNTYGTEESPSQTADTKKNMATTDVKSDTDKKDDKRPGKMRTKIENNRGTPKQPMESENPETQQQKKRTTKEAKQTQHAQHDRNHHKQTNRTTHKDRRTQASKT

SEQ ID NO: 977770 - protein, 52 aa, Homo sapiens
MRRAPFLGLTGARLTSEHVDQRHVRCYETLGVDNELPATGKGTHDGGEEGAP

SEQ ID NO: 977771 - protein, 176 aa, Homo sapiens
SSRRSVHRNEGAENSGTEREWDGSLPKSSDELRDTSALMIRQTIPHPRGLLSVSSSAKADERKKSRLTYESGEDEEDEEEEEEEAEDYQAIRRQGKRNMETEHLDYVCQGPRHGTTHETGPDLDVLAVMRESGDYTQYDNHRCPGMARTRETSEEKQLEIPTTKRDERLEHIRNMS

SEQ ID NO: 977772 - protein, 303 aa, Homo sapiens
ALGVGAEPDREQQASVTSRSWGHSGPADHLTSCPYGQRPLMRMRTCSWPWHYSHVRAGGSWEETPRDVFLRWMPWFQNAATESKAETRRHIHTHMTLREGDTIQYSYHTITPSDMQCRTTGGPGSGGAEKAQQSETGRAKKDYKAHVGTTPTYHYEEKIKERTRHTLEREPNKKTHNELDAVVTTGTSKLNRWKLRKYSPDTQDSAERRRGRNNEDDTRHAMRDHKQIGETTHNGQAHERHQGATGAIGSQHTRPAESRKMSTRQHPRERHANIGQEDPQPTGIQATTRHKRASQDTQINNQH

SEQ ID NO: 977773 - protein, 210 aa, Homo sapiens
MEEKSCDLGPQVVRELGLRRGGTEEARGELAPGAYPAVQKTSSRPSRTPGSELGDPEDPGEEAADGSDTVVLQSSFPCTPEPVNPEPDASVSVSIQGSSLKALHRLVDQPDRGGNEVSASCRANPRLPVQSTSSRAQGELDQLKEHVAGKDDNLGNKPDERGFRLASHLGPPGYGRRLRTVALPSWSGVPNAHILAEKSERAPWAVGQHE

SEQ ID NO: 977774 - protein, 172 aa, Homo sapiens
EKVEEKASRKERKKERGGGERRHGAEEEEEDEVAMDGEEEDEWGMRWKMRKRKKEDDEWARRLKRAWQKRRMKRIAESGKRDDENGVIGGLRLHGNEAWGLRRRFFVSGRRVGGEWASPEFHALVVSILDVLLASWCLSVDPGAMDPVVSVAPSSRFYMSGIVAETTSRPHP

SEQ ID NO: 977775 - protein, 149 aa, Homo sapiens
MCRHPTREGGARPPQRHELLGPEDKQGRSPTLKKSSHLQQQQQTYGNHRQQQRWVCHTIGKNPSRREQTKINQRDDTARAAAVTDTTGRGKEQPRTATKPVPAIGRYVGRSVSTAGRRSTKKPALRQHKDKEANKRGRTDTDSKGTHRR

SEQ ID NO: 977776 - protein, 140 aa, Homo sapiens
PTRRELLRQSTTFFESDSRVPRLPRVDTCAAAGTGASSFASRKDRSSSRIQVFRVPAPQVSRADADREQGTGMAKAAAYRASEPCGTDLRPVVGVSNTEGGDHRQSTRKRTSPSYVAFSDTERAHRMRPKKPQVAPEPAE

SEQ ID NO: 977777 - protein, 125 aa, Homo sapiens
GGHRVTLVIISTMAWGLLLLNSSINSRAQGARGPMSASDSGRASVVVRSSVCTMFVCQRECVLINVCGKLMLCCTVDVAIEYSVLVLHEYPSKASARGEMSPRETLLSYSEGSVTSVALSEGDLR

SEQ ID NO: 977778 - protein, 128 aa, Homo sapiens
MVGVGETAPGERARETSLRASVRRAREKLWLRQLGILPRTAWGGRRRQIKDREKSILPLFLQKKRHTIQKYYYNNHKHKSVVVALWGGAAKQRERHTSFISLSREVGILYLTRLCLILLYRAGDAPSN

SEQ ID NO: 977779 - protein, 113 aa, Homo sapiens
MIIIGGPLGYGEERTGPGIKEYSVVVLATSVPSYSHFKRITVWCGMDTALLVKCGLEKSPFGLGVHQINFEKGRSRGKPGRCEDIWDADDVVWAKNILSLGGPGYIFTRSSLC

SEQ ID NO: 977780 - protein, 185 aa, Homo sapiens
MDELGIAELELQRFLYEEGVISLMTQEEHLLELGWFTMNKLLPNAVYKGSTGGPRAPAVWAIARSPHSSAKFGPRVGGSLVLRKHYEVNVVPLTHPGEHIQFFHTNDGLFLSWSNVWQMMKMVMKEDEVQKVVTTWNYQVVKTRECGFGTDDAVTVGPGKGVGHRVDSESWGHEESCCNRRKPVV

SEQ ID NO: 977781 - protein, 92 aa, Homo sapiens
QRVRPRVGSEGLPEAPHPEMGAIFPNPPLPIDGHVVGLAVLLEVVVIVELVVAAVMCRRKSSGGEGGSYSRGCVQRTVAQGSDVSLNSLKKP

SEQ ID NO: 977782 - protein, 253 aa, Homo sapiens
MTEAEQQQLIDDHFLFEQWPVSPLLLASGMAGLARRPWYLAQGQIRTSWVWVNDEDHLRVISMEKGGNMKVRLFTRFWTWPHPSIENIVFKSKDYEFMWNSSSGLHPQHAHPTWVTGRAGYGVSDIKLPIWAKHDKFSVSVLKAVADFGTRGTRRVWDTAAVWRGSSTSPMLAALGFSEVELVHDGGWTRREAASSRWNTGLDARARASTELMLARNEAGPQPETAVLGPNVIAWQVAACTLMVLALVSPYLV

SEQ ID NO: 977783 - protein, 158 aa, Homo sapiens
MVPGPGKVITHSLSRFTKPYGCAWAGQGGVWGVEESVAGRGSRGGCELGDGAPTRAQGAQTLEIRETGGVPRARNSGNPEGARGPRRLGGSVGQTPCNFCNSPSPRLFLWTPKLWPGHLSQAQAGDLAGCGRLGVLCIIASSDVTYVRDFLNICAFAY

SEQ ID NO: 977784 - protein, 106 aa, Homo sapiens
MYPPRARQGHTQQYRYDVRRPTARRSTRAGKQTQKRSGSSGRHPNQAERHTDNRRDRHSTATTKPHSLARGEQLPPPTNTTEDTIGPATTGTRDTAEHHAAMTGRQ

SEQ ID NO: 977785 - protein, 71 aa, Homo sapiens
RLDGWRWLDLTDSYALRMVHNSHSSTIFSRVRMSIIRLQTGALGNQLDLPASLSWPCSENETVSRRQARRD

SEQ ID NO: 977786 - protein, 308 aa, Homo sapiens
MSLMFTNATLLKCRYFFKARRQMLTHISIQQGYQQLGSEKEQQSSNHNLPEEEGKGVSLGSSGMTSTGFYGSPPGARKAAWAKSSLSGCNQQCKLYPTPKPMARKVNCHGASRAKGEHHSSYQGNEAELRRPKYVPKCGKTFNNTSKLRTHQRIHTGEQPSKCTECGKSYSLKLPRIRHERITGKTHYNDQVQESKRRQPDLTNTNRTHKDRGKQRTKGNRYSKRHASVAPGHLLRHKKRKYKKQKKPEERYTPQQYHLENGGRDRNKRREDQVKYDKNTKTNEKKKQKTPKAKRNHEQTDKENQTEE

SEQ ID NO: 977787 - protein, 351 aa, Homo sapiens
MGYPTGESRNIGAERNKIQTKGQQGTRDEYNKRTVDTVGQQHQAHTPREKHYQNHGETAEPTNGEQENKKHGLPQTPTPYKEELKKAPNKGETPKTKHTPAANNRGVSNPKRHDHTPGPGPAIEQHHLGPTRRDTRTPTEHKIIYPPGSTRDTKQTEHTHQHDQAKEQQKQQRRRKNGKTEKKREGDEDGKQQRREKTQQENNRRDREREKRTKGEERQDKRKTARRKRENTRENEQEANRRREKQNKRERNRSHSNREEQKKNETQNDKSTEREKRYEKQKKHKRAKKRHKQNEEKDTNEKTRQQEKKKPKKKKRGKQRRKRIKKQTRQSSNNKQQKDKKEHTRQNSDGE

SEQ ID NO: 977788 - protein, 465 aa, Homo sapiens
DAGTRGVRWTEACKDFRGIGRHVLERTLLLLCGGCWLTLGRSGTGSMGDPERLIRQDELQETVQSQGKVEFSVEVDGKVQECCQLGLRRDRRLVIGEKPHEERKTLHQSTVARSRGKHEERMPVILEDQGAISSNNTREESSQGVVLSENPCIGPSCAHSSVRRLGLVDQELCIEGCMSGHAVRATEMWAQGAGSGPAHAFAGSFPEHEELPPRSELRGLKSGGAGSTNVPHGVADTDRGGENANDRLEMCTAGTSLPGAASVQGHQEYGSIVPGTGIYSAGKPREGCRHYRKLTVALIQHVAPKREGPFRLLDCYPRSRGSVREALIGRVSTEEAPETSRAMFQHLSLRTRTSGGSTAGRMGQSRFQEDRGHPRSPGERNSYEKGGTNGTGGTGEPGQTQGETGDEEQVEVQRKSGRRSTHKPSGQGAQATRRKDAKEEQSSESTREEERQQTNEHRKHETAHA

SEQ ID NO: 977789 - protein, 107 aa, Homo sapiens
GCPGARARDYGVVEPSNQGPSQIYFSGELVQVLGPLEVLPFWSDPAPGLTAGSPGSPHDCPHTCYDSTVLRNAPERLVQECAAKKPYTPRIAPESPGYRTASRSTSH

SEQ ID NO: 977790 - protein, 106 aa, Homo sapiens
MMTRNSKRPPWDPLMTHITPISTPFIRLLEVPVLRIIGEGALYLSSHYSILALGSNKRMTWSISTDLTLAVEQEAPGKGRRHGRQHKRYRKAPEWEREEEKPPNCS

SEQ ID NO: 977791 - protein, 346 aa, Homo sapiens
PVLCKDPVQEGWAEDVDLRVNFGMNVGEARGFFNEWENVVTFVLSAGWLTHGHPCFTRHAVRVVPGAVHGTAMSTPSLRGHEALTATSCLSPSPSAGHKHADLDHVTSQQCVSRGDCDKGDGEGDHGELSNAMHTALRTRRGHRVMNGQQRSGHTRGRTTQDHAESSVYAAIRCVTRLWSIAITWISSATVAFVLRTGPRMPERSTMVPWTPRHPAISLAPELCGEPTSRQTLGALHGGSARDCHHALDSPVLISKVAFTPWEQQKTMTPEASPEKGSWGVAGTDGDGVGHMTKRTRKRAGAQRWYRPTHRPKGGKPPEGPLPPSYEGAPGVASRRHSRGIHPLQG

SEQ ID NO: 977792 - protein, 81 aa, Homo sapiens
MSTHKNNQPPLAKKRENQPKTTEKDPSPPERERHQPNKGPACTHKRSLGQTMLGRTTDEFTNTKMNYQSAAHHRGETNVIT

SEQ ID NO: 977793 - protein, 318 aa, Homo sapiens
MGRVRNSSDPMNVKRTYGQYHLTHVKITTNTKTTGQSITEHGNRQWKKNLDTQTSSTSELRVAPEEHPVLLTEAPLNPKANREKMTQIMLCDRSTPQPCTLLVQACAYRLIQPSGPYHWHRDWTPSDRRSPTLMPIYEGYALPHAILRLDLAGRDLTDYLMKILTERGYSFNSTDEREIVRDIKEKLCYSALDYEQEMATDASRSSLEKSYELPDRQVITLDMRRYQCPEGTLPALSFLGNGVLLRSRNYLNSIMKWDVDIRKEPYAKHKQHEKTTCTRDMADGSKGEKGRNQNMRTRHDTRRENTETERPRDTSTYK

SEQ ID NO: 977794 - protein, 124 aa, Homo sapiens
WASTVLVRRGPLSSVKARPGIGGGAAAISGFGGGGVWVRSRDLEAVCERVAPATELCSCVLCAARKYAVGSPEACCCRRTVRGRWLRGERGSTERVREEQALQSHACPPAGQIHHVITKVGGLW

SEQ ID NO: 977795 - protein, 88 aa, Homo sapiens
FSIIDLRSLHSGEWRERLLLLAQMFGVCLSSGMVARSSWHAHMESLGRGKCKCQWKGRLDGTSVDLALSLRGMIVLLDVVTCFKDYPS

SEQ ID NO: 977796 - protein, 227 aa, Homo sapiens
MPVNCWQRGAYTQVIFLARNKRDVNELVRVTSEGAGLQLLTVICPGSVATVPRAGPLSNGVSCLQASLYCPGPCEGPVPSVVSLSLGEHVFSGSWCYAGAECVVSPEEMAGSPVYSRACVAGIRCVLGLGVCMCHPGAGHFTFQRRGRRLFPAPGPGLLVPNVSEESFSRDRLGSVAWEGALCYNTRVCLSLCPLRGISPPLICSAGHGAAGWVNQLCRFPGAGPCF

SEQ ID NO: 977797 - protein, 198 aa, Homo sapiens
MHKTTKPQNTTKDNKQAKVNQQTANTRTTDDEAHQTKHQRRQTTTDKKHTNNKQTKRDKNQPHKHNREKRKKPETTKKQEKQNNNKQKRQHRQETNKTTKKETQKKENEKRRQHKDKKHQKTTTQKQTQKTPTTTTKQQKQPTANNTPKKEHKHKTTEKQPQNKNTHNKTNQNEQTKTKQKQSTKNNKQKKTTTQTNK

SEQ ID NO: 977798 - protein, 218 aa, Homo sapiens
RGWADGELRSSRRPRPMPKRMLPLRYVFPVLLKVRVSAQGVEPRRVRRGATRQEVSEKTKPLHVPRGARSRLDHVWDDVLCCRPPGQSPRKPGPTGAPEGVPVGRCCLEPQRPTDQEPVGRPPKLTHLGVRVRWSCSSSACDSWGMGHGGLRSRAGASPVAGSGVRTCLGLLAPVCCSLCWSRGIGLSMCDEQCLCTSVCHCSGDLEAGLMDRVSFHR

SEQ ID NO: 977799 - protein, 194 aa, Homo sapiens
MRAPKKHTTREEKARKTNIDKSKSPPGKLATQRQTQTPSTPKNRTRDNKDRPNTHATQETPHTRHRTAEKQHKKKNSKTQRVGTKKKEKPTHRHTKRTHHAGAQKKTKRNKKLQTTHNQRRRHDNEDTKKPTAERRRQREGGGARRAQRADCQRAVADEGAEGVGGYRKRGSRGGGGAGRKRGAERARGVRERG

SEQ ID NO: 977800 - protein, 206 aa, Homo sapiens
MAVRHAACMARLSPKGPLVKSHIQHTSGSLLNVDDARAARRTPKGVPGATTQAQDGGPRCTGSATTTHGHHLGYSRDTDGSQPWCTTETLGLHTRGQRTGLIAQSKGEHAKRYQATPKWTVAQCDQPQVTRPARDYKRTRKAHNPTNRQPDQRPSEENHTNELDRTGAMRAPRNTNSLSRLDPKDTQKNVNVGIPPIPQYGRRGWA

SEQ ID NO: 977801 - protein, 224 aa, Homo sapiens
MWAALPRDGDGRTPGDQRLHRGHYPWGATAEGGHTANHGQRRPSNYDPIERTDVLSTSADPGNNAALTYAETCTKDTLPTTERGVATNTRQSHTPAIKHLSVQSELRTWPAHQHKSSRNPELERTSAPSNQNTVAQRTELDPNLGGDKKRVTNHLATGAPCAQHTVLTLQSENLVGKKVKLITTAATNNSHPTNDYKADQTRHQPTHKRDATHTQHTQTGRTTN

SEQ ID NO: 977802 - protein, 170 aa, Homo sapiens
FPGRWLLMSVSRVIRERDRGTGSVTRELQRGLVRHSRTSTELRTCQGSVPDSQTGDGMPICQGWQYEIRENGGQYVKSDRSRIAMHKAFYHHMWYDATGLQGGPCRRKTDNTLPPCAPSGVVHGDRTSENESDHHCLGLFYIDLTNIMLIQDDKYIRQVKQCILVYNSKQ

SEQ ID NO: 977803 - protein, 192 aa, Homo sapiens
MDTGSLEPEGKMFIGLTPPEDEESDRTTHSALGGLSGSRTVQGELHVKDHRLVVSHQDDYTGGVLVTPGLPAIAASRLRLLARVTWSVLDGVCRLSGWNARGPVSTIAAVGAFLLAMRDLPEGSAIFRAVAPLGGELERCGGRPKGEYPWCERQPGHHKPKRALGFGVRFRYREGEPIEKGAIRLRRGPVGS

SEQ ID NO: 977804 - protein, 403 aa, Homo sapiens
MLYPHPEHLASLLVRYAANGHWIRENLMLETQYALDIARLALDDCGDTLVCRIFLRSLALRRSICRSTRCTQASASCRTVLVRYQVGCARVINTVCVGIHLMDHPYALKSQTYRSHLNPRHEADTPYRHDDTRTLSDSRHTTHLSLTQARATQYLTPDARQPALNGNTSNVISPHRQHPMYFLVQTWQISTHVTYMQTRIKRSSTGQNVIHLEVTFKQRQTIGLTDIRHLEARQQPKSYTQKHITATPHAPTSYKNKLPTAPHTNQQAEQKRTRHTGHNELTQTTNNDAYTDTRRARPDEDQAPYAKNHDSGQTEASIGTDQQTRRRDTKHGGDRRHRDTTKIDSTMPMRGQRPHYTSTQHRHTAIRIEHNNTTGGHKPHNHNMRHRAHSPQHKKTAQHNTPH

SEQ ID NO: 977805 - protein, 112 aa, Homo sapiens
MRPADGRCCMITSAWESMTESRILTILVQSILFSTTIDSVPMVYSGCPEQCKQGSEMTRSMDTHSRQRCEIAQPGRKEDLDYCFLVQALCSTGYDRVHADVIEAPRVLPQAC

SEQ ID NO: 977806 - protein, 144 aa, Homo sapiens
MVCHFLITSKYREERRKSHTRRRPGRGETGRRASRERRAGQRETDDGRRGRRERRGRARTSTAPQAGRREAARGGRNEGARKRDAGRSEEQDEADRDRKKERDEERGRRHNEERRRREREGTSENEERRGSTKTAGAGETGRRV

SEQ ID NO: 977807 - protein, 137 aa, Homo sapiens
LGQLAALGSVGSQGCQTATTQQPASPTNKKLTPKGQSEGRGQQLRRTEEEGEKGRRAGGTYYIALHIPDSCVMETVARDVRFSRSIWELCRFEFPLRLLEDNCDSDWKGKVLTDKVARGQRLVCLSVCYEVGYPYAA

SEQ ID NO: 977808 - protein, 251 aa, Homo sapiens
MMGPCLANRKVVKAPVAREHTSTRGIERFHTLNGGSWPSIVGAQGPCDMGAAPRPVEGKDNAEEIARWPPSNVIRDVTDGGIESRVGTWGIEKGPPVGMGEENRNAGPRRKERQPIGNGTWVSWPNGNPKLTKGPGGQVPIGHVKLRNRTAVHYPKRETRRFQMQPPGGEGPARGTLRLNPKYTHGPPFSKTPIGPANPGEGAVQSFIYVYSKKVPEGTIDQGGSDWRCTHFVVPGYDETSPWETSPRAHV

SEQ ID NO: 977809 - protein, 131 aa, Homo sapiens
MGQPAVAPLMVLGGIGHAAIPLFCGVATNRCGALELANVAPQRSTPRGYGKVRATRRPCSNTADYLVREFTRGRLLLERAGCVFAFAPKTIAVCRRSVYITSSGVARRSLPPGGWVRTEVRKDTFGIICAT

SEQ ID NO: 977810 - protein, 77 aa, Homo sapiens
MALVRANARGVMNKTRPSAESICARTLAWERIRSMLLRQNAHGLEGGNPQRTTSGVIWWKKELQEQATYEWRVQLGQ

SEQ ID NO: 977811 - protein, 171 aa, Homo sapiens
MTQHSRVTLLMLLADQGAQAAVVVGVTRRYGPYYSKRRRILGDSPTHGVATACGRNNLMGLVPIATDIGLGRIGHAYPILMALETSNSGAVAAPAGAPGANMPEGHTARTRAQRGQTLRALGHIDSATVITSLLWLDRLKRVEKHDRSGGGWLGTQDALEPGSNGYGASPL

SEQ ID NO: 977812 - protein, 293 aa, Homo sapiens
AARFWELDTDHDLLIDADDLARDNDHALSTKMIERIFSGDRHYEAEKCRQEGKISYADFVWFGSLRKTKKHRPVIDVLGSCCYGPWTGYGALSSVRSSEYFYEEQCRRRGTSMAIEALAFQDCLCQMLDLVKPGLKGRSRVLRTCKRCKLANVFFRAPSSISGSTSTTRQQEQYLPAQEIGDMRVAPVARRDWRESTRSEEYLTFLRWSDGRPAGEPWVGRVRGPEFSRCGAECWVSLGPPGGLGALLSGGLDRGVRGVYEYAWGAGPGRVFRRLNRVGAVPVPTARACAGGW

SEQ ID NO: 977813 - protein, 141 aa, Homo sapiens
MERRGGGRGATYYIASTSLIPVLMEPVPEMEVLSGVSGNCAFEFPQAVGGKLRLMTRRWERPHRAKVRPVPGGCVESQGWHEVGYPYVCLGLTVELLVLKQSYRDPQDSLCTLGSLAWEPAMPESQGGLPRIDLDQSTMGR

SEQ ID NO: 977814 - protein, 520 aa, Homo sapiens
GAVPRGPSLALADRWLGLPLYAMLRSMRTEGVSRRVALQVLCEDVLPATIDRQRTRCLQRWDRTRIDTHTRETDLPLAVGGCAPYVHQGAVHMRVCSGVHEWTSIMMATEGPRSQRCKSSPSARERYPHIRRHWQSGTQSVGDRGVARKESWANHHHFRSESGGMTDGGGYHEGSNPVVMTCTRGRTLCKTLKGRNSVVSESTDHRKSTAVCDTVCKATPEAQWLRLDVIAGDMDVLISLVSAILGRPANPSFGAFSGIGTSRVAPGGDQHTTNLYAPKLLTGRGDISPLYPTHWPNPLTDLEEHVGRVGPGNPRTLTLSLQLYRIHTTEARRDTKALSKQPNGAGSGGNIRLPVNLLTGGKSFVANGVQNTHGNIIRHDQRRNGAQTGGQGYTKDDFHYPLGEGKNGITAAVGHWAGAQGHIHTQLGDNEYEGTARAPGEATTSQKHDTFHGGNMLINPHVGEHPTADNTHHIPKPKNQGAAREQTHDKTPTDTNKETISRRNNHQNTRHKLQQHDRET

SEQ ID NO: 977815 - protein, 152 aa, Homo sapiens
MQRSRAQRSDRKQPRTQKGREKRDSKRRETGREKRKRERGTEERTRRKSKTTEQEDKRQKTEQETVEKPPHNPHERARRRRGSEDRSTRKESNNQSRKENRKEQTTNKRIKDKERKRKNDTTQQKGRKDDKRRKKEKRQTRKTKRRDKGKRQ

SEQ ID NO: 977816 - protein, 107 aa, Homo sapiens
VQNPVSARQAPACTHPSGSMTFHAVWEEKDVRRGWSTPKGFEVEIRVHRQATGRWASSVVPEERWRATLARSLDSVSDHICDWFKTHTDHTRLYEALVEKPYTKSCR

SEQ ID NO: 977817 - protein, 89 aa, Homo sapiens
MNLKEATHVEQSQPSHDALPYHFILPCQLLQPQQHSMLLFLHEKRDQTTRLGITSHSDKVTFQPYYTIERRPRLVLFLLSLMNEDILNR

SEQ ID NO: 977818 - protein, 95 aa, Homo sapiens
MKSLSNTLLLDNHRPYVRHYDAQSLHAINDSTINQTRDTIIANNNTDRKKTTNKATQRKQNESKANKEQNKSTQITTLTTKAYHTMHETSKEEQN

SEQ ID NO: 977819 - protein, 113 aa, Homo sapiens
MEGYNATTVKIIIEDKYRGSCYGNHAVLRETRLPKDGSYRLQRPYATWSVVRDSDASKEGSSTDYVHRMELRGEDPRSDQGTLDFAERTDWSWMNYILAKKANWGDGRWNAHE

SEQ ID NO: 977820 - protein, 300 aa, Homo sapiens
MLALAMASLSVIGLAFWVSGDAAWEIRRFMFSAVSPSPEADAELRGVREPESGCVRRVGRLFPWLRCMRQASRRTYRRGGRGLGCRFPVTRNMTMARSYVKDDIFRIYINEKKECRGTTGHRVLRRRPGNGAPNVICCCAAMGLWYGTRYWCSVWPEYDLCSVCEGQGLATGGDTRLAFPSPFGHLSEGFSHSRGFRRVHMDLRVAMMGHGSIQGNCSPRPPRACEVSLAHGESCFWSIRSDPSVDFLETVGESLGVAYLWAGLISMCAGWKGTGDLVQKVGAGKGHAGGLPRAWTLGPL

SEQ ID NO: 977821 - protein, 225 aa, Homo sapiens
MPHTNQRRHSNEHPPQLTTDKTDHEKQQNTQTTTRNTQHRANTKRRPRTNPTNNHQQTTQTKHPHTPPTSNSREKASRHTRRSGETRPARTDTHGTEHAQTDNTKDTSKERARRQRTSPTSSQSRSNRRQNADTSHTRQQTTDNDNKRQRQTATAREQKRSHDQTSDGRHHKRGSNSKLPVRSNQPGTSTDEQTCNTTGTQTKRASHSRAGTPTTKLPKRHRSPK

SEQ ID NO: 977822 - protein, 200 aa, Homo sapiens
MLPKLFWNSRAQVIRLPRPPRVLGLQARTTISTKKKKKKKKQKRTRGGPQQENNPPRGAPNSYQPLTHHVVVEAQGGPHISGGEQLNKPGNRRDGRVLTTPTRFDVGKQREAAEGHPVGRATPPKPSEGGANNQWGQHTTLAGSMKEPAGGVDKQQLDSASSGGQHHAAAKRVSRCDNKLRQARRMHPSDNYLARSGNTR

SEQ ID NO: 977823 - protein, 279 aa, Homo sapiens
SDARWAELLPLLQQCQVVRLVGELWPHGSRRGKDISSALRVKPALVSSSTCAWKELGDVGVHCVLQGLIRAPPCNDPERWASRTVGLTGAPVCGVLFSTLRTHGHTMLESAILPDDNRPWGMLGSACMLLRRTPWSPAVPAGKAWSVEYCKPSRCVSCDGPGLRCLRDKPDFEGCSRLATMTSMRLASVCCARAWSGLPAGSWRRRQAGELRCDYQTTWRDLCGIVASKARWGGGPWGSNKLGDVGRGGAVARAVPTPVPGQGPCGSGSVGSLPRVGGP

SEQ ID NO: 977824 - protein, 308 aa, Homo sapiens
GRVVYRTGNFQARFTKVGRDPCPTYEILLLSSAEPTGLISNPRAQQVPVCSTKVRDQWWDRDDDVPRKASKRQGAVPEWSEAGSAGAADGMWALVNLVIDLPGVSLLAGPGVWRFPSRPIGHPMDCTISLAYGLSPLRDFVAINMPSVEELKWTSRSDRHTSLGFAKHWHGVTHWNRLMARLACKYRMCLELIMCVHSTLGGPMSRVSDESTYQECMKHLDAHGMALGRTVSVIGRTCEWNQLRDHTAECKELRGCSYDIYVKITLENVDVIREWMARGRIAVEIFPWAATRPVAIIDKGQPGFANSS

SEQ ID NO: 977825 - protein, 328 aa, Homo sapiens
ASIIYPTTYVQFLYHGRARDIAIADTFFSCIACVAYATEVELDPGPAGEITGYMATVPGLLKVLETFVPVIIFAFITRLPICTMHQPALEWCWAVYATLLHPSGSRQVLLNLGECGHTVSTHPLPQLPVGAGLAVCPPLMPTPYVLWTLYQFDDECMEARTLVAQRDVSCSRRHAYYVCAWGPATGCGHPDGINLRGVMWLTWCTLPPWFCQGLRLSQEVPCPLQALVLLAARFLSGVLLSSAFSVSSSCFRSLQRFLSVPVVSANQSGGVFLHPFTGGTPGGVGSIWFPGRALFFFLRGSLARERGSRTPGRFPPYLSMPGPHDAKT

SEQ ID NO: 977826 - protein, 83 aa, Homo sapiens
MVNVIRVPAGERPASMIAHAGCGAGALAAARPSVIDRALPGQVLHRGAPGYLPILAFRPAHRRARLLFSQSESAEWMPFSRKS

SEQ ID NO: 977827 - protein, 449 aa, Homo sapiens
GRVGRTTRSGDRRGRILALGVDNLNKDQSPGASIGAPGWYAAGDQMGETVLCLLYDKFQRWDDAKVLVYKLNGGGVLAGTEAMVDFLLALRNKWRKNLFRPPFRQRRHEIQAESTQTWCSWSLTNMGAFFGRRGNYVRPVVKPEIGDEYGGLNKFDKLDGAVKLWFQLGEGALERLDQNSEVVLKMMAEGSKGNVSDKSLKGHGAKFGGDLKFRGERTVRVTTCELKGHRSSRHKGLFSPQNAINISKPSRKTIWVQIRLGGILGADVQELEHGIPWGPCVITRYWGAFTIPLDELSNLVDIKRTIQGFQSNGYLAMGGSGLPGKKFTQGGQAIRHNRKGKNLLREGARAEKGGQGANDGHQGTTWDYEKPPGILNSEDQDNTSRRNNTGPAHNNRAYLGKQHTYEQQINREPATDIMVIPKTAVDKHNKQDERHTQHNVETESHKTRQ

SEQ ID NO: 977828 - protein, 209 aa, Homo sapiens
MSMSAYKLICLAMFEMEVIAVACDMIGPHTLNTRVFIADKRYIMANVYHVVLCVVPQYGCTNCLSQGLKRILHVMIYVVLMTDLKALESYVIKVSLQIPQISSESALRSAIMVKSVQIKTIRVKLLAHVSRWLLTTRMNRHWSFRSLYESFTSVYVKTCGDIKYFLELHADGMHTFVPWESCKTSCMSPPSILILHTGRTLFFDVTNTL

SEQ ID NO: 977829 - protein, 329 aa, Homo sapiens
WPGVQFIQGQHYYTEINGMGGGTREPPAAPPLSWALGVLAGGKKLAGDPHLGGQCTKKPLDRGPDKNLYRPLKVALGRSRGGQRSHTAATGAMGENVRRPVGDRNPISPKGMHKGRFWAQASGGEVRHTQTRQARGTLVPHRGSESATRERGQASYKARTIGGPSHLPGGVTPRPREIARRDMEPIIPTPQGVHHTIPQGDPLGGGHPGGRLGRGERNSLKWAQVARDTVGRHHITTGQLQMAPRAYKGTPTQGPPSSPGGASGEHWGSVRKPKGGLVGAQKPLLEAHSGGSEDSRKRDRDTGQAPWGNATTEGGFQTPPGGEDILWPQ

SEQ ID NO: 977830 - protein, 215 aa, Homo sapiens
SRIMMCGWELASTVRYTVRWCAIFAGAVCPMKEDGLSTMLNGADRRTASVRSVELDSRNKGSDGPGADILRPEVNDVGQLSLGLDERTGLVHGKLILSGFSRVKFTVPSVPGVYSAFRALWYQRGDAATWDRTHCARFLPAEARKKQNIDTDACVVPDAYQGQVTHVNAYGPKEPKGGRSDAQRGMGPKGHDGSYECTPADNSGSAGKAGSARKS

SEQ ID NO: 977831 - protein, 136 aa, Homo sapiens
MAREDEYLGAPVASATSVLELEGQDGEGLGQSVKCGQDAGCISGGGTYMASTIANDCVPVVNINFGGGQTQGTPSEESRGINWNSDIQLEILVSSPVGNGLEMISSMVASSMGEELVLRRWVKELTELAQSGASAN

SEQ ID NO: 977832 - protein, 79 aa, Homo sapiens
SNQTVHKLTHRVWSCSMGEIPVSRCAGVRQSSLKRSLMRYFLLTQAVSDRKSSRCSTTGPGSGVGEECCNVMIGDSYDP

SEQ ID NO: 977833 - protein, 88 aa, Homo sapiens
GRVVIDPRVRSSSVGLLMCDVASAVPYSPYHVRRVRTIPKLKGWVLRRLNLEEGYDSGSAKVMILAVVRSVTRGLSFDCAYVLYPSEV

SEQ ID NO: 977834 - protein, 230 aa, Homo sapiens
ARLTLSIPFTINEGRDHRGRFGVPSVQGWGSTTITDSKDGNVIVRYAPSLRRGLHREWTLRYDNMHIPRKPLASYYVDYPSSCVAMCIVPMGLASMPCEEVNNLSTLHRSDSKDAREGGLSLAIEGPVQSRISCCTENQDGTMQSCSYLTMCVPGGPTVDSRSKYNEQHVPGGPFTARVTGDDSMRMSHLKVGSAADIPINISETDLRAADGTVVPPSGREEPCVREAAA

SEQ ID NO: 977835 - protein, 147 aa, Homo sapiens
HSARVTAVGDAVPHVGARSQLEGHTKRVCIVAWHTTGQNVLLSAGCRQRDHGVGRGALGLAMLTHGSQILHPDTIYSVWLRADDGGLICTSCRDNAACASSEPRKGTSSVAEQVTVPHEGTRDRAVSKCNVGTGWGKILTTGIQRHE

SEQ ID NO: 977836 - protein, 290 aa, Homo sapiens
HSFFIYETFYKLVKIFQRAPPVMAAQPPTAHEVDGGENMTVGRGKNATLGPGNRSLVGQSGQGKPRAAMCHSTALLLRRGAHGAAPFFTRLRSCAIVRRDQPGSFLAGTPAGDWGLWGAQSRILTHGACGFTVLNGHLYPVSCSVPSGFSCDCPSKRGAGSSTPLGEKSPFPVWMMVASLLPAYPWSSLLIFMETQITTSVIICKKERMLGKGSGFHLDLLLIVAYGAASVPSLACLVGWCHWSSGHSANALTVMSKGCGTGDRPRSRRQGTGGTGCGCLLWPSHTGWRD

SEQ ID NO: 977837 - protein, 111 aa, Homo sapiens
MDEKILTRRAVFEDHDDTKSARLLNVKALKPILRQRLIKSFIAVSRPVQVWRLELKPKNRSDAKKSLGNTSVQRLAPTLRGNGSNSKGKGYAYRRFNREPPLKRVKHQIVV

SEQ ID NO: 977838 - protein, 184 aa, Homo sapiens
MPPAGFATHQHQQVAPPRALQRTPPALSFRVLLLGGQAGPLCLALPTLGHGRRAIWALQEQILGAHGETGVLEEQQAGLSSGGASQRVPPAWSEHGMKNQAPLIVHLHKALCDFMQAAQPLWPHVLVHRGRVDWMEAEVPLSLGGVAEGEEEPMGPGSPASLHPECPVHSTAHILCAIDKRPGC

SEQ ID NO: 977839 - protein, 277 aa, Homo sapiens
MNSEREKIRAPSGQRGQSKGNKRTQADLAPGTIRDRLQRQGRPRRTNLHRIGNDSYYPHMHGGTHMRSTRQQQHIKKKTLPVHLLLVNKLRPQPTPDTKHTTRSKPRQQHKNHNAPKHQTSPPNHTHQTNTHDTTETAPQTTSTQKETDTRPDNTQQHHRLQQTKHRTAKPPPNKQQKETREAARTEENTTKARNHTNAEKAYRKEEKKEQQEKRENKEQRKHETRRKRRGTRKKRKRSVIQEQKIQPGKNKTHTENKKQKARGERAQRDRHDKNTI

SEQ ID NO: 977840 - protein, 325 aa, Homo sapiens
MGGWAWWSSIILWIRIRNYLSIFRKFDLDESGRHECLRDADGALSRQASKAQAKNAVQTLTHHPAYSDPDLAVDLDKFPFAAWMRLETSVPDFSKTSGHRSGWSCDLVTCLMWWQLTMFAGGRDSVPLAVVLLPPRLTSLCLLPHHTMATSSLHVLFLGAEKGSARPPCPLSSAFHHRSSVSGQNCVAPDCASHGLGHGLPGPPSIAKSGGLLCACPVPRDESRVCLSILMWPISSFCRRQPLKSSGLGLLWIENISIKSSQPEARGGAAPGREGPGWKPGFRTRKGPFGLGGARCPGGGAPHKKGRDHRTAWEQLGRPHTPEKN

SEQ ID NO: 977841 - protein, 407 aa, Homo sapiens
TRREEHPVLLTEAPLNPKANREKMTQYHVEKSTVNSPHVHCTVAIHGRVANRAERLMDLYQLDIVDGLQVTGSTLTLLPIIRRGMPLTSIASPCDLDPGLAMDLTDYLMNVSSTEASGNRLYSLGHRARKTGVKDPMTIDHFNRTTSLQVALTGSRPPLEKRCSTAEGRRGLIRTAISMASCHLVGKRALPERALTAAIGHSAIRPPDSGSCLPLRARLPSAFASLALWQLLVANPERTTLQGPISASGDVAQSGQRPCTPTTVLVWRGPPMLPGIADRMPTEITGLGPPQRRIRSNEPLRKRQIPREGTDGVKLGLESNLPTNDEHTPDGYQRPGPHMRPERAQGRPHNNAANQMCNDTTSEQDVRQHRSTGYIGVRNKREEESTQDSHAERTSKKSTTGPGTRRE

SEQ ID NO: 977842 - protein, 269 aa, Homo sapiens
MPVGDRATTDQRGAQGKAGMPSAGSSGSSARLGGGELVTRRRAGPEKEAQGRSRAWAQGGPLGVLAWDAYLRALFAGRCMSCTPAWPVVVLVHVGAREYLCKLGSWHTFKQARSTEVGLIDGEPSSIRSRVAPWVDASMYSWRLIYRDRLQLVGGPCAILLAMVLALSSLPSTGTSSIPEAPGGVTHQGHAWVLRETLYQHFHRTVLKVGEPGFVAIAPGPGHTPKGDPLYWTTVAPYTTPPSFLGQLHRPFDNNTVAALSFPPGTLSV

SEQ ID NO: 977843 - protein, 385 aa, Homo sapiens
MTKRSSDIGSPEMLRVGISSNIVRRVPSFAGGPLRVPEAPRDPRLAASALGRDFADETRVKRKRLGGSMQDSTKQAQGRTCPLGSPLLRPQPYLNRARHALRHSAPGTRPHAPRCPAAPACAPLLALPFTAPRHPTHPSLASPRSLPVSLRPSHPHPHRACSYRDTSPAPPPPLPTPANPTRSLTAPPPTARTPAPPLAPPATTPHPAPPRPQPATTHPRRRPAPPAKRRDPTPRPPQPPTPTRTPPPGHTPPARQLPSTAPPTPPPPPLNLTPAPPSAPPLHPRRPHTPAHTNPHHPPPPPPPPPPPPNPPPPPTHASPSPPTHTSPPTPPPPHSPPILPLSFPLLHPLLLSSLSTHIPSLHSPPPSLHPHLPPPPTQNPTHNP

SEQ ID NO: 977844 - protein, 323 aa, Homo sapiens
GIYILIAVGAVIRFVWLPGASYEGHPGIPVPAVDVLHLPGSSWCVCEVVAGNLGLVKKDQIAKDVKQFYDQSPTGWPWCMMTRNERRKAVVNDLPRDALTAVVPGTLDVLLDHRQLAQEQFVSLGRATCIRKPLLREDCHQEDDDLVLREACTSSALLASWSAVIIDLRVMILSHGAVLWHPEQLRVLRTPQTLATGSSGVPPEVSRRLPMGPSSPVYLTFPVLLWLHVASGLWGSVCPNVAGASRAHVTCRWVIIETAWVLRTGRALCRGPVAGDTGLLGHAENPGPGGVPPPLVHTSHPDSAITTKQKPLKVQRDTLSISE

SEQ ID NO: 977845 - protein, 309 aa, Homo sapiens
MTSFLSVAGEKEDGATHDGDWGQWLAGASRWTHDPSCLGLPDTGSFTEDAAAISTVGATSQKPHLTQRQAPDTYMPPAELLGSHWQSLTVFLSTWPWAILTSFRTDYDSPDGHLSMAQSWMIDLPMHLKFYKMNPGCYTQYGPQYLGRPGPRMHHRSHKHIGTLLLNASTRYPQYTYVWNHTKDQKKENTQGLATCDIRLRPHTEKRTAHTITARNAHDQQIAPETQAQSRDDQHISTRQTQTTQQLRTDTQKQRSTTQRSKTTRKPTKHTTTYHHETREQPAKVERHTARHQTQKNTSTTQPQPNTTT

SEQ ID NO: 977846 - protein, 159 aa, Homo sapiens
MYLKPSIRASELCVYRHVNGHDGDKQLTVTPDITDVAARMPAPSKETVTTECNQSPCHAQNRQTVVETRNGRTTRNWGSGTCIANAAASDLQPPNGQRAHEKYPAHSHADNGAENSRTGSPHEDAEQRVPEDSRNAHNTTSRKKRRVQRKPAVARTPLS

SEQ ID NO: 977847 - protein, 380 aa, Homo sapiens
IYDARTPDQVVVALYGPEGFYMASGDVSGKLSASGYTDSQKGAPVELMSSQSCIAGTIMDIALWLKTVKEDRRVVRGKSKVQRRIAQSSTSLWDSVDSLVMESDDGTKELANQRLLKASVCHQRESRAISRHGAMEKHMSALQSACFDGSPIRMYYVRHIGEQHGAIVNMVERFPLPDGKQDSGTSQCLIGRMIVTILVSGDRTEGGRGVAPLVQDREGPWTGAGSYARYIGQSPKKQTMYSLAACWRNNGDQDWDVSVTSVSGDLPRGSLTVLGQTDGLRIGYGPLSKGSRRGHGYCGQNNPRMACGEGPGNPARLAGEKGEAYLGGTRRDLVLGSKGRKLVKDDTGGKARTDSRARDTTGGKRITRNDRDMMRTHTEE

SEQ ID NO: 977848 - protein, 175 aa, Homo sapiens
GPPGTAPDLFLPHFLGGDGPCLTPQPRRSMQCLANRSLRRGGRHSSGSADEAASEEGAGPCPVRAAVPAASTQYQQHRPSLEGGTESPAERPVAEQQEVPGSGRRLGPESCSRRRHESGASPQTLPRCGPRLPANPPQERGLKIKDGNTRRRWPFPMASLFNGIHLYEQAIDNQS

SEQ ID NO: 977849 - protein, 352 aa, Homo sapiens
STHRDPEEKQELSGRSEAQSWMSMRELISNNEQLAMLGQAPWGPGEQVQPAEPLYTRLFHPGDSCSSRGQATTRHTFLVPEQGRLDKTEQVTSQNLQLENLRMKLPKPPKPVSKMRMADPLLMQARAHGSPAPGALQNATKYGNMTEEHVMHLLQNAEPLKVYPTLTGELPGELRHVENAMETIDRKVIESRMHHRLLNDRSRHTLEQKPTEAQRKSPGLEDPHRAECDTAGQGPKPPRKRTTSRHKARQTTKEDDKTKKPKHHTTNRQRHNKAQRREGDEGQKTQQDGEERRTDQTRQEADERRTRKQRDTDTSRTSRQTPTDTPPTGRRGEQEQSEEQQQHQYSKTDHTH

SEQ ID NO: 977850 - protein, 173 aa, Homo sapiens
MARCVVGSSRVTLTLETSHRGLVFLCSPHSRERVHYVVLKSCRLETNLGHQYRLTTHIKEGEMQSVGGLIAYYLRDRGDYFCVDAGVSAYCSSDSVTATPAIFDAGDLMVGPRVTACVRACLILVMAGLCVTRKRVVHMHVPPGPARGSSTAWNDTPGKMGRAKGGARWVGNP

SEQ ID NO: 977851 - protein, 217 aa, Homo sapiens
MGGEPGEAELAVELEIGAIGTGSPGRLEQDSISKKKKKTPLFGPTAPLNHSNEETLEENTFSPKANEKWRALGAFKEKRQGEGCVPGNGLIPQGASHWETAAFFTPRRWNAPLAGNLWAPTIFSWNKLWVSSTESYSRVPFIYPKTRLHECVHKHVCQQPSVSVKERIPIPVASCKRIRHSESKTPKERVHNPLGGSPRAVAKVGSFPKKNPGENIK

SEQ ID NO: 977852 - protein, 134 aa, Homo sapiens
MSCYAAIYFETPLRAGRCSAEKRELKLLQKYLCDEQKELQALYALQALYVTLEQAPNLLRMFFDALYDRGRGEEEDAFYSWESSKGPRLSSRAGGWALICHSFFSAQGSKERLTQLRGGGRELEPWEQMAGYAE

SEQ ID NO: 977853 - protein, 258 aa, Homo sapiens
ETESRSDTPRLGVHVGAISAHCKLRLSGYTPFSVTSSLPSSSDYRVHHQAGLIFGYREVKDGGLHRCKPGGSRSPNRGIRPPRHSQRIGDNPRRATRARRANKKYHNENTSYYTCRTEDTRVREGHTDEKKEGRETETTRQNRERSTHATPRINRTRNYRDNQIPRQYQGKPSQRGGAQRRHNDHREYTEHVNGITTRAKKKNEGKNKPRRHKTKGMGIPRKNDSCNKERRHQATTQRNTPQKQAGGLTRDGERTPDT

SEQ ID NO: 977854 - protein, 322 aa, Homo sapiens
GGKKGGPRGVRGPSRGGGPPPPPAGDTRGDGSWRQPATTLRTGGGRRNKSGGACHKKRNKRGWWGENQAARLGDETNYDSHDYSPPTTRRGGGAPLRMYLRKEEERARGGPLLNTSAQKKNYLGRPGRGGGDTPRLLDDDPPPHAVKDGGRRERTSSGGDTQRRTSVRPEEDDKQERGRLRSRAPTKKRAHAEITYDTSEHSSERHRSPARHPAGARVGDTIYYHHNEYRESSEPDHIGEGRHLSSESNRQYRGDTRTEVGGVQTQEQRNTGRPIGRATTKNSTTTSEKTSNYTEKKEDSSLMYGKQPHTDVGIDEHQPDQG

SEQ ID NO: 977855 - protein, 322 aa, Homo sapiens
MKNTPKTGDGHPATNRTKATQKHNEETMKQKRDNRQREIREQQNREKRTKEKQRKSQEEKKRKEKRQEKRRKETKKNNKENEKENRKRKKKKQEERSNPRKDQRTERRTGRATESKGKRNTKQRKDENKNEKQRKQKEEKNGEKKRKTRQETERKRKANKREREEKKKRAGERETEETKKKKAESKRRGKKEAEENKNKEEKESRRKYNSRKRRGEREREDESRETDRDEEEKKNRENREDKTHTRRTENQRGRKHKRETENTQQNKSTGQKQRHNERERDASEERRQDMEQKNEKQNEGKESTRRTRGSSEETQREKRNEK

SEQ ID NO: 977856 - protein, 293 aa, Homo sapiens
KVVVRDVEGPSEAASALTGGGVYLAPPVSANKEPTETEDYLSGDCGIERVIQLTVIGVGYWSGEVARMTRACRDLESSEMKSAQRTNITYAPKHALRYQPKASSCREGTLRMPRCRGMHECTSSGCTCVYCRKMLAPDTFVAMRVSKEFAILGIQVDKQQCIFHFECRQFFVRIVGALEWRLYELGVARDEMGRLSFASWYVGRWSATTGVCRADRRCCTECLACYIDLASELWVPCLGILPLVLGDRCVVECIVRTWRKWGGWLRRDERNGQPLVRHLSTDSIECYLLSGAF

SEQ ID NO: 977857 - protein, 188 aa, Homo sapiens
MSGEYVEVSFHNGCARTSCNLVLVDSSGDLDSFPRAIGPSIADVKQSSDLLEVDDVLDRLYKNVALEVARWTIGRVLTCITRQGGASRNNNHNRLVDTEYLRNSLDQVVLKRCDSMDSWCRTFGQKSTEGCRRGVSEWVCIINLDRMLECRWFVNEKVRKLIGWRRGYGGGIRELVIRDGYAATGQHR

SEQ ID NO: 977858 - protein, 104 aa, Homo sapiens
MGAPKGLYRGTWSRGDLSTPAGRGGSKHRQTWEHSVGTEPLTVGGGGNSGAQIIQERKNAPRGRHYYHNVNGEQGEQSPKRGGDSWVREVSLGQILSPGRAQPC

SEQ ID NO: 977859 - protein, 256 aa, Homo sapiens
MGEPDTSLRHNFIPDCIQSMGIITYHSPHKIQDTKSIQTCTPVSCNPVMISMVDWRMIIRGTKKPYSLDVVHPMHTCEEISLKDTKDDWTIKKKKKRGESTNHQRIPMPGGPQRKYRTNSPDHYHETQHGEPHNTVEHVINKDKDKGTAQNQPNARKQGTNRDNNKETPTEESEPTNTHAESRHKSDRQTAPKNRTNNKRPLTRYQTYNNHYNSDPTRQFTTHPQQKAERGVTTQSGHNEQLRLTGTPTSQQRPKT

SEQ ID NO: 977860 - protein, 348 aa, Homo sapiens
MGVYQNFMSSAWCIQGGTRQLRPSRELVLEWKWDLDESIIPNHRKLNNSNVFPLVKPVIPSSTISHGKSKVDIELGTQVVDPMIPHPHSLTLKNIDEPLMYGKNPVQLQEKPLRRDKSLPNKYWQTSKDREDLEPDSRYELDTIHRIDRYTTLDQKRYPGGVPWHPSWHTLRTKSKESTNESIRKPHPMMWYQDSRNKSTQSLWTRIGTSHGDGHFCGMSTNQGGLCNHRQCPKESRGRQTAAVAKGVSECGPPMVDRNGTCPGTIHRGATHRRSRSRTKRGTNKPAPEGHHCSAVKPGTDAHKERPEPRKRGSKKKNPGEQIQHKRAPSRHRKKGHTPDKKTAKRKH

SEQ ID NO: 977861 - protein, 109 aa, Homo sapiens
MVGREAGANRARVAVINRTLTSDPKTCTGAYEKQENHVRNISRLDSGAGPNARLVQSRCDSSYSGHGMRRDRAIPHEIVSSHHPPFAERASVGSARGSGSPVGDRTDLL

SEQ ID NO: 977862 - protein, 171 aa, Homo sapiens
MEQLNHTGPKNTRRRPNSTNREKQQQETHERKRKHGPQRTRAQQRTPTKHKRDAKRQQDEHKSNWTQINGQPTANAPSGNTHELGQAPREGRTQTEDRGREHTGRDAHKQEHEQKHAGSRRNKEHRRRTATRERQRREDKTKTAQTHTRRDGETQQSGSTRDRRISDSSGH

SEQ ID NO: 977863 - protein, 96 aa, Homo sapiens
VTRGADAWVDEYNGKSVWHQAEYIYIHIYIRAHTCTEVMLWPRICNIPLGNGSYLWDFRRLEYFFRENSGTQKNERWSLHLLYSSLKIFNFSENYK

SEQ ID NO: 977864 - protein, 491 aa, Homo sapiens
MHRYLEEAGRQGTSRQAAGSQDIRSMGPNQGTKASARLLAMSGRTPVGPWQRVQAVNSVIRQAPSTPAGSTVYVTYPHVALTTRKAQRKSTIASECKRPGRYGTLIMMVMSELLTRRPYHGHWGSQGTLCSHRGTQSTEQAEGRVVEWTGGDYRTVHSLVLSSRTLACPSPRVSAKSDSKQSSNVMIGSPLQRGELSSRRALELSVRRTCEKVKGTRVQLYHLVPGGLEAIGSIIAQELKQDAPIGQVVLKSQGHVRQCYCAPLGPGELRTLGFAIFVLRTWQRSGWLSRCTNNREFRKPTGVSIARQGKPAAKGAMRFYRKRQHKREANWGTKHGPREEQHKPGERIKWETTMEQGKDSTKNTRKRETPCQKSTHKDDPLRHNNIREKSRRERKTEQSNRRSTHRNNQRMSEESKTKNNRKAQRIRGKRRNGSTHTTRTKQKRDARSTKQEHRRNNRKNEQRSNNRQENRTTKAKHHRITQDQPDTNTPP

SEQ ID NO: 977865 - protein, 189 aa, Homo sapiens
MCKLLCQGAKRQHALGETCGPRRGPRGVCCDPGQEAVRASSACFLVWQTQVLSLQDNLFQGDYPVEHSMMMFQLGMLSILSLCCRCPDVGLRIRCPDLCGSQPGSGRTVFEAQLIPSCWDRNPQDWYPGVTLGWTWNGGVPPLTLPWSVSATFLFPVECPLKVHFSGSLKAVLHVSLRMYPVVFPSPTM

SEQ ID NO: 977866 - protein, 307 aa, Homo sapiens
RVGKSALTIQFIQSYFVSDLTDPNYVRSSYTKICSVDGIPARLDILDTAGQDEFGAMREQYMRAGHGFLAGVRHVMSRQSFQRGGQALQRRILRVKDRDDFPEVIGREHKGKIWSHSARSPDSESLCLSSASHHRGLTCEASVKLQSHSVDEAFEQLVRAVLEKYQELRAPTRALPVPPGNERAGLPLRLSCSQAREKASTRSSLVTAAFGPWCVDPESHSLETRQMFLHLGYSQGTKLTIYMPLISLGLFVGLQATVVPSGKSLLVPNLTPGGGKRTQGSKRVITPPQNKKGPAQNTNKRGRQTTK

SEQ ID NO: 977867 - protein, 267 aa, Homo sapiens
MWPGWSLTSDLVICLPGSQSAGMCHALQPGRQCEPPSPKKKKRWVYKPAFFFLFPGLLKFRTDKGKRSQFWITYEEDSCVGGSRYEIDVLDSTGVLVLPGFLEDLVRYWLLREGPKCVRRVGGIGPGKLVKGPVSAGTLHQKKFSFFEGHEGDMTWWRCLGPKRTQRRGKPQRWQLRMATWYFPGPLIMKGISRGEDTWPVMGPDTKTVPGHESEVVADDGGTTINRERVRTGGAREAVLWPTHGKASRKPGLGITLRMGITRNPIA

SEQ ID NO: 977868 - protein, 355 aa, Homo sapiens
MWGAYNRAPHNTLTETKHTNTCGAHTLLDADVLQPKSTTSSRSQLFFTNNKSHNTKQQQEQRRFYTLDVWATRGVSHCVAPHVPGYKTTASSCRLNLLSSSPPQPREANNSSSHNNILVAPPMTTVLWGQEYYNNSRPHICLVNILLLVTGYKTTTPKFLSVGASTNKTEYDIVQTVRGPQQIIGFIPRGGQAHQKKHGFFTDVKQEGSRKGGGQQNKTTKWARTGRQHPPPATIQSSLKPPTQANRRIDHTARRHRKHNTYMRRPRASTTPQHTKHRGRAPKAPHTNPRVAPFSNNHRSQQHSCYLNKKTQRAASNSGASPTRHHLRRYENRTAPNHERDQHTAREAHTRANDN

SEQ ID NO: 977869 - protein, 127 aa, Homo sapiens
TRRMQAWRLGAPKLEPTRPRGVAHEGEAGVAMRRDGVTSVGTWGYRGRLREQHSQAACRRVGLETDPAPSGSPPCASDSQVRERRSGMQGTRRARGGMESLSEASRSSPCAVLLQPRSLCPPDMEGL

SEQ ID NO: 977870 - protein, 375 aa, Homo sapiens
HAVGQEERAGTEMPLTEACKDSRIGGMMKTLLQFVGLLLTWESGQVLGDQTVSDNELQEMSNQGTVTYVPSPGNSKMLSNWGANQHTSIVISNNNEHAQQRKTTAPATIDSKPKHSKQQQDSPKMQHPRANQAEKSCKAAPQEMWQERPMHGPTGAECKHLTCNRPDMKYYARVCRSGSGQVGRQLEEFLNQSSPFYYWMNGDRIDSLLENDRTADAHDWMSMQDNFRRAVRHHSTSSSRQRILQPGAPRITNKYMPYNLATPEDYIFTYPKDPAIERQEERANINQNRAQAKTKAREYQAPVHETGTKNGHTTAHRDTPKYTKAQAAQKHSKTENTTEKGRKDPKGDRETRKHNEEINDKKEKSQAHNIEHTTK

SEQ ID NO: 977871 - protein, 91 aa, Homo sapiens
LIKGGLGGRLYQQGSQTCYEGHSDHTNVRLGISTHIGGLMEMFTESPKPGKGICFKLRLAPTGLLIKGHHLASSINKEPNILQDTVTILII

SEQ ID NO: 977872 - protein, 159 aa, Homo sapiens
MVLGSGGCDLIHPRVEIQSIPDGMREVASGFSPKFSRAALLEGPGATHYLVALPPVGLQRTAHAVGLVVHAGAWFPGVPTLGPELKGEKRKGVRLRAIARADRDYAEVTWSLDFFKNLPRKEGGRQNWRNKLQCFMVWCPGFGGETGHGGGFAVVGNCV

SEQ ID NO: 977873 - protein, 79 aa, Homo sapiens
WQMLGPFGAVTTVKVIRDVNTNKCKGLAFVTMTNYEEAAMVIASLNGYRLGDKILQGFLQRPTSPTNEARIMRFFVVAE

SEQ ID NO: 977874 - protein, 104 aa, Homo sapiens
MQHHQNKKHMDNNKKNTSKRNNIHKKEQKKRDTKKKTEQTINKQQHKRKRKEKQQQSQSSSKKKHKQPIKHAKQQQKITNTNNTSKKQTKTKKKTHTTIKITKK

SEQ ID NO: 977875 - protein, 55 aa, Homo sapiens
MAWAGSRAHVGQAHISPPQVTASLAPCQGSALVLLSSLGESHFHGEGFPWGKEQR

SEQ ID NO: 977876 - protein, 378 aa, Homo sapiens
TSPASITFTTGLEAPGNLDGQGSDPTDTAPDSLGLSPQFRPAGYLTSDFHTPMVEQNQEILLPVRDHISLSILVPSFPPPPTMHEIQAMWGQSLLTTDVHLISPQGEAADPHSPGNCEGRSCRHRSRCLQGPSTNLPQRKPAERTLNSVKATMETDEGELGMNDTQRQTCNWTQTQTFMPENMRRKTYSPNGKREQISMEARSLRKRPLSGHLQHSPDTHTSRNELTPHAPWTTANHRAPTDENRHPTRIPPKTNTAAQTNTANNMKSKQRKRHETPSNTKNNHAELTDNKDPKRKTTNTERPTQEDQANRQPNQPKAHRNTRAPETANDLTTQRQRTHNNPPNERTTHTPNARYKNNKRERHKSRNTSQKRNTQKQK

SEQ ID NO: 977877 - protein, 74 aa, Homo sapiens
MRWSTHRSPRIDSPGVLKPPSWIHIHIQHLRRQDLHHEPLTKSHNRMTTTRERRLILANTTAPPLPKLHTYGSA

SEQ ID NO: 977878 - protein, 131 aa, Homo sapiens
MAFLMLTERKILGIYNYARGPKRCRPPTGVPTSLSLTAIKLLQPKEPLKPGTSTITLYITVPDLGSQHRSFYYEPPLLLYQPPWCNSDLGPPIYSSLALAKSLFDLMSSGIEDEHSRVLTPTPRDRRTGSK

SEQ ID NO: 977879 - protein, 368 aa, Homo sapiens
VSVKCQRLRGFKTAVWSPPIPGHDRGPHWLPPKQHGALPEPLRERADPPCVHPWGHQTGTTEHGCSHADRGGLLPMEACDAEIALAEQHCCAELNGGRGHASRRTDRQAYEPPETHSMHYTDGASHESQNPDTRTHPSVSLWGTHSQPTYTTASTPDGPAFPVQVKVAQPVRGCRTTQAGEPLRPLGPSRRPQISLSQDAGASQEGTGIKDAEQSQSPKGPNEEADWDHLRPWHGQKDRRTDEHTGPQGDTQKTRPPRGMALEIGGRQKRRINAHGHNLTNGCHKLGQEVCRTCGRKKVEWAIGLASLPPQDREQKRRGQQGVEQEKEPTYAEQHLNAQIREHTDSAQRRPPDRARRPRQQNHPGAQS

SEQ ID NO: 977880 - protein, 136 aa, Homo sapiens
MSTDTVCEARREKENQKNNNNERTHEEEGDRAHLLKESHTWVHPKDTPSQKKTKKQRKSEEGENVLTSGRSSEKPKLLRIIHHEENARIKRVKTQRGGGEHSKKRQTDKVETQKRRRRNKKRGHRQSGEEQSKHTP

SEQ ID NO: 977881 - protein, 172 aa, Homo sapiens
MSDAGCMEQSVACRMPGAWMPAARCKDKMEEQEEKAEEESRSRRSQPAAMMCRWKQKRDGSNAETSLWRASSNEERRRKTHDLLPVQISHPCSCVKVSGNMPKSESSHDVEGQREKSENAGTNQETRIQVEIQFQIETKPSIRITLQIKVSFKNPISVQVKIQVCFQIALPI

SEQ ID NO: 977882 - protein, 334 aa, Homo sapiens
KAKREKMTQIMLGDLQHAQTMYVAIQAVLSLYASGLYPGIGDATPGDGVTHTVPIYEGYALRPCHRCVLDAGVSLGPDDYLMKILTDAAATASAHTGPMLGKSCDDIKETRCATSALDYGQEMAHGLAFQTPYRWRRSYETDWTAQVQSPTRANDRREPELYLMSNLITRHFLYLGHVKYLDRAITRQKLTLSTNTQYNRNAVDTVGEAIPRREGLMATAITASCLGSRDRATPTQSQTHETIWTPKQEKWNSTTRDRNYEPGSPEEQPTKTSKGKLKTKELPNTKTTTMEYHNQTATHKQCRSKHRDETSTRHNGSPYNTGTRHTNTPRHKTN

SEQ ID NO: 977883 - protein, 238 aa, Homo sapiens
MAFNLSEQPVLAECHGQLTWTPETRCMMHRNNCLPHELDACAGQSTTTYPSYPDYEGPQVSTKLRACGHETCSSMCAGTYQTPNSRGTCMETAGRHEDRHLQNPEERAQINHTGITTWRDHEYTTETTPKPTDDNTGKTKMDINANPETPEGQQRMENRKTNEDNAEIWPQRTPEEIGKGDKRHQQTKNHKKAYENTKTDDQNGNERTTQANGTKQDDHKTHGQTTTHAKPNIANRNQ

SEQ ID NO: 977884 - protein, 45 aa, Homo sapiens
RVVGPQVAPCGLGPPAHGSFLLMNMLLYVLGNQAVCEENECMLCH

SEQ ID NO: 977885 - protein, 133 aa, Homo sapiens
MNLVEPPVAYASQEEEEEEEEEEEREKDEVETTRGGGRGGAGPCEVDPNEEAKPQVPDYKLHHQQQPEAREPPKAGSEDSGDQASSGVEEEMQLGPGFDKVASVNPTTVTPGDQDSQQPRGRGHKSCQLKGLG

SEQ ID NO: 977886 - protein, 97 aa, Homo sapiens
DWIRCWVWGLEGRGPSALGSQGARACSARPLLVRPHRPEDSDWSNLGGCVTTSPPVLVGLQSSTVGCPPAPVRRAESVGTLCLACICGFLTTSRFRL

SEQ ID NO: 977887 - protein, 378 aa, Homo sapiens
VEASVAGMLAQMQIADEHPDEVQALVLKSGVITMLVGAEQIFGEAIVVRHSVHGNHETLHVVRMRGYSGMVAYYGMLRHVVLGSVDAGRRAMVCLVTHVPEGLCRDFPLDLLMMAVRAARCVYDWTGSHGAALCGLRYNLARLNPWSHLEKSIALLWVRDRPENHTHCCFAQAKATWGTARFLETCVKGRGFEAMDWSRDVGWLRGIARGEGRLVRTKLPFGDDKAALLMPLGGVHRMEIRMGRGDHNGVEPLVRSREECLNTTALVESSGTMAIKRYGERSLRTEKSFAFPRTLIRMALESLPRPRVPCDEVRTVDPREERGPFAGKNPLGDESLNGLPGSVWQDTSWKGTVTGVKPFEKNVQQGSRGETHVGHTEV

SEQ ID NO: 977888 - protein, 545 aa, Homo sapiens
ASDGPVNRVNQAKYGTMCAYSTDSVTVQRHSDLLASNSNSVFRINREESNMQSTSTRHGANDREATGPEMCPGASAPMSFELPRGVEVHYDGWPSGEAVVSGFPGRSWWLGVLGMTASRGSARVGTRGLVGAYQLGRPGDPLGCAHGWVPRGLHMVAGNATPMKEQMGRNVFTRVSHGVDTLLTKVWGARVGLPMAFVESSRAGRAWRRSANWIGNAYLAEATYTPQNRGWRHWEDELGAVWSPQQGERAIFSKSGNQGVASYTEQAGGKAGHRVALREPLNRGGLAHISALGRFTPRGVGAPPPLEWYAPDPPNGLMWSRLIWVRGEANRPGAVHKGTRGQAGNFPHERPPPTRDALGVGHRHSDSGGGRNGHRSTQERGRIPRVGLEIGGSYRIEQQRLAQREGTKRKSALRKDASANPGVPNRKHHIGPPEKANENRLVGQRRTNPGPEIPTHITSHKTRQKEWLEGPTSKGPLGIGTGGNRKSKPKRGDRGKQAHDAARHMSSVSRATRHEEQPAGQTRNREKTTHENHLTQQGKRNNKQR

SEQ ID NO: 977889 - protein, 195 aa, Homo sapiens
MDWSQDSLPPLSPAPGPSQHLEHTLQAARMVWRLGGDVRPEWGSPTYGLRVQMLHIWTSMEEQSLTEWTRSATDMHNQHRSHDEERDSQNRRGVIAILPPRNNMKRGRKLEQMDGTPNKLRGTRPTKGANITLGQRDTMRDAQYRKAREQQERTRREDRTREGKSRQGATQKAQTGRLKKQTGTGKRIQRTNGNN

SEQ ID NO: 977890 - protein, 327 aa, Homo sapiens
MRESRLGRVRLGGGRGVEHRAHVGTSPRFPGVQGGFLWALSASPRGSWEMAGRPTTIGPGNKFFWDDFRGEKKRGSRAQSVGPTRGLVETLSRDPAGTNRWPCGFPKGCVGSVRGGGGAIPQSRGRGRKRCILLLIYGLQENKVHQTLGGAISKRTSFHIPGGLLYGAFYKKENSWMRSSFLRAREDFGRFCTGGDTRGGAPQLFNIFAQLFSLVALTKGSCGRPQSTIFVHTKGEGPWGPPLLSEAAARTWDHLGAQLRTVLRDPPRGALNVGTSCAGDTYLLQKQKGCQRGKNPRGQLGLWGAPKKMGAVKAGPLYTARPRTKPL

SEQ ID NO: 977891 - protein, 68 aa, Homo sapiens
TSSRSRAASIKWRMTPVQRGGPEALVALGWGTAVVPRRFRSGIRGRVAVVDGAGAEAGTSGGRPQDKE

SEQ ID NO: 977892 - protein, 365 aa, Homo sapiens
DVALGFILPQRWVSTYLISLDINDTVPQTSMPLDLPCASPYSWTSEMDLSQARSRRFEGRVAPSCPSASVAEHFPSSRARDNYRPYLLTPKSSELQMSSKAKEVSTITPSFCPLHMAYSGAETRFGAARRDELHMGWSKGIYISTTCHNNTPDWLTPRPRHTLARTNDKGLRHAVALTTPGTRHNDTNPNPLPLLITTITYPKDHHTTFTQVTYPSTGFMSGETTHYQHTWLWPKEETIPRTKSTPPDQQNRPTLNQTHTLRNHQRHRKTPTQKPHRPKGEGGTRGKNKRRNGTAKNGPLKYRAPTRHTPQRSQAGHPGEISRQPTREHTHHTGREPRKYPTAQPRPSTDTAATDNKHSQAQNAP

SEQ ID NO: 977893 - protein, 69 aa, Homo sapiens
MVKPWGNSLTSVHLDLSHVARATGLVQNLVRPRTRRACLTEQSAQIDQLLTGRPKNANAQRTEGELRVT

SEQ ID NO: 977894 - protein, 154 aa, Homo sapiens
MAFLGWLKVNDAPGRVHQRLQIDCGDCEDKLEETGVIHRKHGRDPRGATQRTTTVPGSKTIGRGQRASAQDPRNTKRRHCREEQEEGRSAEDKTDENHEETAGEEQQQEETENGRDEHTARQREQQDHHKSWRRPLQTTQSQRNTETRTEHYQS

SEQ ID NO: 977895 - protein, 303 aa, Homo sapiens
MTTPYWTWMPDKLPWWARPGTMTVVCHLTSSIISGLAKEYIRARDQEAHPVAASTMSLTGTVRYSEALNTTWAKGAEPPRRPERRWATCTCTSCADASPGMGLRGDTLRERYQKIVGHQSATPIEVLCESFPEEMATYLRYVRRLDFFEKPDYDYRAECFFNDSSSSGFVFDYEYDWAGKPLPTPIGTSTPTALPAQSGTKPATEKQGVNSPTGADADTPRRRANARYKRCRGEWREQCVAQRERNRARQVPGAGLNFRDLGGLRGWPKDGFDKNGEEGPADQENGAHTRRTHRKQQNNTQST

SEQ ID NO: 977896 - protein, 197 aa, Homo sapiens
MWNLLANRRLGLGKTENKSQMSGLQKQNSKKLYCQELRKVIEASDVVLACWMPEILWVADVLRVEEGIVHSGQKQLVLILNKSDLVPKENSGELAQIIVKKDCEQGVQKAQQQQRMNGTITKRGEGTRRMLLHPDVTPVAKQGRENSGRSGTADASVDTRAQGEPINGAKQTKARGSTGKDHFLERTKTGSTTPGPK

SEQ ID NO: 977897 - protein, 270 aa, Homo sapiens
HASLRYRPREHTQDTHTHTHTHTHTHTYLPGPIPCVAAPKSQRETERGRRGRQCRGPHRAQGRRRDARCLVRAAEAGPGRARARKGRTNPLSGPSWATESPTGSPCVAPAMISESKSTARIVVTAETESPEESKSRASTNISNTHRKRGKHGHLGDAADGCHPQQELGHQQHDARTKVEASTYNRRTDQRLRRHTGKQGDVLRNNNGTEQRTQENNPPRKQGPRNLLKTMKDEIRGDVARQRGDTIDIQNATERLEKTTKNERDGDQHRP

SEQ ID NO: 977898 - protein, 395 aa, Homo sapiens
QSGASSLASPAEPYRSDTMGKVKVGSQTGFGSYRDVLGHQRAGFVDSWLKAGIVSVAIEVYPCHCTCIAWVDMRKYDSTPWQDSMVTVKAEKREAVSVKWKIPSPMLPGSEIPPRINGGAIAGAGVRRRKSNWASITHHGEGWGYMLLGGSRNGVIISRAPLLMPACASVGVNHEKYDNSLYIIEQCLLEHQDAEHPWGKVIHDNYGIVEGVMTRVHAMTAPRRRVDGPSGNLWVMAGGVSRTSCLLYWCRQGVGRHSWSARNVKGRATGTNARCHCWTEPAARNWQMITPQRAYRVKGPPKGTGKNGKPKGGLPDNQRGNTLYDNVTRGGLRNKHCHEIEVVQCDPNAEQTTQIRRDNENTEEKAHGVTKQPQDHVMNTNSDLLTSTSILSNTQ

SEQ ID NO: 977899 - protein, 35 aa, Homo sapiens
MTQIDNPLRRERTKPRTREQSQLERAQPRHIEQTR

SEQ ID NO: 977900 - protein, 285 aa, Homo sapiens
ESNGTMRFMKLAPGHTAMVVPGPAARRLAGPARAGHSITYPYIPDEAWVLYFHHYFPAMLLLKHVDMAFCVDTLHAGSVPGAWPHGPMVRGIHVAGILSTAPGKLATRFYLIPPSWLYGMVGPHGPGTPKSKWQDYVWLDIMGHYEGHMRKIPAWDPGTNPGEPDGKTAPGASGHEGSSIRQPEDTSCWFTMDPRLLGLPLYIGPTPLASAGARARAPITRDHRNGQQPTGDRNPTVPQRLGKMRANRDGTAVDQYANEKTHETTIHETIKTEKKEQTYLVRKSP

SEQ ID NO: 977901 - protein, 103 aa, Homo sapiens
VVGVSVLQQCLDGCRRSFPTPVRPPTSRPSVTSSPHPRTAPRPPLPLQRRAGTGASLRLSLVARHDAPRPPRMVPGATIRTQRPASTVRSNWSSTALLALYLS

SEQ ID NO: 977902 - protein, 633 aa, Homo sapiens
MGFPLNHFCKTDLVKLYYPTPDPEDLRTECQALTPIPDTRGHHSNDHQMTDVSEEARSLSPNSEVTQVFRHADMMNGRRRLEKSDVNMAANGEERLTVVQHVTYRRENPKTHPDYTEHLTIPCEDSKMTGSTIKQEYYQKVRPMDFQPQNMHKQNLQKGVGTLTYIGLTTDATGTRHNTTTKKQVAIARGTLTTSTQVQKKAGDTAHFSCLVFGCTSHLAQHSEDTKRQAQHNTHSNRTCATQRQTRPIPHVKRQRNNSITQQTHNLDRARSQHKRKHSPNQRKRNPQARNKREQPPKRTNKGTTSTTQNLEQRKNITQQYNGANSGDQYTRDPQFRTHTKYNNGQPPPTHKKKHKRNIHITHNINTHCRQDIFTDHIITQDITATQTYKNHPDQTNKQGDSRYTNRRQAKQRPVTHEQTQTNPTRTQHDNNKEQKSSSSTKPRKTEKKNKRKTTNKNNNTMQHVHKPNQGEKPTGETTQNKPQTKTHRTPTQQTTKTKTKKKDTGRYKQPNEREQRRETRIGDGLTATLEQQQKDKKNERRQKPRTENGSKKQRTYNITECNPRDTTTNTETRQEQSRTNTDEKTDHARPQGGGHTTEDNTAHTLNRRAAAYSTRHNQTQTDEHSTQATGKR

SEQ ID NO: 977903 - protein, 220 aa, Homo sapiens
MAGVSFSGSRLELLAAYEEVIREESAAEWALYTYDRWVLMTSSLQHQEKGAMQDAYGTLLRTTRGDVRLLQCRRTPKLLCQNTVLINWVGEDVPDAREVRCARPPWLRWQSGLPGCPTVIVKRQSRRGRPLDAGATRGSEESLKGSLARLSSPGAATDMRGCQTRGCRTQTPVGSTYTGRHGVHPVETDSGLTDEQDLEEQDKEGQKSCGTEAERKPAWM

SEQ ID NO: 977904 - protein, 97 aa, Homo sapiens
MVPGVPQGMPAETPQGEGGHRLPHAQAHSAEGELEKGSQRKEAKSPVDPARCSEQVDWQLGGCSESQSHTPGKLQKSARYLKKRDTLWSESKMHESA

SEQ ID NO: 977905 - protein, 244 aa, Homo sapiens
DVGIYFLTCISAAPFPGHVLPVKSLKLRRPLYAHLGCAFLWVVVAVAMGPLLVSPQTVQTNHTVVLRCSCTREKVSHHALVSLAVAFKRFPFITTVTCYLRDSSADLRQDLRVEKRLMTKAVRMIAIVLAIFLVCFVPYTVNRIRLRASNYRSHGASMRHRQRILVPGETAITSCLTRLNGATSTPSGMSSLAEKFRTPCAKWLCGTRAQGPDPPAVEREEPTESSLSASQSCDRGAPPGRAQT

SEQ ID NO: 977906 - protein, 151 aa, Homo sapiens
MGEPSAAISRIPSSIVVLRSRAVRARGAERESPRSLTPDHGDEELLVSVLLRCTDADSHGRRCEGTSWRFAAISQSQNPTCRLNSMALVSHPEQRVSTWYIEEVVAVTSSLAHISSDHHCKLVRDLTKSIIPSWYSKVRKKAIAIQSLPWT

SEQ ID NO: 977907 - protein, 166 aa, Homo sapiens
MRLRRMTWRWREAMLLLVKKSRDLAIAMWLWLHAVAKTASEMVLAADNFSTIVAAVEEGRAIYNNPETVHPLPHLVRTSGNVVCIFLTAALGFPGGFDSCCSCIWVNLGDEMASAANCTGVQPSVIWTIYEYTVPGSPKERWIMRVASLSVSWLCGCYVGAATVGA

SEQ ID NO: 977908 - protein, 201 aa, Homo sapiens
MGRCMPSRSYSLLTVPRTPSAGPGEGAIDTIEWSPGRSVHYRIGARPGTVETEQGCGVCPALRLLLNEAPRGMLCYEGSRGGCLPEHLEDHYGEVCRGQSGGSSNCLPKGLSIGKSLVADMKAKTVRRGNRERGRRGVTDRFWFGDGHNASRKPRREEVCVSHGRRPRLSRIRPPLVLAAFGGGEAAHDLYRTTKTHMCVA

SEQ ID NO: 977909 - protein, 284 aa, Homo sapiens
MVHLFHAQLWRHLVLARLLQFADVLGRRQSEDRAFRVRIAGDAPLHGRARAGALTIPCHVHYLRPPASRGLCLGSPRVKWTFRVPGPGRQRCWWRGECRVTVNRGPTGSAVALPAYPGVSLTDVSLGRLSRAAPNDSGIYSLGGPARHRLTAVDAVDGQVQGVVFLYREALARMLSPLLGPRRPVARLEPLNRYPGATLLRLPWGAIACDCCGMTAPDGTGSIPTQEKAVTAHDVPGSDIMGGHRMTYDVSHADPYGNGRYTTEDWRQHANEETHALNTRRNQL

SEQ ID NO: 977910 - protein, 252 aa, Homo sapiens
MSTLEVSAGKSDVSLGRADGSPGWTPAGSGGKVRAQRASVGPWVMVSYGGQEQLGLDCVELIAYEMELWSEPPRRWSVLGRSCAGEAGRASWVGPGTKQALMLDMSTHQRELMEELVPCNVQSTRFKKLPVLEALSAVELRANPAEAPAFKGPERCRLNKLLGGRLCVYEIDLSTALRTRRGCNGGAIARATWQRRDARTCSDGRLGTVRGRVHVGVVAAPWGGSRTGPRWAQRDGKDGLNPQEGMCEGVPV

SEQ ID NO: 977911 - protein, 197 aa, Homo sapiens
MNRHASESFLSLRPDGWTDMPSPISPVAVWWQVPCRQGYSKYGGQGFVPRLKVTSAQIGGSSGLIIPITSMASLTKCPGTSTQAAATCQVGRRVVEPGAQPNGRQTIASHTTLLPARTPAATYKGRSQELPSGLEDRRRQDKRRTIGHTKSRHHNQSKKTPHDQATEPNAAPTDKAREHMQHRHNMTTTQHDQPHRK

SEQ ID NO: 977912 - protein, 111 aa, Homo sapiens
MAMNGGEDVAPQVRLTFGPYAVGNEGLVNTRHGWGGQRILSSINHCTRLLSKCLAIQNFGPFEYRYQIPQCNPCKCSPWELILLTRIHNVLKMLAKSDDEPISKKEKRTKR

SEQ ID NO: 977913 - protein, 105 aa, Homo sapiens
MADVKRTLKQTRSYTSPIAYIYIFNSTGSQALEKRRVNKRQMVAHNMELIPVTEHFYDYDTAITTGLAKQIRDILHKDILDPIIKRTGANHTIFLNYPSKIAPTF

SEQ ID NO: 977914 - protein, 317 aa, Homo sapiens
MDRIYRSMQGISGRNRRGEGYIPQVNIVSWIFYLDITKRRHNKKESTATGGYGKHRMKLSHTYDTYESIKKEHKQETEEEADKHYKGDKEKEKEKSTETNRMTKREKRRRERRAKKTRGPHANKEKQRTKQAEEKGKKENKKNEKEDKQQPKRRDKDKREKSEAKKKRERREKQGEQEERRTDSAGDNGGRTKPGRARYGRSRETETRRREPRGEEETPGKSKRRERRKTEGQRRSPREAGAEAGWGRERRVRRVQRRTNTRAGKQEPRRAEASTEDNQQASRRRGPGGEARGREANRESSPNESAEHSTEQHRHHD

SEQ ID NO: 977915 - protein, 450 aa, Homo sapiens
MHSMLGTGGLYPYKNSTEKRQEDPYYMTQGISMKITDTQKKLDRRAYNKKYACNGTEIEHPELWRRTTDYRVTHRTDHMPAPRRPMDQRKATAHKKQTLATEERKRHTEAPVPQPCIDSKTLLTPRKGTTNLKQVHSNKRGTHQNTRPLETLQNKQTSHRPPNETHKNTGSQGASTQPKPPTQYKETTPNDNLGLPPHPEPQTPRHPIKLTTEICTNQNKTRYSHLSLPSFSYTTTTTHPQQKHTTHPHKTTTQSTNTTHTSHHTNKKTNTTRHTRSSQRKAQDKEQSRTQQGKDRETRPNDAHRGPTTKREDRKENNAHREEGERPAREHDNKRKTTAEEAEREREGRRRKPEETRRRRKRTDDSRRERGQKQKEERGRRRDEREKRETGQTERQRGAHRGEDIDTKTTAKRRASDGRTERAKRTRKGERRRKPGSGRERGAREDEKTN

SEQ ID NO: 977916 - protein, 392 aa, Homo sapiens
MTNRLVRAGQELIPPGHWFIPFTYHGCVPTAPNGYEKPIPMAEFFKSLRFEVLFTPSLSGPATRWTSAGDLGVRESGKTAVGQYAHMWPHIARKQGPPQTQDRYSKSRHCDVCALNNSGVNTARRHQHTSTQHRTTEQQPHDLDNNHEDNTQASKGQDNERQGNAEDETNKREKQTEDGDAHAHEEEEGSGEEEGRAAEGREENNDGEAGQTQSEAGEGEQSGARADRDAEADRDQASPRGQEGGEARSSHSNKKAKAGGENEEGEDRRDGGGDEGRKGRGEGQRGQEKRGEGEGEPRQEQRGKTESRGTGRAQEQRERRGQQEERAKKESQRGAKQDKKGAAAEGAREREGEQAGEGEEERRKSRERARRTSSEDGSGSREGNTARGKRRG

SEQ ID NO: 977917 - protein, 719 aa, Homo sapiens
LDLSMPLDQYSPSFPDIADHYVSSVRARIPSSLMRPADRGALPVPNTQFHACQCADSKAPCDVYSFRTPASPGLQHVQACRRASTQRVHVTEAPRDLFALTRATTIITVWTGRPDMTIHGDHSLCWAVLCQPHNIRHQPSRASTLLYSSRDWMRMADRMEAGIVWLVPCPIVLFAPTRRTCFGTRTSALPLVHLEANLTLERAWGTVGGRQNENRVMPKVARSLSLGGCSPVRVGSGFEPFQPREGPSSHVCVGQVTLVLKGLQAKYVEGFRCISVPRGGGGDLLPHYEESMPKWGEIMSRDTEVCITLVSKEPVDQKGLVRESQDWWTSLLVPGGPDPKNGDPGIMCLGTAHVSQAEKFTACERAVTNTARALGHSIITNTRCRHAILSAALAYVVSCSYDIQKEGYATHDHTDAEHNDKKHARLTQHTEEHRNRARRDGTTREKTPEGRDERESKRRDACKTKRQSRERRGNDRKAKGERTRTAERGGQRETDTEEGEESSLRNRRPRPSGEKEEGKGRERSSWRGERAERERKREPEQNEDRARREGAEIEDQDVKRAKTTRDEREQRDEGGGQREGESQRRNGEQIDGKQTRQGKRWDGRQKESTRKRTEQKEEKTRQERSAGRRRTRAEQKKNARREKTRKKDTRHRGATNDDSKSRTDTRDKTRTRRQQKREGSEGSGSEQRTNHTRDSKTEERDTKHNTQKKEHPATERTTN

SEQ ID NO: 977918 - protein, 141 aa, Homo sapiens
MSPMPLAPESLPRVNRSSTVAALSRPPAPVVPGPVAVRTKGQRPRLGVALRTDRFDIPAISRRNGLGNPKAIATRRAMGANRRWPIGWHFGRTGGLRVRKGGRDWPHQLDNTKVANLPYKACNAKRAFSPIGRGVFNPSAD

SEQ ID NO: 977919 - protein, 94 aa, Homo sapiens
RPSSARDLGSADGSMPRTVPGSSMKMGSLSADRNYALFTTCATLRSVMRYSGNRLSDTLSHDAQPRSSHTCSTAYTAGQSTGMEEEAVECVLGV

SEQ ID NO: 977920 - protein, 394 aa, Homo sapiens
MAFLMLTERKDSRLYTNYRKGPKRCRPLRATTTRSLTPVTTLQPKSPVKPATVYHHPLHHRPDLSISRIGLFVLDEPPLPNTRSPLVNVAKLEGSYLFVCQPSSLASLFNSVWISGCSYSNISHTTAPVVARYCGESVAHKLQLNMTVTLYVISSYLSKHYITTVGLPVEAVRPNALVRNRRKNIRPWMHVRAHAFDPFRLLPMDYSLQNDARDQAETPRRHYARSGKCPTLAHQAYNIRIQPQGPLRPPTPTTTPEVPSQQIPHSPKTPKTTNAGIGGTTTTTPAPRNPQQHIRDANPPLTTRTTVNPTDNPDTPHHRTPANKNRPSPPGHDYGSPPATHKTHTPTKKGRRHPHGNEPTQTNTTTKTTHTHDTAQTTRHNPPTTPHIAHQQRT

SEQ ID NO: 977921 - protein, 277 aa, Homo sapiens
VNSFENLELEEKHSSRVSYIPHQTEKGGSDPTFSDSKQATEGSLGKVIPPMARTDPLTTPGKPLVPCKSGWLGAPLTINWPEKCSPFLLCLDSPPHNKDALRPSCLGGSQKKKKKNTQEKKHKTKKKTRGGGAAMIMISPAGGARTPMISAISTQVFVGTKGAAPKYERGGATISRGRASHRGRSVYTQTSVRPAWRENNTGDPARGRHTLWAKSDHTTTNRGGGTTPHIGGRTTHHHTERKFNKPALKEEKTYTTPYNKAEKRGGTTTNAGQNTSA

SEQ ID NO: 977922 - protein, 292 aa, Homo sapiens
LEGLGWVCELHRIHRPQDARPWCYSLCSWSPPRAQSAARTRVSPLRVGRASPDPDSTSGLRGWMEEDPCHSKLPVNKLAAACASNFGYDLYRVPESSMSRTDQSCIRVIRLHDVADVTLSALIAWDAGASNENSIIHRALKYELISRPDIHGTYKDGSLTSVTVAPQIEPLMSASRIVFEKKLRIESSLVAPLDKSYGTRPMSPDGCNLVALDSCNAGSSYTGCQGGSMIMGNGSPRFHKGNFPDEYQPECSFSGGGGSFRGGKWGNQSLAPEKNFPSEEFPNLDGREDQGK

SEQ ID NO: 977923 - protein, 85 aa, Homo sapiens
DAWLELALGRRREEESSRDLWTGQDSEATPPAHSPGPTNPAGLVYYASLYGSTPYDRKAGVRVSIVRPIEGELLIKRAAHNVGRC

SEQ ID NO: 977924 - protein, 94 aa, Homo sapiens
MVSPGAKTCVFPLVRQEALAPSWEHRDVRDGQEEEPRRAVGRNGIASSSGPGTGGLRRLGDKGVHTGEEENTENGGPARRKIGDPQTGRKRSDM

SEQ ID NO: 977925 - protein, 87 aa, Homo sapiens
CVVCGIPGVPRGRTRGLEQCTPPLAAELLPPWRLRRTNAVLSVLDEPERGVYPSSASRGPLHSRRIHQNQTYSSEYRMRRVGDHSPK

SEQ ID NO: 977926 - protein, 62 aa, Homo sapiens
MVLAGMGAAMVRSALLLGGLLGEADLLIHRSLVCSAPLLGPAISRLLLSVPGFQIAFTCARK

SEQ ID NO: 977927 - protein, 172 aa, Homo sapiens
MGSPTRHRLTRAVRHQESTLPAVHTAPLEVPPKITGETIAQLQKANSAHTDTRPAATTPHDNGRTGAADKLGTQHPARTHTQRAERATPQTPCGEHLTDDSLRDNPPTPTHTTNTPRPTTPTTNNTTPPRRAHTPPAAAPPRLAPPRPQPAPPPPAPPHPRTTHLRTHDPRH

SEQ ID NO: 977928 - protein, 63 aa, Homo sapiens
MSPSTGPGQSSLWRGCGGGTPLCGQEVKGPCGRMPMCHLRLLSHLSSGLIAQAARLDTLRGER

SEQ ID NO: 977929 - protein, 491 aa, Homo sapiens
MSYLRLRPEGGHNTEEPGRARGIGEITQQSPSERDLVVSNTQYIAVLGVMTKYMKKTLRVWVHLSVRSQGEKLIVIARRRHVLAELTDALLQCKRHDKDALAKKYHRCDDTMKRLPRSHIFHRILPHKQSSQHRTGMFDQALYGAYVMERTTGRSREQVPAVNKALICGGAAPQGTSVEPLVPGRRRLPVRVHLKRSEHFINLLRYARAARREMHARSSDTCPEIRGLSHAHGGSSPSILRIRVTRLVGNGKSFGRHTNATYVCAWETFQSPQMVEFRPPKLCRVNCGTRTSPPVCEAFVDMPPEGMARYYKGPHTSFSHGSHTRGERGDRLFQRSRSQRRYATKVDNAKMGPTVTQRETSLRHTGNSCVRTPLTKRLDVAPTWNHLLFTSYPSATEYQKRNTFKAALTTQITVIPGRIPNLKHNGASYREDTVTFSVALHGFLCGILGPGKGTGTFEQCGHTMRRSARNYNTQEPTTAGGKRHNMGKRRE

SEQ ID NO: 977930 - protein, 305 aa, Homo sapiens
MAATAMCRGPCGIDGKAPYLPVSPSKFLLWGPGRAWDAEQFYVRAAWYLVEEAEWQVEAGRGAKYSERYKHQSSTAPHQVILEGPRGPEGAFSSGAVGLGLTAVQAMLATINPSLDIYKPVSVVSDLDWGVMVLPTGFLLKAVIVDDRRCHWVPLVGTADEVALIRMTADGRLPADQRRGYKTCVNALIRISREEGVLTLWRGVNPYSMARAAVGNAAQFAFLSHPKQANVDSGYFSWRNLVPILWQDESRGTGPTADAVQGDTGKTLKCQNRGRLRETRTKNRLQTGTGQNKELTRERQQKRPK

SEQ ID NO: 977931 - protein, 52 aa, Homo sapiens
MGRECEWIVDWHPLLRICDGAAGDRKPRSPGPQAWAQGSRPVVHSVLMGLLR

SEQ ID NO: 977932 - protein, 295 aa, Homo sapiens
MYTNYHTGTKHNNEAQIIQQKQGNPKEAIKQKSKHRQTYNNTIARTNNPPRETNKKTSNRGTRTSTTRTQAAIGNNKQQKTTQKATHKRTKQNHKQTKTYQKNTETKAKTRTTRGRNQIQTQTTNMDTRTHNTMDHTTATKTTPNIEKEQHTRSGYSDTDNAKRQANTKGETHRSKMNTQTESIPTTKYYYSHTRNKSRQHNTANGTKQHEEQNDNTHRTTIATPKNTQLRGQYTNTIDKNKEEQYNKTQPKHNGTKNRQTTTNDQKRERHKVTTTNKKKHNTKIQTTTKAEQNT

SEQ ID NO: 977933 - protein, 266 aa, Homo sapiens
MGYTCPQYISYRYLQIHMGAAVLAPQMYPYAVSNSVPGQQGKYRGANRLPSSAGRSDHKTQHKPLAPPDDATAARVLARSGGCHRPYSSYIRLQDLMLDFPRALAYGQWIAMPMGPHDSSFEQPGGLPLYCFRVKPIVNAELSGPRHIARGHLCQSLYPLSTLLLSSLTPMPVYAHCSPVPTSIHMSTTALNCPVMTVSWDNHVPYWITTAVSLKQCVPQSVKAASVRGGPTSVVSGMHSKSVSPRGLVGRCCWAGFLAFLKEFPA

SEQ ID NO: 977934 - protein, 329 aa, Homo sapiens
MGRSPQIQLLLPVGVVAERRRLRIEEPQHEELQAWTASGARYKTGRVGENVHCGPAKAWFLVEKHWYNAVGGIRAVGDQDSSTFPGCINNATLFQDEINWRLKEGPGGRRKTMCRALPQSVRAITCIMLSDGSKSMASHTIERTVIEACPTSRRSKCTQENWLLVRHNDWGTSHTCSVQPYRFYGLVIAHSSGAVLLGAQDDTRLWGTELRKALRIGGMTQHSTGPRWRALRLAVITMRPADECDVPAKAGCVMNTHSNREAHRHDGLGTQYRCTALHPPDRHMDGRGTTNRGKPEQGTCHGNTEEPRSQKGLTQHARTHRSNAPTVPN

SEQ ID NO: 977935 - protein, 126 aa, Homo sapiens
MWMCFPDGRNCCCAERRHVRSSCRHTPPHGRLPGCALGGVGCDRLSLRIARQYYPLPSGWIYALRRELSPPPSSVLLASCTRGLVTWHRALCYARLLSDCRCQDARIVVTLLWLSVIWGRVRQTLD

SEQ ID NO: 977936 - protein, 222 aa, Homo sapiens
MPGPPAASQTVTRQRGDVGGLCPDFSPSVHDPRCIDDRRPVEYRQINRLGETRRIRQWMRRGRHQSQQGGEHVRRPWCDDEQRHQEQRSEIARGQTDHTGATSTSQHHNSGKHRGSQTKRQTLTHGRKDHTDKTTTQAIETRNKQEALPTGKAHAIDTEAAPDARTQPTRTANTENPAKQTTQQENNKRARTAHKSKNTHTKNDTQNNRHQTGRGKKQQTAE

SEQ ID NO: 977937 - protein, 209 aa, Homo sapiens
MRVTLIVQVRPEEALWACHSEVWARGCSSLIPTLLPVTQPFPPLLRLGQPINKEAHPARSQILLVLLACRAKVSGSDFSSVHDYSGKGEGVMSMLRHPSSLLKAAPKCASCIAPVLPRSLPEIHLWEEGCDGRLVTLASPRKVGLPNDCWGRERARWTKVVAPTQFDREDKAWPRATESHSISKIRKKKKRSHQNTQTHKRRNSHTVYR

SEQ ID NO: 977938 - protein, 69 aa, Homo sapiens
WTLHASRPQYCHDVCLECDARDASVDLSGLVLVIEPPRSAQTCLAEPPRDSGDPSRNSRVLHLARVRWA

SEQ ID NO: 977939 - protein, 301 aa, Homo sapiens
VVATMPFSSITSTMHTEAAETSAIVLVNASHQEAARRVIATRDDIGSASVNHAEYRNERMCVNAAPTPAADAEISGPLVVPAWWLQRRCREGLRVFAWRRLQEPLSWNALDHNGIVIYNGLGIGVSRRTPAVLPIQKERNGIPHALGSRRLGPEVLHSPAFDFLCPQSRGHCHPRITYHVDTWSRISVGDQGARQGQKYIPRKTHIRRDVLEILYKTRYMSLHLEAREGNHNWLLTNVVNYAPSVWIVFMVVCHTGKVVFPSREGRKVDRSPAMFYAHIGQSRGYFCKPPAAGSFGEEPGT

SEQ ID NO: 977940 - protein, 352 aa, Homo sapiens
MAKGEFLLSPNVVFMSYLLLEYRGVDVQDPHRLSCPRHSGSWRMVQFTVGRHMPIHTATVKSQHRRGSPVAIASQKKYQISRVVLRVDAILDPGYQNHTSRANIVTFNSTATTGDRRLVPCVMQCTSTRTGGPDSNRDGKPSLSYSKWRKPAVSLNEKTWEPLRAGPVQQKVPVRAKTCVGPVGWDVIRAPRGPDAARTPQQTLRREDTPEGSRSRTHARRRTPGLQRRGATKSKPQSAGNGLNPIGRDKKSDQTHRQTSNIASVEPTHTPMQANNNRGRHISTDAVASHERDHPGIRQHTSSTSSLAVSAVLCCLTNRQRRQHVQHRDANAAEHKAAKHKTTRTEQKHNNG

SEQ ID NO: 977941 - protein, 245 aa, Homo sapiens
PTRLGGCPGRCGGREMAHECLDLPVEWCPADCGMRGMAHEAWTWWSVCPGRRVRGTGSQRLGPAMDGCPADCGVTRDMLTRLGPAVEGAQQGADALRGGCSCCTGVPPVSSDPVLVPPPNPIPMQNSQVTCTYVHGHGGWREEAWSGPLGAAGRNGRWGACVAVPGSHPAFHPVRSLHSCPESAKQPEETAGGFLKDVLMVDSGSTEYRRFLSSGRLEEGDTKELHDLGLMTGGQVAELRLEGWG

SEQ ID NO: 977942 - protein, 187 aa, Homo sapiens
MSPYSFVRPTYRMRECRASRRIRRRTLELANTIDKSCAWRRVQSRCREQTITKKTRLPLYGKSALQCLLDVIDIGLAPKLNHIVTILLSNTEAIYPSWVIISREMANSHDRMSVGRTSYLHAKKAASLTHGLPEMNTPGSTEIYRSLWRRDLNPDTHLREGYRGLEERGTLKQNWPPGYAGQKGYKN

SEQ ID NO: 977943 - protein, 155 aa, Homo sapiens
MASSIGNTSRSCVPIVNSQGLVIIVDPAQVALVALLNLGHVELVGVHQLNAACCIRWRHNPAVIGACCVGHHLFVLTCGSNRTLTRLSSWRTTQLLLDIRHYSVVDKLDTLAGPRELRNIVQLDSIMNKCGATNVECLFTQMQKSSGTPIHKDPQ

SEQ ID NO: 977944 - protein, 142 aa, Homo sapiens
MLVPCGVGRNWGAELVPCGVGRMGGQCWFPVVLVGWGGSAGSLWCRSDVGWGSAVFPVVLVGCGGVLVLCGCWSDGGTVLVPCGVGGWGDSAGSLCVLVVTGGTVLVPCGGVPSCCAEVEGILPRPKEPLTFTVSRRYVVCS

SEQ ID NO: 977945 - protein, 62 aa, Homo sapiens
HAVGDEVLGGIEGGCLDPSCGYREVKPTSMAQGGRREPDGELSEVEGRGMVVGISDGIAGDA

SEQ ID NO: 977946 - protein, 383 aa, Homo sapiens
MGSVISIRTIVGSVCNGSVTRCLCSRFRWTRLWVRHTHRHRRSTEKWLATWLQTGVSDSCWSRLMGLCDKALRKRVYRPLTAGITSSEVKVTDLLTYAVVPSTGIFGGTDVQIYICKRGTESSSLLQSIAGCSTGVAFGDDAKVHQHANRQWDRGLKVLQAVGPGPSDWKLGLISARGVELGVCGAGVAGAPDWGPAGGSVAGWRIPHLCCHLGSLIIGGPMTQTSCRCVGRSRSFAWSISRGPEWEVRLWDCDRPWSPSCLASSGRRYPRAYSLLCACALACGGWAMCHLQFRVCVPALKMRSAGPSASVDRIVHLLSCASCSVHCLHARKSGAERAGVCSLLCSFAAAAYVFMRGVRGHVRDCSCVLPSDQIFALYTCSVS

SEQ ID NO: 977947 - protein, 171 aa, Homo sapiens
PTASGCAERSEGFVAHRSFAVPAATVSTLSVGSRRWWVRNSAIAVLVVVRGPVSWGTAVYFEPQKYEVSPTSRTGLRGTEDTESRKRRPGERAGRFQGVPDLKDAEAVQKFFLERNYSLAEELTRLRGWNMREGRRTIVTNAIAVCGAPAAVTAGRVQQTLPAPVFQMLLS

SEQ ID NO: 977948 - protein, 125 aa, Homo sapiens
MGGYILWWCLCGDNIQFIQERFPATMVPENQYMDRDNFVVHRIIIKTRHAGKSESTQGKIGYVTGVRGPWRFIITVTEPCGKKQSRRHTNIGDRGAGESGHLLRTMKERLQTKSSGDESVHPRIN

SEQ ID NO: 977949 - protein, 230 aa, Homo sapiens
MDVVLVRALYSGGELPSGQELSDPSVPAGVGCAVIDVELMARHVVQPGYPAHRRIVEVFGSEVLLENGDIRDRKVLGDLIFKTDLTGGKLLNDHQPTPRFGKEMMKETFKYFLRGYRYVILDITPAVETKKLAQSTGKHTGGRYNLGNRGHNRWHGVDAEETAWKPKNAKARNPMPRCPDKEKARMARLSRKLGEMECTQRHKYNTGHMSGKAGKRQKDGTKRGKKPMNN

SEQ ID NO: 977950 - protein, 102 aa, Homo sapiens
TTRVMVARRRRSELPGPSDLPPAGAQRESQSGGGGLRRLGEPIEDFPPGHLTMCLPWAASATGISVCWACMGHGPGLVDPQCKLAGRPLCKEEGLGPFGPTQ

SEQ ID NO: 977951 - protein, 197 aa, Homo sapiens
GAFSGPRTGLARGLHLLKNQLRALAVLAHTQAAGAHRPQSAIPSTVTASVLPLPRWLTGLNLRVGATAPPLPMPVDRRVKACSCVSLEKTARAGLQKGQGDTSLQAQARRSPHQRNDSVEQIRWGRRRVVSEHVMQAVSCAGSQPGGSYSATRNRLRRDRVLAPMRVVPPAGASGPLAEGSRLSGRDTLPLNKMDSN

SEQ ID NO: 977952 - protein, 166 aa, Homo sapiens
MSWRLIPQEPQGCYLTITRNNREQSQTKSTRQSPPGEPQLNKRQHLGEAPYRPATAHHPEEATGKHPSLKGPASAYTTRGGRNPRERENNDHIPLSANKGDSNTRKNTTTGPQKMKRALTQPDRVPTHVPHNKHKRSRQHAKAIPTRHRGKEKNTTKHRNNTMNDK

SEQ ID NO: 977953 - protein, 138 aa, Homo sapiens
LLGTGDACCHDRRTCLQVIHLSVDSSTPSDHQLIFLARCTSSMYVIIGRRSGSLGEEERLLMECRILLPGADDVEALIASLRMQTTLARLRRIVRTSEDLGNTRTCAQVGRDNSSTRSNSRSTFAPSNRENPLLRRRD

SEQ ID NO: 977954 - protein, 473 aa, Homo sapiens
MWPAGPPLTQHVCRAAELLCYTNYYEYCYCYYRKHTRKQKPANQMTPLQHTRTRTPTLTTDQTPPRTHTKNTPTAGTRPPPQNTQHHPPHTRNQQSLPPHHPHTAHHHTATNQERAPLSHPATPPPPPPTPQAHTSAPNAHTHITTQRSHEHPPRSTTLDDAATTIRPHPPSPPSTRDPPPNTPPLGRPMHTPLSRLAPLHTEPYTSNALPLTHRPTPSTRPQHYPAHPHPPTTRPTPASPHTLKHRRTTPPTHTPAQTPSRSHQATDFTSPLRPPSTYKSSHHKTTTTPPHHSHHLTTTHSHRHLTTPNQQQLPPSTLIQHTLTLFTTHLVTTPTTHHTTLHNTNPKRYNTTNNTIHKLTTPKTTAASRLTGTRRAGQEPRVSGSGEATVTEDDEQRPDDAPSHAHGYGGRTADSTYPPMRHHTQVDTSGAVVSASEAITATQKDNDATTERGLTISDRRGSEEQKLSGETD

SEQ ID NO: 977955 - protein, 295 aa, Homo sapiens
GRVGGRERDARELVEQMRRPRRPGGLGVDPGVFRLLSSGLPACVSMAAPCGVLAMLHRSMLPHPVLVILIEPGVVLVLLTLARSCIHGWLGLGMLPVWDRGGKAQDAILATSTIALSSSLERRVAHGCWLPETQRRVLPQRDEFPCANCNGPIYPHAYLLHCYFEGLDWRTAILHRTSARTPKMAPVAHRGDQVYWALVHTQKTTLGYLDLVGRLLFTIVNSTHNRGQPGPLVGYSAKGKFLGGIPTKHYHQDEWQIWSLGSLSVRSRLAFILANTRHGKEAMEAWRSPGTLPTV

SEQ ID NO: 977956 - protein, 248 aa, Homo sapiens
MNDTCNYVPARQRTDVTIWSLGTTGPCSLGGKNCPKARDQMWYEDALGFQVDPIISVTCIGNARYQRTADTGVDALPGADVPWLPCWSPLTTEVGVPRGTAILKGVADPMRPAAIWTGTKGEVVDTPGHLLPTSGRVCHCVRTRTKNPQPQMEPQHARKDPRITTRRTTTQQRTITRRNTYTVEHRHTVQHETDPGGPPRTDSRPQTLERYQEPLTANHTTPNTKQQATDATTTALSKEQNDKTANNN

SEQ ID NO: 977957 - protein, 535 aa, Homo sapiens
MAPTVRVLVDYGECQRDGGVSVTSHATVNADETCTVQGNGADWSEALRKSREMHGTIAVGSQRERGTAGQDSPVPMGTGLREPERTCSHEATCLKHTRHQAGQESVRDGRLGSPCLLRAYHLQDEFGVRRFARETTDACWSSQDGDPHAGPEPMASLAGVAVREPTVTGLGLDLSRRDPLLSFDSRCYLVSLGYLGGSPDAGLGNRRLPMTERPAARPRARETSIARTPAQGPAAPRKRPASNSSTTITVFTEDHHAGPRTTVIHVTSGNIGAANAYSDKFFEDDRKNPHRARYTPTNYSQTVDRKSATHEKLGSTYINTTTQNHISKPQAPPTPQKRRAPTNPDKNSFHSTNIGTTHTVIRGGAHARGDSAELGRAHVRGRRTRAGDEERPIRRRVGVFEYGDDELLDQVDGDKCGCSEVRERGRRMRRWRREREQQIDENQEETSIQKDLTERIASNHTQGSKRSHKRGREDQHVSVEDATQQPTTQTTQTQKAPTTTTANIDAHQHQAHNQHLNHRRHNQDTNQHTPSQSTH

SEQ ID NO: 977958 - protein, 289 aa, Homo sapiens
TLAHSPSQSLAAAAGLSRAPGGDPRRRRQDFLQVASEPNPSPGYACSSGPRLLLLPAGEAAGRWARLLLCLSRSVHGRRTSLMMDLRYFAVRICGADLQATCRGCDSAGSPHRSLCHCPSTCWSPPEPAVCLCLGRLRCGSTVDYSLSLWDREAAGAWCAAGGGARTESERGPYPVTSGGYVLLTHPWLNGVSLAADSSLASKRFRVILSTCAQSNATVTLNDCQSTLVKGDGHTGVVFSFYRKGLHAAYALSPYTGVPMRPDDRNGAHNWHPRHINAHTWRHKPERRS

SEQ ID NO: 977959 - protein, 443 aa, Homo sapiens
LDPRRDQPPRSRGARAIRVCCYASSQRAAAASEQSIPQVSEESPHAPRSTALAGRNEEPMEPRQSGSSTDVQRTDVTRPRAKPSLPVQSRLAWTPCGLDDATEDWTMRHAVRGPHGTVCRKCPGLWMSGYLTTPGRKTKSGIDTADMDTGSMTPRSASSRDRHAPHADPRSEHDETRLTTRSTLTHPFGRAPTGPLQTNRTAKPTPAQNPTRHRSDPTQQPPPPRPTTDTRTHTPPDAHPPARTTPNHEQPPGTTTQNATQDTATPTTRTNHTSHPRHHAHTTLYPNTTADNHPYTQNKAHTTDKHRTHKRKRTTKQSSANTPETNKPHTADNVHNDTYTKTQDQLAQQHKPNKTQTQHNQNKRTTHTTHKPTQDKPTRHKPDNNNTQQGTRNNNDDHHNHATQTQPPPPTNNYKTTPITFTHTNPNTHIPKPKHNTKFKHNH

SEQ ID NO: 977960 - protein, 221 aa, Homo sapiens
AGSRQATPTASSSSTTPGRASGGSMRASRLQQVPGLLHRMANLMGIEFHGELPSTEAVALVLEEMWNVQPGPTSWAAWRTRVTDDRCRVWDIMDEFGSRIQHADVPSFGDGPFLLQCRQRGGPYTAVVWPTEGHLVTATKRALTPDDLLWTLTGTHGTRSRLLESWDTWHDCMPLVPPPDMLDLSSCTPEPAAEHYQGHSGRKTRTKLATWTSNPVECSPP

SEQ ID NO: 977961 - protein, 257 aa, Homo sapiens
MNKRYYVEACVPGARCLEQIYPSHDVCDGTGSYNIYKSHGYVERYELELVRRRVQIVPNVNHHFHKHANERWLALGDKSPVRHGERANVDPLTLVHHDRRNADGDAISALNGGKGYANADLRTVERNWVRDFFAGGNLNSKHPEVDLYVGRQRRRVTVAGRHLRRRYPPIERYQHWFVHKRLNNPRPDWQIFPSPSRLDHPKCAARTTYGDFPVIGAQWAANLRGGHRDIHPLRICVRLGPFEPSYTHEERLVQPLR

SEQ ID NO: 977962 - protein, 417 aa, Homo sapiens
QISHSVLPSLRRSRLSLPVASGQNEIARACVSLTSGSRPCVNTCGFCLAGRRRPRSQCFASIVRGRRPDQPGRSVAACDGPMNGLPTSGPRTSPEKHRRASLLTPGIGTPVDVDGQSVTQHETEHVMNDIMATTTLLTRQTLAPMAPRRSHAQVASMSRRPPPEPPKAQTTRTTTDSRIECYDAPFQTTLRVQWYRLAHSKGPLLVSLFNALMGRQRLWVDMIQLRPSVRGTGGSIHECTGLSSSSYPKRDLKTPSRIKVPNSAGRIWGIPVALSTESKLLKPENKPSNLKGIAYNFEGTKGAKQHLRSERPHRRHRKPGGKTPRGAPRKSIQKREEKPQESSYRSSSPLKHIERQQHKDDDNTQPGKRTDNTFWERKKTNQEQRPPTVEPTASIYTTWVVEEDTGLRDGPQRDHSM

SEQ ID NO: 977963 - protein, 332 aa, Homo sapiens
MGRVHRDIQSECLSYACRLEWGSVVRVIVLTSKRSANLRTLAQYAGGIVKELTPTVNGRCAVYTINTMIHKITYPKCNAIHDGKATLSSTSHFHLPRRFIFLNNFPTWDMRLEDENMTDEASEMFVRWHELQANSSDNCYHRVYKAESLVSSGLMAVGVGSRALITSPRRSSGAGRRVGQGSPGRGHGRFWRNQSHLPETNKLKTPWSCVPRKTKARSCTGGGTGGQGRNRPREGGGPQKRFNGGNAPRVKPRADQHSVCPHEESQRGTAVQTKRPKGATGEPERESHHNEDPKTSGKASCARYGASTLRATRETLKFTGGGAAPHIAHKLQ

SEQ ID NO: 977964 - protein, 301 aa, Homo sapiens
MVAPWTDGGWSMVLLTCCDPRKASSLLTVWFRNIVVREPSERDGSGSTRFGRRLPRGVGLPLVLKVRIMWAPATDPWEEGGPSTWKPIHRTSLDEWGVYVEAHRGMCLVGDIVGLVGAGPVTWLKHWVTIDHLQSHAHNMRCDERSRCTALVVMSGRGGQEPGLDLPKRGAEVLKRLPESDPQVQGILRGGRGEHLIAGDREPAAGGILLDGTGGERPPAWIPMTKSGPERPNQETVVETRGAHDSNTPDTPVDLGGDTTRREDNRSGESTRVQSTIMCDIVAARSHLILSISLPPHKTRE

SEQ ID NO: 977965 - protein, 228 aa, Homo sapiens
MTLATPLTVRQCEVVRPRLKAPISYYYLHHKTSCTHELVPTLRLNQQMQFPDVLNQTTFTGYTTGGYTTVNALNICGAKPEFHAQSPKNYSPKKSLKVGPSIYPIATPSNPSRGPKTKNIDNKNKPNTKTNKNGTQKNGQRGTKTGPPTHRGTQGTHKKSNSNQKHAHPQKTPRRRPQAPMDTDKTTNYSREYNDRTHPTKHPRTKHKRSTDNTSKLRKKTPKLNNNT

SEQ ID NO: 977966 - protein, 182 aa, Homo sapiens
MEAYPRARWQVWMAPRGFLGSTDPHVTYGLCTDGQGHSVGQSSVLAVSRSRGVTRSWTTSLILLDSPGWCTASHGRGANCGKEPLQERPGIRRERVAHGTKVEPHTHDPCIPDSRVRHTGLGQTGRSTSRQPGDTLAKRCLGLTAGRNAGHLPNVKPEVRQRNSQGRTSRASEDTERTTHVV

SEQ ID NO: 977967 - protein, 232 aa, Homo sapiens
GAFSGLRTELQSADMRAKNQLRWPAWPAQVSARLGRSIEPSARLAPYSRSCDSTRLLPRALGVALARALEPHAVVAWPGVLPSRRPDCSVWIMRAERGLAWHDMFVCHVSCPVGLVVMSKDNGTKSEHSSRPGLPRAMAERLANAKMWRATRLVSVRPTDQSGSRAHRGTAKVGTGIYLGTATHVKPRGLAFPLVRYEKIPEDHRDVAYPVISFRARAMVEDQGASPEHGAR

SEQ ID NO: 977968 - protein, 240 aa, Homo sapiens
MRSRRKREKGFACGQAWSRTLALDLGSLSVPQVPGGVLVASRRFFEVNRETGEMFVNDRLDREALCGTTGLLHCILWSRYVENPRGAVQRWQVVIQDRHRTSNPCFTYPGYDMEISEAVAPGDALFRIDERARSRCGEATVLTKPYEPGGRHDGTTYGRQSRWQNTREETGATGTRHHLDACERGPPDTRKRRRQNYTQTTRQTLIPARDPTRDKHHAQRAVHLNLRMCESQDRSNRPAI

SEQ ID NO: 977969 - protein, 101 aa, Homo sapiens
MELLRPCHRYSSLPYVHTLGHNVPIFKLRVSTVPDHGNQRRRAINSTINFSGHTSNCHIPNNRAKTTMSNLPRIQPILEHYLTIATRCEVMNVGKGRYATQ

SEQ ID NO: 977970 - protein, 304 aa, Homo sapiens
MRSCCGQWMRTVCMWSALGPRPMQSVCDMMPDEIVVQISQFASSEECEHPNGNDTRRHAAIDRMSATIAGLFAPLEMQSPPELHCANLYAQQLTRTPLPFGNFGALSVTLDDAPQSTPNWTFGEQHKAPLIWSPLVTQETTSLRHRAIDRIHLANHQWTAALGTIESTLRGLNPYEPPGTHENTMVIGPTLAESPLAFGPKDTHQGSTKGTYTPGQVGTPPFLWTTYIPHTVAYSPGRRYSEAHIPKASRSPRPNYYPKALGPKSIGPMGTLTTHPTNDPVKSGATNDAGYSALYAIAHTYPLK

SEQ ID NO: 977971 - protein, 328 aa, Homo sapiens
PRVFCAAAVCVCREDRSRLSLRNVFARFLEEFQCGADAPIFSGACSNNLVARLERLGPVCGDKLVCSCVSLYAAGARHEGGQPVVTIAGTVRVRPVTVSLRPACLVCLGPRSDGGVALTVVPGWSPSGCGKLRRMAGATGREVCLVGTSEGEPPGYSVRQKKAKARQGNRARTGRQDEGGMCGATDCDVPGTSSRCVMLKRAHGKASERDEDRCPVWELVLPGERCCPVVSLVDLVYFRPVGDSKAGEAFARIVGSPSCVVNESHSGIACTGPPLVCCFVGDNLWPWVGCSSYLGAGPYAESVTVPRWLHEGGNCVSIPMEGPFGGVS

SEQ ID NO: 977972 - protein, 77 aa, Homo sapiens
LARHVAPPVSPGPKLFPVHLGPMPLCWVIILMSIMPRVGLRLGYLHYWLVPAAYTSDRSGSPMAAGTMSVVPGSHEM

SEQ ID NO: 977973 - protein, 266 aa, Homo sapiens
MPLDKGTWHRRPLDNKMTVKGFRSKKTQERINKKDGQFNTGDRHIETRKEEQKGLSQQVGKKPKGPTTRQTGKQGHHGDNKTNTTMGPFTINGVGNNAGARAHKTARGKRGEHKYKYLDQYMPFEYGEDKHGGGHIFTPFLGIEDAQPPGDKMGNSGEYDRNHHHKGHIHNIWDKEHTNPVQRQYTHRKGIQKKDKKSDYTHRAASTGVDPKTTHERWARNHWTQENDQTRHKTKMGTQRTMDITYKENIKQRIGRQQGELSKQNG

SEQ ID NO: 977974 - protein, 230 aa, Homo sapiens
MASPIAGYRLRVPGGGMWRSFGVPRPSALSGRRHSVGGSPVSCGLVRRWRPCLGGLGLPPLEGIWAHTAQLHSCSLTPFDTLGAAVATLSCLPCCEAFRSPAGPGGSHMVAPPSDRFSGGVLATCGAAWGSPSFGSPQNTPPLLGDPTSDQNDCIIPRIKRNPHLGAAKAHLESSQQFSHATSSTTVGADNRGTSREESGMGLKGKLRANLISHAWTQEEIACDHERHVE

SEQ ID NO: 977975 - protein, 209 aa, Homo sapiens
GQERALLICGGQGDRTKMWGLAVVSQLRKPLPSFCVGQGLAAALLPPRLLRLLGLATGQHCRLRLRWQEPPRKPRKLTEPKTGTSPPRVFAILLTWKVLGKGGVGLSLEPQGLFGGGVGAHGRRAGALAGWAQGLHQGQETRELSIKGRDATRRPKPWAGEGKAPGMGQRPVCASVESGHPFSCQKNRGSPKSLVPSQVPEDSHTRCLT

SEQ ID NO: 977976 - protein, 138 aa, Homo sapiens
QDELSWNRRELVSRLPIMRVAQVSDVSLIVLPPLFDTRESVVQGTGECPWMYIAPTSSYVYFLSSLMAILLFMSFVSSCNDGHAVPRVGLGDGAKAVMWPTNKVPRAAPVHLVVLCCPMLTIVLFLVLLDLPSSAFTP

SEQ ID NO: 977977 - protein, 281 aa, Homo sapiens
MTDLRMFDRMRLDTRAPFYLLGPWPTGAQLPCWGLQPGWPSPLLGNLPVGGAPLGLSLRISPMPFGPHFSLGRLAGGPPLVPPQVPPSGPPNSPGAPPGTAFLPPPSHHLTQTWRSSTKNCPPVVWTPTAHRPCRDTPTHRRRQTRRAPGAKPHLSADTEGTPPSRLKTIVQYGTTLTSHHSFLANTNAPRDPSPDAPPLATNPILSKQLHHNYPRHYTTSTIPLCTQFNTQYQTHATHPQLTTLQKHPDPTHHVLTRHYSRPHTPLKTTQKHHSLHSTTT

SEQ ID NO: 977978 - protein, 127 aa, Homo sapiens
IWEVLDCPFEWVCMDAPVADTSASAAGIPYKGGCAIPLQHMCARISTHRAVCGLLTCHTSDSVARDLVAFSSDGIMIVTSIHRCAMNNDDRFDRYVKRKVARSRAWSYNVKETLPLSLHRCAIGRYR

SEQ ID NO: 977979 - protein, 170 aa, Homo sapiens
RHLGVQCALLGSPIPSYAWNSPGQEAWKVEGVNRECACVSHGAGWGAGGTWAGGLGLAELASVGHLTAYKCMSDWTQTIPSTARSAFGTLSLPLQAPDPQSMACPLDQAIGLLVVIFHEVLRQGGGLSTPLSNEGAEVELIHEGRSPLARTLQDAEIVRLMEDLDRNKDQ

SEQ ID NO: 977980 - protein, 53 aa, Homo sapiens
MAPAGGGESSAGMSHSFLTGGHQTSWIEAYVLSPDMCLWHWWAWASEVAPDPD

SEQ ID NO: 977981 - protein, 296 aa, Homo sapiens
MPGGDALMSLQELHWLELGCFLPGDLVGHVGVWASVHGGDVGTRSDSQLRPRRGILRDSDPSEHCASRGDGWGVRVVSNGPLKFDMMPYLANTSPDGSVNWLLCTTSQKSRLDLEQLKQHWVTWARQTPEQGTAETFLKRGKVPHPRHLEEQDDGQLSIKEQHREMSIQIRETESLDQAAGDHSVEEGCAPRYTGYDCAQVMKEDEVHITEPEDRENWRAGHKKRTDTKEQRNEHKGRPNTEEAPRRQTSTAFSEKRAPNTIAHKTVQKRREATTTAAREHRARTEQKHQQTREHE

SEQ ID NO: 977982 - protein, 456 aa, Homo sapiens
MANEEDDPVVQEIDVYLDQEIWRKKHDIVTYQIPVMRSSRRSDHTERPFTHHRQTTDSKPKTDSKGSAALAAEAQSGTTPATTNTSLASPAKQGADQHKQALQQMGQGGPWTAAETGRKDKDEQNKEHHQKDDLDSATTKDRRTHNIHDAPYTSQETQHKGTSTAEFNTGEDDNGPRTVDKPPVKQSRHRRGNGQGPIPKATLGKHKAQYVTQHEVGTRRFPNGRQDTWDTVGKPPNSRPVLINYRRLKTTRWMQTIYYAGTDGNHVNMTKEGTTPAGGRKTDTTREQQQERGITPTKTAAPCDTKPAGGDIGKQTTYPRYDYRTTHQRQGTQYEDNTGGTRDETKQGNTDGETIGVLTYNKSSPQRETSLAKTAQRKLGTKESSLTSTNHTTTGEDNPGQDNGEHKQRQNDQSEGATPRGQPREKRAPHGKMIGARTAITTTIKIDTTEDYTPNR

SEQ ID NO: 977983 - protein, 264 aa, Homo sapiens
MAQYKVGFTDSRVQGTMDIIHNARRDMGWVEPKNNLPSHGVHPDSLDTKRGDETWVGICRRWERRRLSDERQSTYIFDGPPPQCSVDTVNDMGQVSGGCPRERNIKAKAVPTWRNRWLHYSTYKRGQWTRKGNVPPNALKRLQNPLRGQHGQSRYQKGRDMNRGITLGRNTIQKGTPWDQRETTHRNIPQTPQDTKTKNKTVSGAERHSEQKSPLQKGGPKEYVKSAHTPQTSTGTPKGGDPEITGRPAITIETSAERGKAAGQ

SEQ ID NO: 977984 - protein, 354 aa, Homo sapiens
NTAIDPLLGSSGERWRARSGQRRDGVSGSGGARIDSDEKNLLEQVVDQGAPRLRQWAEHSGHHARTRAYTPCASLSSPCTGAARRGLLKWRLATNSGSKTRYLPYVVVRRSDATRKYVDMEVGDNYHPTPVRQANAHDYGKGHRANTAFDHEIVARTRIESENWRDISWGRTHLTSLSKPNIGKTSAVGSGAFHGRGKASCAWLGVAHATWLGAAASQRMRAIRYSITVLKTVSGATGQSKCLCDKSPFYDHPLMWHLTTAIRQVISEEALVAEAPLALDWHPHWNPAYTQRVAGLVPLASGATVIRWEGLAPRVKAPGNVGVPPICDTPAGVKLVPGATQLGHLARVPLKADT

SEQ ID NO: 977985 - protein, 117 aa, Homo sapiens
MHYLSRRLKRLFSQCAHITRDVNYGCIIRYLHANGSLKYSLSASSYTSGEAYITDLFLYSENLKHSAVILLLATIAGSLHRLCPPVRPNIILRGHEYITSLLSAIPYIGTDLVSMRV

SEQ ID NO: 977986 - protein, 115 aa, Homo sapiens
RFSCLSLPSGWDYRHAPTRPADFCVFGGDGVSLCGQADLKLLTSGDPPASASQSAGITGITGMSHHTQPNVFKFLKLFLLGVMAHTCNPSTLEGRGGRIHEIETILANMVKPRLN

SEQ ID NO: 977987 - protein, 75 aa, Homo sapiens
MIITPNGSTSGTLTSTTRGGRLQQRFSTAALGGANEENQRNQASGRTSHSGTVNSGSMRRCPTRGTSEWDNSSPW

SEQ ID NO: 977988 - protein, 269 aa, Homo sapiens
PHDDGWQWLVAAAGISEWLLPGGVTQAVAGLGCVVRGCVGSSSRVMRDYDLLCGRRGDLGVPGLCQGWPAQAVEVKVSCGGLRGTFSPRHPRGASLLAPAVNVVLASPKKLMHQCWHCWEACSKMPPTMAGSVAQTVPHDWRKDGTKLFNNHVKILELGPTRGPASGQKKSPYFNIKASFVDDATRFAAVAKMVGTEILLSADHIIICYWIGWPRLPQLQHRKCAFENTWNHHVIEHLLAVNGIPWKKRWSVGGPGYCWGLGVLVASST

SEQ ID NO: 977989 - protein, 103 aa, Homo sapiens
LLVLLAAALCHGPAAAWAQPLSEGARSVPDKNVNRSQSFACAAPKEGGPRLLPPNAAPARAWLVPTWRDEPVCLTPSLSDGLLGGTWAQCRRAIDLAWQLGHG

SEQ ID NO: 977990 - protein, 149 aa, Homo sapiens
MKSPPDQYPAGFTEPVARRIDLDQVPYFACRAYLTPVSYPVLICWYLSMHSILDLLPQDHASSEHRAGVGGPLFDSYMLSSDVHGHLSCILDTSGSDVPPVCSCCPGKYGRWNPGCPGGLRGARGGVGPRFRERGGRFCPEGSPRGIYT

SEQ ID NO: 977991 - protein, 327 aa, Homo sapiens
CGWRAAGVLAVTAAGEGGGVSRAVALAPEALTMDEEYDVIVLGDRSHRMHPVWCITVLCNCVTECVLATCDRTPSTTVGAMSSSITPLCCELYKRFQLLEGPPESDGPMAETGTVDLIPKIPHGITGQLVKMLLYTEVTSLPWTFKVAGGHALSTKRGATDLQTCRPPEYLTASGLPTLDWGHVLTKTRAFQPSSMDVMRQDLRLTHDPQAPTEGALDPPELTQAHALTSHQEKSAPRATASSSELHHEANAPWRATYQSTGNGRPMGHKTRGGMEENGKEQALNQRTKEQDPDGGPGEKDKKTPSKLKPHAAQSDWRQHGAHGRMA

SEQ ID NO: 977992 - protein, 464 aa, Homo sapiens
MGTLAVCILHPIRLLRATVLMLCLACCGFPDTRIHTCMAPVITVHPVQYMVMLNVRQPFVGHREISVEREHIQKANYQSKKIVHGSNCSITSHAHRMHSPMNAQKRRVYIRRLTVNHHPQDLYKEPSPREEHPHRTRTNEEPKTTGPRRTQPRRRGDTHTAEQEDGSERARRQHNKRHAPATQPEHDRRGADMNKRLVVPPDVVEDGGRAGQKYIRRRREELIWEQHEVQYGQERVAGTKPYDDRRLCPKDYTQEEQKERQMRGKVHTELGKPITDEEFDEDIGKDECNIDNKKRRVEDQAIIHEAEHGRKKAAASTRGRGTPGAAGPDARDGGTPGGRTAGTGAPRGGGGRQPSAEGRAEPTRAPREERARQRGGDHATETRARQPRTRRAERQTRGTAGAGRGGGQTAGQSRAECRARETEAPRDRGSDRGAEERERGEEKREERRGPERAATRAGTAGAAD

SEQ ID NO: 977993 - protein, 177 aa, Homo sapiens
LDLQVVLAEPAPGPPDGPHLPIQTAELAPELVISNDKRSFCHCLGRVLTPPERRCWRPVLPGTPVNLSCSEAGRQGWVPNLRPAQLDFIQMPFLETEPGAQELKDCELVALKSQSQLWLTRLGDVTLTPIPSPSSKVFSERGTGVDSEWLRLPRSYAKRAAAERGLSGLLGDKVLLP

SEQ ID NO: 977994 - protein, 221 aa, Homo sapiens
MRRPEDDDWDEQVLQESRAMVGSDSFHVDLVTIVWMNISFLQRSSDNCAESRCSLVPAADGTTQRGSEDSTARRCTHCQSTDGRWQRQRRRLNNREASPLKTKESSPHLIWDCAQQQLKERTSADQMSSLRFISQEECEGPGMNMRGCFRASAVQLPSAFWARLYLLFPLTLAPAYFFNRSGLTGDTTGGKAPYSRGASGRWVLGARWAELGWDKACGLYH

SEQ ID NO: 977995 - protein, 362 aa, Homo sapiens
MDDDICRARRQTTCSVHVQGLASAGATDAPLGRLPPPSVVAPQCTSGCDVSGMGHEGFLCGRPRPMSKTRHPHPEVPPYEHGIVTNMEDDMEKIWHHTFYNETAVWLPEEHPVLLTEAPLNPKANREEDDPESCMRPSTPPAKYVAIQAGAIPDTPTGQYHWHRDWPPVDGGHPHLCHIYERGTATTPMHIHAYGPVLGRDTDLEYHPEESSPGARHTGPPSTGRAEASRAWPLKENGAHRQPCNSTHQKGQRWRPRPPRQDSPTHAGTDTAPHGKGGHGPPAHQPPPHREGSPASTKHHNTPWQGKGPRTPPPPGERAHTAPATRGHTTAPPHDAHHSDARAPNDNNKGRDHDSHAATSHD

SEQ ID NO: 977996 - protein, 178 aa, Homo sapiens
MLLEEEEVFGPEPFSGNLSLAYGCSQSSLSLETLANTHKQPPSEASPTHAPHSLGPVVCFSGYTSLGGAERVGDYPSQDRDFRGQGHHIRPQFFLGEFHDLLSRGTQLLALAQSLGARTKMVSGELEGQLVAPRALTQTRMWVPCMGNPRVIFQMDRTREPGLSWYKPKGDGDGGYNN

SEQ ID NO: 977997 - protein, 376 aa, Homo sapiens
SDPAKRCVLESLRPCGPSATRGPPVPRAILRAEPEDYWPTASHRGCATYAGLRSTDVPQAFDPQARVCAMARATTCQCKGVWLDGPGGTLLALSKSHFYWSVIHGQQAREDLHSSLTKSLPRTGTSDLSVSEEFKDVLEFRTVAKDSEPGLDCGRGARLEVHTRAFSWLIAQRAYTYRGQRTASVGDCCASWISQKGGPFNFEDSSGSCRPGTLTGGQELSSQVWGRPWPVTKRNCSLPKAGELWDRARQFMSGRIDLVGPAFAMTGLAFGRGAWGSPSGTCKGARGGHLRLTSTPQGNLGGHTTKGLCPQVDRKKRKCHEGERVDHSGAETPEWNGPQVHTFTIPFAEPNRDDHSGMLNGLRRADRTYSRATPTV

SEQ ID NO: 977998 - protein, 143 aa, Homo sapiens
ALPGAAGFFRGGRGRWPCRSLEERGDRRYGGNRFEAPGRGGYGGSRDYYSSRSQSGGYRDRSSGGPTGDSYDGLRIMVTPPRVARHAVCLSVGARFTLVPSPMHFSAGTYSGRLSRVLAQKRRICPLRAISIAGRKEPNETDQ

SEQ ID NO: 977999 - protein, 284 aa, Homo sapiens
PSPPVSLRELPTDGAPPAATVRRLAEHAVLNRRSTEGVRYRARTSPALSGQAMAKGADPRCCTRSCAAKSTPSGFTLDDVIQTGVDNPGHRTIMTVGCVAGDEESYEVSKDLFDPQSLEDRAPGAYQAQTIDDSKTDTSNPTTLQGRPTEPWNAQNNGAEASQGAHGPQQIQWILTPPPRTCQPRESAERQIERKPRTERQDPCTNAHGTAEDQARPNTYRSSKKHDWQSGYNRTTLQYSMNNLTLIRKSHEVAPRWQDLGQLDHELRPVVPKDRGHEDKKTPK

SEQ ID NO: 978000 - protein, 310 aa, Homo sapiens
MASGLIHAFRGARDFVIVWELLAFTRASVDFERAPLTGITPEAARGSRRRVGLPLGAFNFAVALQLVPSFPCGVHQPLWKLQGGWSSDSEARSHRGNPVGGGSPQGQKQPPHLCAGQGLDVAGHRRCQGARGLIRHFQETVRPDPGGGGSRPCRERTARVMLSASSGAVLPRGPSRSTLRAPGRGVTQRLGGASGILRGQLLATVLPSRGAEGESQPHDKSRQCTGSGGNTSVPTGAPHQQGTRVPKKNLTNAKRPTSFAALETAARNTTAENYIYVSASKPWKRGWRTKGHRSPSPCTLLRDVNTPQRT

SEQ ID NO: 978001 - protein, 144 aa, Homo sapiens
RTRAVDAWVDPCVRRCVSRSMSFEYKVMRCLHRQYGLCFCRQKHTVQSSLGVSSVFQCRFEENIIILPSAHGFANTIWDSTFHFLIEYEGGWKASHTLKWRLIDYSKMYADIIARKEAYRRKARFKKLIQLCQDIIPRHIRTVE

SEQ ID NO: 978002 - protein, 130 aa, Homo sapiens
MSRTSKTKPLSPLHDRGYTTVNALKSVEQTQLHAHRPRIIPLKIFEIGPYYTYSTHLTLYSEKKKKEKGKHNKHKTKEKELQKTQGEQEHTKMKKATESSNNKEQTTEERRDKDTPGERSHETAKQRKKR

SEQ ID NO: 978003 - protein, 150 aa, Homo sapiens
TARLHSPTASTSTTTCLQLGCVGRLLPRGWCVLVLALDQGCAVLCSAAPAVPNEGIAKSVDGGTLTEVGFKPQRDMWWAYLPEPLGLTNNTGITDKIQRTEAAYYLGSPDNRPPCTADSVHHSTTNLRASPPAQRPKLQGPCSRTTTRKR

SEQ ID NO: 978004 - protein, 124 aa, Homo sapiens
RTRGCSADPRDILATFSRKGTWVSFITFLSFLGFVVFFGKAWGFGPGGMGGASHGSWLPHITRGQIEGSLPSTWNSGDLQLHSTRVGITIYFWCRRRVFPHSVAQGVAHQGVGWDTQNVVPRVP

SEQ ID NO: 978005 - protein, 287 aa, Homo sapiens
FCCEAACIVDEAMLTGVSPCHMMKRSPSEDLSPDRVLDLQADSRLHVIFGGTKVVQTSPQRNAITVPERRVTAGAWPTVLRTGFTTSQGKLLRTILFWRSPRVTAKQPGGPSSSVLFLLVFASRVLGCLCMDCRYQRTPAGNRYDAVSGVLLLILTIVSCLLSCPSSCPVAVNTSLIALAKLYMYLTEPLRIPFAGQVEVCCFDNDGDVDPVTAGGARCGGLRDGNGGEPSVGVLWNLAGLARATRHAAWEPGLVVPLERLLAAVFGLPMDVSRIPGVPVFGALRSS

SEQ ID NO: 978006 - protein, 219 aa, Homo sapiens
MRRLPLPHSSRPVTASWLARCLSRGTLRRVCAWGPAPAARTPGGFLAPARVVPSFLHLVPAGQPAAMVCLPLSSPDTVKCSVGLGSGAPCRACVPLPVLLRHARLGRLPWSDAHNCIPELDSETAIVFLSTMRHVRGRQVALYCAKYLPRISSRTIRMAYIGKAMLQAMACKKMPSMCYLTPNLTTEEVIKEAGTDMHGRTTEDEDDTTKNVADERLIV

SEQ ID NO: 978007 - protein, 109 aa, Homo sapiens
MTLVPLNESVAPDMALPRDKLHKLADVIRRPLSYSCSHRAIVEAGGEETGLQAVRTLPESGGDYSTTPGEACRVVPVTKSYFLNNLDKVVLALLMLEGGASSCAVHKRS

SEQ ID NO: 978008 - protein, 226 aa, Homo sapiens
RHALGPGATRTPSARACDTDPGYLGTMDEKLSNTKIIFVVLWAWALGKGTQCEKIVQSMAAPTSPPRDLLRSDGHGSGSVRGKKLSEIMEKGQLVPFWRHESDMLRELMVAIDVKYFHRGFLIDGYPLEGARKETGSFEQTDWTRPAHAAVVWTRALSTYDASGLLIDVLMPTSERRVERTTEETTQFKRLETYYKATETQSLGFYEKRGIVRKVNAEGSVDSVFS

SEQ ID NO: 978009 - protein, 316 aa, Homo sapiens
AEPWPGVRLCPQRPRGLSPWDASGLYLLAWCCTLLVALWLAGLRAAELGCSVVNVAMGPLGRKWVAWRHGTPDLSPRKGACLCHCPGPVEGQATLKPPPAAPVAGMPRDPTSSNHSKLLVYILNMQRERLPEAGSWQPAPAHESCADAMDTSDRPGLRTTRMSWPSSFHGTGTGSGGAGGGSSRRFEAENGPTPSPGRSPLDSQASPGLVLHAGAAPASAGSPSCTAQDSDYDMFTQDMSGTHRSPAKAAENLIVTAIGHGAGKLRSVRNQIHTSLNNVPDPRYKRARWADHPVLQAQTVKKRVTIDRETGRMKIL

SEQ ID NO: 978010 - protein, 250 aa, Homo sapiens
HAFGPLGPHQLPAYGQLTSPGSCEDSNRAKLPRGIQRNVRTLHCKNHLINVPLHSAPFSPERCTPVYHCVRMIKIMQRVRGEGDHAALGMSSCQPLPGTAAPLPPRAEFSMCPGSPCTHPVAPGRPLATATSIILWAQCSECPFSPCSLSGQSSTCLPLLPRDPFRQGGRASRVFRGIEPAPGWPPMRFRQCAFLFRGVAVALLHPGGHPVPYLVWSTPAATSLKIPPDFLVAVCLLPPLWPAISLVGTP

SEQ ID NO: 978011 - protein, 194 aa, Homo sapiens
QASAKSDVTLDGRRPRGHRRGHNIVFSASWTSREFSMYVVGSHGRTTDAPRSFVPRSHAPLCAATGTQARCTGCEGLYSRRRHLLLDGAERQSPTMLRTHEQSLTPDRYSDVATANHVVHLRTQNEYKKLRRQPEASRTNLSVGVMGLARSAARTDGVVSVARGPTLLKSPNGANAPHERLHPLRTRVSMKERI

SEQ ID NO: 978012 - protein, 421 aa, Homo sapiens
MAYKGTKKSDERDREADTGHAERRITRAADTSTPGKDEHAKQQRTNSIERTPRKRERHGQNTASHNTTTRRSETTRAQILTNRDNRATKQRRTARKPPTRRPTQNKTPEQTETHATRANPNRQRHGQKTKPPDGHTEQRREHKPTPQHPHPERTRTRTTTTRATTPTQRKRKTNNKQTRNAHTHKRKETLTGQHDGTQLEDETGTQRANEPQAPARQQKTRQRTKTPEGRNIAHRKQVRQKSKRRRPRQTNHNNNTGNRTQDKPPQNTDQAQRGGHQATHNKRGKPRRAPTTTPGRRSNLKHTTNTRTEPRARRGTQTTKHHNKDKNNTRTKATTTNSPPPPRTHHKKNKNNGHRQHTATDTPHSRGNNNNKKHPPKKEQRQQHKNNNTNHRRKTTTDTRKPQKENNEYKQTTTKTHPKKK

SEQ ID NO: 978013 - protein, 91 aa, Homo sapiens
LKTSSAAAGALGCALSLGQLPSTLGRPVACGGGPGTGWGLLTGYPLCFCKFLAHSEWAGQTHVTGLSESGGFPSVRGMADYVNFLLAWPLV

SEQ ID NO: 978014 - protein, 264 aa, Homo sapiens
LIILHVAPNDRPSTRMDRLGVGFQDPPVELLCWCGWISASGLGDYLQLLHRPGTVGVIFNGWARTTLPSDEPNAIVSDGKYHVVRFTRSGGNATLQVDSWPVERCWYPAGRQLTIFNQPGCHQDRGPWIRAAPSMGRCVRPLLEWGSMVLAAGSPRATPNVRTEGPPAAWWGRGRPCCSVRETVAPCCWLDIGPTTHLMETTTTMAVAHAPGAGRHTEGQDHPRRADDLLVALLKCQSDDDDWRNVSPVLEESILPFTEILAQR

SEQ ID NO: 978015 - protein, 248 aa, Homo sapiens
MAAKVPSSFFPCRVSRKGYPYQRAPRDSRQGGRRRGRETDAEGPGGSKGPWWAGSWLSRHIGKGRGGVDPEGPPQDQRCPQSGCAGRAATALVRKPGRKERAGAAAGEPGHTARARTETSPPEGTTFTHRAQRGPEVPMEGDVQAPRVYRSRERGRKAPRGVCQQRKPLLTTFPVPVVAPKRVDMRVSMDGLARHTTAGIHSGITVRHRTHKFWLVGEHSSTLGSKPPQTGTRYFSPSPWRPFRLIPL

SEQ ID NO: 978016 - protein, 429 aa, Homo sapiens
VAQPLLTLAAVSAREISVCSCRTEPVHPGGDPSVRMADKLLHVPADPNLRALVHCMQCDQTVPVPPDWLAHGPVPECSLQRLRMMFSERRHDSDGPQLFSSAASAVRRCHCSGCARQCALTIPCHCPRTMLANQPTPAVCYVPRCIILLESKVDLSMIPGGQERHEVLGGLLVGSRYVKGEPEDLPGYRVGTCLAVPSCRLTERHSLSARDEAECPKRLRVSILAVAVQHGIRLEPAGDGMWTRSTVNRGRLSLTPNRAHCTCYCLYVHYTGGDQQTGPCSLDFREAPQFTPHPDRRHIMHDLHYRRAINHLEILARQYQSTNRALRHPQSKNPQPQDPFTAEHGIAPPEQPDTYTYWNHKHHTISQDERTIGDSREYTEKSRTQRTQHREKASHHNREHTQPAKSRRKSELGEPTQATNINSKSCEPK

SEQ ID NO: 978017 - protein, 257 aa, Homo sapiens
LALRRHPSEYSILREELQRPERWTSEASSSRSCDAILGLGGEPQAGAGLTPDEAQGPGCHHWDGDWLSWGADRDDCCQLARTVGRGPSRVPSSTTPQLSPKSGPELAPGDVSPGALRLPMLPRECLIGRTRMVPIQEVLRPQKGPGALGPGGPERATCHVSQYSNTIGKLTLLALGRERSNGRRRIESGEFSMSAVALLHVSTVSDVRRGSQMGITGPGPQLSGNQSRITGIYKVVFNKAVPKSDERKALFKGILET

SEQ ID NO: 978018 - protein, 450 aa, Homo sapiens
MHALLEPSTPPFRHCLSDFYCIFPFILRPLSLLSRVSPSPTHLYQTKRSPKEAHRGASIPPNRPTYERMRDPMRGYEQSRIGLAENMEVTTLGMTGPVNLGKSSMFSLCSSTLIIPEGPILRPHYIGQLTGPYTVTWQNTKNIQGVHSREHRLEPCHNSANNQKITHIPLETMRHSTHNNHQADTNPTQIENEHILPTEVIRPCPNDNLEELGVPEHIVKGMITHRDAHSYHNTRRDNPRTDGPQWAQTGRTTEQLEHHTKNHTVSHSTTWRYPINWFQTPRKNAHHQHKRENQHTHSPHTIHTREPKPNEAHELRPTPEKPNQHTAQVAEDTTKPTTRQPTHQATHQPESTPDTARHTPTATAYQKHPQQHKPRTRLSTATTTSSADARRRNNTTGHSRPPTMKNTASRQKSRGNRSKHTHRERADGLATEADKPERDHGTTEHRQNTT

SEQ ID NO: 978019 - protein, 461 aa, Homo sapiens
EEKKRRTKKKGQEGEERRTKKKESERTQQNANRNNTQQKLKRNERNATRTKRTATQRTNSSNATNTSERKQRNTNATNGTTETDDTDTRTTDTTGHDTTHTRHNDTDTRHGRHHTDTDNNTRHDTTTYDKRGHDTRHPDTVLHEPRHDTDTDTRHRTNDATPTTHTDHRRDKRHDNREHHTGKGRTRNQTDETKHDKKLKDTDDTNTGPTDTKRPKQKTNQTPTRTTPTGHHHDDTGTDPDATRNDTLHEHDTGGHHTTTRDRDAPRPHPDRTHMTRDDRHPHWTRHDSERHQDPSEERTSDTNGRQATRIRTGTNRDDPTTLNRRTGRLEHETSRRMDRHKGTGKRAKDSETDRPRQTRGEDTKATTSSDQWHNESTDATGTGTQEGRKTGTTHLTGTQERANDARQGYGPVKRKARETSQPQDEDTRRHTPQGDHNKNRYPAIWEQRDPYTSQKYITTA

SEQ ID NO: 978020 - protein, 270 aa, Homo sapiens
VGREGGRGVAPSFTSSCCLPRRSTPATETPTRDSTISLFQAMQKGLVLRQHGIRLLEAQIATGGIIDPVHRPHDGACGRGHTSAAYYSDEEMNRVHGRNPDEDTKGNLRHHNTALRNTHVQAADMERCVEEPEDGPCAILTTERGGDRLRVEGDHRRMLRRGGRTRRAVEETTDSKIPGGRQAHGRLNHVPRWEKDGSTAQEHVESNRSEARQTQQSMQCARSLSRDRAERNPRTTANEQSSVRTTIQSRKTAATTQTTTNRAPQPQSKQ

SEQ ID NO: 978021 - protein, 127 aa, Homo sapiens
ARVRRRIGKWERPEIVCTKLQSVHIWMLVEHHAAEPSQISHLSGITTTNPGRSAKDTQKHSHTGGTGGNRSGHGNFCLKKQIRRKQQRSLSHAVLWEPRLGEHENPRGDILGESIKFLNAEYDDPRL

SEQ ID NO: 978022 - protein, 251 aa, Homo sapiens
HASPSLSLREETWEINISCERYSVWDCRLHDAGDSWKGIAVPEPPAWLGLKQAGKPGVCHEEHGEQEHGLYSLHRMFEIVGTHSDTQRCARCLTLSIYALSVTCMTTTLWHSIRQLDSDIILVWHCDAPRASMVIETYTLLPGVTSMLAAASITRPRHVLPYVNPSRGDEAVCTDLDRQVSGGDHQCRYVTPQKPSVIPDTKASHSPSKNKCITTLEHDERGGPSTGVLSTVLECGQTEWKREKWKARHTP

SEQ ID NO: 978023 - protein, 604 aa, Homo sapiens
MHGGWVLLRRLLLLLLLLQLLLLSPVMCLPCLMSCAMLPMCMPRCAPSLSRRGTRDVAAAPVSAKVAPALALAGAEQSSVACRQPLPCCAAAQANFGEDVQMHACTQCKLAGKQAGKYDPHVSIRGVHTVGIHCVPCVVRPMGVGPLWGLPDWLVAAISYCSQGTTTHTGELALYIGTNFTEPLQIALHWETQQGWRMRAEHEKALGSHTVDAVAPLNGGNTACGDPEPTRNPERPRNRQQEFGTPRTAPLHNANSERRPTTQIGFAKKINPNYPKSEPVEHTAFFTHEGISSNSFDLVTPLLTTALEEDCCVSTQNRLTTQRYNPIGIWKHTVVSEPGFINLDSGGQHTQLGTPHRGSSHIGGAQKQPYSRVAAKNRVWEPPKTSNTTIHTHQRRGQSGRGLRTSVTQRSSFRRHWRGYEKPMDTEEYTAHTEQTPNPMAPSSIYGVEPISQAKAHTYGPTLGTQTNADRHNTTRREPHRRMTPKPKQQLNSPWNRGDNGMGDNGATAYPNVQVDAPSDNTTTPTGRTEKHRYNQTTRRPTRTNPDTDANTTTARRTTLKNREQTARAADDATPPHDDTSCDADDRPHTTHHTIDTQNQTETR

SEQ ID NO: 978024 - protein, 179 aa, Homo sapiens
MVRQNYTLEDLRGRHQIEQINLELYALLRKPVHVLVLETSDDVVLRNFANYFLHQSHDGARRTLLRTPDEACSKPTMVGPNLPFRISKTTQTCDRLGQSWAEIATWSVAINIWDTQNVKSSHLLELHHILATVHKNDLPYCVTSFETHYPVNEHGETPSTEVAVTTVTQTWRNDRQRHE

SEQ ID NO: 978025 - protein, 110 aa, Homo sapiens
LRSELCEIPSGSVPASWHPSPDLMSSSLLSVALDPMIGAPSYERAWIGWKLRCSERHTSTPGTWWSVPWMAWWHADLLGLMIVSHSRVAALVRGTPVLQCLQVGMFGRYD

SEQ ID NO: 978026 - protein, 141 aa, Homo sapiens
MRRTGQSVGLRWSKGACKYQILARGVHITHVTGRGVVCHDFNQQESQSQHRDYPHQDFLMLGLRSSGNATVSFSDSCGWGVVHDWEKYEGFALKFESSLRKELIPKRMGFLMGDPFQKMGCNGGRPGLWERGNAWSYNNDP

SEQ ID NO: 978027 - protein, 180 aa, Homo sapiens
EEKKRRTKKKGKEGEERRTKKKERKNKKERRKKKVKEEERRKKERRGRTKKKKEEERTKERIRNNETENDNELKNEEERNNDKRTDNEGRQTGHENKDTTRTRYDNAGHDNDNTNTYNDTDTTRTNRHGHTTDTKQTNTTETTRTRKRTDGRTNQGRTKRTNLTNGRRTDDERRDPRTTN

SEQ ID NO: 978028 - protein, 428 aa, Homo sapiens
LQILKVSSRCASISIPWSRSTWVDARGDERWDRHERQQQRRSKTDARRPRRHGVTRDETVGKRRHVTRDGGPRTASTPVADDKNEPVTGEQTKRQSELQTYDKGRRQNPRQSTLTPGGHGQSRHRIRLHSPIEDIPIGDMTLPRENRTTRLNIRAPQWGQKHVDNADKEATVGTAARKEEPARKIPTPTGAHTTYAGRHTSVATERHEEQNDRDDDYGTEPQHKQKDKLGSHHQPQHHVARATSHPTKKERLHTYGAACNQQAHTQRRHMNIMGETEHITPYQADDSPSTHRPETNTPKIHHSRNARLRRHQTRESDIEESQESAHCTDPDNRKTDIPPTAQLVDLLVPEPTQTGMTEHTHAVNTTNIDKRGRKHEPLPSCRTPDTDTHPSERQEKQQHTITTTLSSNGEHAHTTPHQQEHTHAKERI

SEQ ID NO: 978029 - protein, 200 aa, Homo sapiens
GVTHPIDYHTTDYVDEIKKIYPYKECDYCHGPSVVGQILPRATISCNPWGKVVTYGMAKLLTGPKRNLMAPCAPVHGGISTADDSFCYTCLLGTNQGLMCGFHLVVLLMDDEVELVSWCGGPPPWTLYNPGSTSNALIIDSDYWNLYEKGESDVHAHTACSVEERKCGQRSSWLPGPETGESRGQGGWSKNPKKTKRNAR

SEQ ID NO: 978030 - protein, 73 aa, Homo sapiens
TGHVRCCLRGVRWGVSSCQKPCSACVWVPVAAAPGVIFDLLPCMSTLLAFLCALQKVLLVPCELVACVGDMWA

SEQ ID NO: 978031 - protein, 150 aa, Homo sapiens
LALRRHPSSTCILREERWGLSVDRELIIESCDASSASEESPKREQDSPPDEAQRPHGVPSREETERSGPEELERQCQDGAVAAARVYLSYEQPPQNETPELDPELPPGDGALEPETPMEPRKPERRRRVPTKVLRTQRALGPLGPGDPAP

SEQ ID NO: 978032 - protein, 112 aa, Homo sapiens
MERNPERREGARELDKKPLNNQHGVTKQRTTDTQTTHQQTNGQKRTHSNKTRNNERRQQNDENKNRHHETTLQKDNKKTANTRRSHTTDTHTNYNTIDTPQKNSPEHTQCNQ

SEQ ID NO: 978033 - protein, 129 aa, Homo sapiens
HLRQRVWPSSSGVYSWHSPGTTHRCCACCREFIRFHQIPNPLAPAPRGVHSSTPGPTPTAIDMNAAAEGHSRECLPGVTSAWRAERHSLLQHVQDPSEGPARAAFGPMAMKFKTTHAPSGDTRACFALW

SEQ ID NO: 978034 - protein, 101 aa, Homo sapiens
ETVFAVLPRLDCGGPITAHGFLKSPGPKQFLPPCRLGLTASQHTGGLNFFLVERDSLCGPGGLIRLRGSEWLLRASVSKGTGHVVALSLAIHCPTRGSIPL

SEQ ID NO: 978035 - protein, 240 aa, Homo sapiens
SCQSELHRALCAAGRFTELQPRGPHTSSPSPNCDLQTVQLPPQCSVTQLCDGQLCAMCWCVDLEDGGEGFLWGAMDAKVGSLDLPPRWLTCLSRVRPASRPVDSASPATPVLLEAAELSQSGDLSLSPVYCLLARSFPQMRVCNVCVCVRSVDSSKASMGVPLGKPEPGVYSKVVTPPKRTDALALSPRRSAALDDVSRFDPGYSSLTHSFTHPRPPNTDLLTMVPNVPALVNRLGEVQY

SEQ ID NO: 978036 - protein, 548 aa, Homo sapiens
SWACQDTPYNSLGRHGEQSSELAKQSVAVSVLVEELSYDHHRKNNHREQQPLSAYCRHSSGWYCRCELLVIGSHSTDGTRHNMGLGGATTTLCAHDKSPPCHVYQHSVSRNAAVVHAEIAIEVAYTYKRYCVTSGNATVTAQDRVTLFFICIVPTPVTTRLERRTPRCEQQDGDARPSPREGDAEAHRQREPPANVACTPKRTTEVHRRNRQWHPANTEDRAHRHKCGCGLAHRRTQGSARPQNYSQRRITWEGQPRYLDESNDSELTIVDATSHTYDPLEGGKPRALTHTQRDSGGTRHAQAPEQANNHADKGDTRDTVTNHPQGGKHHEPKLKDETTRKHTPHLLRLLITVGGEHMDKGTQQTSTATHRDGQHMTHKATTRPAVQKQHEPKQMIDMGHNHRKHGDPQAQAKIQRQRTRSDSTEWKDDKTHETDNVKTRLSNRNTKHRTDRLSYRHSSTNNRSGEHKKRVTTQKEDDTSGIDAITHTDRQDTKHSNWKERDDTHQYTVTMTNNVERPGTDNTTPDTIDPGIESALEVVANACSSSGQ

SEQ ID NO: 978037 - protein, 308 aa, Homo sapiens
PLNDPGVAMGRRPGRCYPGIVLNKPYPKSRFCRGVPDAKIRIFDLWRKNGIKVDEVSALWPHGVTMIMSSCPLIVPGTGCPNFVPIMYMVSRVVATDGFHIRVSGSTPSTIIPRSTKMLSCAGWLTVLQDRSCEVPLGKPQGTVARFTLGRVIMSIRIHSCQRPRSTCDLSALTHGASSSFPVRQKIPISKASGGFTKVQMLTEFERQWWLIQAAHPRWLWGQVPSPVVALWYKVAGALLHHDGLQCAAPFFITQPCNSTTWSKIQRDPEETARRHPRISHRVPKYGYRHSLDKRAPIVIYKNSQESV

SEQ ID NO: 978038 - protein, 95 aa, Homo sapiens
QYYKGSDFDCELRLLIHSESAGGISWGQQVLRINETLREKQLKTTIKAFPGTAVLSSTGQTLGCSYFETEQIPEYGGMIRKVASINRFQVRYEST

SEQ ID NO: 978039 - protein, 129 aa, Homo sapiens
MDGYAIHLEYVPYCRQSLHRKIKTYGPENPEHYRSCPRSRNISWLPRTLLGPDGMPDVVRYRSNPQNHQYWRAHSQQRKENADELTQKPRRTPKEEGATQKQRKHTGDPAPRRTTKQAARTHNKHRRAQ

SEQ ID NO: 978040 - protein, 297 aa, Homo sapiens
DAWGGSRLLRARLHVRTRFFPAIQHAAAAEGGQQAHLPPGAFVCDPGDGENGGSSKGKVQIPGIQLVGSQLELLYTFWAPFADLQLVQGSLRRRRGLGCVSLLFPSELLPRGAVGLQGFLGMQSRPVGNQIGWGMWLLGGLTSSFLSPSPSTITYCFLSFYLQWPHNLFYLFIILWGPEPGIEGAQGTGHGVPSHQSVRVRVLVCVWRSSWGMWMGPGSGVRRPSLVAEAPRVPGSFTHSLPCGVVWLLIGKPHSVVLFPWLLVCRQFGYPVNLSLVSQICLAANKRRGGEIPWGPL

SEQ ID NO: 978041 - protein, 390 aa, Homo sapiens
MIEVTAGDRSDRPEKKELTCARPNRAERNEQTDEKRQDGDDHRYIYHYQHTETGGAPTLPHDERTFRTNGPHGAYRIDQHNTTTDAARERRDATRENEPSGARTTATGYGTHKQEGGRESERKESREVEDRGRVRSVEGESETKTVERDRGRAVHRRAGQREERERSRTSEKDRDRKDKSTTAKKRRAEEEKREEERRKKESEEEGRGGDEEKAGEEGRREEHARVDEEDRHVVRIADWREATKRKRRMAETRTEAWGLLGVCQRDREQSGQGREGMSEARLEVTDESHGASELHNADEVRREARRVDKSENEDDIEDRSDRQEERETWRETSTAQSARESECVMELAKKKSADDYGQHNGATGKRLSRRMSGEREAPGRVREEIETGRT

SEQ ID NO: 978042 - protein, 65 aa, Homo sapiens
MPLTATCHPRPVFDVLRHRGSRQLSDEASDLCINLQSANMCAACRVTRNGCGARCGTPPVYAPLV

SEQ ID NO: 978043 - protein, 210 aa, Homo sapiens
MGEDQGGRVEGFVELAEGGEWGRVEGGSIPWEPGARGKPRGCPGRERGTLALAVQCRTRVERAVAQAARVGIHHCLKTGRRAGAAALRRGLAPLGPGSPIWTLQGLSWPHMSGQVSTYPGLQGRMDGKPANGARKNATGGLLNVGLGPRPVGTYKYYGSYEPIHELRLVSVMVNIPIYSGPWYPVVPLTNNMHRNPDKQIYPIHHLVADK

SEQ ID NO: 978044 - protein, 74 aa, Homo sapiens
NLRLGYEIVGGVTKSNGGKMKKVLSSAGHLSGAPPYKVLVTVGCQKAGGWLESQVDWRRRPGQANRENPISQEK

SEQ ID NO: 978045 - protein, 323 aa, Homo sapiens
MRGASHKRLQQLEITHKFRIQDPSPEKIKHREKYYKGDATANPKTVDPPEDMRYTESTNKRQRTENGRQLRRTDDHEAPNANMETLCTHHGATPNKGTENPNTRHHTRTITQQEVATGQNNPNAASSSTHHWSSHGSAQAQKQKDTSDEIPKTEQCDKQHNRGSNNRKHHTDHTNTSRDKTIKDPPNNYHQHNRRKPSSGSQTTQEQVARNTIVTPRPDHSRSTKPGPETRLDELTINATQRDTQQQKQDTTNGDEPTGRKDTYKRERSVTNDEIELKNNENKRRTQPRRESEERQNNIRHTERATRRNTQTAGPPYTPHAQG

SEQ ID NO: 978046 - protein, 225 aa, Homo sapiens
EVQATVSLKPHSEPWNVCRASASPTEEEDVWNEDALWQSLVPCTLLQILNGARCDLWHEVAHGHAVWQPAAEGDGVRHASADDWEPQALQCCLALSPGSVPPPAPEVQIRTPRVKHVHEKVIICLDPVTSEYVTAKKLELAPHRTPKLNALNVIPEDDCTMVQSRDKNTRLDTQPRVCTWCCVNRMITAWLALACPPDPDELMDDLPSNDLETDYLFQPIHLARD

SEQ ID NO: 978047 - protein, 569 aa, Homo sapiens
VTRGSTHAVGRRGFSSLPLEPPRFPTFPVPPMTALHTDETHRRRHSAGRYTNEEKESVSVMIQHIAEAHNSRSDTHKARMQTTGADRHMNTLTWTHNEETNSSNYTELPSKSKTGKRKNHKTITQIHKSETQHTDNALTRHYETRQTPGSKDDNQKKTTPDRNRPKATKENNTGNNNSKRHITGENITAQRNRTNDQDTKPPARKRPPNKQTPTNQVDNPQRNTTKKTQHIRAQNAPTKRQHNIHSTRKKRETRGKRTHNQNEKKEKDDDPTMRHQPKKNNEHGKKTHLSEDKMKRHGKRETQQYDKQHTQERKHTTEKHTHNDTKSKPRAKRGKITERIKPQNYRRRDDAQETKKNKTHERTENECNHDTQYTTTTKKTTHEHKTTHNKDENNKKEEETRTAPHTNHQHRETPNQKQEAKENHTKKRANNTQETQTEKQKKDTNTNNAQNEITTKQTQDGRQPITTRPPTENTAAPQNEKQHTKKHTTHNHPARANKKQQRTNTSQTRGHTSKNTTNTETTKEKTTKEKNRKKDHAKHRQTHNDTQKQRNTEQENRTTQHRARSIKKT

SEQ ID NO: 978048 - protein, 120 aa, Homo sapiens
MTTIFALSRITPKDRIQGYNTCTTLVHPMRTTFEDYSDLIGNPQRAPYKVEIREYGTLDFESVSPKRLPGATFRNFATMHNLGTRPRLAKFVFHTGLPEKEDHASRVLMSVYISTVDTSA

SEQ ID NO: 978049 - protein, 161 aa, Homo sapiens
MREIVHLQAGQCGNQIGAKFGGYHVTNMASTPTGHYTMGTVICNWRVINVYYNEAQEEIMSPEAVLVDLGIPGSQWISCPFWPLLVMIFLSRTTFVFCAQFLEPGNKLWHIAGLYQRTWRMHAWCDAVLDLYVRDRDGRQSCDLSFTWASLADPLAGGRWH

SEQ ID NO: 978050 - protein, 79 aa, Homo sapiens
PRVWSRGSGVLVRSVKHGTLCGHTMRGPGLLTLCEMYMCPDSCSLVEMAWVLQEHHDECLDSDHWLSLVCLCAFCRALW

SEQ ID NO: 978051 - protein, 131 aa, Homo sapiens
MNVACKGQSDLHGLSQMRSIMQSRRQWLMVTRLCIRPVESDRHAMFRKPGPARSVVMFMRCKADEGQRERQENLTQESSVSSVVTVNYRERYCAAGAQRHGCDDLQPGTGVALQAPCDRQKATHKVAQGKV

SEQ ID NO: 978052 - protein, 262 aa, Homo sapiens
KRHSATEDFDVGWIRGMLEQLNAELGSVMPRDTAQNPRDAPPLGPEIHFSGSQYTTQNAQRRGEEPTAASQFDGQELYGIMSCGFIGKEVLLFSFLLHYSDSVCAGADVVLVNAALSGCVRYSDLSCRALLVPCMSLGHMVAIYHVSLGIWVFYKCLVKIRVWSRVGGLMCACLDPWGRQRVRSLSPHRALLPFGLRPVSRYSYYFLYSLTVPEGALGWLVRPYSVFSCRNLFSGDPLCPAFLSASIDDPSVAFALSVRRGG

SEQ ID NO: 978053 - protein, 376 aa, Homo sapiens
MDDDICLALSVDNCAPVHVQWPVLLLVLTDAPLWPVFPFHRGVLPPVPPRGLCLAVALELTRTSYCVADEAHQQRDGTPHPAPYPTRCTASSPTGDDTGRKHLAHHTFSHMTLLSWPPDASTPLLPDPTAPPDHPTGAHPAALPRTDPSIPLVLRRTLHHIPTPSVYCSPYSQAAAYSPVTALCRRSPLGLRRLDLPVPPPSPHTWCPSYRTRYCPSPLAIPAAPRTLRLRPPPCLASPPRRSSPGPPLPPPPPLPPGPSRVPHRPSCRPPRLPPTCPARPPPLPPPPAAAAPPAPRSHPNTPTPTRPEHPPKPLNPERHPPTPPSPPPTPPPPSPPPPAQAPPPPPPPPPPTVSAPPPPPPRPPPPPPAHHPPPP

SEQ ID NO: 978054 - protein, 119 aa, Homo sapiens
VITVGLPCGLERLHGCPFEKCCSTEPCLSWPWRLWAWVMNARVPQSQACACGASMGPMAHVDALVSCRRDLGKPSPLLPCVVSLAWVMVQHHTCLWNLCVPKLQTGCQWHKFNQTPRLL

SEQ ID NO: 978055 - protein, 101 aa, Homo sapiens
SNGLQPVRTRPLSPGICELPALPPDQAARSLHPCGRLSKAESLLLQLPVFPSWVCLLLVFCTGVGDGVRFVWISGEMVRRLDLSLYRLFACCIIVYYCNFF

SEQ ID NO: 978056 - protein, 396 aa, Homo sapiens
MGTSVELREASRACRTLIGAHNKEEDNELIVQRLSVVFEEPLSKTNDTVDTTCKQVGPDTQRVQTVLDARILTGPFLEVTAPTVGQCGNTRDNIHGLRNRDVLQIVRNKGGWTREILKPGRGDLNWRPRTHALTSAPNSAWTENLGDRVGEYGDTRGPLETRRQLKALPPGTMVDYAHTVGSAGTGIKPSSVIHPRTTEAGASRNSGGDKLNYRMGRAGKHFCTGGLRNALSGLETGTRPPLGGDTVRKWRADNTWGRHTRGQAQIARCPYPSRHSGGHEKTRPNRKDSGAPANCVTQRSESTREWGPPCNAGGHGPAYQENDETMIPDTHDSQPAGIGTIRSTHTPQGGTHTVKTHSTDKVVTQLWRTNAHDNQAVTQHTRKHHHMSGDDNKVNH

SEQ ID NO: 978057 - protein, 275 aa, Homo sapiens
MAFALWLLELERQGLMPLKQEEAEDESGAPLSGPPPHVDLPMAAGVRLACGWMCCPEKIPALRPALLWAAAGALAVLLLTPRMHLQCRDGYEPCVNEGMCVTYHNGTGYCKCPEGFLAGNIVNIETPVQKKLLPEWWDLCGPVPCWVKATCLMCLRLYTDEDLPVLDISSMLGVSTLPEWPEHAILLSRDTYELHLYRSGLTGKDVQWTRCLAVSFPVANGSSCTTVGTSLLQMATGSTGAEAVDGWLMRCDNPRQLASMVVIANLLDSIQIQWH

SEQ ID NO: 978058 - protein, 159 aa, Homo sapiens
MTKRGLFCSRGANRPSQATILKALVDPSDQWAEIVLSIGIYCWPNYRRGGVFGSLSQVVGHIGAIPEACVFRDRFLIAREAGSGGVGLGWVTFAGVGVILTQFKEQRAIGQAKVAVGERPDNVGPPGCFCGNGRYPRWGPVHSLERVRRLATLREFSEL

SEQ ID NO: 978059 - protein, 247 aa, Homo sapiens
PRVGLLRFQAAASVTNDLCDRVVKKKEKPALSGGEKGLTLGVSEDGSGFSGRAGGTLTVTVCDASSLPMHRARSGRAGGYFILDLLTWFPRCMSRVGVETGLLLAQRRGAGRQITLCLGGRSRSRAWVGVSAWNVNWTSTRVAAKDQRAGRRGRLQAHFPHLFPGPTWPVCGAVLAPSEQSGDLEPGDAPPAAGDDSGVGGAPNRGAQGPVNCEYWELNGAGERAIAPIACILTHNCRRAEEKRDHS

SEQ ID NO: 978060 - protein, 349 aa, Homo sapiens
MQARSLEDQAFETRPGQQWVKTPSSTKNTKQLARHGWRYAYKSQILGRPHGRRITYAPGKAEVASELTIVPLHIQTGQTDVRFQSKTTTTTQHGDNPLHATRRSTQTHRHHNGLADAPHNSWQPEPRDIYTWPARKESSCKGDYTAMTYTQHTQNLNEHTKYTIPTKEKDRAKKTAPKVNKSKNTRQEIQPTGTHRKELTRKATNLRALRLGMTDITTNQPHEQHPVTQRHHTHPTQHHKKGKDADNRAPKPPDTNRTTYKAPTKVRTHQTPKTTASSTDAHPRAKPTPSKAQNREKHTPKTTRRNHTTDRVDTHTRREQQRTHRQTNRTKEDKTQNEKKKQPQTKTDA

SEQ ID NO: 978061 - protein, 304 aa, Homo sapiens
MSEKKKKPPSRLSVVAHACSPCTWEAKAGESLEVQEFEASLANMVKPCLYQKYKNWPGMVALSVVQLQLLQIWAEVGESFETREVEVQELKYTMYSYLGDMGETLNLTNKQTTNTQQANDCVTKSTGPPSTDKMPDSVWNGHLEERNDPHKGHRQRTYTAKGHMGRTPSEQGHTDRVHEATERAHNNYTRSKTNDRGDWKKPPRCSEDRRRTEGEERREEAGNRTGKEERDRRKRRRTGEKKQEDTGSKDRQRTAARRRQKKSEKNEKRREKKHTRQTHSERRAGDLSERAKEQERKKQQQGEK

SEQ ID NO: 978062 - protein, 129 aa, Homo sapiens
MVSTSLTPSAPVLWFLGHVLGGNEHSEENRRCVLGGKKTQTCVVDRIGVDANATDASVLRTTMGETARGHNTNDRIRSEGVTAVLVRTFRIVLVSSCVEGSNVTLEHATPSWLQGSVIVSSSRAGPPSR

SEQ ID NO: 978063 - protein, 368 aa, Homo sapiens
MNSERGCAHSDVTPVVLDGHLQGIRCTELPKREGSSRSNERGVPKNHFASRRRTIPSMVSIKKETEDRDDNHKHEICKRMNNTASNESLGYTMDIEHVYPRRDTKYSQWDDPSKGRTEVHGTDTITASTRQEEQPPKGEHKENQNYRKDTGKERADNTVEKENRAARECKRGAMHEIEKNRMTQQPKQVKTTQDSETPKKVQNTTQGDSHTQLRIGASRNTRREPRKRHNHNTSRGQCGPPYGSKVEPQRTHTTRIASTRDNKPDEAQDIERRNAPRFVQEHINDQGSKTRRTHNEKTNCIDNTIIQYFRNTKIQGNNEDNTKREENPTSRERRHGTTERINTVGENTKQRSNTNERQTNINWKGKKK

SEQ ID NO: 978064 - protein, 169 aa, Homo sapiens
MIPERIGDRKVRTRTGRREKKRQRTGPDRHQRVTGATRPLGNVDETRDTVTLHASADHKWGERTPRADTSHPRDHHDAHNETSGTRHRNDAVQRNGTLDTTTEEIIGEGQKNNTQRGTAANADNTTSNKAAPEGRTTTTNRHRAQATQQHRKDKHEQSTSTRHNTHHNP

SEQ ID NO: 978065 - protein, 382 aa, Homo sapiens
PRVRHAVGNDRGSRSVPDEQLKQLAVPAPRSRPDSALEVWVQRLQEVVPAWQVHEWPSPRACWPSSVDARLTRVTIRDRAESNIAWQVTYITHGSHAEEAEAVRGQLQGAQRDGARQRTQELDGLILGCGRDVSSMLPPMPERRRCGPVTPALRWHDTLLLGDRGQQVDPDQPSRRHKTNIVPGVHALPVLPSCVSEHGRRDGPWGYDRDKHITGESDDAGRTIIPRHMGGWKLCVRPSNDGHGPLQMNHDWRGELDYNTKNKEAYRKNSMAAITPARILWHRWGHIHCRKDEDYQRQTTTQERTIIPQKSQQEMAQKTGNTPRMKETRNPQSSEGPEKSHKNKKKTEDKTPRDIDHKSTPREGPETDKGNPQGQPRGTTRV

SEQ ID NO: 978066 - protein, 273 aa, Homo sapiens
WDYRHAQTCRRLRALARELLGEAPERGSRAGAPPWRRGEPQRSAELSRRPARSPPGMRRPLPALLYGCQAAQPGHRIWDLVGWRGRSWLVGWLCEGEGLVLAECGVARRGVAWVSVVRVPASRGLRRECVRWPSPGVVLADAGGGRSAAVPGCSWFSAGLASNSSWCSGRRKAGVCPCAMSGGGPCPRMVGPQPDLHFLQENPSADDPEPMLAGTPRGGPSGPTAYRSPPPAGRHHTPSPRAADRPTNQHALDTSQGQHGPLARTSRMPPTYR

SEQ ID NO: 978067 - protein, 104 aa, Homo sapiens
VGVGGNADGSGGGEDTAFRISQALGIRAMGQALARHLYPEVPRGECDAWCGTGGVIRCSWKEGAGGGTVVGSLLGPTLRGREHRVPRQPFAMVFVYPGQCGACS

SEQ ID NO: 978068 - protein, 333 aa, Homo sapiens
MLLLLYFTAAEFPGIPASRDIDSRRSHDTLLITEGETKVKEGETQERVPECTEGLTSECGTRVPPSDDMITGPLVLSSSNDYSLDTFVALDWCNTCRQDEVVPAMECTNSDFPGHTKLNRPKVQRWREILPERAKPTRGMNTNEEAPKPTPEECGKSGQHGSRGRATQSRTRDNLTRKRTSTGACTRGNSTQNPQKQEVGRTKSACKERKQKKKRQKTKRGRNNHKLLEIGHIHSRAFPGNTAERQKKRKTRTPGRTTQGERKNHKRVILLTVGSTHEAWCMLHDVSENEENDNRNTERRKQYEETPTPNTKETRENKITRGTLELHKTMLDK

SEQ ID NO: 978069 - protein, 185 aa, Homo sapiens
MLYNGWSRIERGWVHKILIAVKTSSGQFPVKKQEVVNTLINTCSPRGGVWVARPLETCWCHAKRENFDPTEAKLKVSCFPQGTYRRTAAVTKLHLEEQNMVVRKSSGWNYKTFASVSTHEIVKQIGEKINIMAVYEVTSVTVVSDGKRSVIVVEPQCTLDGKRITFGKIDKVGKEEHDIYRSYTR

SEQ ID NO: 978070 - protein, 87 aa, Homo sapiens
HAYAFEEGDTYSPMMMNGKILFRDELKGFTSVQTSACRDKGSSKDKTAQSLQCFSYLFGDRKFMWKIVISLGLELEIVVFLMSKTYW

SEQ ID NO: 978071 - protein, 108 aa, Homo sapiens
MGRPAKDVLCYSREICGWGQRVDCMHGWVVVGKNLLIGIIGSKSYSFTSSAGGLPKSEHAFSPWSCQEPQEGESNKHTSSLLLGSHCQMSSQPYKWQDQAHIKEVEKG

SEQ ID NO: 978072 - protein, 132 aa, Homo sapiens
MRHVLVAILTYITRRKYSGPAGYGVSPYLPMYASDSYHRVFSYSLLASASSGGQEQEQVEQVVPVPLDRERTPTRGASVDANASFSLTPSRLVSSYLYGAIKFAVTNNLSTIETAAGYNPSTKTPLFDLIRS

SEQ ID NO: 978073 - protein, 104 aa, Homo sapiens
AGAERVLVMCCGCPAGSCGNLSAWVAGDPACHRRCRCTGEPAGDGAGGVAGGGLEPQDVQSSDEMRSPEVVPQRQHELRLTEEEISQQERHVGDYEVEDDTIWA

SEQ ID NO: 978074 - protein, 438 aa, Homo sapiens
HASAAAMPRPFQLLLQVSPRGPRGSQSCPLPFLRLHECQRGHTIPHEPRTTTAVVPAYRSYHQGEPLGESGMNLGGRHTRALKCQELTYPFQGTLETPNRSIRYPLTSKYIRRDLDGEESMEAGIMREHSHGITRNRSENQPLTTDGTRHPFHGHALPTPTQTQNDKTHTAYEGNPDNLTHNNDTHNNARTWHESRTEGRREGLDHTEKHNSNAKDHTHKRRTTSTHPTECTHRPQNNDPRGHTAEHERTHTHKQREGHQSLVTYDKRPKNPEQEQHPPRQKRTSHTIQVEHRPKGTTDRRQEDTGTHKEETKGNRQKRRRRKQHTTKTRIHTEPKMRTANTNKPMPKERETRQPSEQQHKGSQPKENDAANKRREEGTKNKPDNKALQEQKQDKETTHQREKKSSNTTTNTQHANHKKKRATKNQKKKQNKKQTGAT

SEQ ID NO: 978075 - protein, 169 aa, Homo sapiens
LALRLEPDGLEEVITECCGWAAYACTSSVARDIARCWCLESLWSPEAWVNVRALGTNTHRRYQLWGVQPTTWRVHDGWTPRGLRACLLFRFHTSPTALQDARARRRTCDFTRESRGGTASGSRVPGLSFGQSRFFVRGDLVVLGAPGSLEGSGVEMDLVDYGVSDQGAS

SEQ ID NO: 978076 - protein, 259 aa, Homo sapiens
RVCRLEAPDARVSFPQGSLTMGRTPTSHPPSGQRAGRMCDVSPTSQCLQLLEPSDKWDEQDLEDLQILIKVTMENVYHMTSISAAGPWLKFRGRLGYHTPTTCSLGAINIENRKANSVRSAVTQEFWARTLTLPLHTTDNIVTTGEVGDRENDELREKGPRLPGEAIAASERPIASPFGGDLGPLSPLRTRLFGQCIPPKKQLKEKGPLPELLTLRLTRVAYLKEFATGWDKAWTQIKGTLKDFQAPGQGTVKCIIDRP

SEQ ID NO: 978077 - protein, 205 aa, Homo sapiens
MNAIWPGVVGRPGGVVRGNVEEWATDMAVSPSSHARKAEEHVRGRAHLTYTEKAPIPTLWHLDRHKTDETREKEEDNQKLGGGSQTPMNSKAHNTRPQREKPENKHKKHARRTQNRHQTGNQEKTRQEKDPTKVTGPTSRSHHCNRDGIDGRYIRSRKRHTHKPNRSDVEDITPTQTREKTKHKRERTKKKHNNTTHHRNRPTQE

SEQ ID NO: 978078 - protein, 96 aa, Homo sapiens
MTERVGDEEETDDGGGTKRMTVPWDRVTLWRQAIRAPVSPRAGVVPRLWTLTNRVPVPPGQCALRTSQWPPRRRREQLFTLQTVNSSGTSDRTNST

SEQ ID NO: 978079 - protein, 268 aa, Homo sapiens
ARPSTSQAAIIAKDLQGPRDHGGEKIRRSWLWEAPAPENMAEQIIQEILTARIQEQKEDPGKPSDEEDAPSVDDANIRALPRPDQADKVGDKIASRRGLRAGSWPSWANGQVSRESVVPGWGRPKKIATVSRRSSKKEHPDRFIECYMAEQNMVSIAVGCATRKTGRCPFCQPLFASRIFHDGPEEQIRLVTTLFREQHQPSAASHVRRYPNRRNDGGLPGMAPRKDLAYVYVSGPHIKLSLYPSDRRCYREVHVETIRQYKGYLIHR

SEQ ID NO: 978080 - protein, 320 aa, Homo sapiens
HVVAFASRTPVLLTQVDYAGREAEVARLQARFVTTGAGGDREAIQDGRLRDGNIDFWRQHASGLVCARRLEDRMLIQSPTDSLRVLRLNSCTDRSYVRVDGAACCAFRDVPFTEAWSRRRLLRDPLACPPRGPLRAEPHSPVLPRVPGGVALPRRNAPWVTVSYRSQPGPSPGVVVARVPGCPSGGPGWVSSMVGHGRARASRWRSSLLVSDPGRGPEGPPGGPRREPGFDADNSVGIRRAPITPSRHLCKISLQVGDPFLVLHGSVEDEREVHAFIGKAGPNERPKKGGGGRRFPRGAGKVQRVLEAPMGVKGRRKGWN

SEQ ID NO: 978081 - protein, 288 aa, Homo sapiens
SAPCQTGQLCATQRGLQQSWMGPPVLPHFPPLVWDLGGSWAECEAPDRVQWIPSDCSGGSAALEDADRHSQCSLCLGALLPSPWAKTGATPWYTKAWGRLCRHASQRDGAPGVCCLDAAVRSVQGWKTSNFHCWDPENDLPMSPRLSPLIEYGQEVTDPVTNDRHGVRPGPREAVWTAVDRRDGVALVTNDKFVGIELRWFRWKREWKAEFPLHHSQSALTGRTSPRPLGGPGLRDGAPLKDFTGLIGGEGPGFLEKLCDGSFDVVRKGEWTRPQEDSGCDVTAERDV

SEQ ID NO: 978082 - protein, 46 aa, Homo sapiens
MAKARVSGGERWTMGGGSGSPARTVEILRHDPHKLLEVLPGGGPGH

SEQ ID NO: 978083 - protein, 142 aa, Homo sapiens
PGAPTKEHVNVVFIGHVDAGKFNQWRTNNVFEWNGGQHGRLKSMKEKLKSKNRIKLGYLCLGLRHQNSGKNETTVRQYKWVVAYLETEEKHSRILDVTLATESVFPNMIGGASQADLAVAGNLRPGQVMSVETGFDYRRTDK

SEQ ID NO: 978084 - protein, 166 aa, Homo sapiens
MLKARSLRCPPFGGRWERTRGPWRCRELAEGGEGGRWRWDAYRGPGDRGKPGVPRTGKGQIAWRACRTRVKGLGPRQTDGNTVSKTGEGPGHECAYSEDMDPLGTGISHRDPPGLSWPHMSRAGIHLTRLQGQDAGKPGKGERTEQLKGGIAKPGLGPQTADNNKY

SEQ ID NO: 978085 - protein, 165 aa, Homo sapiens
MGQRVPSPLRGSPWSWPRLLRAFSRCIWKEHSSEDRCFFACASLGDAASCMGVLRAGCPVKPIAVAHLFQLSLRYTRPEPAGACALGVSRGVQGWTFSLSPGPEAGARNGCLGWAAVVCAAVNGWTPEGLRGFSVVWPTAVRYPMEICFTLWRSYPGCLESESWG

SEQ ID NO: 978086 - protein, 686 aa, Homo sapiens
TRPPTFPQDMVMFNHRLPPVTSFTRPAGSAAPSAQQGGVIRPSTSSKPPGTLSHARTSAEPRDDDVTRKERGRHCIRPTVHVTRAPAVTTSQEGDTSAKNIMKGYKASQRDTRKDNNTAGTSQEENGRARITKHQHNHEYNTQHHSTTYFRSEQSARAHQTLRTQAFGTSNARRSSTPRGHHITQGRGQHVATTEQSRDTDHTTRHGTHIRPTRKTHTKANYTYPPTTTTSWSRTGKKRETKRHPQGHSDKQQDGNRCMKTSPKTQDHTVCSPDEAPSATRGNPRNRKMWERKNTADKKTRSTNKHKGSTQPYNRLVARKREEEGHKNTRGPKKKDPRDTNDHSDGEKAHKEEPTNTRQREQRPENGRRNTLDDKQSPVYSKCGQREQKMGTRTKVCRNRHKTITAAQNRVREKTRRYQQTYTRHEIPTGGQRTATVKSLHPADSSPTTKANTEGTGEETNVDTIQTHYYVPRRRHRRHTHARMDSTQAVVYEHSGNKTNNKITKDETHMNHNDRDGTTAYARKTSRQKSERRTEMSTCNAGAHAKQRHERHDEDESWQRHAAAGRQKPAEDKTQTSTGRRNSERETKRPGDATAATNTQTSRRCTNTTHTRQQQQDDNEKKADSTPKRHQPETTQQLATRDKGSDDTEREHSREQAMTHTKSTHTDARTTNRATRHASDTSKEQT

SEQ ID NO: 978087 - protein, 73 aa, Homo sapiens
LMPSRCAVSCLLGVLLAVKMCIPVTLSCAWPQRSPASYVDRDHVCDTEVSVSYSPVRGKDYETIVKDISISTR

SEQ ID NO: 978088 - protein, 214 aa, Homo sapiens
MTECARACCTAGVAKYYPSYWKGPPGRNVLTTTIGTLEVRPKACSRDTILSSTRRCAPMREEVLGHLRLLRPHNERCLGHNNLADSTLDDYTKFKPKYPGTIGAFHSPKAWQAKGEQVLSANGEPYLGRPSCCLAICIDPEDLPIKSTDIEQSIALSTKRLYTARATQFVPERQTDLAKRKAAAGKEGAPHRLAPPLEDDNAPWVSPWRDAYLL

SEQ ID NO: 978089 - protein, 204 aa, Homo sapiens
MGPASCPCLDCVCACCMLLPWKIRRRGGSEVPEGKDACHKSALSDAWKAKTDDGKVSTLVFQGCGSMRRDAELGKNLIGPGLRFEEGSPKSGSDECQTLKSRAVYQRQRQLGRGEVGGKNRHARGQRLTSRCTTLVIKSNTGLLQTGSFTPVVSPPGRPEGRDLHKEAGDALPAVVGGDTNPKKREGGPTCEIQAGGPMKRHEG

SEQ ID NO: 978090 - protein, 284 aa, Homo sapiens
SIQYQFLRRYKLADQVTYRVVHVTDGQLDGQGEQLVPEASCHRCLCAPRSCAPFPVRHVIQNPFSTGGSPRGRGLSGWGGNEFALYDRRRSRWWEILPAVSCTRPQSQSLAGWRPVLRHDERPRMMLQNRNTYRRLAPRTTPLLSNEVMEPEDPEMRGEEPSRHESGAESGGDRIERLASSSFRKLIHTVRQDDEQTGSPLEGRETWCKACEEHPDELTQNRAAQSSKTVQKARVEPEWPKTSERANEEAEDSKRTDQPEEKVTRTCARHPHRTPPSKIIHAKT

SEQ ID NO: 978091 - protein, 141 aa, Homo sapiens
MHPMPSVCEIVVAAHTVDCDAGCCVGTLRGVGVGITVVAGVGRRMVLSASVDGGLVVDDARKHYADYLGEYCPGGIPKRLLTRLASLLCETRDWFPHKTLGYSLVAPVRVPIKFQYDYTWQFKRPGWTGYRCSQGGIEHCL

SEQ ID NO: 978092 - protein, 107 aa, Homo sapiens
MPFSFDKNSGSQTLLSGHLDGKRVDQAITIALESAEWSSMGKLEQSSTSLPVDSLVLASKDHLVEGLSIPFKGVLRRHFPRLTVKGEKATRKELILFYLRKTDSSGR

SEQ ID NO: 978093 - protein, 271 aa, Homo sapiens
AEPLYVLFRAIQYQVDKGPVAAVTGKAKRTLNDSRVCCVDDVEFQPLTSVVVLGVWALGTEPGPAEASSGCCMRCAMPGVLDHGRTSHLHGQRIKVLEPGLQRAPPFSQMPLKCMPIDHCSGCSGPGWVTTLSDDMIDPRVTLEIHWIRGLRNIACKATTTVPRIVMATCGGSSRFKTCTVVTGNPYSQSPVPPKDCPVGEEEHTHAWEGLADVTCEGVVASWHPWLKKPPERGPEGGRMVRVPTSLPGKLRAPRNGPRPFRKSNLNPFCV

SEQ ID NO: 978094 - protein, 201 aa, Homo sapiens
MAAETNFTCIGDQTRSPSELRSHILEVVALKSTKIGRRGELDPVTAVMAWCKLKNQIRDARKCIVQIATLSQITNNDLTQLGRIQMRTDGRTICVGAPCAKIYRHCTEETELQGFSVKLPRKVMVNVIIWEQIQHQKGSTAIPSDAPSLWSMTLCIIPLSWETMWALRVALKYHLAPIYNLKTREGEKCCFKSGAGRKHKY

SEQ ID NO: 978095 - protein, 202 aa, Homo sapiens
MTSDACTSMRGCQLGRLLVTSRLTERQSQSPIPVPTNYSEREAVSASGRNWKPACRVKDRADTPCQWSRMASEGTNIPSPVVRQIDKAVSDLQYMTWNGTRITRFSPVCTTFCERCLQNYIPDPQYNPLLPSCAAQNLHTCPRKGVARLQNKYLSSTQPDGQCCKNELQAATAEGVFHPGEQSLMWLVVKASHHARNQRGAL

SEQ ID NO: 978096 - protein, 138 aa, Homo sapiens
CSFVLPPDSLNSSPRPECTDVLQRCPTVSVCVGVPVHSTIPQFGPTGEWPGATTCENTCGEACTKNVLYPLETGPRGHGPRPLNQAQSLAEGDIMKYSSDYVDSRKRHNDYQNNSLRCDVHDNTTHTDIMTNSVAPST

SEQ ID NO: 978097 - protein, 115 aa, Homo sapiens
GVLYGRAQLMSAAMGPDLETGTRAAEYLALPPRFLLPAPTASPVLCFVERVSFGQRWSRFSRELARTTGLEFHWLLVPHLCGAPAAEACEPGECMSRSSTHELRGCRTDPETRYL

SEQ ID NO: 978098 - protein, 383 aa, Homo sapiens
EAWRVSTIRLRPCNRNAGAVVCSPSGVRLISPLWAFIQIRRAANYSRLYLCKPGNADNQGSELDFVGHQMSSEDLASRSNRQGRQSLKEHIATVLVEVVDVNDNAPEITGSSVYSPVTEDAPLGTVIALVSVTDLDAGENGLVTCEVPPVVIRYSLTASLTNILHWGRSRADLDRETVSRIRSSASPDRDGGTPITSQPLQYCVFKVYRFNEKPPRNFSILLRRIHRKNTSSAGLQEINLVAGNPKTRSIARTTYLTLEQGGETGHSRGPAKSDTTSVQHLGIVDSLSGPIQHKGRLSQLWHYTEPLTGKRGTHREPTNNNHTVNIIRQSSEVTNASKGKTQAHGHHRNMSHDDIPGPQPTTQSTQCTLVIKTHHKPPRHHAP

SEQ ID NO: 978099 - protein, 372 aa, Homo sapiens
MVGQCGRISMDHCRVPKQGTHTKDYHHTFYYYIYNTPPYHKPLFDTTQNGNTATRAEEYIQAPLLIKGTQDPQAKVLYSITIVFGFGLPSTPVNRKFVKAHTGYSLTLDRSAITSSAKSGDTHFGKSGLSSNRVGGGHSGAMHWAIHESAEKVPLIIEGHLSQAVFTCHDGDATQRIPCAPTAGQSVGRYMSRHSNKGATTQERILNIKQGIARNRSRVMTHTRRQMSTLSAESPQQYKLGANTRARSRATETYHCSSEEERDTHRETRGEEDTTQKAQDDRYMTESQIRHNTSLQTVMRYRPHHDADRGVSVERRGATYVTILPRLDSKRAQRCQVEDGGTHERVKTLRDPTTLAQHCRQLGDRLDSTSHS

SEQ ID NO: 978100 - protein, 143 aa, Homo sapiens
MATTFLASRCSCLTQVVGATQVGATDTVHQGHLLVWIMCRTRPSSNREGNPHKVELSTEDPNHVRSADLTYAGSCANVSKVQDTPKSGMSREERLKCMTNIATKNPRRAKIGNGRGRQRRSARSISLAPEIVRAQSGCKPMDR

SEQ ID NO: 978101 - protein, 67 aa, Homo sapiens
MREPAGTTEAVAVSPQAVSESRRYPVLKTVHEKYKARPLQCCSSVLTAANGSHCLGDGLGTKRQLGM

SEQ ID NO: 978102 - protein, 117 aa, Homo sapiens
MEDRGTETEGRWPGVVRGLLEFQQPLSKHQIQQLDWTDSPEAPRAMEIIGTERGRSDKYLGEQPKGDSLVSTNQCVWNGATEEVLTPRGILTNKPEKPLGRRPKGKDGAGMKKAKHP

SEQ ID NO: 978103 - protein, 180 aa, Homo sapiens
QLTPEIKSKAMAISSTGYQRQLKYKHYDGSYSTFGEAEYGEGTPGHNNPWASQSPLVVSLDKTLWRPKGRPNSPEPMSVFRSRKCEKKARSQATGVNTPPKKGPRPLSNFNMGGPYSRFRPPKRPKGVPKGPTKEGGKNPQINLLGGPHLGNYCSNRPGQKGAPFFPLCGREDPPCPLPK

SEQ ID NO: 978104 - protein, 599 aa, Homo sapiens
MQAHPGSTLSLAPDASAVCQPSTPVRTDYSDVLALFCDSSIGGCRIHLPLRRFPGFSRPLAMDGDGVIRLHRAGVDPGYTRAELHENNSNLGPWVTLNTLHWWWQLAKRPAGSTRDTVNRSLPAKARLDTSSAHRRRARNLPHKRDPRTHSTHMTMRVHDTILTTATKERDQPASNTPTSHLSTHKMHRAPNTNTYTDPRKHSHTHAPTATIIANRVPPVLRTSHIQMPAQKHPVRLRQQQHGKTHDTTETTADTTPDSHTRLTRAPTQPTNHTTTPDIITNTQPTTNKHHRQTKTTHHTQHHDTPTTKQAGQATHRAPRGPRYGQRQQSEEKRRLNHSYAPYTTLTARPSTRAPPADTERSDRYGERGLTPHSERAATERTTQESDQAQRRHDQRKTHSTPPTHTQNREPKQTTHRTHHKTQTQRIATNMRLPPYATCARPVGRTQPPAESDKRETTPAHTHRPYTNDHNEPLVTAEHKSRADSTTTTDTSACTGRPTRVTPAAERNTHPKHTPPRHHTRTSLAKRQRTQIRKPAQTHKRLLPSKLHRARDFGRRDRSKQIARTTRQKQSETQTRATNRRRAPRLNDTQHEATVEHRQ

SEQ ID NO: 978105 - protein, 300 aa, Homo sapiens
MDSALRQKSLDGPPPSASLACSVVYYVTSNDLTSASPTTAPPSRRTSLSPTSSPDPRRDRHTTRVRMQHSKHYIPTSRTKRSRMQGGSGGVRDGTDARGERRPGANRDAKGWSDGAVGRDRMVREKETGREPRRLEEGRVGIRQDRYYNARNSREGQNKNATKTNKTENTPEQNERQNKPSHNEQGRQARARPTQRKEKKRQEKRKQREAIANHNTRRQRDTKRQPQRQKARSDDIRTHHKERAEARHNSTSDKQNTKRRKQSKTGERQQKETETRSKEKRPRNSESQKQNTESRTTAPE

SEQ ID NO: 978106 - protein, 92 aa, Homo sapiens
ARRRRIDRRVDVIRNVLGCVPSGRPSCRVLRLTRLTCQGAKPRGVPNLNAKVTSDPPDEFEQWCSELLSDRPELHRCTCITLHVQSMQMHRT

SEQ ID NO: 978107 - protein, 183 aa, Homo sapiens
MSSSCDRHMGCRGLAEPRALKVRLHVLLLLEVEIIEPDSTRRQGVEVVRMPPRGTGRRGPARADAAKTSVAHRLNGYARASMSLWTTRGTVGGMGPARMDLVHESLNGIERSQPASGRSTQRTAKVPEPGVATTGTNAVDTEHRLYTHDDGTPWMRKNTKDMQTRNFENVMHTRKRPCKTLTE

SEQ ID NO: 978108 - protein, 391 aa, Homo sapiens
QLPSCYIHGIEQFVTWAPKFRENWAFGAGGQRRTVGERFPTGRLRADLSVRNSSRPSETTVPQNLGTLKSPERRLQMAQTLCVLSLFPCTPEPVNPEPDASVSSPLGRQLPEALHHISPNRQRGNEVSRSAGLALSTPVSIHQRQLAQGELDQLKEHLRKGDNLLNKPDERGFTPLIWASAFGETETVRFLLEWGAEPTESVGNERESGRGTQGQQEAGNTDHCGGLAGWSGVERGTFSIPSARDCDATVPLVVSLRSPGNPGVYWRLIGLCLARGRGPLPLGFSVCITPADGPVMGGHLKESSRQATQGRRKKTNDRSNERDETNKTRGDWTTINKKKVTERVKNTNGVTHLSASRRKKTHKQEQKREKQRSTQTEHTCNRKVEQDDKRS

SEQ ID NO: 978109 - protein, 221 aa, Homo sapiens
QSVELPKGDLGPASPSQELWSPMPGACDGDCVLPAPRVNDPPCECLTCRHVGHVGGRGVAWFPVDYGYRAFWRGPGGVLSGWARQCPGLVKPGPPPFSVCHVVVCRFRDEDTCLVGRHCAWYGGRPPRCGAFTLWGTTSEAPQSQKIVQSPRGGNNSQLVWQCWPLGMGAAVGQLMELQRRSISTLLRQLMGTQEFKREHPFTQREKQVGNCWGTNPPQSE

SEQ ID NO: 978110 - protein, 192 aa, Homo sapiens
MTAGDGRLAEWSSRQLVCSVQSRFPRQPLESLCILKPDCQVLSSPQGMSSSLKALPHTLTQLVQRGNDGCLSSCRRSLDVPGPSTQLAATGRSWSILKEHFCGKVTNLVNKSRRARVQPPSSGPPALGDDRDCSLSWLELECEAPHTGKRAKDPPVVEQTPGGHQHIGGGCACNRYLQIQHSMHRTCGDPHR

SEQ ID NO: 978111 - protein, 246 aa, Homo sapiens
LNEVVEVAKRGGDKRGLWLCVSPRSAKALKDITMDFQPSPRRARPVSGGRVGLLLREQACPLGSASRQLALETDRLQQGPGTFRGTTVGSYEVQDSAADTFTNNEGSYLAHTQGEEAPDRSWPGESSEGGRRRPLPQARAVRRSPVRGRTKFVKDGRPGYEVTKQRDSEMGQQRLLFQIEYPEEIAEGLRPLSSASCLRTSKRIEPPDRRWQYLASWPRALENIAFKVPSREIDRGRASLHHWNRE

SEQ ID NO: 978112 - protein, 84 aa, Homo sapiens
EGSPPSRPLQPRGGQVQVPPRMGAWVPAAARAPGWLGGVGPLRGLTMWRQPWEAPLLHPWSLPESLEPERFRLDCALAVYTPSS

SEQ ID NO: 978113 - protein, 192 aa, Homo sapiens
MPRRVHKHVVDESLPNTPSHGCLEQTAYGSSKPSTLLGAPGQQMDEYFVSEIYPQNAQRTNRFIGTTARISNRAVTRRSHKNFGVRFFGYRRKLGLVPKGGIRKSPIGVPYRPKGSFQIPPPVGNFGGFGTFLAKNLVEILVGKENAPIAGLTLYRAKHVGKCCERHICASNWRPIVVRSHLTSGARCPSPV

SEQ ID NO: 978114 - protein, 241 aa, Homo sapiens
VNREHGVIHGCQRNVTGWECVCTCQGVMLCRDRDWDRGGRSEAYLDGGCLRCCVAHNCPGVVALEPSTAYCPAGVPQQEECWLAARRVLRGRTMALWESLEALLQKGCGHLPKAEVLVAHGRQVQCGLCRVMCLQQGASWALAFQANPNSEEIWLASREMLESENDEYERWPWKACLGQGRWKHLHPAVPGVMNVLLKLEWVQDNIQDSQVSVRMRPAAPMRTSPTVADEGAHRVGTRHIM

SEQ ID NO: 978115 - protein, 145 aa, Homo sapiens
MGAPIIAPYFDLILVACVPPLHILRVMGSRSPCTLYNVTLIVCDHCPRSPSRTFRSCDIVAEYVVWAGNREEGIGVKCSSRHLSSEKSYIPPSAEMSFLVGNARGSCSLLYYPLYFWLSYISILNWWVPLIDMYLVYSPFGGKHR

SEQ ID NO: 978116 - protein, 321 aa, Homo sapiens
QTAVVQRDADIGVAEAERDAGIRELTCKKEMLDVKFMADTKIADSKRAFDAATSQPSVRRLTSSTAEAQSATELQGARCNSQKTPAGKTTRALERLLHAQEHTTCPWRHQETPGVPTRQLIAYSCAGTAAGTRPTAIHADLPRVKTVNAGPLAHRQSAEKIRKIGRGGSGSSSRRWATAEAERMKLKAEAYQNIGDAANDGLVLEALPQIAAKIAAPLINGRCRIVVLSRRPPVKVHIQTLKRLLSRACLASVACPQQGVDLVSDNPDSEGNGCCTVLTLLPGHFSYEATGTSYKTRNKYTETRARSGTRDALFPKRDHKW

SEQ ID NO: 978117 - protein, 146 aa, Homo sapiens
MEQVEQSIPPLSEETLLPTLERLREDLNRIFCLTPRQVSPLSVGAIKFITTIINDSNPLPDKPRYQSAPLRLIRPESAGGAYVLLSLPGLAAGITIPTKQTANLNTSFFDPAGGTRHPFVYRTPILIYRSPCKFIFYPPRLRSKLP

SEQ ID NO: 978118 - protein, 203 aa, Homo sapiens
MVCIQSIWVGGFLFPQPQSRGKRIWATARKRVKQTWKGKSESGKAKGRGPDLVFYLAAAFWVAVMYSYYPRLSACALFPKVYKCCAGPPPAYFSTIPSMPCPVPMINLPCWMSCAVHSWSQEGMGRVERVCPCSLDAPWCASCLPSPSSVCALSGSLGTCASNLTQGQHGEEMVAGKMHFIEIFYCWEGVFLPQFVCEYSLVL

SEQ ID NO: 978119 - protein, 73 aa, Homo sapiens
APIAQLGQLSRLDLTSNRLATAGSCDPAFLSWCCDADGLSLPPWCCCFSWEPPALATVMLAVAAVRLGCCACD

SEQ ID NO: 978120 - protein, 384 aa, Homo sapiens
MAKCSWEIRRSLTPAASIHSAIPSGTQIVPMEIAIEHFGLIAYSRMALADLFINNIFQYLTVQSYRNIDPYIAESTYIVRNTLLGVHDQTHHTRTRPSGLYMHSHKESYHKRVLNHHRRLLRQDVKHLAGGDSAGTQGWDNVICNILPDTTEYFTQGINPPFPRPTHGTRYPGGHMGPEKNANGAGPLDILGKYMSVLRMDPFGPWRPHIHLVDAQRYRPWTYAYTFMTEHPIGKHMGPSILLHFPWGFQTIATSLTMGPTLEPYHIVQGTVHTTRVGAARPRSRLEPQRTVRRHVRIAGHPVQITRYMVGRQDRTQPPHNLSTAWTIGIQIRHRGHHPEYSDTPPEHAQTRQDHRTQHPPTVTRGEPHNSTMSHGDDNHHTYR

SEQ ID NO: 978121 - protein, 404 aa, Homo sapiens
RDFVGESTHGRHRMQCYVYRKQTKKHGAMSRATAGGQTRANAQTCLRTAGRCTAPSVAHAAAGDMNTGNGHAHGQLHGTESRSEMTTYRHQSSFTISAFDNIKLPDSKYIDIKLISDKMTMTCHCTKYHEYCDMYKYLYDSNYSVLLHNLTRWCDPYDDMCDYYLVMATVKKQNEHQRDVHNPIETTQTKTQKDTSIDSQEYDDSVTTIPPVTNTTYYGKPKRLATIVANLMPSVSTARHKERTNTDLIRVPPIHTSSIKNQTGLKTSGSFSYGLWDCHKINIGTVTDTQIGRPPVDGASYNKFNAFLGTTRQLQKTPDVNIQDDIAKDGRQWERHGKTRDSTPRITTTRAGTNAEVTLSDDAENEGWHKTMGDSENLPRYTKRYEKEKGPPGEDKKKEPEMMQ

SEQ ID NO: 978122 - protein, 216 aa, Homo sapiens
QDRVWTCVFPRKEMAGELQWTQCAVASCCEPGADQPGQLVVNPETILLLSVWECHVLSCAVNCASPGVNVCAVVMAYVEPGVCTCYLFIVKMANHALCNEISEGDLMSLWDTIAPKDLKEEIDIRLSRVQDIKYEPQQSLQMMMLDYYNWKAREIKVADNYLYRMKALDAIRNLMRSHFILKAGSPYLNGQEYTAPTLLDLRNTSTPYKGVRKAPH

SEQ ID NO: 978123 - protein, 187 aa, Homo sapiens
RGVLLWKDNWVSFMDTMLQMSILGSRKHGLYLPTRVTAIHIDPANHRQKLYTLQDKAQVADRGGEQVAEESQLAGGVHISGLHTESARRGSRELQVPILEKFCFTPHTEEGCLSERAALQEELQLCKGPGAGTCRPQVTHAGAEEWLVHLDWMCAQIPREPSQKELPRTCVGCLTGFSSTGNLTAME

SEQ ID NO: 978124 - protein, 467 aa, Homo sapiens
TTNCYVTLSARVTQVSAVRDLQLQTIHVHAPYGIYRHAFEDGFDNCDAGWLSDRTVRYPITQSLLVAMATVAAFQGLRSYAEAQPTGTLRCAIAFARADWGARSLYAGPGPPPDTGRRALHTCRPPGLPTTWPRLGTDQHTGTGLQGLDHLRPGPGWPTASVRIPRIQHRRRRPLRERPAPAPLPHPHYRPPPTPGPGLSHITTTDALRPPYLLSRSLTPPPRSHTMEHPSRPQSLTRTRPATHSRIHHKGPQAHDHSEPPTPANAPHSRTRQPPDFPNEHPGTVPPPGRHTPPWQPSHRHTTHYTNTTPQPTHPQSTPRQAPHTAHIAAPRSDPTTVSHPTAHSQPSDQPHHHTYTPRAASPTNHTPHTNAHLHPDTPDHHTSTPRTRHQRAHHHTTHQRRNTRYQHTHQRHTSPSHAQPHTTAHPRPTPAQLARTVPTTILRPDTQPHDHAAPLTTNHTTPHTPP

SEQ ID NO: 978125 - protein, 207 aa, Homo sapiens
LHNTTPSYSFTHSTNPTSIANPTPARTAGGWCPRPRAPGPSLSRRWLPRPGARPDGQPEEATGPPRPSGRTLRRTHTFNSGEAGLGTDNEDARPGGHRLGPTPPLWGGGQDCAPTCPRPGGPPDALGSASPPGTRSERRCQNARGPRATSEWVHQVTPLEINPRSWRGDTTYTTQRKAHTTESTYTPYPWSRKTADNGLGEWSGRER

SEQ ID NO: 978126 - protein, 114 aa, Homo sapiens
CTDFLIQPSPTCLGERNYGMVLQRERDLNTLQLASASTLVKQNSDDGGEQKLDSPALGSAKEEIGYLRHQVNLRDELLQLYSDSDEEDEDEEEEEEEKEAEEEHEKKKKQRKTC

SEQ ID NO: 978127 - protein, 161 aa, Homo sapiens
MARSEREYNAIAWRGIPWSVISIDKTGRAISVLIYDIQGSLLYIVVTPEEGKYKLCKVRKDLVGAKGIPHLVTHDARPIRYSRSPHQGVTDTISRWIVETWRRLLISIKFDAWYTVCMVTGGANYGRMCVITNGTRGILDLLSVVHVTRCQWQQFDSRVPT

SEQ ID NO: 978128 - protein, 63 aa, Homo sapiens
MKNQESRTLQDNSHSNAVATPDGVICGGRTNDDGETQGRTDWTCCWLHDCFNGRYGEALRETG

SEQ ID NO: 978129 - protein, 119 aa, Homo sapiens
PRVRSGVGSLVVGSWSRDFRNEAQTFAVSVTALKDGVSGVSSFQWVRGLADFKNEAADLHSKCYQLLKVVRTQRVSSSKIYGEDRKNKASTVWKGDLSGLPLLARVASFYSLIVPAHVC

SEQ ID NO: 978130 - protein, 172 aa, Homo sapiens
MAPNTRPYHYTTHTHYPQEHPAATPQQPNTTHEHKRHDAPIHQRGRKSRAKHNPSNTPYNALTTKQTQQRQYPQDDNHRYTQALVITTNEPTATPDYHVRLTTTHTITTPHTLEIAGEGNEQPPVTEWVGANNQQPSYPPGTHRVHRAGDKNHQTRMDHERRDKTRRRSEQR

SEQ ID NO: 978131 - protein, 370 aa, Homo sapiens
GPSSGPHHAWDEEPNATALLCMYDDTLRTADVTHDTWCGGVCVCGVCGGGAPKENATEKGALEGELVGLARISTTRPQGEEEEPPVMSAALVAPITTPALGRGTEERAGESLFGPLVYRARLYNTEETPRLALRVTCGPPWCHNEHSYQPRRGRELSSTRESDPREKERRGGERGGDAACGEGGDKRGKRQDMSGKAHSNARVWRAQQERGRPRGDPTKAQRERDTNGPHPYPKRPMGRPPPEQTGDDSGDTPQQNSLYTTGERTRERTPTRGDPHPYRGTPPKITSKKEQTTETTQDSPKQRAHCVTQAPPKSVASWTTRAPPTRMGPHSHTPAKMANGKNPRTYGAQGEERGGTKRGAHDGQNNRVCG

SEQ ID NO: 978132 - protein, 303 aa, Homo sapiens
GTRHLPGSNAPSTRDPGGSLPVLGHSTAGFNVRPWAMMTLWHDDDWTRQLILRLTMRTSENGSLPGTANIKALAAELNQLAVAKEPTKLVDVYQAELAESCVLRLDQLTVNSARVEVAMGQSGHMDPWTTCECMQLQDETNLRLEAENNLAAYRQEADEATLARLDLERQIESLEEEIRYQRKIHEEEVRELQEQLAHSRSNVELDRGQAKHLTAALTGDTARRLRPWTSATCMQPKSGTDPVCSTADAAARTRSCPPGQPRKPGQPGTRGRHDPRLEDLPGRRIQKGQWPAGTATQEEQHPG

SEQ ID NO: 978133 - protein, 129 aa, Homo sapiens
VSCFSCSSSNSKLTLKNKFVEFDMKPVCKEVLRRMFPAGAEDSGVKKLSGADLLAMAHATGAIRTLQLMALEGPLLMSSRLTIIETPIREPYPCASTHGVVRTDYGTRTVQNTSQYTHPARTPYSDKSL

SEQ ID NO: 978134 - protein, 304 aa, Homo sapiens
PTARIAGRWLSDILLRRFLASVISRKPSQGSDGHPITIQQPMQTPTTAAPCAGPEPATHRKPQPPGTPTTPTARNSTLAHTHLTLLPRHWHPCTLSTATRPLAPTSLQAPPQPRLRLRTSHPTGPPSLRLAGNPPAPRTHLRAPPDADLTPATRHCASRPNRTLTHRAHTRAGAWHLGPPHAARRHLPAALGTPNQPSNPNPAPNLCTRYLATRLAPTARRTRDPPQHHMGPGAPCGAAPQPRATTTAHTPSGPTDGTPPPPAAPRGRHHPHKPARNHPAATTPRHRTTPSLPHHTAGAHHTMA

SEQ ID NO: 978135 - protein, 280 aa, Homo sapiens
EIFQDMVHIRTKPGPVTQYDILFDNLSSAEHLYLYRPAEGPVTSEVTLKKSSEMLHIIVLEDKWNLTEPLPELGCMRRNALHRHRPHQLGIQGAVILVDEPTSGMDCHLQEGHLGSSSAGMKIERNQSCLTHPLHWTDGLTCWDDRIAIIGTQGGEAWHEVADEVTFAGTLKARQHTGDLGITMDLLWFTRTPDTANPVKRNHSSPTHWIPHPNTRVGAKRPHRQWKNAKATERPRKQGPYDNTSPEQQDGTMLGTGQLTEQTGPHTTERRWDKANAEEE

SEQ ID NO: 978136 - protein, 132 aa, Homo sapiens
MTRGDSGWLPVRTPRGQGRETVADTPEAAFGVNDLQAGRYADIRQNSRDHGERSRDRTPLSSSTGSRTTIPILLTCHRASSKILPSARRAYVAALRWRAMAIYYHIYRYMARHAPFIWQDLYVMPDYRAPSD

SEQ ID NO: 978137 - protein, 192 aa, Homo sapiens
MLITPERTAIPCDPEMSDHTCHMARSQTATQSIDRNWTDVDDQIMVKTDCPPEAGDKWCPLATTPHIASTAYFANKLTFHPRDTYKASPVDVDGYHHPWPLVKDGLTLAQILLFDTPVHHPTDGGIAVGAKQHENAITHRLGRPNTPTQTGQAPPTQRRTDAPRSHHHPTSANVTDTQRDHNYHDTAPPTRP

SEQ ID NO: 978138 - protein, 150 aa, Homo sapiens
MSQAGDAALICLDGPPVDLGNVPRWRVALTDGSQHELRETASGNSSPLQRTGHPAPTETQNCVWWKIPERNRQFGDAFSHEQTQEPREQSPGARSRHRQRRQRDSIATDWRWRTLATVNDETQQNKPLIRERNLPVVGCDVRELIEPYDL

SEQ ID NO: 978139 - protein, 235 aa, Homo sapiens
MKFESMREIVHIQAGQCGNQIGAKFWEVISDEHGIDPTGTYHWGQQTLQAGHASLVYYNEARGGKIMFLVRILVDLERWDHGALYAQRPLGADLENQNNLVLGSDLGHGNRTGPTGHIAHEGCQSWIDSVLDVVRKEAESFECLHGLPADPFTGRGTGVWEWALSLAGRSDKEYPDLLIMDVPSGVVAIHPKRGLRTDDRGAKSAPSPCNQEVENTAATYGFDKRGPPKDILLRS

SEQ ID NO: 978140 - protein, 186 aa, Homo sapiens
TRAPEEYQELEAPSEDNSWKNCPSRDLSAWPSQCCPLTAPAEVRVAVGPRISVTCVPSPCHNWWDMLGRAARHVGFGGFSFGPGPRGGELVLHVYASAALLNTAPCLAGPFFASGLLLSKQHISITRTERDSDGNDEARRPRGTESSTGQADIWAQTIEKHPDVKHGPSIQTTLVPGSTQLDSDFN

SEQ ID NO: 978141 - protein, 249 aa, Homo sapiens
CRLGPAERSYAPRAEHTARAPAPLRARFMTVSPDRRPLASPRRRSIGPLPACRDGPSSEGRTGMCALVLHPFGGACYTPPVVVCSGVPMPAGYHAVRALRTACSRPHLTACVEVRVSPASAGHRTTGPRFLINVTVTQKVQMLPLCPRTSYPETASGASDWRVVLRDPCVSTSEPSAETRTLGVGHRGRCKRCWSRSKCRHVSGAQSPWKEAKESLRKLKFVPHSVAEEWLPFDPCATAIGSQLGTDRV

SEQ ID NO: 978142 - protein, 296 aa, Homo sapiens
MVWHLRPDSRGLEDAYGAVPVAMNRIQRCPSSGTPRVGRPVRESWISDDSSQEPPLHAWNHSQIKSAAVIAFNLRPVLVYWALCLCKAKERTSDAWPAGLHSDLVTEVGLLALDDFLLARGSADRTGKLWRRARAWGRALTLRQTWGWCWAPMDLPSGRYCECQPKLCSGMSGERDVGTSVKVLGRIQDSKLLTELAPMRDLGARAPHGADDGRPWVRARRSKDNGEEAGIAEPQEANAVGHRPEHCKAMRQRQGKRAGEERTMGKAEVTGYTNGYRTRETGGATYQQRLGPRWDL

SEQ ID NO: 978143 - protein, 324 aa, Homo sapiens
HCVGDDLAEPWGWACPRLPCCALPSAWAAGAVQCTGHAAPVLVLCSAPEPPWECPEAASPARPGSSPHLPAALAEQPALPSGLPPCSPLLPAPAPSGSALGSYVGTQLSTVRDCEAGRYWAPGKGDTSICHNAVIHWPLHLLPGELVGPAVDHPNRRAAERRHTERYLETFMFGGVMLKLVEHDQYIPMTGQTLLFWWEQKHCWLLKTHWTLGQIWGPGRCKAFYFTPQHKNGCAFVCRIWKLVTVGVQLLNCGFKAVSDIPANLNIRKSKNFPCEDPLVNIQKQKTKTHLVDPIEISNRKSQVTVKATGYRNMTILRKERITN

SEQ ID NO: 978144 - protein, 299 aa, Homo sapiens
MPAAGANRLLLLLLMAVAAPSRARGSGWRAGDWCAEGVGRNGREWRRPVALVGLLLEPLFEIDDSANFRKCGAHCSGAPALMCTVVPVTAASSCEEELGPTPGCGSPEWAVPGPDPKADPGALDVAGSWCLCLLLCPCVLPGGCRTCRDQLTLRRVSVAAYVVGVSVVTATLGAAGALRWQDVDLELFSTSVAVRRPPGLGPETVAHLSCLGDVTGPWRAGTPQEQKSFFGNYCVYIISRGHVLMSSEREERGPGLAVDELEFVRSYCVSGQCGRIVFNQGTMGVLCQIQRDRSRFREM

SEQ ID NO: 978145 - protein, 100 aa, Homo sapiens
MRFVARRQTYISDSVHLRYGAATVGALSWAGGKGKNFGGPKVTQSDNCLPPSGSEGVVNRWGRGYWPGADPLVGCWVYSGLFPGYSRLENRLQWRGVEPL

SEQ ID NO: 978146 - protein, 221 aa, Homo sapiens
MKTVETNSINTDSRQQVNAYNQRQTSLQAKGLEDYIGTQCQNEELRRRKGTRAHCLSTYKRERGVNTRKRDQKGNISGRRISVPTAGCTHQIDNMTDSPSQSGQQFTRGYHARAPAGQQRDTDQRKPNRAEGGQKHCPYNRAPLEVPQEVTRRLHKNEIKNMRHTDGDKQRKTANTVRQNKQGVKHTEERANTTAARNNKQNNTDDNEQQNATTTDNAASE

SEQ ID NO: 978147 - protein, 325 aa, Homo sapiens
LNSQSLYKLVLSLDAARNQGGVREMLHAVVPGAECGTALLTCCCCSAGLVCVVVHGCDEMGSVLHCCWFESVEYVRGLLLWTVIDICASYCCVPYCMCAGTYVLCVMCWLLCAARMDLMWLLTLTAMHALAAVLHLCVTNGVWDSVEARWSQSTGGGKYKVPALEIPPRRKSPLTLDNSETNWGDVKALTRKHGRDWKERGRHWICPLGEDLVHHWNLAQEPASKKTSDSLGGSGKRVGVGTPRTVLDPNLEKAKHEGDLAHSLGGERLPWKGDWWRNRGRTGKGSPGRSTREVAGLAHIPRHEVSNPPKGHGMSGSTKSDREKK

SEQ ID NO: 978148 - protein, 292 aa, Homo sapiens
LAGAGSCLRASARCERLRDVAEPGVSVLVANALWVTELGQPRSICACMLTAWWPLVRELAVPYWVFSWAPCDVCAGLQCPLWALTCILHQTQDSQCLLDSGVWFFPAKRSQNTGNGWKITCSRHCPSSTCDGRYHHLRQGQRYTGIICTKRTRTCSPSGDEDPGKFKEAELNDGNAEGMPEGEKLVNSTPAEVDIFELLKVFYEKFSSLRAEDIEQMLVKQRLKVIQYLGRTTGKRSVVRAKLVTIGSYHLISMEDLYMVYKARNVKADTGDNKHDNGSKRTTTITNRKLPN

SEQ ID NO: 978149 - protein, 283 aa, Homo sapiens
MRLQARPPMMMNEAAAPQCGSVRPDGARIARQHPARPLEIPRGERPCVHGYELSGMRRLDQGWRTPHYTIHQLRSARAVVPARGPRSRVQHYGTQRVCKHSLPTSMGLMSRSIVRSHARFTGTPGTPCHSHAHCARTRAFGRLDRSCHSTDLYACASLSSRAAVFAASTLVLRAYRSLVRLRVQLSRLPACSVGTACPVPISFLRPPHPLPSHSHPLRCSPTCAHTQPPIPPTASAFQSQCQAHNQPFTGHAIFSRAPTLKRQPPRVTFTTPKQHPLAQPPPV

SEQ ID NO: 978150 - protein, 352 aa, Homo sapiens
QVHGCGWKTGIGLCFSDQRWACQSCELGALFLVIAVRCCSGKMFPDLTIGGGPGLCECVFLSSTGARGRVTYCARRICPVRRQSPSSRCSLDPPTRSVWCLVRCRQPPRPPRALMPLEVDPSAIARERGPLGAARLTLSPMHLVPFYCPAHCRRCPCGMGLSACVRLGPTLACRPGRGTGPLADVCPLLLLPPGVHSAFLRQGPHSRVTRARGGALGALEECILCSHLRPELLAAGSVTGQRRDSVPGDLTILARRQRLLPGSLRNKVPTWNLPALDDPGSKSLDLQSPLCHPADAGNHNSGGDYKIPPGAILPPTFLTQPIRGLTHTAHTQAPPNNSLWALRAHPPTRHTH

SEQ ID NO: 978151 - protein, 125 aa, Homo sapiens
MGTSWRWSDGFAMTAGIQRVVRVLRAPHLTSGSPIRAPSMGQCTGSGDSTRRAWFLAQDEKRYTSCRTFNTPMDMRSLMRLSHRCTWSPTGSPLCRSTRRSAPWSCHHRVGLVLTPIRRAHLHAF

SEQ ID NO: 978152 - protein, 167 aa, Homo sapiens
QEVNMNDIPDGHRILSLDSLTNMVLKGFLLSQCTVLCPACWALLDENESIRASLMNLASSVVWREDTGSCGTSTSRDPSSSRDENRFQFLLFLEMVLLAPGFPARAPMVLSFRSGLLVLLLLLRTCSVGDSVPAVGQSFSCCFPLSFPLPSDSGIQADLLIQTVHGF

SEQ ID NO: 978153 - protein, 245 aa, Homo sapiens
GHPPNQACSPNPRLSLQWGAWFWEPYPQMQQHETPHHLSQSGAPSFNPDLYPPPHPTMLLHDSLRIPGLPIILPLLPPHQVIAEPLGSSDPMTTPDSLEARSYKRGGPLLSCTPAQDLEQQGMAALTAHQAHEAPQAWILQAIHEVKAVVGKATEAYENPGKLPHQGLALRHLISNHFKEATQREPEQYGRGGKRKYCPDCPHEDRRQLINTCFGLEGRCQPWRPRHLLMGTTTGRKRGHEEQIL

SEQ ID NO: 978154 - protein, 344 aa, Homo sapiens
MSKRGGRERMGTRRGNTPRGPPPGTIPGGELGGSMVMMDHTVQPGPQERENMRMGDPKNANPKAPPVRRKTERGPEWGDTPIWEATTHQADRARAQGNHQQRGTRSPRAGANNTQGDRTIQHMDKKEDTHTKKRCIEEHQTIYTPKTQESPIRAAKHEDHHRGQPYEQRRTAIRCRQEVHKRPKIKGRKEDMATIPTTETPTRRQKKEQQHAHHEDSMNPNNTIKQPTTKHREKPTNSADNTKPATSTPTTKNKRRTQTTMRAKNEKNKHTQRHTRTIAITTTGYKQTNNQKTNNATKQTKPRRPKQQKIPRKQQITTNHTHPDNPHPHRTKQERKQPEAEENK

SEQ ID NO: 978155 - protein, 104 aa, Homo sapiens
MGAHSRILRRLYSALTQTERHMCSAHGTVFATPATERPGPSACHDLVEKTHITEQLNPTPHNATHVGTTCYKSKEAIPRRKRALRGTGSADKPPTEETGHRTIG

SEQ ID NO: 978156 - protein, 224 aa, Homo sapiens
MGLLMCGFVLVTMEISTRVCPRRGACKWRSLGSLQSLPPEFKQFSCLSLPSSWDYSHYCRASRNTGMATFLAGRDMTWWPIGASLFDQQRGLWPLHRTGGLRRGRRSGRGRLRVECHVTCCWHWTWVFDAHLHLTQRSSHLPEYIQKRYGGQRIRMYLSVRSLHTVWTFNKISLDLYAGAQIEPHLPGMETTSLSNIITLGIKAQSTIAALEQEREVTGSRRQT

SEQ ID NO: 978157 - protein, 203 aa, Homo sapiens
LRSKRLDVDPESHWQEVGSSSCEDTVAPVPYETLNKRFAAAQKNIDRETSHVTMVVAELEKTLSGCPAWTPGSACWTAWMEKLSVLKRKAVEIHPGRGRGAARLVHKRRIEHLKEAEQGTARGGSVVEEGMRMDRLMVEHCCGAGYYNTAGQGWLRKAGIEDLVNIEMFLTGNRRWMSPWRGVETGTCLGLGAMTTSSRLREI

SEQ ID NO: 978158 - protein, 78 aa, Homo sapiens
EGRAACVVIITSLFNERTSMAAEELIQEEHRIVNARWVPHPGKDRTTYHSWIGPTTDEARDTLITRSTSDAETKEHQH

SEQ ID NO: 978159 - protein, 92 aa, Homo sapiens
MTNTAYPSSRTTVPTESVTTKRRNESATKARTSGTSSSRPDRKEKPTEYLPTPPYLDITRIEENEANSLCKLRANSKDTINNQNERPPNRNI

SEQ ID NO: 978160 - protein, 360 aa, Homo sapiens
MDSVQRQTKVVDSEVTDGKSQELMCTLLPVSSRTWAVNVYRCGCEERRIEAELSAPGVPAEGHHLSTAVLDFTARIWLRCAWPDSCRLTLAKSAPWVGDALRAWAPGKARCATKALETNTLHLHHRHNVPVIAYDAHEMTPHYRADSLHLVHVTIPRVPPPRINTPPYKGYIMDLRIKGAARHILSYMLGTNHSRRVNALSSRCAKMWVPRDPGTLHNRGNAQGPTNNTWGIHTTRRTKPRSHPRRSIPARDEPTHILMHARTRGHADRKPPPCQDAPRDPDDQPKRRTSAVAETRHTQGSHRHGNQLSKHQPTIRPPPTRKPRSQTAQTTQESKHHNKGHTRIDNKPTNTAQGIATTQS

SEQ ID NO: 978161 - protein, 253 aa, Homo sapiens
HAYAAGLLPEPGVVGWRLPVPCPCPLCLGCWAVMWTTLPCVLPGGVPALPSRLCFPCPACSCVLALCVKHDNEPEGNQDSKRGDRIGCQTVEGPEQNKDTDESQLAEKRSNRTVHTRGHCSTTIADLTRGSCDELMRTTRSRYVQRTQLTESLTLIQTGLPHCDDGACTTRRNTSQSKTKEDKHADRVTTGKHNVQMTVNKANHEQQSDLHTICRPADEADLGAHPDESMAKAHENQLPSRTTYKSVDERSLT

SEQ ID NO: 978162 - protein, 300 aa, Homo sapiens
MGSAPWAPVLLLAARAACGSMAGALQGPRTPRFQELLLPCMASGPLSTSMRFGIKTYPSADFLVSGHGSGIRGRGAQSYFYTGNEGDVWAFVNNSGFVAVSMAGRSGVGSTGLRGGSRIRTGSRCRSVRKSTLTRNHIGDCWRVEQCPEPELTAELLRRVYDARLVRPRMPPAIAFGGSNRGDAQQPYLMMKYTPPGGRGALWPSARVANLCAEPLTSPNQVSFRDVTVRDFEAGHEDPNAPRGVDGKRVSDQIKGLFPTGNANTRGRMRNRTWQSVSNRNGLTGHNYARKSNGLDMLNP

SEQ ID NO: 978163 - protein, 301 aa, Homo sapiens
MTSTGCLYPLRWTNSLNCTLFIEDTGQDVSPNHFGPPMDHMFPGRTLRRLGLEGPWSKDDAVACRRRATGYLIPFKRNQLKAVCHIWGRLIIAEGGGTPCDGTPWPSTPQGYVSGARILDRIGGDMRERTTITRGGTLESRRIAHNVCACGYIGAKLTVVGVVERTDGIPCNFLCDVLKSQEAVHPRGTVRLKSPYHKFRGQACMISLHEIPRKTITLAHTKLVSVETLGLLSSTSLFMEQYPNLKRGRIAEEMCDHRTWFLRCNTVRVPNLPERRSYFAVRLGKEYPGPISTYNLRFNIH

SEQ ID NO: 978164 - protein, 222 aa, Homo sapiens
ETRGGGDGAELLRERRAPACRWCRCCPVSRLPSLGGTADPSCWAPGGLLRSQREHGCNDPGHPLWASPRPSPQLEPRRLQQGKDWRLPQSCAPVECQLLPVILEARQDGVMGHGSRATPQPWSPAWQQSSEHALPTQMDLRAKCLSRPHAVCAASVHLALPIITTGSDADNFRHRNTGGSVATKKVITLGCGARKLFYGFATKFLLDSIGLLPPKLRELVLL

SEQ ID NO: 978165 - protein, 272 aa, Homo sapiens
TTHRRTLYFPRRPLERFITVSILQMASLVQDDDFARFVYGPQPRIECVRANTVTTMPINSSANALREFVTIVTEGVRNVNESRTLSVRDALDCDYEECSLGLESNVSQCLRPGKYAVNTDEDCLISQWDICYWLRCHVGEFLWVPYYYLHMRVGPHIQVEIRPIDRGITCLVQCSMKCTKKSYLLGSTLSNPYLPYVRSHITIAFRIAGVAWGASSSGNLVTAKLLVASNCVPQVVGKNGHAALWRNSPRKKIPLTVNGTCIMNHVGQFQKT

SEQ ID NO: 978166 - protein, 455 aa, Homo sapiens
PTRLARKRTGRVPGSSELRGPCVLHHGLLACPSCLGPMMPACLLLLAFLLLLCAPSAAAPVCMAVPVWSLRGVRCDWLLMCLLACLPSCGPAVCACEHCDDVPDAKLLCCASILIACVSDSLDDADRLDLQYCCLNRTAAVPWMKCLQADLCVLFCTAVVTRTNTPLFAIHLQALMETVGLHGHYSPAPKRMACTSTHATARTATQCNRHANGHCNANAEHGTQEHRGAPDAPGQPRFTKITNCCVTPLALDHGPMITIRKAHGPGIHTASYMGQPLAPLLPSRVEQNPGLRTLVLIETRQANWGAHHDEPVAYAFNLGLDLDLSQRQLVQMGMTYGTLISRECPPGPTEPQRGTLGTKPAPARTLTPGISQREFGRIATGKPHRQHPGLPSGAQLPLWGPGDPQQFQGEPATTETSHKQRQQPFGGPTGATRTQGPPPHSHEPRQSPDTSSREV

SEQ ID NO: 978167 - protein, 296 aa, Homo sapiens
MVWWAWLLACLSGSWHPPLPGSECPLHSLTLWCDFSLCWGTQCWLPRQHPGPVQLGHAACMAASNAPAFAQLTIAAQVRFPVATAKTKAAGMLQLNQTAGPTEPTQCCARRLPVLMLRRAAGCWLDSTHPATSCPGWTVDEVTIWCTMDHVPLVDVHDRSRVLKPNPAGWNADESRLCCLVDMAAVTECPPCARLDSGAGKTGVACAGGQHPGPVAGRIHAGRRRRGTPAQHAGPDQPRPMQDRFGTALAPSAPGPYHPATAALQQPDFCQPPATMNVRLGSIPSTPCAVHTPDKA

SEQ ID NO: 978168 - protein, 266 aa, Homo sapiens
MAYSTNLLADSCGPAPMCSQLVRATHEGLSCAHHASPGAKDAPWAMLHDWRGEGARELHVFAFAPCTWWSVRPLELHQVVLQTPPHDAKAPLSLSSWVPFDIEDGRDRGLETPRGGLLMGKHAGTAGWTATVRATNGNARTRALLGVATLTCNQECSTVSPEQVGKLKGFPWPKSAPLRTAEISPGKPWERMHGPGKAGGGTRAPGLGSPARDSILRYQEPVPETGRALGQNGAERRTVNRRGPSHDIGLMGLYTAPLYHEPINLT

SEQ ID NO: 978169 - protein, 121 aa, Homo sapiens
DAWVTDQPALPNPCSPVNMPARWGCLQTSLPCLTPARHASVATSPQTGPTPLPWGRPRTVNPWMLFPPETLPLEARRRLVPLPPSANHPQDRDGLVQAQGQASRNIVLPGHPRCADDEDGC

SEQ ID NO: 978170 - protein, 316 aa, Homo sapiens
TPSPSDPRWFRRRGGQAWVGGRLCCLLPPPQAAVLGPLPLGNPSLSGGRMASACFLGLSVGACPATLTLTCAQAWHLDPGSCLGPGDGVPIGLWDHRATGPPAAPPLAGVLALTSGLEFPSSSSPTGPRLGLLAGGSTVWVGLVVPGSNPGAFMLNVADEAAWTACLVPCMSTLDVHSDSGSSAAHVLLTISQNIGVRETEAVDKALGPSPKTHPSIRRAWARVRLGLSISTDKVTHILGTSTGGHGKYDASEEAPHGVAQRLWRLASRIAGQISNTLVGRTTAHRARRPTGGPGRITIYRRSGHRRRDPQRADTV

SEQ ID NO: 978171 - protein, 214 aa, Homo sapiens
MAPSRNGMILKPHFHKDWQQASGHLVQPAGAQDPQAQGPAGESASHRPSPRVRPHQAHREVPYSEIHTKVRAGRGFSLEELRVAGIHKKVARTIGISVDPRRRNKSTESLQANVQRLKEYRSKLILFPRKPSAPKKGDSSAEELKLATQLTGPVMPIRNVYKEDKGQSYPEEEKNFKAFASLRMARANARLFGIRAKGRRNAAEPKMLTNKKSK

SEQ ID NO: 978172 - protein, 238 aa, Homo sapiens
RDSSEIQARAAGAGRHALGPGAVEECVPGRGTQVHRALQQVLPVPVSMKQLSRLRIQQCLREDVYSLSSGRRLPVRLANIMKEINLLPDRVLGTPSVQLVQSWYVQSLLDIMEFRGQKTPRTTGLYSQFTDALVTIRNRHNDVVPTMAQGVLEYKDTYGDDPVSNQNIQYFLDRFYLSRSPSECKSIKHNLIFDGSTNPATPKHIVEHRSQCSGLDVVKDAYEWLKLLCDQYYMVPVN

SEQ ID NO: 978173 - protein, 91 aa, Homo sapiens
TRGSSPLPTLSNDPFLGHFLIHQSIFLSCDWIGPQLGGERGRDCFLPHPWAYLLPEVGSQEPHPYHPSMWRKEEIFRAASVAQLDFPQSEE

SEQ ID NO: 978174 - protein, 330 aa, Homo sapiens
QWTNMEKAGKRLIQSSAAGGIDGKGEELRWSLKNWGRNPGNCQHTHRILLGCKEETEYMVILPKIPECVALHSVAVSGNRDRVVKFQEPLSLTRDRDILYRRTIFRKATCIITDDTLAPAVDAVAVKVGKSPLQINVSQHSREGWGNLEEMMKYASDEATLVWTQKLSDEMMVSLLHQWDKLGLLRRWTDPEQLGKDGLSMEGSGLDWIASDVMWEYFRYQAGQSLAWSSGNVSHGRKELVCGTLMPRLNHFHLEPVQVPINVVGLTSAYGCCPKRLAFTSHGEDWWAENHYPGGEHGKKRGRIYVGKNRDGKRKQQHRIAAEKKRVAEE

SEQ ID NO: 978175 - protein, 99 aa, Homo sapiens
SPSSRQSVEDNASEPSGKDVDDVQEKPKDIIQFTAEKLSVGEDVTVGGVPSVWCSVSLVGTTRNNFEGKKVISLEYEAYVPMAENEIRKIVMTLDRNGP

SEQ ID NO: 978176 - protein, 117 aa, Homo sapiens
MRCRPKVACVKQTNLMYTLFGTVYVPRTVGWTSRFLMERVRGCGWNNVLGFTCSGIPHYGLFDHLQCLKLHDLKFACIYQALFVRVLATLGFLLVTMCGCGMCEQKEDEDEEQKARY

SEQ ID NO: 978177 - protein, 368 aa, Homo sapiens
MADITRTYLSSHSSCFWVAESRGQTVGMVAARPVKDPLLQKKQLQTTSPLCVMQHRREGLGKAMVRTVLQFAQMQGFSEVVLSTSMLQYAALALYQGMGFQKTGETFYTYLSRLRKSPMINLKYSLTSREGDLSSLSSGRQSGSDGFCNSNKQTQLLQVQTTNPHSQAHLSNVYRGWAWGNGYSDVSQGFLRYPLANINAMYTKYHNMNYSKYPELWILAGYRIKHGQLRKAMDLTRYMAQYRECQGTQWHMVREEGDGHDAAQRASPGQGSTPHKPITKRQGKTNSGDQNGQCNRRGTRAPTVMRAKISSKHEGETNKQQWVKDTVSKQHNLKDSTAGSRANICEHTAHHETVNSSDALSIAHNGRG

SEQ ID NO: 978178 - protein, 291 aa, Homo sapiens
CWVDPRKAECDPEACNPEIQDATLLRNCQAPDSDGNNERALECEQSDKKQNLEPNLPPSTEATNEQSGRPTGTPRSWDKGQHGPARVTQSNTSHFKTHDSRGYRFHVTIYPGFTNRQNKTRGGLCLEPYALKVYRKHQVFKSGLLWEWRERRHEGTPGISSAAGEMPAGTGQLAWLLRGARLCSGVFAGVTHFSSGRGGGITAAIPIAQRGASKHGEASCWVGIVPRLQVHQDSARLTPWKSGVYEDGNYDQMRSHAGIRWSPFQDTGVLRRKPVKDPEKVHEAEACDPQG

SEQ ID NO: 978179 - protein, 77 aa, Homo sapiens
QASLYGGGEEGPQYAWNSVNSELNGQHGEFSKTLFTLRMERGSWGYSSVAEAPCLQCARSWVQSPVLQIERKNIVLD

SEQ ID NO: 978180 - protein, 323 aa, Homo sapiens
PGGAGFPTGLKWSFMNKPSDGRPKYLVVNADEGEPGTCKDREIMRHDPHKLVEGCLVGGRAMGARAAYIYIRGEFYNEASNVQVAIREAYEAGLIGKNACGSDYDLMFVVRGAGAYICGEETALIESIEGKQGKPRLKPPFPADVGVLDAPQLWPMWRQWLCPPPFAVVGAPGCWLGRERNSGTKLFNISGHVNTPALLEEEMSVPLKELIENMLVVSQVGGTSPAVIWWSSTPLIPNWGVNVLMDSMAGAGQNGWTGARCNDRREMEAPGHGLQLGSGGSPRGVRNRGPLEERPYPGKRKPRGGGAGTRGDGEGRTPREKCT

SEQ ID NO: 978181 - protein, 133 aa, Homo sapiens
MPKDPVNRIRQQQDSRTNRKHRRTKTDKTIQKPYQMVTGPEEREHREQYRKRTIDATCTWYHNNDTEEWNKSNMTTHDRPMRCTTKANRSTRSQQETYQKTTKNRQKKLTQEQKREKKENTNRRKPIEHDNNT

SEQ ID NO: 978182 - protein, 117 aa, Homo sapiens
MQLLTIWSSRTFSLQIRMSLSSVCVHYKVYPRKQTNTGPPKKPEGPVYQSRFRSRALGGDIRSRAVTGGRESARAGTTTSGHWAPSNTRKNRWSPFREPRLYTSVYHYKCYNNTRSH

SEQ ID NO: 978183 - protein, 303 aa, Homo sapiens
CGVVMLLLNFSSKGRGAESAKTLTPKLVSWNIVMEPFFKREVFDTYLSQLASVMKNMEESLYAYEILGVPKPKESTIWIVKARRILSENLEDIHVYFGDPVSLRSLAAGRLNRNTYNLVPRCIPQKQPEDVQAFVTEVAYKMQLLQIENLALSPWLLVVTILLQNQLSMDFDALVEKTLWLKGVTQVFGGFCFADNKLPEEVVQSSILLHSNLAAVSKTRGSENDSWKLTVVTGLCRNIASSCVLTTEPVLHICPPPSAWFADEPVRKRGSGIFPEVRGITSPGNTRRGRAAGSGEGENPQRG

SEQ ID NO: 978184 - protein, 306 aa, Homo sapiens
MIIGSIKDEMEPSFQEVSFYYSEENKPPEPEELEMELEMEPENMESVPLDPSASSASLPLPERHSGHKAENGPGPGVLVLRASFDERQPYAHMNGGRANERALPLPQSSDLLILGHTEARANSNVCAPTRWAGGRGGESRLEQSIHKPSLYLSGSSDLPLLANGRRLSLAENTTLGNLPFLTNVTHALTYLLYPRTIKLTMGLWTTLNDNHLIASRTLEKVSLFRCSGLILLPLPFRLLPSSLPRPGFLFLCFPLARLQVAAPGKPAASYTTATRGAPGGSASVPVLDVALGPFAQPFRYCRRLAP

SEQ ID NO: 978185 - protein, 127 aa, Homo sapiens
MCSKPHEAHCPSCHAPHQGTTHGLSSCPMRWSMGDWWLLLPEGGGLPGSYLHVVGWGPIACVQHSEEPGQNQARSKALEIQTTQGACHRHNTWWLMAWARLEFPKLVEALTHKVSKGPSLAAFGPVM

SEQ ID NO: 978186 - protein, 244 aa, Homo sapiens
SEGLVDKRCGVALVAQRAGPGAEVWNGDCRAAICPCCCNFEGCTGRGGMQTMDKHEPAGEHAAEPGPSEDLCGRVKLAWIPPVDLPAVELAVQSNHYCHAQKDTGSHPDPEKQRARRKLYVASAICLVVHDLAEIIGGYLAQSLAIMNRRMRTCYGYGQHAHEPLRPLGVFPTSHQDMNFGWHRAEILGALLSVLSIWVVTGVLMYLAVQLVDSGDYEIKGDTMVDHFGLALVGVNLHNGVGPP

SEQ ID NO: 978187 - protein, 171 aa, Homo sapiens
QIDQLLIHQQVELLEVLTGFETNNKFEIKNSLGQMVYVAVEDTDCCTRNCCEASRPFTLRILDHLGQEVMTLERPLKCSSCCFPCCLQEIEIQAPPGVPIGYVTQTWHPCLPKLTLQNDKRENVLKVVGPCVACTCCSDIDFEIKSLDEVTRMVRSPSRVWLCERGLHGFG

SEQ ID NO: 978188 - protein, 103 aa, Homo sapiens
MAKLTYLKTTNSKLCSRTLNTKWKKIHQQTEVSSVNPPKLWDQFPLGAPYRDPGRTSALFFFFFLVDVLNMFWGCEVIYYIPIEIKKKIISTTLRALTDRQEG

SEQ ID NO: 978189 - protein, 135 aa, Homo sapiens
NVDYALANQNDMGGLSPMIRRMSWSPRCSSKPQLIRSGNVGNDRGQTFIGKSDQHRTYVRRFSRTMPCVNHIFLFISSSTRSSRSGRPWANVHVRYAAVHLTAAVAPRVFTWDALSLRPLKERQLLIGICVVPIR

SEQ ID NO: 978190 - protein, 195 aa, Homo sapiens
VSSIMDRSELGRRIAEIDADDCGGCAAQKQKVSLLENNLEQLTKVHKELVRALMPISAVNFLQWNQLTSSSTLRDVTSFGISTETKLPDKCNLMIANAISKTRSHNGQQSGQRIWTEEGIPHRLLNLFVPGNIQQLLQLTQVQFVEEVHLYRTARQWQCEVEEANKCNRLYIPTGVYKYSKYDEDMVSSSHSMNI

SEQ ID NO: 978191 - protein, 276 aa, Homo sapiens
HASEEEEVAPGTEPGGLGCREDGVVEPRCPLFLRLFCLCAPGSAIPAVIFAKNSDRPRDEVQEVVFIPAGTHVPGSRLQCTYIEVEQVGKTHAVILSRPSWLWGAEMGANELGVCIGNEAVWTKEPVGQGEALLGMDLLRLAWNGSSTAQEAVHVIAGLLDRYGQGGSCREDQSLLYHNTFYWADRTEACVLETVGACGLSADPGGARNISNQLSMYKTFSEHRSSEPCQAGDITGRGDEGSQDKQSGFVAIRGFRKAVCFALPRPKLVIPCPKPR

SEQ ID NO: 978192 - protein, 133 aa, Homo sapiens
MAHLMTVQLLLLVMWMAECAQSRATRARTELLNVCMDAKHHKEKPGPEDNLHDSAALEDEFLLFHEHKARKHIRTFLTCTVQLEPLGTMTSECKGTLSKDTWLYGVSGNGDLVHAGAEVGKRGLGVPVQSCHG

SEQ ID NO: 978193 - protein, 166 aa, Homo sapiens
RKQGVASCEAASAVLGGQKRHQRRERTEVRQLSSETDLESGVRKAALVMYWKLNPKKKKQVAVAELLENVGQVNEHDGGAQPGPVPKFLQKQRRIVERLVRRGFQNFFALDDFVEITKKYAKGVIPSSLFLQDDEDDDELAGKSPEDLALRLKVVKYPLDAIMEIK

SEQ ID NO: 978194 - protein, 120 aa, Homo sapiens
MKNRFLVLGLVAVVLVFVIIGSVIWLPYTSGKPDTCTSRAGWHDAKRCSEMARDILQEGGSVVDASHRKPAVYGAHECHQYGHRGGLFFTIDSKHYRNGEVIHARELPPGGIPLVTTPDL

SEQ ID NO: 978195 - protein, 81 aa, Homo sapiens
YGIHHQPSLLHSGTANLSFLMSYFNEREDMWDNVIFQTGGQKHEAHPCCFAGVPVIVIIIFSCLVSVCVRIGTRYCSAPFA

SEQ ID NO: 978196 - protein, 281 aa, Homo sapiens
VAESAARSPFVSHGAHWNLCEILFIEVAPAGPLLLHLLDWVRLHMCEVDSCLADVLGGDNPSKHENFWDLVTVLVLQGRLDEARQMLAKEADANPSCAGMLAGSCGDRVVRTMPILSWLVILRHLTEWELKVAALAEECERHLQDNTFAANPRLESLCKIMLGDEAAFMEQKELLSNWYHFLVTRLLYSNPTVKPIDCTSMPSPAKTCFLGGESSPEALDNILMAALSSNISPGDHKSAASPEALVVRNQLTELLVTADSPVQKVSIGSKGENPPGGYGQT

SEQ ID NO: 978197 - protein, 213 aa, Homo sapiens
MGGASIAAASCAWLQEKFRQHNSGIHDEEIYCKSCYGKKYGPKGYGYGQALATLNMDRGERLGIKPESAQPHRPTTNPNTSKFAQKYGGAEKCSRCGDSVYAAEKIIGAGKPWHKNCFRCAKCGKSLESTTLTEKEGKSTVKGVRKELWAQGIWYGQGAGALFMLSNGVNPVSTTENLHYQMRWVYGLTTGEQQTWMGITSAVGAGRQGDLGI

SEQ ID NO: 978198 - protein, 123 aa, Homo sapiens
LKTQRADMITEYLSVTALLPNDPEYNTVAKQVYSQTCSHIRIEKIARIQNPDLWNSYQAKKQTMDAKNGQTLHAEATLPWDRCRIRATRHSNWLYPQLCRKDMLLAYGKGTYLAVNANYTAND

SEQ ID NO: 978199 - protein, 133 aa, Homo sapiens
EDVGPCLDFTVQELSALVRTAVEDNTLTIEPVASQTLPAVKVPTVECNNTNTCALSGLARTCHHRIRLGDSDSHYYISPSSRARITAVCNFFTYIRYIQQGLVRQDAEPMFWEIMRLRKGMSLAKLGFFPQEA

SEQ ID NO: 978200 - protein, 43 aa, Homo sapiens
DPEQLNRNQSLGKSKGCCQENTDNFPEVGRRGRQAICHQIDPE

SEQ ID NO: 978201 - protein, 168 aa, Homo sapiens
GSRLMEEKQILCVGLVVLDIINVVDKYPEEDTDRRCLSQRWQRGGNASNSCTVLSLLGARCAFMGSLAPGHVADFLVADFRQRGVDVSQVTWQSQGDTPCSCCIVNNSNGSRTIILYDTNLPDVSAKDFEKVDLTRFKWIHIEGRNASEQVKMLQRIEEHNAKQPLPQ

SEQ ID NO: 978202 - protein, 67 aa, Homo sapiens
STVQVFEVGASEQGEPGKSCQGQEGCAVWSPGAFTPRCSKTHLPGFVEQAEALKAKGVIVVACVSSR

SEQ ID NO: 978203 - protein, 96 aa, Homo sapiens
YISWSAEVDPITPIDIPAIVSTQYTQDIDQNQAGSELIATFRGHLKALTVKTLSRRARRIGNSTTGTVRVTASSTARRTQRMSGSFWLYMCSISAL

SEQ ID NO: 978204 - protein, 158 aa, Homo sapiens
GRQRPLRRGPRSGAVLGATRLSSSVVMADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFE

SEQ ID NO: 978205 - protein, 99 aa, Homo sapiens
LVQDIHKLVGVKFTRITPIVYPATVCTQYDKDIDQNKQDQIMATFRGHLKALTVKTPSRRARRIGNSTTGTVRVTASSTARRTQRMNGSFWLYMCSISA

SEQ ID NO: 978206 - protein, 335 aa, Homo sapiens
MCRACPRWDGPGICTFPHWRYGKLQKISNVETSVHVTETLENNLYRHYNNSNGRGPIRRYVVGTPSGVTLTTRGQPLPCEMRNTDNNHWELMGAADTTAKDITMADRTHNRERWWGCPTKINERRTCETNTTHAHHSRAIDGRPSYEIYTQEKLALDEAGTDNVAASIDYDTRLGDTKRAPRKEQHHGGRGGHPTNTGRADKVANNTGGDEQAHANGGTRLDANNTGGNVVQPTTPSDIDLHKKKEVSYTDGEQSDNTIQRDTRAETAKHGTRRSLEMNGETDARSRVKTAVDAAQTRTHSPPATYRNPSQNRRTHDTDQQQRKSEMTALVNQLQ

SEQ ID NO: 978207 - protein, 37 aa, Homo sapiens
DQVNDSIVTVSTLWRGMPCDQAGMGYVAVGDHEGWPV

SEQ ID NO: 978208 - protein, 222 aa, Homo sapiens
TVSGAKPRGSSVNSAKKGTCSSRSTATRLCAMTVRLSSTGTVTMTTRPRAPSVPGSREEAVTIPGTWPRHGCLEHWRTPGTVSTPPAGACWPCPPDVHSTLETSPPPPQRITPKTPRNQGPKRKGLGAPGNKPTGGRKNHRGAEYHGICEWRWQEIEGSKTRAWAPSRSDTPLGDDRHLWVWVHTTQKRVGKLRHTNGKKTLQGALKQPRHLWHNRNDPGHR

SEQ ID NO: 978209 - protein, 68 aa, Homo sapiens
KRGVKSESEITDKVYVNTHKVAQSGQGHKEEHPWDRLHMTLPLITLLYKDLGVLTPSAVSDELIKLYL

SEQ ID NO: 978210 - protein, 173 aa, Homo sapiens
SVLLRLHAAGLNTPKLHAFSTGHLLVKDMVRTGLLMNLMGVLLLSLAMNTWAQTIFQLGTFPDWANTHAANATATASSLEQQHSSNLLSPAGDFVLGWAFFSRRLLLSLAARSLQADQAILSCNLIGGSKQGHPPVVSWSHRVTVCKHLSLSFSCISKPAISCTSCLWPVEQA

SEQ ID NO: 978211 - protein, 121 aa, Homo sapiens
MQSVLCSNDAKYTPVTEKLSVSHSISHSAIATTKLNGCTFLSADLLLKGLNLETETNHALSVYFEKTIHKKGAKRQFPMGGTFSWRYCKAKSVHFISCPLTDSVVPPLSCTGSGSSFGSYS

SEQ ID NO: 978212 - protein, 201 aa, Homo sapiens
MKELAYMKALYERKLPVPKAKDDNRHAVIMELINGYPPNVRYIMSKTLHQYMMTLLGLDSQPEKPWDWFMEISMNSVSWLDTDDTYPVMNNGEVVSRSHQKARADIGQRHVNGIRNELTGNALNNDRREYTTVGNKKRGNQQERQHTRESQHKTASHRQKNKPLKTGKRHNRHTEARQNTGRNREAQLKRCREQEAASDKP

SEQ ID NO: 978213 - protein, 86 aa, Homo sapiens
YDRGASVQLKRVQRRKSKSHMASLYRLLCVNTAGSDTDPPGHIPPPDCLLTIHTCHLILNPVPNFSTLKKKIHPKPTSSFCSVYSL

SEQ ID NO: 978214 - protein, 298 aa, Homo sapiens
SKAKGRVRRRRLRAKLRAIEKEPARTSPKLVGNSGPRRQQERNAAQRRQLPGDASIDRTVSTFPSSGCEGSETATGARPLQSRQRQDPGHKSSPETPPDVAGAPGDRVHAAPCQGERDAPWQPGRWSSLPGSNFSCKPFGPNLSRVHRSPSGSGVERLIYSEMSERKEGRGKGEGARKKDWDPGEARGPTKGRPRCPGNGPPQNWKATLRAQGVQDCMGPQGSVSFGCETKLLRYVPHSEFTWFPDLGSELEPVGNKPTKVRDPEAAQGKVQGLNQESVPGYSGELLQGTESMERLCL

SEQ ID NO: 978215 - protein, 85 aa, Homo sapiens
LVDYAQPLSKSWVMFCLLIRSLQRASIGVWWWSIRVRVRNWVQSRRLFKEMTKINDVIVAVTMACSVIDCVLSDELKYQLIIGGL

SEQ ID NO: 978216 - protein, 44 aa, Homo sapiens
SRYLPSRCRMDDREDLVYRRKFAEQAERYDEMVESMKKVAGMDV

SEQ ID NO: 978217 - protein, 86 aa, Homo sapiens
KDFGPFLQLGSRAVLFQHPLQSEYIIITTTHTSTTEPFLVDGPTLGAQHLEAGGSLTRHVTQEFVSRTLTTSGTLSTHMDQQFFQT

SEQ ID NO: 978218 - protein, 70 aa, Homo sapiens
RTIAHFSCWVSSEIDQTELGALNHHGDSVVIRLYTSTQLSAFHLMSGMPFPKRVSHLFFVTFKKKSYLIQ

SEQ ID NO: 978219 - protein, 66 aa, Homo sapiens
MPQARLTTVRQPMGRRAPFVPRSPCGQSGSVVPNTRARSDTLAGCLGPHQQERVQAGQAVHLDPQP

SEQ ID NO: 978220 - protein, 152 aa, Homo sapiens
RTRGSGLSTLLGILYEDKERQDFIFTIYHWWQAVAIFAVYLGSSLPMKAKLAVLLVTLVAAAASYLWMEQKLQQGWSRGSRCIPKPQHKVRGYRYLEEDNSDESDMEGEQGQGDCAEDEAPQAGPLGTEPAGPCRKPCPYEQALGGDGPEEQ

SEQ ID NO: 978221 - protein, 137 aa, Homo sapiens
HTTVVYDGGYHNNLLYMDSWDAQRPTRRHSVKTTSSPHGKSHWASATVIKHHCKTTIIIGFIVKIGIIRLCTSFDGRLKYKIKDDLYALYYPIGFSSNKNNSVSGMRTAFLEKLDGGLSVLSKFFDFSTFDPNNSSC

SEQ ID NO: 978222 - protein, 37 aa, Homo sapiens
LQPEVRPHKTSENTHRENSMYVTDVGRTFYKNSDLIR

SEQ ID NO: 978223 - protein, 100 aa, Homo sapiens
VDLLGWTQELLDLMQRERGKLDGQDRYDYGFFTWGSHTADHAYVQQDFMPEDSSNTFTNMNQTTTCGLDSGPPRLPLERLTRDVYPWGPSMCAPCPPHHC

SEQ ID NO: 978224 - protein, 167 aa, Homo sapiens
VTLSRTLGERIGLLAFAEKEYRREKEKKHFPEFLQPCLCDSYYYEDGGMKPRVMKEAVSTPSRMGHQDQEWYDAEIARKLQDEELLAAQVDMRAAQVAQDEEIARLLMAEEKKAYKKAKGAGDIIFGQKKASTRVGAKNSYKQQIPSQKRVVNLTILRMKGQHGHHH

SEQ ID NO: 978225 - protein, 99 aa, Homo sapiens
AEYLCIPLSSNSTCAVVIVDLYVESVPEQVLVRRGSCLITKLMWKVSQETLSEEASSQATLPNQPVEKAIIMQLGTLLTFFHELVQTALPIRQLCGHLC

SEQ ID NO: 978226 - protein, 220 aa, Homo sapiens
AQPGVLFFADDDNTYSLELFQEMRTTRKVSVWTCGTVGGRRYERPLVKNGKSCGWVHRMERRQAFAIDDGWVCVVSLQVILSNPKAVFKRRGSQPGCKNLTFKADNNQLKNWNQKASNCTKVLVWHTRTEKVNLANEPKYHLDTVNIEVYRQDQQVRTGSLERGLLPIQVLFLCLQPFLTADGRRFDSYLEMLQKIVLSSLCLDCVSELEEFVGVKATCH

SEQ ID NO: 978227 - protein, 299 aa, Homo sapiens
LPPILLGKLGSDPQKKTVCIYGHLDVQPAALEDGWDSEPFTLVEREGKLYGRGSTDDKGPVAGWMNALEAYQKTGQEIPVNLRFCLEGMEESGSEGLDELIFAQKDKFFKDVDYVCISDNYWLGKNKPCITYGLRGICYFFIEVECSDKDLHSGVYGGSVHEAMTDLISLMGCLVDKKGKILIPGINRCRAPVTDEEHALYDHHDFDMEEFAKDVAALRTLLTAARKDIPDAQIGDTVLYLLEIRRRFFGQGRRLCSPERGRQFSSGRARHDTEWYETVSTATLRSEAQSPGSARAAGL

SEQ ID NO: 978228 - protein, 143 aa, Homo sapiens
LLALAGKAKTKGLQSGVDIGVKYAEKQERNFDDATMKAGQCVIGLQMGTKDKCASQSGMTAYGTRRHLYDPKNHILPPMVPLHHRASQMGTNKCASQVGMTAPGTRRRIYDNQAGHRDKCDYSSMSLQMGYTQGANRAVRSSD

SEQ ID NO: 978229 - protein, 130 aa, Homo sapiens
LLVVQEWEHFGHLTLLHELRTGVFHTFLNLLDKQTGQDHSDYELVCGISTSGPNRNLGTTETCGVCIASPNPSVRCGTTRVGLLATVLSIIIKQMLLHDHHSWSQLKATSFKLPSGHPEFSARHDKGNTS

SEQ ID NO: 978230 - protein, 167 aa, Homo sapiens
QHGANVNAQMYSGSSALHSASGRGLLPLVRTLVRSGADSGLKNCHNDTPLMVARSRRVIDILRGKASQAASGSQPEPSPDQSATNSPESSSRLSSNGLQSSPSSSPSLSPPKDAPGFPATPQNFFLPTTSTPAFLPFQESSEALAGPYPLPQLQEAAETDGGADPDS

SEQ ID NO: 978231 - protein, 109 aa, Homo sapiens
CIVMLMMMQFSHSSLLTQRSVCVSIGQGLRGMDVLRHRCSSSQFLTPGPVSSPSWVIHFDSFEPFGGAVSGSCGFYAFKEFLQTREFLLAALCVSPIGDLRQYVLQSTY

SEQ ID NO: 978232 - protein, 183 aa, Homo sapiens
MRALYKDTCLQGGPAQADSPQPARVLSRPQAAAASTRLVLTDADDGLNPFSETPPAGSPDALLPYQSEARRHTFLGGLPGLSPLPERLAPCRELLHFYPGIVNPRGVFTLRGVGVPPCFVSGLRGAALACVRELLYDGAALAPVLTLLSRGHVRDPWMGSLGALGSSGTPMGGYYGDNQVGFR

SEQ ID NO: 978233 - protein, 148 aa, Homo sapiens
MLSSTTPQHRTAHIVVGGPKLYVPKSDMAPVNTGDSSLEYVGRASTIVTGGPDSSITGVNPTNWQVVFTVFPQSVSKCCRIVSFTVVTRGRFDTSVNYREQLPRTFGYHLRFTYCLSMAVRVAVIMFESEWDPDRLTAWGPHNKQRII

SEQ ID NO: 978234 - protein, 41 aa, Homo sapiens
LVVSLVGLDRVPESRVYMEPLRIRQLLRPFFLLADLLYDEE

SEQ ID NO: 978235 - protein, 154 aa, Homo sapiens
GNSSDYCPGNDHESPLYALDRKAVAKDNFEILVTFIYTGDSTGTSHQSRSSYIPREILWGHRLHECIGSEEKYYKVNCVAGLTGSVEVYAPFCSAKQLDWEGPTSQQLGENVPCPRILQFLTGNTRRRSFSAVCCGDAAVRTQRRPSVSPQDEL

SEQ ID NO: 978236 - protein, 245 aa, Homo sapiens
GSVRLGSPISVQFGSVMLRQFSMLRARSPLSAADRPEPRCCPPSHQRGASPQASQTWGLLQARSSLSNEWHDAVSRKTFPTVNPSTGEGHLPGGPKGTRRTVEDAVKAARAAFQRGLALAPRWMRSDRGRLLSRVADLIERDRTLPSGLWLTLDTWHSLIVNLYLVDLDMVLKCLRYYAELGWTSTMGKNHSHRRVTICQTIPAMSLVGVCGPDHSVELPAPDASMKLGQACNRDTVGRMQVADK

SEQ ID NO: 978237 - protein, 147 aa, Homo sapiens
KKGKKRTQDDLMNMMIDDSAASTSFQTQPGQPQQGYIPPMAQPGTAPVPGAPGMPPGIPPLMPGVPPLIARNGTSYARHATWIASSEKYTQSFCGENIMMPMGGNDAPWTRNTTSDAWNATRYAPTCSTSWNSFHDSSTGCFSARYS

SEQ ID NO: 978238 - protein, 139 aa, Homo sapiens
MSYCRQEGKDRIIFVTKEDHETPSSAELVADDPNDPYEEHGLILPNGDINWNCPCLGGMASGPCGEQFKSAFSCFHYSTEDIKGSDCIDQFRAMQECMQKYPDLYPQDEEEEEEAKPVEPVEETADTKVSAAKEQGTSS

SEQ ID NO: 978239 - protein, 180 aa, Homo sapiens
FDVTLPGSWRPTHNKQDFADAYGVSVTCSEQCGSPGRQYCKDIAIVHRGIIHFWYEFGYLSVNWNHPPSTDLRLQIAVMSYGNPHHHPVRFVSDMEILPFHAEFCGKTITLTPGFAPGTLILNRTGVRLLNKTQKVPLGTFRKDMKTQEEKQKQLTEKIRQQQEKLEALQKITPIRSQAD

SEQ ID NO: 978240 - protein, 259 aa, Homo sapiens
AHQDGMLQDLSAGVFFPPCSQHRTLAQVPDNDEQLFQTIRLKVGFSWPPTENQERTPQPMFRTRVCLQQEQPFKFSYGEKCLYNVSAYDQKPQVGMRPSNPPTPSSTPVSPLHHASPNTAHTPKPDRAFPAHLPPSQSIPDSTYPMDHRFRRQLSEPCNSFPPLPTMPREGRPMYQRQMSEPNIPFPHKALSRSTTTQSMNIPPWLAVQPAKVPPPLMIKQEPRDLQYDSEGASCNPLYDGRRLPGHSSRTERCCLRRS

SEQ ID NO: 978241 - protein, 91 aa, Homo sapiens
ILQVISKSSPRLACFSQSVVLTLSCVNFYHYRDHAMDWVRQAPGKGLEWVSTITASGGSTFYADSVRGRFTVSRDASTNTVFLQMTSLGAA

SEQ ID NO: 978242 - protein, 146 aa, Homo sapiens
QALIPAEQSGGVGPIPSYTLIVVNTRFYCSSPQSAYKHAGRKIGRESPRRLTPDSSEPVTNARAPAVGRTLSYAESGALGARGSLLPGGPVSLLVRDSRHLWHCWLLAPSYRDSEAQGERTKQELLAGLEIKEGYVLTRVHRTLRT

SEQ ID NO: 978243 - protein, 161 aa, Homo sapiens
LGKRGIFRPVSCLLDLLPFTLPVEHSYEVRKKKKQLMPWLLVSFVGLKSRSRWGAGCWGLGLGGLDLAYGVERLYLGVCVGGLVAGIGLGKASRKMGFRGRQAFAVVGRVLCDSGGSCSVRILDSGRRPGPLRQGQCPLGTIQPPSVVLVTIQQGTFLRVR

SEQ ID NO: 978244 - protein, 35 aa, Homo sapiens
YARPEYQHALLCDCDYTGLQCRWRKMKVGACVFVC

SEQ ID NO: 978245 - protein, 235 aa, Homo sapiens
NRTHKFLEKAEGLCKISGVIGPYRETVDSGEKKVNEIKDIRGPEAQQRNHVKNIGILFEEAEKLKPKMSQKEMAQVEVKLTDTASQSNSTAGELGALQAEAESLDKTVKELAEQLEFIKNSDIQGALDSITKYFQMSLEAEKRVNASSHRPQQHCGAVCPHARQSRRSECGARVSVQGAARRNRHASLDERGRQNCKVSTCRLVAQMTCGTPPGLTVLKVNGGGPNCRTDEGEQK

SEQ ID NO: 978246 - protein, 34 aa, Homo sapiens
HIFCWDQEEDVETGQLDQGKATMDDEQDIEQDRE

SEQ ID NO: 978247 - protein, 263 aa, Homo sapiens
MGYDVTRFHGENVDEDLICPIGSGVLEEPVQAPHCEHAFCNACITQVVLSATDMSRWTVCSDGKPICAQYLRIMRNMLSKAARFACDNAVFGCSAVVRTGEPSCLNLSDCEHKPKRAVTCEQGPVGLGGCPKDEADRPLIGLATGLNGCTAKQETHRLREAGQESSGLKPTHTLGRGENGTPRPAKDHTGVKPRGYTRSFGNRGERTGDETTNTRGEQPITERKHAEEDQNTQKCAEKSDGGRDTLTYKSSTEQPAMTEPVTA

SEQ ID NO: 978248 - protein, 88 aa, Homo sapiens
DVLSFKPDDGNSSYVQSKPDIQYAPRSEQEPTTLERIISKPNVLSDSVRSSHAPRNYIEDGESDGFLRCLSLNSGWILTTTLVLSVVV

SEQ ID NO: 978249 - protein, 79 aa, Homo sapiens
MNSSDTMYWGGAERLHGNQRKPPGFLETVREQISLKNYDPQNDKRFSGTVRIKYHSAPIKFSVCVPGAPQQHCDETTGR

SEQ ID NO: 978250 - protein, 41 aa, Homo sapiens
ASVVVGPGSGCCAVSELRGDGAVYAGAVLCLSFVVVGPCSV

SEQ ID NO: 978251 - protein, 136 aa, Homo sapiens
SNRARYRLFVFPAVSSVKPACNTRMGRKERESLSAAWPGMVPAHGFRLEEISLWRIWNMARKENQNTLFELQGARKSLEVPRGDSADGEGGTLRSHREEAKEQHQKLWEEQLAAAKAQQEQELAADAFKELDDDMD

SEQ ID NO: 978252 - protein, 246 aa, Homo sapiens
IKNSSVIYLVCLSEKNIEIALDGLSGPYNSNGQLGRFQILHMIFVLICHARVGSSHSLENFTAAIPSHRCWVPILDNDTASDNGSRILSQDDLLRISIPLDSNLRPDKCRRYIQPQWHLLHLNGTFPTVTEPDTEPCVDGWVYDQSTFLSTTVTQWDLVCGSQALNSVAKFIYMTGIFIGYIMGGHLSDKFGRKLIFTVLFTENGPSLKTVCSFAPLLPQSTGHFPIPVRDFFLQPGGTKTGFAQY

SEQ ID NO: 978253 - protein, 36 aa, Homo sapiens
GEGSRAPDEAESMGTTVKAGTDGTVGGGLEVGLFLS

SEQ ID NO: 978254 - protein, 465 aa, Homo sapiens
MVRGPLASATCVHQARPLPGALCPDFRGCPAPSVFLMVWKTHMAIPPLHPRDDATPMLWHPGLCGLHSVPMWTLLGEAQSPLTMGHVHSSDGILTEFSQLVPHSLLQMGHVPIALVLASTRGRLTTDGSPYVIPWTLNGLPSVDYEDSSSPLITVKKPSSVHLCLPTEYPIIHLNHLARAMALETSSDIMGKQSSVDNPYTWLVPPLYEPQNTPKATTGSLQVDTHMAYGKPMHGYRATELVPYGPCAMKESTAEICFCLAVVMHHSCPRELGGLGQGIERGHQEQRQQGWAWLGRPNIKRCPPPNPETQYKSDTPDAIGVAQRPTSQTTRGTVHAHHSPARSDHRGVAQDEQRHSSRTERPDPPPREEENGDKLPPQPYNKTTREQQHSTDNEDMQTPEKRRERNKNKGSGVRKRSLHIDSGTTERPARQAATPEKDWPTQYKSRAQYRKPSTNIISLPQNEAT

SEQ ID NO: 978255 - protein, 192 aa, Homo sapiens
YSKTIGTSYPDCQNTTTALFLSDRQKQQKVFLYGRWVSTTCLSTHHKLCTFILKNPAENSDSGTGKTELEKKNRKGKYKENGSVSSSETPPTPAPPDEINPPPHTMKEEEDDNWGEDTTEEAQRRRMDKISDHAKVLTLSDDLERTIKERVHILFDFVTKKKEEGVLDSSDTEIVAEAERLDDKTMGPSGPN

SEQ ID NO: 978256 - protein, 74 aa, Homo sapiens
QQMTTELFHRQALYLPTCISRHGCHCGFTAPSESLISLIAIEVIVGVLRWALDEYFRTEERIKGLMHGTDLPSL

SEQ ID NO: 978257 - protein, 328 aa, Homo sapiens
PGRSLMRSRKLTGGVRSSARLRARSYSSASLASARDVTSSTSAKTTCLASSSHKATDRRTSKKFKYDKGHLVKAELQKLDPKSDISSLPKVAPVAPCENKFAEDSAEAAVSVPESREPPQGCSTPESEEPSVKAENGLSTEPSSAAAAQEPDDSSAGQAEPVPRTEEVRASVLQMDSSIFLDDDSNQPMPVSRFFGNVELMQDAATASSSYPSMSRQRIQKNALQRQDDEDDAEGKSCGRLQPVSKDRMASSENTPETRGHQGTAWQNAQGTMLARRRGGEQRKTRKSPGAGEKTDIFQRTIDPTERNHREKKPLMKEEHTRRGRICK

SEQ ID NO: 978258 - protein, 204 aa, Homo sapiens
RVFTQRIVLCWTRARETGGAEGTGDAVSGENLLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQWQKE

SEQ ID NO: 978259 - protein, 78 aa, Homo sapiens
SRDLSVWHHPGHLRDLMLGVAEVIAMPAAVLLQFLILGLIPGLGFCPAADGNLLILGLDLSDDAIQVQVADVVHGEDH

SEQ ID NO: 978260 - protein, 68 aa, Homo sapiens
GSPREEGCPLPPEGEKHRCAQPAELGMHRHCLLLLQHTISPAIRLARRAWAFAEALESCSLSSPSCLH

SEQ ID NO: 978261 - protein, 207 aa, Homo sapiens
QQENRILWERGQVETGGAEGTGDAVYGENLCLEEALLSREHVLELENSKGPSLASLEGEEDKGKSSSSQVVGPVQEEEYVAEKLPSRFIESAHTELAKDDAAPAPPVADAKAQDRGVKGELGNEESLDRNEEDLGAEDGWTMDAEADHSGGSDRNSMDSVDSCCSLKKTESFQNAQAGSNPKKVDLIIWEIEVPKHLVGRLIGKQGR

SEQ ID NO: 978262 - protein, 285 aa, Homo sapiens
MATVWDEAEQDGMGRRCSRCPRKRLSSAQRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDELATEQYSDIGGLDKQIQELVEAIVLPMNHKEKLENLGYPSPPQGVLMYWAGLKQGRLCLPEDCACQNKGNFLKLAGPSGVVPDVIGKGAKLVGKLLAGQGKAIYFSYHWCRGPSSTGKGATE

SEQ ID NO: 978263 - protein, 150 aa, Homo sapiens
MALVQESEATLQSTYSDTSAQPTCDSGYGTWNSGTNRGYEGYGYGYGYGQDNTSKYGINQRLDMVPHLETDMMQGGVCGSGGERYDSYESCDSRAVLSERDLYRSGYDYGELDLEMEMGYEGQYDANADQFRMRGTDPFGPRAQGWARNA

SEQ ID NO: 978264 - protein, 95 aa, Homo sapiens
AVTLKNLTGLNQRRGEKGTRVLGGAAVDMKGFDKMLPPIEQDVNENTLKNLESYDSHKAGNHNALAAVLTWNWATSSVPNARPGLLMPFALQLCV

SEQ ID NO: 978265 - protein, 47 aa, Homo sapiens
DHAVVILRERKCALHLEAMGLSNNFKPLGYANPVHLYTHTYECAHTY

SEQ ID NO: 978266 - protein, 107 aa, Homo sapiens
MEGADNQAGEQGRPVRQNMYRGYRPRFRRGPPRQRQPREDGNEEDKENQGDETQGQQPPERRYRRNFNYRRRRPENPKPQEGKETKAVDPPAENSAAPEAEQGGAEE

SEQ ID NO: 978267 - protein, 71 aa, Homo sapiens
EEAKSSDRGGEGREAQQVTWRKPHTDLLMLLTQAGCALNSGSPPGIGPCYENHGYQSEHICPPRPPVAPNG

SEQ ID NO: 978268 - protein, 111 aa, Homo sapiens
MITLTSLGTTAVHGKMCTDVQENKCSWLEVQCLQRATPKQYQILKENYGQKEAEKVARVKALYEELDLPAVFLQYEEDSYSHIMALIEQYAAPLPPAVFLGLARKIYKRRK

SEQ ID NO: 978269 - protein, 82 aa, Homo sapiens
MGETIVGIYLQSSYNKQRLDQPLEASTWLKNFKTTNERFLNQIKVQEQYVWNTRDSTGERESSGRKWLNRANTGEGTPTMQC

SEQ ID NO: 978270 - protein, 337 aa, Homo sapiens
EVEQPGGGLRAGSRKEGSGRRAPLPALLSAGGTVGGQSRMEKLRLLSLRYQEYVTRHPAATAQLETAVRGLSYLLAGRFSDSHELSELVYSASNLLVLLNDGILRKELRKKLPVSLSQQKLLTWLSVLECVEVFMEMGAAKVWGEVGRWLVIALIQLAKAVLRMLLLIWFKAGIQTSPPIVPLDRETQAQPLDGDHNPGSQEPSYVGKRSHRVVRTLQNSHPCTHGYWGGPQQREIGRNAAGGLSRATKTLGVAGDPWPKLGHLPGPGWTWPAWEYGRTDLGAPLVQCWVRHFSTRAPAGATTLPQTAGSPRGRHPGKYREQHGFTSSRATLSHVTH

SEQ ID NO: 978271 - protein, 107 aa, Homo sapiens
MDETASRRGRLGSQLLNNDIVYSRGGNPGPWLTTQQGGDPNSYRDEAEWRETTLAGPESPATTSYSWAGALRLHYAGKCSFGSGDYKIHVPLTSRSWKRMQICFHGD

SEQ ID NO: 978272 - protein, 116 aa, Homo sapiens
LSILITPGIARHEVYLRAQAHAICKYGCDCPGSRPGCATAVRKHELKELHEYQMNTEPGGREELAVTITKRVSMNRMESVWRKGSKGNQPISSGLTQIKDICLAIQKITFSCVGPS

SEQ ID NO: 978273 - protein, 156 aa, Homo sapiens
RDPGRGGYRQWMWSEEGEVSSSADPHHPLQTRQNTIWWTSILFEISPNLYQDLLTLRIVLLNFTLDAFLLQCGQIHLPSGAFSMSGSRQTMWHARGQVSTTDDLTDLLAHLQIVLVVCLITIHSSHLLLAFLFLFSGSAITCGCGYYGWLAPSETE

SEQ ID NO: 978274 - protein, 163 aa, Homo sapiens
EREARRRGKAEEQAVRQRELAEQELEKQRQLAEGTAQQRLAAEQALIRLRAETEQGEQQRQLLEEELARLQREAAAGTQKRQELEAELAKVRGRDGGAAGQQGEGRGESRGSKQVRKSKQRLEGRCRAGSVELAGGMAARLACLGWNEAKTGSGSEAEEDRGR

SEQ ID NO: 978275 - protein, 77 aa, Homo sapiens
LSAASNLSRSPRHYIDELDVYDLAQQKSAQMSGLGDYVIEDSKCGYFQAVPKESWLISTYLGILLCFLKSPNIFQAS

SEQ ID NO: 978276 - protein, 138 aa, Homo sapiens
NPSSDLLTKGDLEAYCNTHEGKLLDKGIHPLTQSDSLDGHSAITWNTLLILKGVSKLPFAVSNPYPLLLVNIGAGVSILTVLVPTINTEGVTGTSLGGEKFCGLVLSAYRARRYTEEALEMASRGDSTKVDNLVRCRY

SEQ ID NO: 978277 - protein, 81 aa, Homo sapiens
CHQTTESHMVENVYLVLLQWHMDVDLPSGKALVSLPESFSVGPQQMLIAQNNTVHPMTMDSSSDLSKELAIRFSANLQQWQ

SEQ ID NO: 978278 - protein, 115 aa, Homo sapiens
SAEGRGNISYLRMFLSLYSKRRAMRIVFLKVDLRRISGTGSSSSTSMADEFVCLSLFSPNLTLDGFTDGHLASTLANLCQVSSREAISHFSQELQVHILRNWGLAQVSLNGLLGT

SEQ ID NO: 978279 - protein, 69 aa, Homo sapiens
MASPDDEFSDFVIYSDEKRVGEGTESPGGKRGYILRDNNHSRAVGQESSQDCLYKEAKYQDLDLHPLLE

SEQ ID NO: 978280 - protein, 171 aa, Homo sapiens
MSANFGLCWKYPNPSQIWAHSVLSSGKFYGDECETIKVCRQARCARFYALSASFEPFSNKGQTLVVQFTVKLEQNIDCGERLMKLLPNSWDHTDMHGDSEYNIMFGPDICGPGTKKVHVIFNCKGKNVLINKDIRCKDHEFTHLYTLIVRPDNTYEVKIDNSQVKSGSLED

SEQ ID NO: 978281 - protein, 133 aa, Homo sapiens
LINPTMRLTLFMYMDKRNNCSSMISQNRNYITEAANHLCMWYAWSMHCQPIPNPLHITVPSIFQATTLWTASTYLLHRSCQVSTACKFTHTYSHFTSLHTSRQTQLPPTPQPSLALLLHAPSQRTLFCTLTSL

SEQ ID NO: 978282 - protein, 59 aa, Homo sapiens
MQNVPMDEDPAPRHAVKRNVHRNNAHEDINKPLAHSNEILLCNTNMRSKYRSTKMMNID

SEQ ID NO: 978283 - protein, 198 aa, Homo sapiens
TGKPLEVSCTLSRLADENFKEYTESPPSEYDKVIQLDTICSGSLNPYWASMKNLQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGLIYALTDLMTEAEVTENTEVELFHKDIEAFKEAYKTGSLVD

SEQ ID NO: 978284 - protein, 110 aa, Homo sapiens
GPQKVILEPAPRVIGSRSGLSSRTSSLASRTSSEMTLDRSETSLIAQKLLPDIWMSYLKITDEESPTTPLLDDMDGSQDSPIFMSAPEYKYMPPPTYTEVDPCILNNNVQ

SEQ ID NO: 978285 - protein, 30 aa, Homo sapiens
MAAMAYRTSNAQSGNVYRRSKARVITEEEK

SEQ ID NO: 978286 - protein, 52 aa, Homo sapiens
MVAPRFGHYVCTLVRYEGGGGQMQELRRVRAGVMSDKDHMVTMHDVLDAQWL

SEQ ID NO: 978287 - protein, 202 aa, Homo sapiens
LTQLSRTEMNVEEDMKKPKKKSQFKSAVVTKEGQMCDIWKMIEHKREKIQRLREENDIARGKLEEEKKKIRRALISGPVTLHISAKAARRTNKGSSVGTTDAGMYLDFENEKLDRQHVQHQLLVILKGAPKSKKSNNTVGILEKLHEFAITEPLVTFQGETGTEKKLPPHQKVPQLHSMKAWWNVPVQYTDPALSIGTACHV

SEQ ID NO: 978288 - protein, 69 aa, Homo sapiens
MDHLHGRDHITLSRLTYMSGRLVRSDCPMRENITLRGLVLPVGGIQDRVLAAHRAGLKQVIIPRRNEND

SEQ ID NO: 978289 - protein, 60 aa, Homo sapiens
YSNYITSQNAMNGLGRRSTTSNTLAAAAALYSKSIFQNGMRRRDARPRGPETRAETSQQE

SEQ ID NO: 978290 - protein, 105 aa, Homo sapiens
MFDIHTALHPPICVQKAAFRKLVANHALLHSRALHREILVGTQTRISREKAVTEVELFLRVCKCPVIDVHNISILQLTFQHHRMMRQKKKSEGLCPRFLLKLCCL

SEQ ID NO: 978291 - protein, 71 aa, Homo sapiens
LEDPVHCAMKASFIESYSICKVGLTRVTKHKNNIQLAKGADEINNQERIYSCTSLIQLNSLQYTKPINNVV

SEQ ID NO: 978292 - protein, 128 aa, Homo sapiens
MSWYHQTRSSYRFIRFALDIRMPGVTPKQSDTYFCMSMRIPVDEEAFVIDFKPRASMDTVHHMLLFGCNMPSSTVSYWFRDEGTCTDKANILYAWARNAPPYRVPKGVGFRVGGETGPKYFVLQVHYG

SEQ ID NO: 978293 - protein, 53 aa, Homo sapiens
LDGSRRRTMGVLLGELVPPSHDLSAHGDGPRLSRLGVKLAGRRKLRRRRRKLR

SEQ ID NO: 978294 - protein, 150 aa, Homo sapiens
RSRTSVRITAASTSSPPPVISLRPLDIGLMKRAEQRWSTIVPSHRARLDTLYPGRRGSTFNTGGSPQNLDVQLASKLYPTDRNLMKDSEDRLIEREVPGDVIPYAVEGSDHEVPGQQGKRILGRKTKWGTIEVEKTTHCEIAYLREPSHQ

SEQ ID NO: 978295 - protein, 35 aa, Homo sapiens
YPLNTFHVSAILARSHIISQYPTHVDLFVIAPPCL

SEQ ID NO: 978296 - protein, 112 aa, Homo sapiens
MVTSGSLMFRCWATEAAPAALGRWPTPPEMPGTSRRLNTRNEKAPVDFWLRWGLTPSWTQMRRKAMTQGLSSSNIMVVGHERPWVNPPLINTLFKSKISRKCVQPTSEERIP

SEQ ID NO: 978297 - protein, 145 aa, Homo sapiens
MSPVGPRGCRGHLDVLGWEWGAVSGLKVVQMFRARNTAFRGHLHSCPTPRSRGSRARVLPGRSGGQTDTSPLPPPIGYKLRLPPAVRRPPSTASPLEDPPLASAGYTMLQELQQEVICSVGHDVLRNRRGDDLILGSPDQQYRTW

SEQ ID NO: 978298 - protein, 168 aa, Homo sapiens
PGHVELFLLPERWGAATADGKLDKLQGIPLNAEVQDPEPEHEVMTQDALCARPLELLEAEEDCKMALRCSALSICAGKWHDQEAEHVPEGRQAHAHATLDTPVAAQASARAVGLHVSQEGQVVVLAEQQQDDTPHPHRTHQHEVEGPYRIHGQLTPLVREEGVLESLD

SEQ ID NO: 978299 - protein, 102 aa, Homo sapiens
QTITLNIEVWNYFFDIISKHTVNSNDPQITVNSLKQGCTMAVMQSMGQIEIHGSATVRITFHFFPRRATVYGAEVNVLPFEDYWHTFSFFTSLIDWKQPADH

SEQ ID NO: 978300 - protein, 191 aa, Homo sapiens
RDGSRRLTLKHIHGLLVPEHLTYDAGMLQNVPLRPPPFKQCTTVRPSPPLYSSCHLSTWRMSFKKERLDTGVSLYIGQPRNWNCCTIQISILGTGGIVNAEYPADDVLFQVSRDKFHLDGAVSVYSVFWPVLWTQLGRIHIIEHNYGCAVIIQDQSPKVFHCVWRMLRDYKSCLFIAGHEGSIDVVAALPI

SEQ ID NO: 978301 - protein, 222 aa, Homo sapiens
VLSQRTRLATHQETYTGQGIGEEEQLSSKKQKTENVFVDETPYSCNVTYIPLMDNADSSPVVDKREVIDLLKPDQVEGIQKSGTMKLKTETDKENAEVKFKDFLLSLKTVMFSEDEALCVVDLLKEKSGVIQDALKKSSKGEETTLIHQLQEKDKLLAAVKEDAAATKDRCKQLTQEMMTEKERSNVVITRMKDRMGTLEKEHNVFQNPMHVSYQETQQMAM

SEQ ID NO: 978302 - protein, 118 aa, Homo sapiens
AALLLLHALKAMDYHWIETLQSDTKRVRKVLWTTASRHDSYVNPKQSRILNPFFMEIAADKLLSRSMHLPQTIEQKPTTGLLAITLAHYLSTRADSGRFGYRNTYYQKQTIHYYEQIT

SEQ ID NO: 978303 - protein, 164 aa, Homo sapiens
DPFTGSVISELISMKYLAGSRGGSLRALEYLRSSVASKLKVVLLRFPQQDFPSEQILLVEEQDHRDGCSAIFVPDALEEVQSLLQGGVVWFVLPDDHVVAAAGHHEDDGSHIVEALDPLAAFIALATHVKHVEVDFVHLELGLKDSRSQDTAAKQVLIARHIVS

SEQ ID NO: 978304 - protein, 69 aa, Homo sapiens
ESPAYCTVAITPLLGKRHCAGRSLQPFRARVFYINRRAKFLKTKLDSCSYMKIVYFYELLKHTLLFPSV

SEQ ID NO: 978305 - protein, 115 aa, Homo sapiens
MTLEVEPSDTIENVKAMIEHRDGFPPDQITMIFAGKQLEDGRTLSDYNIQKEPTLHLVLRLRGGIIEPSLRQLAQKYNCDKMICRKCYARLHPRAVNCRKKKCGHTNNLRPASVT

SEQ ID NO: 978306 - protein, 172 aa, Homo sapiens
ILEYPLLVLYPENCITFMVEHCFVSILHFVLGVAVDFTSVVLLVQGLFSQIFHVRVFHPVDAVPVPQVRGPLLIIVTGVGRLSGVGSSSCIDIDVIRQVVHHGPRLTGFNVEHHLSVHFVFVHVMDGLIQVLYMKIFIGKNQYSSRSMVSEVNEHVILGATLQDYAGSYALH

SEQ ID NO: 978307 - protein, 77 aa, Homo sapiens
MACLLVLIVAPPSSSNGPFRGSSSSSLWCGLHCRYCDPAGGPRLAVGSGTPGPHPPRWAREVKCSGKALDSAMWRAD

SEQ ID NO: 978308 - protein, 100 aa, Homo sapiens
SGIQRKEGFPPFYGNGGTRLSTCIATAEFQAAEHHEVVAVEEADLIEGEAKADTRNKQNFGPKSQFKETKSGNYSIITTQGLLKGKIVLLFLNSLLSSPP

SEQ ID NO: 978309 - protein, 130 aa, Homo sapiens
RNLEQTADEDADNNEEDPEGSSEEVVDEDRFLAAPFLKMRSDAPAGESRTFLKKMDDEDEDAEDSDDDEDWDTGSTSSDSDLEEEEGKQTALASRFLKKAPTTDEDMTAAERNREDIAKKMPDRKSKRLD

SEQ ID NO: 978310 - protein, 173 aa, Homo sapiens
LRGMERVARENSDFQRQKLEAHQGLLAPQEAKQKVEKEVQAREANLQAECSRQTQLALEEKAVLRKERDSLPKELEENKREAEQLRMELAIRNSTLDTCIKTKSQPMMPVSRPMGPVPNPQPIDPASLEEFKRKILESQRPPAGIPVAPSSGGGGSRPEDQGMARLGGLRRMQ

SEQ ID NO: 978311 - protein, 99 aa, Homo sapiens
MTDLDEQEDESLVTTVKDEDENSTGNKGELTRNPDLHEDNVTEQTHHMIIPSYAACLDYNNVHAIDRRVLPYFLNGKNKSKIPENYLAYRNYMIDTYRL

SEQ ID NO: 978312 - protein, 64 aa, Homo sapiens
MPFPYCQILNSQIQFPFLPPGGAMERRALTGPGDLGDVRGEPLVIGSLTLRKIKGPKSQPRHPE

SEQ ID NO: 978313 - protein, 143 aa, Homo sapiens
SRGSRILTLKLYAVSAFFFTALETLSIGDMSQNGLFTDGVQIQWLEHRHHSELLCKVANIILLTAFKNIYPSRLGFMILLLQKCKSKGTAGTLAGGPVSIEQGSEPMAVTMLEGCCGPKDRLNGECIGVSVDSMWLPLEIPGT

SEQ ID NO: 978314 - protein, 42 aa, Homo sapiens
SASFSSANLHACEPCGNPIQVHCRRLFGLDEFMDNHLNSEAR

SEQ ID NO: 978315 - protein, 161 aa, Homo sapiens
MCLITIFIRSISMSQCVAGYGFRRVNLIVTTEKFSARPKIELRCVGLHFFLTNFYCFLVSLLGVRHSGLFVVSRCHFRKIPKIISFHFQVEHLTFWLCSIGNKIFVQQLQNIIADVLQICLYLLTGLFAHLLLLLIPLCILLKAGDDTPEQSGGAYHILVG

SEQ ID NO: 978316 - protein, 151 aa, Homo sapiens
DSIMSQVVPRSHELVLIQGPVIRVVLKVLCGQDVPWSLDSRVVARSLTPGYNKALRHRTVKRPDQRLIELSMSQVPAKFPEEGYTKVPVPVLHKGTRAMSFNGHSRPSSAEDQAEVIWCTDKPLRSQPPDAGHPLPICFCVLIVCRPCNQY

SEQ ID NO: 978317 - protein, 105 aa, Homo sapiens
LLIGPGKPMCVESFSDYPPFGSLLLCVDMRQTVAVGVIKAVDKKAAGAGKVTKSAQKAQKAEMNIIPNTCHPTLNQWWKNGLRTVGFNGPFKFSSKRLVNDNNAS

SEQ ID NO: 978318 - protein, 122 aa, Homo sapiens
LHVILYACEVAAVIWGFVNTDQIAKDVKQFYDQALQQAVVNDDANTAKAVVKTSHETLDCCGSSTLDCFDHLSAHEQLVSLGSKIISTLFKEACHQKIDDLFSGKLYLIGIDAIVVAVIMIF

SEQ ID NO: 978319 - protein, 122 aa, Homo sapiens
SVPPVLMAMVCVDLSCSLIQITGHRGRSDYYNAVPAIQEASGCIVLARGSCRCSVCSLAERVIRQHLQCLAILNMFAALAEISHASSILDEPPKRPEKKDCEFFTLRSASANSAIASASFPE

SEQ ID NO: 978320 - protein, 44 aa, Homo sapiens
RFPNEPELSKRAKSVSVELVWQLLAWWARLSFCSSFQLPLAYST

SEQ ID NO: 978321 - protein, 84 aa, Homo sapiens
MVLTEVQVLLSVSAGNERATANEIKDEYVETLSKIYLSYYRSYLGRLMKVQYPFEALFRSQHYALLDNSCREYLFICEFFVVSG

SEQ ID NO: 978322 - protein, 114 aa, Homo sapiens
MSHIVFLGYVRFERVPGGLVVGRSVPYSLRTHPNPQEAPTHLEATFHTSSSSTTWLDGPAGKIMMVAQPWDVMWDCVLGQIQLCSLLTISQGKQASDGAGSGSVRRGAAAAVFY

SEQ ID NO: 978323 - protein, 98 aa, Homo sapiens
MSVIWPISAPSCCYIYFLVLCSCNKYSTLYKGAADQDVSCILAFGYNVVLKSTIMFAFTFVSDRSILQGTEEHVLIDCKRTFTLNGRQQSLIDSKLPK

SEQ ID NO: 978324 - protein, 60 aa, Homo sapiens
MGLNLWRVKSGTIFDNFLITNDEAYAEEFGNETWGVTKAAEKQMKDKQDEEQRLKEEEED

SEQ ID NO: 978325 - protein, 125 aa, Homo sapiens
PPYGRSWTTPRSRWSLTTFVQVQSPADCVSAVNTVLIREHRAVTQDAPIPGSPLYTIKAFIPAIDSFGFETDLRTHTQGQAFSLSVFHHWQIVPGDPLDKSIVIRPLEPQPAPHLAREFMIKTRR

SEQ ID NO: 978326 - protein, 118 aa, Homo sapiens
MQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQRQRET

SEQ ID NO: 978327 - protein, 82 aa, Homo sapiens
MGPYLENTSLYISVCGVQAQSQILQDNSEDQDLPDSQYDACEIDMGEWLWLAVYDHLECKTCYVIVYGSGSETVTGYNAFGS

SEQ ID NO: 978328 - protein, 98 aa, Homo sapiens
LPSFVARLVPVGLGTGQPDKSIRAESDVLWEFFLTVPISSPDLIHHRSFLSRESIYIYAFQSTQLTVFVEITFSLHSCKNPVAPGFNEIMRTIVIKPE

SEQ ID NO: 978329 - protein, 38 aa, Homo sapiens
KLQQARQLKELLQTELSGFLDAQNGCGCCGHMSLQELD

SEQ ID NO: 978330 - protein, 135 aa, Homo sapiens
TFTHRRRLRRRSSGLYDNRPVCKQWEEFREQYTPWVGTSAPKAVGSNARMDVTDKYKYPEGSDQERQVFQKALGKLKPNTPFAATSSMGLETEEQEPSIIGKLKVAGMLAVGKEVNLVLLLKNLSRDTKTVTVNM

SEQ ID NO: 978331 - protein, 99 aa, Homo sapiens
IYKIITVYESCSVAIIILYLCDPPGVLYIRCTSLYRERSDWYTMLYNPSPDYVTTVHWTHEAGYPLYTIVFIYYAFCYGINDAAPDSSGEEDCMWVREI

SEQ ID NO: 978332 - protein, 153 aa, Homo sapiens
AYLGAAGKAKMIREPTIGVWNLAMFSLIQSYSGYVGAYSVLRGTNRIAYNLEILHNGESPVDCDGLAGKIRIVSRALDLFSDNAPPPELLEIINEDIAKRTCEEHQLCVVAVLPHILDTGAAGRNSYLEVLLKLADKYKKKMWGWLWAEAGGI

SEQ ID NO: 978333 - protein, 37 aa, Homo sapiens
RVGKGCHWRGYKTEYLVDNKVHARRPFGRTPLADLWP

SEQ ID NO: 978334 - protein, 107 aa, Homo sapiens
MSYPISFLVCEVIVHHRRHSLQGLHDDPVDLVEQLAGHLLAAGALQVEPQVTHCPLAPMDVVVVFPVFLDGDVGKMNEHVVQLTGTRGVFHCAEPAKPKLVHVTAQW

SEQ ID NO: 978335 - protein, 71 aa, Homo sapiens
MERNRRSVEQVSMNRKVRASQLYPGGQGRLEARGWTKHPEERALLPERGLRAVGLRAGGSTSVLVALPAGG

SEQ ID NO: 978336 - protein, 137 aa, Homo sapiens
LHEDIVHIISAIQIEANGIHCHSCSLWLPHSSISSHDSPLGENITIVMVSISALTVVPSRQVNAISTTVTLNKTIRAFINVRFTAGSSEALWAGTHISGNTGSSIPTAIFAKCFACRSIPCIARLANTVVSSNSVEA

SEQ ID NO: 978337 - protein, 107 aa, Homo sapiens
MSTTCWRHLISLFTTVTFRHRWRARECRQPETVVILSRLPRSDGKCRLQQLHPGLPVSAPPPPIPRSHIPPLLPSNPSALKAGCTDSILYANDTYIFLAITFLLQKN

SEQ ID NO: 978338 - protein, 91 aa, Homo sapiens
MSKFTWLTLLASVSRVHIYRFFDYVSHLHEESVRGSHRRSNTTSSPSSSSSSSSSTAASVKSSRSASDRKFTLINIIVFLFIFLFLFLFIF

SEQ ID NO: 978339 - protein, 140 aa, Homo sapiens
IAISCSCAQPRDPASDAQYLPPLHRIGTAALADEFVVSIWPKLNYTLLITALWRFQTEQVSKDMPYASAEPEQMDRLEEFPNTCKMREELGELSEQFHKYAAQLGEMLYMSVPAVAKLRRLLDSLSREALPDILTSIIRT

SEQ ID NO: 978340 - protein, 34 aa, Homo sapiens
SRASSIIDELFQDRYFSREPQDNYHYLPFSLTHR

SEQ ID NO: 978341 - protein, 50 aa, Homo sapiens
YERQIDQRKKELEHKFDVLDENQSKLSEDLMEFRRDASMLNDELSHVQPR

SEQ ID NO: 978342 - protein, 129 aa, Homo sapiens
TQDGSAHIPHYLMTSSLSDESLGRRRVLNPAEELHHLIHAFHDDEETALAMVHVLIHIQDADNMGAARSLPVMVYLLPGLGAVIQELQGTLLSSAPMEALQHFAVHTQAQHLLGQLVVVDHCVLLGLPP

SEQ ID NO: 978343 - protein, 73 aa, Homo sapiens
MVLSLPGKAVGQGSLDILLLLQPSGSPSSRSQAFRAEGLQGSAVGEGQRPGFQQWALVNGIEVDGRLLLTLAS

SEQ ID NO: 978344 - protein, 132 aa, Homo sapiens
YDFEGERPLVVIEDAHELERHGKQNSYYRYASFQDVHVMVFVGFGFLMTFLQSYGLSCRVASTSVFGVFGIQWALLMRCWFHFLDDRYIVVGVETFVNADFCVASVCVAFGAVLGKVSPIQLLIMTFFQVTL

SEQ ID NO: 978345 - protein, 128 aa, Homo sapiens
MCAMCRALQREHAKGLLQMLMATGATELVDMPPRAVSPACPRAVGCYCEHGGAVLSICPCGARCSCVSFSIYSAWGEHCEHLIVRFDGFFGIFFGVLGGLLLLGVGTFVVLRFWGLLRGQVLLFPELS

SEQ ID NO: 978346 - protein, 100 aa, Homo sapiens
DDTIGSPEVPLELHRHVIVQKGSGIRMMMDDLELNIHVPAPELQSCIIAITGLAANLDRAKAELLERVMDAQAEQEDRALRSLKLVTVDPKYHPKIIGRK

SEQ ID NO: 978347 - protein, 127 aa, Homo sapiens
GAPERLDLYRYVFGQKGSGIRKRRVLFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQIT

SEQ ID NO: 978348 - protein, 120 aa, Homo sapiens
PQVPLKEIFYQKLGDLLFRDFWGNHLQEFSALALEFYEEIKKYEKLETKEDRVPRTREIFDSYIMKELLSCSHTFLKSATEHVQGHLRKKQLPPDLLQPYIEEICQNLRGDVFQKFIESD

SEQ ID NO: 978349 - protein, 73 aa, Homo sapiens
IPNWSGRCMDTHHSQRSCGMQHSILRHAEHIYLIFSLNKNNHWLMYQGWEVGAVEERQKAELKPSKTMMPNVC

SEQ ID NO: 978350 - protein, 54 aa, Homo sapiens
LAVLISAMHGDMAQKERDCDYEGVSVLGSSRVYDYQLTCLARGIDVQQVSLVHQ

SEQ ID NO: 978351 - protein, 78 aa, Homo sapiens
MLLQNRALGFPIRFSFGVFFSLFHVILILFRVIWILPVKQTVRDFSKEMTTVLLNVKVDSQTLPDSQAVIILLKGPRV

SEQ ID NO: 978352 - protein, 38 aa, Homo sapiens
YSTEEDDTAGILARRGGSPVSGPAGANLSVARLLVPAP

SEQ ID NO: 978353 - protein, 45 aa, Homo sapiens
MRQLCICGSGMSEVLLLRRICCMLSHCEMAKTRLQVHFLTVNTPP

SEQ ID NO: 978354 - protein, 131 aa, Homo sapiens
MAQGVKYYQRCTLAIRCRIVSAIYRACMHLRTVSRCNRIHPGEVIQFVQQDLPTQELLQVFSEVLPGLAIRPRIVAIDLLEHPPSKWSARVLGCRRYKEYYPPSHGTMGWGMVPTKGSVLEESQTSPWSER

SEQ ID NO: 978355 - protein, 67 aa, Homo sapiens
WNGQNSYLYVDSTRLKHLPESRKRCTGPDTGEGSLFGWGRLAWGQNGLSTQTRWAPPPPSSSLAYST

SEQ ID NO: 978356 - protein, 34 aa, Homo sapiens
FLEEQAEKRGISGPRKPYTSGRTTAFLSGSGVNI

SEQ ID NO: 978357 - protein, 49 aa, Homo sapiens
QVLAHSLGACSLQQGPLGVQNLVLLLQEPHLVDEGGKLIVGGLDGSVAH

SEQ ID NO: 978358 - protein, 78 aa, Homo sapiens
MGHAVQLIICVQLFVRETPSSLHLAAMSCPFLWSLVICSFFSSISSRTNEYFIMIGDANAGTDGHEHVSDSLRGTRMF

SEQ ID NO: 978359 - protein, 90 aa, Homo sapiens
VEDISKVNSEGALHDDGADIIEACDVRLKEDDKDVESVMNSVVSLLLILEPDMQEALIESLCEKLVKFREGERPALRLQLLSNLFHEMDK

SEQ ID NO: 978360 - protein, 143 aa, Homo sapiens
DSRASRPRVAQMREPDVSQFVLTEGNPRWEETHLTYRIETYTPDLPRADGDHAIEKAFQLWRNDALLTFTKASEGQADIMISFARGDHRDNSPLDGPGGNLAHAFQPVPGIGGDANLDEDEGCTNNFREYNFIALLVMNSAIL

SEQ ID NO: 978361 - protein, 63 aa, Homo sapiens
MLAGLADSRISKILRRGRDAVLYEGTEGGVRYALGISKYNEKEILRLQNGLEIYQYLRTYEGT

SEQ ID NO: 978362 - protein, 52 aa, Homo sapiens
MCLNSQYLVYRLISWKSFKNIKQYYPSEFERTKPYCYVKYSIANFTNLNPIG

SEQ ID NO: 978363 - protein, 46 aa, Homo sapiens
QLVSACCPDSTRYTNRAGRMDKDRDVTVINTKISYLQFSTSFKRLS

SEQ ID NO: 978364 - protein, 88 aa, Homo sapiens
MSAVRCRGWLRATQGRDGHGGLVCGAGLSGCSTLTATGASITPSATIAGSWTKIKADLCEKSAIYQLEEEYENLLKASFERMDHLRTY

SEQ ID NO: 978365 - protein, 94 aa, Homo sapiens
MSTPCRGGHIARADTCATLEKCATCSQFQLERILRAMGKAYQPGCFTCVVCHRGLNGIPFTVDATSQIHCIEDFHRRFAPRCSEYGGAIMPEPG

SEQ ID NO: 978366 - protein, 142 aa, Homo sapiens
ALDDPSLGSQVESTDMDISSRGLLLGLTLCTDKTENEVAPVDARPAADRGVPTRTGSGLTNIKTEEISEVKMDAEFRHDSGIGSSSSTHLEYYAEACGFTPHGAIIGLMVGGVVITTVHRNHLGDAEQETVNIQYIMVWWRL

SEQ ID NO: 978367 - protein, 41 aa, Homo sapiens
TLAGSRVASNRITGSEIGQLIMLGFVGLVVRSAHHAWLCWL

SEQ ID NO: 978368 - protein, 97 aa, Homo sapiens
NKGSPAQRKGGTSGATSIMIPGGFMPPQASGLRSPQVGGSERDGMRMHRGECDWRYFGRRLTGSSVLASLFGGGLEESVPGGESAPRLTEHSCNTRV

SEQ ID NO: 978369 - protein, 101 aa, Homo sapiens
AFAGRWTKEVTISLAGSGRGAMATCTSPSVDFIVPWNTLSSHPEEEPEPQVPHGLRVQDHALPHDPAATSPPRTSASGWTGSQRRTSTGTRPSSSPALRTY

SEQ ID NO: 978370 - protein, 128 aa, Homo sapiens
LTPCALQSLSTTQVQHRSSGIALSVLLDIIVQVTCRTLLCEFRPNFQHVHFTAGDHDSDQDLISRPLALHGVIQPISKIQGLVLNALNQVQESIFQVSFNLFPDAFQHVIRAVTLVPIKYFLEVGHAP

SEQ ID NO: 978371 - protein, 84 aa, Homo sapiens
GHNEAWTVMIGPVICAVCQLLVINLTPRSVWPLSLIALIKRLEPGCSGRCRSASALARLQNLLLERGPRKKSMITDSLMGREKR

SEQ ID NO: 978372 - protein, 45 aa, Homo sapiens
MKGGSKEYWFVLTAENLSWYKDDEEKEKKYMLSVDNLKRRRYVKD

SEQ ID NO: 978373 - protein, 59 aa, Homo sapiens
ELEAIIEEADGDGGWVDTYHTTGITGITEAVKEITLENKDNIRLQDCSALCEEVGMLKD

SEQ ID NO: 978374 - protein, 84 aa, Homo sapiens
MGVSKYGMSLQENSSLTRVDHTEVVRDLTNAPDGKLDPGVSFKRQNSQSWDLKDDGNMMKVLRGHQNWVYSCAFSPDSSMLCTV

SEQ ID NO: 978375 - protein, 72 aa, Homo sapiens
EHIRNILLKHIRSQAYHHQRESIYWKPRNLLHHQNASPWSEPADVKLELTAYALLAQLTKPSLTSKGDSEGH

SEQ ID NO: 978376 - protein, 100 aa, Homo sapiens
CLQDPFDWRALMHAYVLTSFECKRLKSTNLTKMLMLDKRILCSPASKLPANRMDVAGNLCVLIYAVYCPLSDIEELKSDQDVDVGEENSLLPTSKLPANR

SEQ ID NO: 978377 - protein, 131 aa, Homo sapiens
MITDTLHNPVRRWPTGKNIGRIVQEAEKYKRLFMITRGPRCHPRLHLNAFAFIMPGTVEDEKLQGKINDEDKQKILDKCNEIINWLDKNQTAEKEEFEHQQKELEKVCNPIITKLYQSAGGMPGGMPGGRR

SEQ ID NO: 978378 - protein, 91 aa, Homo sapiens
KAGRKNLNKAAESDVSTAIELYRQAGLTAIIISGSERMTLLATPKFCIQRWKPSNRCPYKELASDHIIKDQLASKYLYHGQTLETLGGKKL

SEQ ID NO: 978379 - protein, 153 aa, Homo sapiens
IDNTQLVSAVDKSTEKENKITIQNDKGRLSKDDIERLVQEAEKYKAEDEQQQRDKVSSKNSLESSSFNMKATVEAGETSQASHSRMRHKQKILDKCNEIINWLDKNQTAEKEELEHQQKELEKVCNPIITKLYQSAGGMPGGMPGDKEVGYRA

SEQ ID NO: 978380 - protein, 89 aa, Homo sapiens
CWHRLTYSTSSRDWIAWSENGWSGLSLSAGGDAGVLSPVDDSGVGLDGFLDPLGELAEVRVDTRSVGPGTRVISPGHESLQGSHCNTVS

SEQ ID NO: 978381 - protein, 203 aa, Homo sapiens
MSHKIAAVCLLMSCLIATAYSAAKVPISIYYESLCPDSAKFITEQVYPAVKGELRDVVELTFVPFGKSQFVTQGSEVTFTCHHGPNECYGNKVHACAIEHIQANSYQVEYTRESLTMDFINCLMKAGKNFPDNVYPGQRCASENHINNWENIKTCANSTEGSVLLRKAGESTMRLKEPLTSVPTILFNEQFDKKVNDRAQVNL

SEQ ID NO: 978382 - protein, 86 aa, Homo sapiens
VCVRKRDPVMTPKIQVGAYCNRELYTVLLEEESIRVYPRNQTTCSNTLQTRSNQAPRRCEVGSGPSPQEYFAPSTSTQCVQVTYQT

SEQ ID NO: 978383 - protein, 64 aa, Homo sapiens
MAPEPRGGESLFQRRAGVSRPCTEQFTTALLFRCKKSTIALAELQEVQIGHAQLQRIGELHVIC

SEQ ID NO: 978384 - protein, 154 aa, Homo sapiens
MTRHRYRRSLMTQPNGLTPSWQAERLLMQTLPVLGEGPENTRSQLLIMDRAADPVVPSYCMSSRSRPWRMICWTYEQDTYLAMIQHGLSEAREKAVLLDEDDDLWVELRHMHIADVSKKVTELLRTFCESKRLTTDKANIKDLSQILYPVGWRH

SEQ ID NO: 978385 - protein, 70 aa, Homo sapiens
MCGTADSNRAEATPNGYCQLLELKPPPTAKTTAIGVAASSTQAYATADTTGTAIATGDGGLQQRDVAFRR

SEQ ID NO: 978386 - protein, 65 aa, Homo sapiens
GSVITSIRSVSTDAHVSTELVQAGMHRSGEYTSDQAPSLRYEDVLTVLTWSTELVQEGMHRSGEY

SEQ ID NO: 978387 - protein, 73 aa, Homo sapiens
MVESRAEVSRKSSHCNQQNIRASSVGTSLGLAEVTFVTHEHDDDRGFSMVIELLQPSLHHSIGLVLGYVKHQE

SEQ ID NO: 978388 - protein, 110 aa, Homo sapiens
MEDGVSAFVTLDTANKKVFLGRDTYGVKPLCNAMTGDGFLAVCSEAKGLVTLKHSATPFLKVEPFLPGHYEVLDLKPNGKVASVEMVKYHHCRDEPLHALYDNVEKLFPG

SEQ ID NO: 978389 - protein, 33 aa, Homo sapiens
ALERCSEQRHPLHQKAGGTMGKKQNKKKVEEVL

SEQ ID NO: 978390 - protein, 111 aa, Homo sapiens
RYHTPMSKTHPGNLQMQEWPSEKSSSDYQLRKAGTTLKQTSQRISSSVMILPNGNGNTHNYIHGAKWGDAKETKNPDVTTILQFPHWQSRTTTFMTIKYPLKSPECLREYL

SEQ ID NO: 978391 - protein, 92 aa, Homo sapiens
MKQQSSCNPLTGQCECLPHVLAVIVQLVTLDSTICRVGKAVRECDCHALGSTNGQCDIRTGQCECQPGITGQHCERCEVHFGFGPEGCKPCD

SEQ ID NO: 978392 - protein, 39 aa, Homo sapiens
PRNTQRGVHQREYTSAAEPSPTVMSTSLGSNLSELDRLL

SEQ ID NO: 978393 - protein, 78 aa, Homo sapiens
PAHWDLDCCLDQYNDRICAILDIPRYKSRIQTGPSALFRLLRIQELTDFKALADGETASTPSSNCTSQAGDMETLTFS

SEQ ID NO: 978394 - protein, 172 aa, Homo sapiens
TDTRKRLWRRRDASVVQNIGAPNHNGQVLRVLGISWVTVAGAISPHQPKSRFPDGPGHCQDILVHDRRRSGVIGRRICFLTESAPQLRLGLETFWLYFFQINGGTAAKPQEQHVLEPPVKVTELLHFRHKCPVLLELLGRWYQLPTSPLQLLREVAHLFLLLLVVAQQLLIQ

SEQ ID NO: 978395 - protein, 176 aa, Homo sapiens
MGGDACELLFSEHTSPNHNCQVFEYYGISYGLPVAGAISPHQPKSRFPDGPCHCLGYTCPCQAQERGNEDDVFASSLKVLRNSGSGSRHSDFYFFQINGGTAAKPQEQHVLEPPVKVTELLHFRHKCPVLLELLGLLYQLPPSPLQLLLEVAHLFLLLLVVAQQLLIQSPGHHSIF

SEQ ID NO: 978396 - protein, 166 aa, Homo sapiens
MLGMLRSSSNICATQIITASASSTRNLLGLLVAGAISPHQPKSRFPDGPGHCLGYTCPCQAQERGNEDDVFASSLKVLRNSGSGSRHSDFYFFQINGGTAAKPQEQHVREPPVKVTELLHFRHKCPVLLELLGLLYQLPPSPLQLLLEVAHLFLLLLVVAQQLLIQ

SEQ ID NO: 978397 - protein, 164 aa, Homo sapiens
GDASDARSDRTSVPQIITASSSRTGITMGYLELVPFLLINPNPASQMDLAMVKDILVHDRRRSGVIGRRIGFLTESAPVTPARARDILTFFFQINGGTAAKPQEQHVREPPVKVTELLHSRHKCPVLLELLGLLYQLPPSPLQLLLEVAHLFLLLLVVAQKLLI

SEQ ID NO: 978398 - protein, 122 aa, Homo sapiens
MCVRTKVRASDSVVGRRCHSYSQRDHLGDADEETCTHPFISGVVEVDAAVTPEERHLSKMQQNGYENPTYKFFEQMLNKTPATAASEVGQQKPLLHYPSVSIYRIMWEETNPFYDLLIIALR

SEQ ID NO: 978399 - protein, 108 aa, Homo sapiens
SKRVRGWQHYTMNGDRWVVKQWLAVQLQRLRGGGLVLHLLKELVGRIFVAVLLHLGQVALLWGDSGVNLHHTRMNGCVLFLLQHHQGDDDHCRYDNTAHHESNDGTFV

SEQ ID NO: 978400 - protein, 121 aa, Homo sapiens
SQSAVPPGQADCPAKRLALGSPRKTQENSSSASIKDEKGDEVVVELVENGKKVTVGKDDIQKMNPPKFSKVEDMAELTCLNEASVLHNLRERYFSGLIYTYSGLFCVVVNPYKHLPIYSEK

SEQ ID NO: 978401 - protein, 115 aa, Homo sapiens
TSRSRSLLRACLLKEKKSSSTGVGRPSQAAGDYQGDEVKEQTFSGGTSQDTEASESSKPWPDATYGTGSASRASAVSELSPRERSPALKSPLQSVVVRRRSPRPSPVPKPSPPLS

SEQ ID NO: 978402 - protein, 142 aa, Homo sapiens
GIRLLEAQIATGGNQSEPEERATRLTVEVDYKRGLFDEEMNEILTDPSDDNKGYFDPNTEENLTYLQLMERSITDPQNGPVSLPLKEKKRERKTSSKSSVRKRREVIEDPETGKEMSVYEAYRKGLIDHQTYLELSEQECEW

SEQ ID NO: 978403 - protein, 69 aa, Homo sapiens
GEISGQGLHLIETVSGDDLSLLLVSVTSVPQIITAKFFVYLESPWVTCELVPFLLIDPNPASQMDLAIV

SEQ ID NO: 978404 - protein, 49 aa, Homo sapiens
RRQPMIQLQHLPSKGANFGRHVEHQRHYRRVFISIDDEAHLFQASPAIP

SEQ ID NO: 978405 - protein, 86 aa, Homo sapiens
MSDWQNPLLGYMLAMLEFMILPVGAANVSRGSHAALEQRFTTYLKNVIEEKYGNDATNVGDEGAFAPNILENKEGLELLKTAIGKA

SEQ ID NO: 978406 - protein, 155 aa, Homo sapiens
MLTKVAPPMADCHVSDMEQRSDPKLKIPGLNSPIPESCSFGYHAGGWGTSPVDETGKPLYGDVLGTNAAEFQTKTEEEEMDRSPWGELVSSDEESSGEEEEEEGDEDKPDERGFISPGERGLITPGGFSSVPAGMETPELIELRKKKIEEAMDGS

SEQ ID NO: 978407 - protein, 97 aa, Homo sapiens
WSPSNIISKGKNKDAIMCHIYLHRNKVTIENCCVHHQSMRMASDVNATQSYHTLSHQNSHRITGTSPPITWRLQHLAVFPSSPFPASSYDFSETLVS

SEQ ID NO: 978408 - protein, 72 aa, Homo sapiens
KSEFLGEKYIRRVSDETRLLLVEDLKPRKMNSSLEGNDIELVSNSAALIQQATTVKNKDIRKFLDGIYVSER

SEQ ID NO: 978409 - protein, 81 aa, Homo sapiens
MRNVPSDGRKCAVEYVWAGGPIAHGLPAHHSKGDASPVIIEDNRSKVLGEPENTEDTVQNRSLVALLVFCLLVSTQIIANP

SEQ ID NO: 978410 - protein, 37 aa, Homo sapiens
MAQIRIDSEKVLDVEVELDGLRDTVKALTREQEKLLG

SEQ ID NO: 978411 - protein, 37 aa, Homo sapiens
MTSRDPNCTTYGLPSLHNFFLLFIITELSVSQNSPLL

SEQ ID NO: 978412 - protein, 96 aa, Homo sapiens
NQTRDQDMLYGRKLDKITSIERPPRKTEWNDWKIKGKRRRGRRWGRTEDGRSRQVTGEEEAGDDDEDAASATGKRAADDDADDDVNTKKQKTDEDD

SEQ ID NO: 978413 - protein, 52 aa, Homo sapiens
MEIMTKRSNYTPITNVPPEVTVLTNSTVELREPNVLICFIDKFNPPVVNVTW

SEQ ID NO: 978414 - protein, 107 aa, Homo sapiens
LGSSPGEPVSESAQEQYARVEIGRFVLGLLFLGAGLFIYFRNQKGHSGLQPRGFLSCSADDTFKEELSAPALQDEKLSLLAVILPQERAFSGPGCYWFSNCRKCPPL

SEQ ID NO: 978415 - protein, 92 aa, Homo sapiens
MSAGCQLEDSGVMFSDVHSACNMRDSSSDSPSPLAVVIHQKLISNEVLGPGHAWVLSGLGSSILRSSVASKFWKVVLNLRFPSKEPHEAQEP

SEQ ID NO: 978416 - protein, 34 aa, Homo sapiens
MAVVDVYSPLRCMPPCTSSCRHDEHRCMTSKYLI

SEQ ID NO: 978417 - protein, 76 aa, Homo sapiens
SLGDTRHTDCGCQSQLLHMRTQCTTAPGAGTLEMLLKPERLTPGSLAELALKPRRLLLWLLMVVDVLAMVPGDERA

SEQ ID NO: 978418 - protein, 156 aa, Homo sapiens
TGYVLDTALLIVLHRAVGDGHHLKHVIAVACHIGVDLAIVVLGIQMISRWAATFMPQQRLREATTTWIAPELKSCSTRRRSMGLSPSCREPTPFSSVSLSVLSLSFSRYGIRSFSVQCKNLCRWMSAAQVVRMSMAVRRVCLRDGTKTMTGFLGEC

SEQ ID NO: 978419 - protein, 86 aa, Homo sapiens
DRYTSRNICMHRVSDITWSERSYAETRYHIDNICCDVAVLTADRPGCRRNRYESSALRCHSWVPHACRWPAALITRQSEQEFGRFQ

SEQ ID NO: 978420 - protein, 52 aa, Homo sapiens
LRLGSVSWGKEAHPELPLPPLHKRRGTRWLVVPLLSCKGLGFLRSPVGKLDV

SEQ ID NO: 978421 - protein, 63 aa, Homo sapiens
VVGTVGWVGSPGVVETFEEHVQIHQVRDDIGLAIVQGLQGRQVGPVPLDQIGRLLNRLADLIE

SEQ ID NO: 978422 - protein, 107 aa, Homo sapiens
LGSVTGTVSVIQAGVLQVLGRTWALSYNLSVHSISYERGTCICETALAISKSLPSLIYSRLSGRCLRTLSQLWTTVDHLADSGGSSLLSLYYPGGTALPLRSFRNLC

SEQ ID NO: 978423 - protein, 105 aa, Homo sapiens
LYVEGLRVKSRDKDFILQWSSYEELLFRLLSQAVNHDSRGGGFAPSSDSNLLSQGLDITFLHQNRSEGHATLRNGPVEEVLGQWRQNKNRDTFSSLLTLHKMVTD

SEQ ID NO: 978424 - protein, 123 aa, Homo sapiens
WLSYVITEGHYVTDNVEEGSFLWIASSLDKFLNCKTLRGLEALFTALRASLVLDLRASAWSARSFLRALSAFSLRMCSMRIRLFLNTFPFTFRYRLCYMWRSIFLDSRYLLSSRRKILILLIH

SEQ ID NO: 978425 - protein, 46 aa, Homo sapiens
HARVLEDPLKSDQAPAYRYLGESATVLTCRRNLSKGGMQRSGEYTS

SEQ ID NO: 978426 - protein, 102 aa, Homo sapiens
TCGYQGDERSLVLADILLLMREMYVWILAWIHRGEIVSGENEHITSIYSCPLIHSQLILFVHAVSMSPFDRDVRLISLGSRQNLCVNEDVKSLGTVQLINDR

SEQ ID NO: 978427 - protein, 139 aa, Homo sapiens
DPLNDAICFGLSKKRLLDVIKINHQRVRPYVYKEPKNLTTLVSSLGGKLAFCRSICDSLFQEERCPDEEEGGFRYKGEKPHNDSRCQGSEGDVYRGIHPSCGIQMIQKHEEVGRVLLVATATAQETASGGWDSSHQGPR

SEQ ID NO: 978428 - protein, 160 aa, Homo sapiens
EATELLLHRASRIHKFLIGRGAGNNRKVRDSTGARSSFLRLRQGPGTDHHHWKGGRRPRGTRRAGGLDPKPGRERASAADSAGAVMGWLIFHLFLTLQDNVVEDSMLVDPKHQRHFVIRRGQVLREIAEEYGGVMVSFPRSGTQSDKVTLKGAKDCVEAA

SEQ ID NO: 978429 - protein, 35 aa, Homo sapiens
MIKLGLGIDEDEAAADEPNAAIPDEIPPLEGDEDA

SEQ ID NO: 978430 - protein, 125 aa, Homo sapiens
PAPEESVRGSPGPSKDTKDLSLEETSERNYEAAEERASPMNAEVLKQLAEKREHEKEVLQKALDENNNFSTMAEEKLTHKMEANKENREAQMAAKLERLREKYQHIDEVRKNKESKDPADETEAD

SEQ ID NO: 978431 - protein, 155 aa, Homo sapiens
SCHPVALMKEPLQFRFPGTSTSATLTGLTRGATYNIIVEALKQQRHKVREEVVTVRNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGDSRVTS

SEQ ID NO: 978432 - protein, 177 aa, Homo sapiens
RVVLEVTCVIQLLQAEGAYLVTEYLSLSSLYHESTVLSEVHNDLHSAKKGSASVNSMKHETNVCIADLSDNIANERNVSCPASPRHVSDVTDHRKYITSTQQVNHPVQQCLLQLKLLHHVQLGVLSLKKLNKQLQDLGVQELVAGADLIQQRQVGQAYGQSAAESTLVLIQSNPPTS

SEQ ID NO: 978433 - protein, 199 aa, Homo sapiens
NQYHSSSWCLIGSAASGRMPSEGTVSSSEVWVLIKLMDCLRHSSWKHCTASRGASATPVSESKHLILRHRRPDGLGGLLLSEAAFIHSCHLCQVKGADSRARYAVAGRGKNGQDHGPAPEADHARDSLQHVEVEMGVSGYRAVEPCLQEGRPLLLQHAGGASHVVLAHSGHAGHHHLLQVVKLHRNLPEEEVDMAAPLQ

SEQ ID NO: 978434 - protein, 115 aa, Homo sapiens
MVRCSITSIRRRIVLHDTWSNKTLNLGCLGPRFLTFFSIRAFLQQLADIIFLIEIEKFADAANSFGAHAVRHCSISQSRNILLSFFYNNQVENAQICIHNATMKLMFSFRPKYST

SEQ ID NO: 978435 - protein, 95 aa, Homo sapiens
LYQGMVCTYKAGSRYEDFRQCRKHPSAASHIQSDERRSFIFQDNPWNRSTWSGIKCDRDKENMAYTAECLRGDVDILMEFLLNVTTAPEFRRWEV

SEQ ID NO: 978436 - protein, 105 aa, Homo sapiens
MRQGYFESSHLLNHLFTGHVPQVVHSQFICMDTKRSLKVMDGNILQVFFPKLNAERFHPPCCYYGFLWVFFHSSQWVSSISSGYRAKLTTGSSRTLSPQILLMEI

SEQ ID NO: 978437 - protein, 177 aa, Homo sapiens
YQLGTHSVLHDVIGHSNPLAIWFNSLRELTRQYKQVLVEICYLIELLEHLVAVSRRHPGRTSWSTSLALRGSTICAFTSNLQRRRPLNSSIFPLPLRRAPVTWATSAPRPSLSRRLGPSTDAPVYTHTWRPEKKKSFLESGSSKTESSLRGSAGHLSAIRKGPCGRLPLPSENRQYF

SEQ ID NO: 978438 - protein, 129 aa, Homo sapiens
SHGAVSTLGLHSSKSQQMINFWPLQSPCCVTCAYLTLNSLFSWKHLAHNGTPQPASVRTTGHFCTSVAGKCQSLSNLTPHPTSSVAPGILHLFSLLLTHPVSSNSGGRSAYDIRILRAKGTCRDHWTHH

SEQ ID NO: 978439 - protein, 136 aa, Homo sapiens
DYVAPLILQIRHQYRLLSSGDGAMDLSSLYDDLRLLKSPEVLSHWTRPLQRSAECPLRASPASSTTARVITKQYNNPAGLYSSENISKFKNALESKTAGSGVEANSRPLDHAQPPSSLVIDKESEVYKMLQEKQEL

SEQ ID NO: 978440 - protein, 110 aa, Homo sapiens
ASHYSLFVMSGAGWEDRLWCRRAGWASPAPLPGDCLVEDTAEQGLVAGDTEQVALAVAHVVLGRLAGDQDANVGLIHLAAHEHHEDLDACPLSYLHGLLDGSGRGALRVD

SEQ ID NO: 978441 - protein, 179 aa, Homo sapiens
EVISTGHHNININVVDEHTPMCEGSVPPPLDQYVKFDAVSGDYYPIIYFTDYCNLQKDYYPINESLASLPLRVSFCPLSLWRWQLYAAQSTKSPWNFLGDELYEQSDEEQDSVKVALLETNPYLLALTIIVSIDHSVFEFLAFKNDIQFWNSRQSLEGLSVRSVFFGVFQSFVDLLYIL

SEQ ID NO: 978442 - protein, 154 aa, Homo sapiens
RIVLSRYYVPASETLSTWSFCHRQPSLLVQNRVAHGTCAEYGVHADVPNLGSFVPIIREHMGAVGTPTNCVNPTVVGLASAQRAHLLPSLPVIDVSGAVSTGCGKSVPIRRESHTVDKAAVVANCELELEWGSLKECRAVIIASRGQPVWPALL

SEQ ID NO: 978443 - protein, 165 aa, Homo sapiens
MSPLICARNCEIVSVQILCTQHSETLSRWSFCHRQPSCWSRTVEPMVTCAEHVVHADVPNLGSFVPIIRDQIGAVGTPTNCVNPSVVGLASDQRAHLLPSLPVIDVSVAVSTGCGKSVPIRRESHTVDKAAVVANCELELEWGSLKECRAVINRFPWPAGMAGSA

SEQ ID NO: 978444 - protein, 154 aa, Homo sapiens
TERRHTVAETADAFLLAYVALHSLCLNGFHYISRTAAASEHSSHVVATGADTSASLNIKGTGTQPAQGDVDDNAIGRLGNQMGEYATLYALAKMNGRPAFIPAQMHSTLAPIFRITLPVLHSATTSRIPWQNYHLNDWMEEEYRHIPGEYVRFT

SEQ ID NO: 978445 - protein, 91 aa, Homo sapiens
MEIMCPAVITHEIIEIIATPERKYSVWIGGSILASLSTFQQMWISKQEYDESGPSIVHRKCFQADYDLVALHPFLTKPNLRRKQDEIGNQA

SEQ ID NO: 978446 - protein, 106 aa, Homo sapiens
TSFSTREQLAQFFVAERSSALSDDVEKDIVLYNYTHRVISADLAHVIVCRHESFWASLQQRSPTASEREDMAELCEIHPSNILRVLLEDRPRPKDRSYREGGFNSI

SEQ ID NO: 978447 - protein, 69 aa, Homo sapiens
IDGKLINERRLMTAMALYTKVNGESDKNVSRTPGIVLKTLDPILITIIAMSALRVLLGAVCGVVLYCAC

SEQ ID NO: 978448 - protein, 47 aa, Homo sapiens
MVALPDIIFVSSGIEKWQRSSKTPQEMARGSTISLLGTEEVILVELF

SEQ ID NO: 978449 - protein, 37 aa, Homo sapiens
FICRIIKGEYKYLLAKGGIWCDRVESHCSSKLPLLAT

SEQ ID NO: 978450 - protein, 45 aa, Homo sapiens
MSLLPPRATGIIASSPAPELTSAGTPLTWHNGASDNSSPSNKTDF

SEQ ID NO: 978451 - protein, 66 aa, Homo sapiens
RTVISLVQRNDKSLYKNVNVQNFHSQSWQGWSPFNALIHRHRPELIEYDKLRKDDPVTNLNNVLYW

SEQ ID NO: 978452 - protein, 118 aa, Homo sapiens
MKCIMAGLWTLADRSDGRSHTAENAKLETLQIASKPERRDPGSSRIRNKGAWTEFQEENRGRGETVFEEALVAEEFLKASKTPKPKKCQAGKHSPGQQAGKQTLIWPTPGQTRVKPQN

SEQ ID NO: 978453 - protein, 79 aa, Homo sapiens
AEIVAMNMDQGTYEDYVEGLRAVMTREEMAPSWVLKSGMFLSHWVRMMTEEEVEMLVAGHEDSNGCINYEELVRVVLNG

SEQ ID NO: 978454 - protein, 47 aa, Homo sapiens
SIAEKDLPLSSLLQPQSVDWLLLWSYSLFQVWLNPSPPPDLSPRSKC

SEQ ID NO: 978455 - protein, 82 aa, Homo sapiens
LAYVCVDVWLRRIEKSESSCSAVGGSHAIWILVYWWRLAESLEKPHQRAFSVLYFPVYALSHLTLRFLLWSVVDDLDMSFEC

SEQ ID NO: 978456 - protein, 79 aa, Homo sapiens
WVSCIRGTLLQLVTTSLGASPSPGPNDRLIQKCNTLRGQTNRHTDIITLLMFLAVPRASFHSNHAKFFPALPSLSLTTL

SEQ ID NO: 978457 - protein, 87 aa, Homo sapiens
MPQLHMGNDYRCTLVTLSRDRLVTTAPYSLSAHAITTTIECYSKYYQTSFRVSVLIDVYNDRSFTVFFRFKIGSRLFLEWARTTNIG

SEQ ID NO: 978458 - protein, 140 aa, Homo sapiens
HHFDVAIGLQTAEHDRFHLTSRDCNIASLVNAIKAEVLHLLFSLGNDQSSPCSFMLWPPVFCCFCFSAIPLSYLHLLSSDAHHTHQSRPRATYHVLCSLCEKAWCIKLPLLEKRLIQAPVLHPAVVNVLSGGQEGEIVEL

SEQ ID NO: 978459 - protein, 127 aa, Homo sapiens
IPIHYIRMFWIREILDNVHRAMEEQTDGDKNRCIMLEQKWQQDVVREEPESSKNCLDWESEAELGSIDDDGPRHGRDAAPPQCEDTLFPGDSHQGVKHIFVATALVSWKPAIGSHADESHFGWCSHN

SEQ ID NO: 978460 - protein, 105 aa, Homo sapiens
MALTYHITTGVSKRTGVRHPPGSEEITLRNSCSMDSYEIEQGVSSPGQSVTLRSRNTDLISDTSSDFRKLMVPWQQGKKAEDGSVINYELIDQDARDLYNARVKR

SEQ ID NO: 978461 - protein, 121 aa, Homo sapiens
GKRPALNSRPWGNWTLRENTLHTRSGQAAARDIVQIVPYRRFQNAPREALAQTVLAEVPTQLVSYFRAQGWAPLKPLPPSAKDACTGPPGLGSLGGCGKSSILCPRGPSGPQPNPSHSPQC

SEQ ID NO: 978462 - protein, 88 aa, Homo sapiens
MRKHSLCLFLGENQRPNNRSSWPPYFMRANLKKLLNKTNKKAVGPEGPVLPTSQGVSCRRLLRNWFCSPSPLAHLKSYHCRSAPPHEP

SEQ ID NO: 978463 - protein, 51 aa, Homo sapiens
MKTPSAPWHKKEMPQTLHVQKLVGSGSGEGQSGSDRTSGEPKGLGEQTQLL

SEQ ID NO: 978464 - protein, 133 aa, Homo sapiens
EEKPPGIVHYSGRHETQVLHVSCPLGGGGNFGTLTNLQERIWHVLVTTLCYPCLLGIPNGLDNCPKVPNPLQTDRDEDGVGDACDSCPEMSNPTQVQGDGKDRGGMRVLMDEAPALWMESGQITLFRVIKRRW

SEQ ID NO: 978465 - protein, 122 aa, Homo sapiens
MTISPELEQAGINVGDHCGQQLPETQTPFFLWSGPLSCKRGTGSMRELVEVGPRAIPDIKRPQWVFTCFSQSGGAAMKTPSAPWHKKEMPQTLHVQKLVGSGSGERQSGSDRTSGEPKVLGE

SEQ ID NO: 978466 - protein, 133 aa, Homo sapiens
EIPLELELNGMIYFQKLRHAAEEVWLQGPRIESEEMQPSLDLVLRSTHLASDDLYKLSMKMPKALKPKKKKNISHDTFGTTYGRIHMQKQDLSKLQTRKMKVPNKRPAERITEDHEKKSKRIKKKLMELSQPL

SEQ ID NO: 978467 - protein, 60 aa, Homo sapiens
ISGGKTRMLTCRRTLYRQACTAAGEYTSTRLHLYDIMDVNTVLTISTELVQGGMHRSGEY

SEQ ID NO: 978468 - protein, 89 aa, Homo sapiens
TKAVLACRRLRDVRQGARSSSAAVDARSHPCGPSLLSRAALRDNHTDSDIQEKLFVVPADEAQARIPYARVNHNKYMVTERATYIGTSN

SEQ ID NO: 978469 - protein, 59 aa, Homo sapiens
LIGQINFSGLQIAYQVCRPVLDMFNAVTQPFFQLHIIQTACADQRVQHRRMFATTAGTR

SEQ ID NO: 978470 - protein, 36 aa, Homo sapiens
PRCPTDVIQYRVNSEWFSSTMAKASSARAARRIMST

SEQ ID NO: 978471 - protein, 127 aa, Homo sapiens
DQANDTVPLLFMRNVCDSHDEVVCTENLTPMAEALALNSKAGLSVTDEGQIIDSTPATTPQADDISALICKKCTLFYISWELRQTLSVVFAAFITVQGTPEWSLFRMFSRTLTAPCPLASASRVSVD

SEQ ID NO: 978472 - protein, 38 aa, Homo sapiens
NLEDLWRRLEEARSVATKRSRKKMAALECEDPERELKE

SEQ ID NO: 978473 - protein, 101 aa, Homo sapiens
RPNPTCILGQLLFKFFLCQKSFIVIGSFTSDIPSDCVWGLTTVERRAENSGDLRPWRWLLHLRGSRGLDVAPSANRKPWHLPEPWSQGVRAGLALSSCREL

SEQ ID NO: 978474 - protein, 114 aa, Homo sapiens
SKTFCWSEGPIATALLRQTCSDMWGNGQPPQSHMGQACEAVGCGTYNMGLVGPPSIVMKLSPSEQQLCLSDAQPASQKVLCDHRMALLGSGCQEPFLHRVEGQWGWPHQISHIL

SEQ ID NO: 978475 - protein, 49 aa, Homo sapiens
GEDIKGHICSCYARGPTSSSVPWKRQDEQLSLQVKTLYRGFPRLSSILL

SEQ ID NO: 978476 - protein, 113 aa, Homo sapiens
MIHSSWLNLLGLCPPAPGHQETFCIKEPCASPSGCESPHRPSLSSLCSLSCHPTASSSNSVHFSRSPPASTMAPIPSALAVWEPAGSSPQLSSAPADSSFLYPPSLRSSLPGL

SEQ ID NO: 978477 - protein, 61 aa, Homo sapiens
SFRAQGITGARSGDGGSRGPWGQSGMISGKDLSLTSIHIAFGEVEFGETDVVLYENGEVFG

SEQ ID NO: 978478 - protein, 74 aa, Homo sapiens
MAVAGALSSCCYVFDQHRGPFGKMYGFALQLLLMLKFKSQGEGPTCIVECLLLKHMIVFRFEIAQVSGSGGGSE

SEQ ID NO: 978479 - protein, 74 aa, Homo sapiens
EEEEEEEDQDYYLGGLRPEPENVMSTENEEILEAYDEDYDKELYPDIHPPPSLPPSRAVRPAPLVPKELYTSHL

SEQ ID NO: 978480 - protein, 67 aa, Homo sapiens
IELGVLRAGAQRGVSSSMPSPGTQALASAKVLKPWDGMAGQAGKGTSQCYWGFFVGSGGIIWLIDDG

SEQ ID NO: 978481 - protein, 95 aa, Homo sapiens
KHRRNRNHDLGKVGLASLIPLFLPLCWHPPRASFPVKAPLASHKVKQCGAAGNMSSMVYGPFQKGQNLTSIYAAPPLLSHLGEFLSKALLSSESI

SEQ ID NO: 978482 - protein, 46 aa, Homo sapiens
AGSIAVCSAAAEVSLLYNSQFFSQQGNSTAIVYNSRYFFLPIAIFL

SEQ ID NO: 978483 - protein, 35 aa, Homo sapiens
INTPKKMTDYAKKQGRIQEPKQLLQNSYALSNQSS

SEQ ID NO: 978484 - protein, 34 aa, Homo sapiens
NLINLYEPLTVGMRQSGSYSPLTTLIFSQWHVVH

SEQ ID NO: 978485 - protein, 111 aa, Homo sapiens
EAPNISRLSWLSTSVIECKRRYSTHGHKSQKKAFTKYCTTWQDEDGKKQLEKDFRSMKNYCQVIRVIAHTQNAPDTICAKKKAHLSENPGDRRHCGRKAGLGPRKDYKQQG

SEQ ID NO: 978486 - protein, 35 aa, Homo sapiens
CLMLVLELEEALRFLLFFCEGGGELSYSVFQQFLF

SEQ ID NO: 978487 - protein, 37 aa, Homo sapiens
LTKTLPFSSFPALKRQPSKALLDEEQPCFPVPSLCYY

SEQ ID NO: 978488 - protein, 178 aa, Homo sapiens
ECRGALSLPAMQRSSAVVGAGALIQRAPAVRRRKRRRLSLQYTKKPQRVAGGAAPSKPASGKKGKAESSNSSSSDDSSEEEEEKLKGKGSPRPQAPKANGTSAVTAQNGKAAKNSEEEDEEKNQAAVVVSKSGSLKTRKQNEAAKEAETPQAKKIKLQTPITFPQRKKGRTNGHHPHS

SEQ ID NO: 978489 - protein, 153 aa, Homo sapiens
MFFPAEPSSEALGVGEVLHVKTESLAPPLCLLGDDPTSSFETVQINVIPTSDDSSDVQTKIEPVSPCSSVDSEASLLSADSSSQAFIGEEVLEVKTESLSPSGCLLWDVPAPSLGAVQISMGPSLDGSSGKALPTRKPPLKPKPVVLPLSNCI

SEQ ID NO: 978490 - protein, 171 aa, Homo sapiens
GSDELADQTTTIKLYQEQILNYYRANEVQQFRYSRPYRKGDTDPDNGSATLWLDRTPYTTAYTFPGILKWFAVKPISTEEISPLEHAIETMELTNERISNCVQQHAWERSLSVHPLSMLLSGIVDPDVMGGFSNYEKVRLVPESPEGFKDLGVCVPPSVPFATDKFISYSC

SEQ ID NO: 978491 - protein, 176 aa, Homo sapiens
MSIYCDLILIEIHAFSADQILTQYDSINVIDINKVVKYVPGLQTEDGSYAGDIVAEKLTQDSLFVRWQLWLCRGSLMLLNVEKAIEFVLSCMNLDGGFGCRPSSESHAGQIYSSTGFLAITSQLHHVNSDLLGWWLCERQLPSGGLNGRPEKLPDVCYSWWVLASLKILGRLHWLD

SEQ ID NO: 978492 - protein, 35 aa, Homo sapiens
GSATDAHEQAILRLHVNNVLSSLMTQATVKLEHAK

SEQ ID NO: 978493 - protein, 84 aa, Homo sapiens
MESLMLATTKMMASHIVEALDPPAAYIALDTHVKHVEVDFVHLELGLKDSSSQDTAAKQVLNRSEHSQPASSRRSCPGSTGHSQ

SEQ ID NO: 978494 - protein, 103 aa, Homo sapiens
MDFISLLEKDKRLPEYTDMLGGSQVRMTSPELEGMKVGDRAYPGPLSVNSIRWGVLLWTSSPFTRQQIFKLCGSATLSLVTKAGPRGQKVSKVFPSSHCFPVL

SEQ ID NO: 978495 - protein, 183 aa, Homo sapiens
DAEQEEEGSWLTLKTPVWRLERDLSVVSKGHLDHKNLDASILHGGEAEGSGQVWDPELPCTPALSQTSDFQTCTSEPPPASRMGAWIQWEITWEYGWQTAKGQMSVRLQNKSLLTQRRKGLRIKQERLDGGRRADGPKNKGQNENTASAKEDRGCLSPGKEGPFWPRTEAEASGYNQVRCARR

SEQ ID NO: 978496 - protein, 76 aa, Homo sapiens
MEKNALVLDPERSRERSGDLESSIGKWVEKDLRVPQGSQDLLSPDLRVLPCGSPVSRGEDGSRIVKGKSLFPVGIL

SEQ ID NO: 978497 - protein, 78 aa, Homo sapiens
IDLGHEALAISCFAFVTFDDHDSVDKIVIHRLQTLNDNLIHGVMVVKGYKGKAPFLATASVSHDFNHFNFSILFKIIS

SEQ ID NO: 978498 - protein, 63 aa, Homo sapiens
EKCTYPTDNVLLPCLILLSTEGPARIQTFGVCAWLRSQWGEATICGIMTDRLYVRIPPRWHSA

SEQ ID NO: 978499 - protein, 69 aa, Homo sapiens
HINQLVPSDRARWVTSTVLELPVENSDQVSRSCVSVKPARSDPEIWPQYVPPCFRQYATDIGFIKLRLM

SEQ ID NO: 978500 - protein, 76 aa, Homo sapiens
LAGPWELGFCVHAAHEGELGFLCARCLHEGGSWGSCVHAAFSEVGAVVPVCTLPSQSGCWGSCVHIAFTSWEHFVG

SEQ ID NO: 978501 - protein, 72 aa, Homo sapiens
KTPHGIEWLSPKSCLRTCTAVLTFNGINMVPPNTTTPPLKTIIRFLQGPLPPGTHLQALTPVWRVAAPMGPS

SEQ ID NO: 978502 - protein, 128 aa, Homo sapiens
MRIADKLVGEHLQGVCVDGIVVITSRVIVGYTTVSILHPGMLPIFLLNPNPNHGTHDGLAGGHTPSPVTFLGILDPLLTVDLHTVGPQRGDGSVDDLLHHLRVPIGFLQLSSRDPDMSVCRNVLPRLV

SEQ ID NO: 978503 - protein, 33 aa, Homo sapiens
LGNIHGITRPSPRRSNSPDKFKRPTPPPSPRDT

SEQ ID NO: 978504 - protein, 106 aa, Homo sapiens
LLSSASYPFKSFENKALRSVSSPPKISIVIRSYRIKLRGGGAFVDLRKTPAILRETSEGTSYYMVRLVFRPYTQVDDRFARQDRYGPPPEFPLASPCPGIVHHLSG

SEQ ID NO: 978505 - protein, 76 aa, Homo sapiens
VNVEQGRKQAQIMAYRKEKAEHHKSSRQERPDAVLATANANELKHIRILAAALTHHNGDATASLTVAEQYVSAFSK

SEQ ID NO: 978506 - protein, 46 aa, Homo sapiens
GYMDPKDVWLSYLAQQRSMWRKATRGLMERKEERYKRHRQKQKHKD

SEQ ID NO: 978507 - protein, 129 aa, Homo sapiens
MVGRRWRSSLAPRGHLEKSSSQPGDDRLLWALERADYIGAVTGKCADSKRKRRGRGGRLLPSRARRFQRKPSPSSSGILQKENKFPKTVCQLNRDLHGWQKRWTQAKWSTALQNKGRALKSPAPSPPRP

SEQ ID NO: 978508 - protein, 69 aa, Homo sapiens
QVEPWPKSVEWERARAGPESGLPLKLILSLLMPHLSLLTFIPSKHTHTAGYVPYMSFDHEPGGPWLGLP

SEQ ID NO: 978509 - protein, 87 aa, Homo sapiens
TVTKLALAVLVHPIFYHEHRSFYGENVKSEIHSRKTLFFLGYLSSPSPRAAQATAMLLHLTLCSPETLGRYSTEYVLFLSLSGVTCA

SEQ ID NO: 978510 - protein, 39 aa, Homo sapiens
IHVQDVSFKSANEEIGPVSTVNSQHGFNTKTADPREYVL

SEQ ID NO: 978511 - protein, 149 aa, Homo sapiens
WGIDLRKIYTGSRGGAGSGESGVGKINSTLPIHAQVSSCHDSRTTIGVEFSTRTVMLGTAAVKAQIWDTAGLERYRAITSAYYRGAVGALLVFDLTKHQTYAVVERWLKELYDHAEATIVVMLVGNKSDLSQAREVPTEEARMFAENNG

SEQ ID NO: 978512 - protein, 135 aa, Homo sapiens
GAMKRKVEVEELLWMIFRTGDGAVAAVDCLLNGRQAFLAEVPDSEEGESGWTDTESDSDSEPETQCRGRGRRPVAMQKRPFPYDIDEILGVRDLRKVLALLQKSDDPFIQQVALLTLSNNANYSCNQETIRKLGG

SEQ ID NO: 978513 - protein, 41 aa, Homo sapiens
MLRWGFQEFYIQGGDWGSRIGTNMAQLVPSHVKGLHLNMAL

SEQ ID NO: 978514 - protein, 42 aa, Homo sapiens
ELAPDKMNIAAVKLLVKARAEDDDTIKSQEEDQPIIIKRKRG

SEQ ID NO: 978515 - protein, 167 aa, Homo sapiens
DAEWRMSYQEKVWSQRSKTTVEDVRLCRDSKHPGTYAVYNLSPRTYRPSRFHNRVSECGWAARRAPHLHTLYNICRNMHAWLRQDIKNVCVVHCMDGRAASAVAVCSFLCFCRLFSTAEAAVYMFSMKRCPPGIWPSHKRYIEYMCDMVAEEPITPHSKPILVRAVV

SEQ ID NO: 978516 - protein, 135 aa, Homo sapiens
MGRQSSIVASHKISQRQSNGIQNKLNVSPYSLDFTSCTVSLNYMTVLYEDSINNMEISTLKAIHHFCQQVRPFLWKIFSANNANCITYLLLNLLWAAKHQVHYVGFDGHSIGFTNFVGFIFNNSPVPFNIVLECY

SEQ ID NO: 978517 - protein, 55 aa, Homo sapiens
LSRFSTSNIIRGYPEEIARAFHITNDFTEEEEARYAKRTSGVKRSEMLCLTLNTV

SEQ ID NO: 978518 - protein, 117 aa, Homo sapiens
MISEDIFSYARQIKSQDFPQSHEDFIVDANITSLSAMREWSGSEPMSSMEDYSAQHESMIRLSEAMARMHCCDEVQAKHVKEAFRLLNKSIIRVETPDVNLDQEEEIQMEVDEGAGG

SEQ ID NO: 978519 - protein, 66 aa, Homo sapiens
SEIEDMLKVLQKMTKEEEEDSDEDYSSEAEESDYSKESLGSEEESGKDWDELEEEARKADRESTVA

SEQ ID NO: 978520 - protein, 69 aa, Homo sapiens
MRDDPLTSPWWMLTRDSCVKLVIRYCYDYGFEIEIFHNLDFWAINFNPDVGSFSLMRSKLSVIQFSNCI

SEQ ID NO: 978521 - protein, 114 aa, Homo sapiens
LGLDPLLPSSTAFAMIIDTLEEDIAALCPSRTAASRPPGHLRLVVPASQCGSLIGKGGCKIKEIRESTGAQVQVAGDMLPNSTERAITIAGIPQSIIECVKQICVVMEETLSQS

SEQ ID NO: 978522 - protein, 147 aa, Homo sapiens
VTPGYLLVWPIDEELNQLLQEFTIAVGCVTKIHSELVAKSGDPKVSLEAIITPPPGKKGKSPSQKKPVSKKAGGKKGARKSKKKQGEVSKAASAGQHNRGHTFADGFTVLSNKSLFLGQKLNLIHSEISNLAGLEVEGHNQSLSKDE

SEQ ID NO: 978523 - protein, 41 aa, Homo sapiens
MEFPAGATGAFCFPKTNSVPLTSPSVCCVTDFLFLFAVCRL

SEQ ID NO: 978524 - protein, 44 aa, Homo sapiens
MSGRSDGCDSPCSCAWPPVTPSESNPPVKCNDIPIDAGKKIFPT

SEQ ID NO: 978525 - protein, 38 aa, Homo sapiens
AVVHNYSAVVLGTTANSSTFRPSALEMPLPRKRESTDI

SEQ ID NO: 978526 - protein, 102 aa, Homo sapiens
SDKARLLELNHSPGQAVLRRLLSLCAPFARPPSCWNLVNGTVVPLGEMRGYAPFSPDENSLVLFEGDEVYSTIRKQEYNGKIPRFRRIRGESELYTSDTVMQ

SEQ ID NO: 978527 - protein, 111 aa, Homo sapiens
MCAVHEGRSCIAVACVLKIGETPHIRPRASWNNANVLARYASICQQNGIVPIVEPEILPDGDHELKRCQYVTEKVLAAVYKALSDHHIYLEGTLLKPNMVTPGHACTQNVF

SEQ ID NO: 978528 - protein, 130 aa, Homo sapiens
MRDERWQRVVGMRYRITKQPVVYHPRVLLCSARVSRGIIREQVHACAYSLPRVFWEEVNEPVIFSGRVSAGHCALPLPARPVTASVYGRLARLRGCLEDSYPSALSAQVFLDSPAVGCGLETRLFIEAAL

SEQ ID NO: 978529 - protein, 88 aa, Homo sapiens
NGSCRWGKLVQVCADTETMAMSEKVGVKLVLDIDRNEGKHRCGQVQCVSISRQSVCGRVTWEELWMEDLESSTLEVNLEHLVIAGQMG

SEQ ID NO: 978530 - protein, 108 aa, Homo sapiens
MMILHVNVDLMERAAKRTRRLQGSNSDGEKATKVQDIKYNLKEAIETIVAAMSNLVPPVELANPENQFRVDYILSVMNVPDFDFPPEFYEHAKALWEDEGVRACYERS

SEQ ID NO: 978531 - protein, 69 aa, Homo sapiens
LPLLFCHCSSSSTWMGLPAICEHDRVFLTRNRLVVLQLSIAPSPLTIPEVEMGHEDPPGEKLTTTGQQP

SEQ ID NO: 978532 - protein, 66 aa, Homo sapiens
MSFLLRGQSNGTSCKVLLTDLSVTRLSKAKEIGADLVLQISKESPQEIARKVEGQLGCKPEVTIEC

SEQ ID NO: 978533 - protein, 33 aa, Homo sapiens
MVISTDRNTGFVSENPPRKLPRYYKNIGLGFKT

SEQ ID NO: 978534 - protein, 110 aa, Homo sapiens
VCPRPVPTIALSGPSLSPTVFTRVPSWYGHTLILAFHVRAWAIWYPAMAPNPAVSPLSRVFFASWRFVLESGIDPILRGLMATPAKLNRQNQIAVDEIRERLYEQVMRIG

SEQ ID NO: 978535 - protein, 104 aa, Homo sapiens
PPPVKRECRDAQYVGDVTSFEQIALPVLRNADCSSVPVQRACVIDEIGKMELFSQLFIQAVRQTLSTPGTIILGTIPGPKVKPLALVEEIRNRKDVKVFNVTKE

SEQ ID NO: 978536 - protein, 69 aa, Homo sapiens
KSLCRLAKPAPPKPEPKPKKAPAKDRERSVPKGEKGKMLMLCKDGEEPVQKIGDAKDMTSALEMLNVCL

SEQ ID NO: 978537 - protein, 34 aa, Homo sapiens
MWYFINGSYEDTKGTVSAIRGLLGNKMLFKRHTS

SEQ ID NO: 978538 - protein, 103 aa, Homo sapiens
IFEEPEDPSNLLILLREIILTYLCPDCDVHATAGRYIAHPWTTLTVQWSRDLEHRRHDPYETYQVHDYLSEQALFPVRERLQYFDKFECAWNGSDSVIMTVVA

SEQ ID NO: 978539 - protein, 144 aa, Homo sapiens
MQVTMFRYVGPERGTEESKGFFQNLVLLGRDAGAEKIFRSNGVQLLQRLLDMGETDLMLAALRTLVGICSEHQSRTVATLSILGTRRVVSILGVESQAVSLAACHLLQVMFDALKEGCQKGFPRQRRVHHLWILARELEGPHQE

SEQ ID NO: 978540 - protein, 152 aa, Homo sapiens
MTLSGQVVALGGRREPMQHRVATLLAANEDFPSGEGVQGVFEVHEPAVIHGEPALPEAFRLLGPRLLHVAFLQVVPGELWHQICVAGPWECHLQVVEASSSECIEPVHNLLPVLMVDEDVTGAVVLQVGDLQAVGVGDLGRLESGVQVLDLH

SEQ ID NO: 978541 - protein, 182 aa, Homo sapiens
RGSPTVHLLAVYFFIRILESVLGPPCSWYLTLAMDARRHCVQSRRLFISFFNRLLMKSLAIVGDLINASSSMSPVAEVTLAKVSLSLSPMKGERPLTEDVADDPDAPHVCGVADGLIVDHFRSHKFWGAKEDLQRPRILQPPGQTKVDELDPGARLVDTHDVLRLEVQVHDALLVDVLHSLR

SEQ ID NO: 978542 - protein, 136 aa, Homo sapiens
RGCKRIETAETQSCTLDVWLPSALLSGRGDVPCVCGSVGLEMAFCGKDVDFDGYPDEELPCSARNCKKDNFIYVPNSGQEDADRYGIGDACDEDADGHGILNEQDNCVLIHNVDQRNSDKDIFGDACDNCLSVLNN

SEQ ID NO: 978543 - protein, 126 aa, Homo sapiens
LSSSIVSPFGLRRPRQVRKAPRGSDFITPDASLCPACTPVQYNTVYSYSKSCRDGSERDAPLVNKVVTLLSPSGNLHLEANPDTGVLTVSWERSTTPDITGYRITTTPTNGQQGNSLEEVVHADQS

SEQ ID NO: 978544 - protein, 120 aa, Homo sapiens
MDRRESDLAEHSIDIAYKLLRANPAKQSVFPLGEIEMYVLDTEEFLDEPRKAGVSYIEQTSMKILNSPQCPLWAREGEDSEVKKAFGHLRGSGPQLLKKQRAQCIGVSAGTAEGCRPCAG

SEQ ID NO: 978545 - protein, 48 aa, Homo sapiens
MYSVIRCKEAQRLVKAIGIVVLDSSRPTHFFRMVHTLKSLLLNMGAGS

SEQ ID NO: 978546 - protein, 75 aa, Homo sapiens
MPLTGSKSHGNLQVCIRNALVVLPAEDITQQPGFSIASPTGAQQEKMYETYQPFQNSTRNYDESFFEDQVHHRPP

SEQ ID NO: 978547 - protein, 151 aa, Homo sapiens
PDPGTVMEQRAEARVGRWDPGRGRWGQGEGPAERFLTWRSGPFIIHPMVTEQDSPPTPPRGNSAAASGSAHSSPAVPRSGGTQQPSHPHHRDLRPRHFVERPAYKTSAQTDQGPTNAVTGQGSPPKPGLGTRHCSGPGPGTEHSVPKTSFS

SEQ ID NO: 978548 - protein, 107 aa, Homo sapiens
CTMDPSHCAHVRRPCCCFNVRSRIDIALAIYHVIMSVLVRSSSTQIHVTHAEAFCNLSQMGYLRIADVISILLLITMLFIISLSLLIGVVKNREKYLLPFLSLQIMD

SEQ ID NO: 978549 - protein, 124 aa, Homo sapiens
VRPRPQVRDPIKLDGHRLYSTTPGLQICETVNVHTPLGTHVNTLFWQPELTHTLEASFIFLTSVSIRKSHMTKGHADNGFFSMRLFRLEAFALRSHDVKAHRLKWSLGGRNSTSGIPGLSWLSL

SEQ ID NO: 978550 - protein, 46 aa, Homo sapiens
RLYEDPHSLISMRDLLKTLASLGNKSLLNRFVTKLWYPLSPSPEST

SEQ ID NO: 978551 - protein, 52 aa, Homo sapiens
HDLAILLARPLRSALRLIFGSDVVLSVGSPVSQRTIILEMTPDVKNMNTWLL

SEQ ID NO: 978552 - protein, 118 aa, Homo sapiens
TIYALVYMSECWKRVWMPFVTWESPLPCGLCSLICSTTCDSLGVYPCREFLPFPDPCCIVTYKSASLFPGVVIWGIKKTQVLLSHPQTNGIKIRSWGIGVKRWGHWSRIDTSENAPRL

SEQ ID NO: 978553 - protein, 70 aa, Homo sapiens
MSTTDHKAIATSSRKCRVDTDSPCTKTCLHYRDWEIFLFWVTNYQGERVRITFQTALTITHQCGERGTEL

SEQ ID NO: 978554 - protein, 101 aa, Homo sapiens
MIIIRTLRKDIAKYNKEDDIEDTMEESGWKLLHGEILQAPPVPHDPQLTARNSGIQSDSRMILIVILVAMLGMLSPSIRVALMTTGCFLFMFMGVFGGFSA

SEQ ID NO: 978555 - protein, 34 aa, Homo sapiens
HTGKQSFGPIKLKSTCRLTQKFSEVLIHYPVWRE

SEQ ID NO: 978556 - protein, 127 aa, Homo sapiens
SETLRCKRGESSPGTVSPIPSMKCHSNSVAYSGDFVKFIEGIEVEAYVRQVCKVPVPIGASWVLGTKVPDAYAESFSGLSRACGDGNVHARRRFPKSPLSELPSPSDIVGGCHWPNVTRDEEWHEIT

SEQ ID NO: 978557 - protein, 65 aa, Homo sapiens
PAPDFWGRVRHRGILAAPGGLCHSSFPRFLENTLVDVCAYAGSGNVLKVQQLLHICSEHFGSKEK

SEQ ID NO: 978558 - protein, 101 aa, Homo sapiens
MSLLLVVLILSTSGWENSVLSTSTSISSRSESERSEEIVDPMLSIRIVPSSEDPAAVPVATLKISVLFQILELVLAFSFSFFKFLDVCFGFCEQTKCCVPG

SEQ ID NO: 978559 - protein, 112 aa, Homo sapiens
HPAPYSRSRISFLKIAIPLTIPVGHLGSSGAGEGHQEHHRGPGPGLLQQWRETLELSLLLPPRLCRLRSGMVRLAWMVALGLSPSFSLAKQWLLRIRCREDFTIRAFWGCTG

SEQ ID NO: 978560 - protein, 121 aa, Homo sapiens
MQRKGKVPVLKAEEEGVSLGVPLRTTRVERTGMDTSPYCQAFGAAGRVARLHAAEQETYWAVCAGPLEALEIVASGKVKRNKGQAGDGGRVYHQDNLQFGSKERGTRRAGERCWIRRQSLD

SEQ ID NO: 978561 - protein, 131 aa, Homo sapiens
MPFEGFCAVPGSRKGLLLLAVVASPRWALLQEPQWGWSRLPRARGSLETCKDLMPLTQFSKKLHFARAPSREVLRCATRGHRWPRSLGIVRALGLLSGEPEGSSNPGVLWKLQLVYMQMRLLKSVVTSLFS

SEQ ID NO: 978562 - protein, 55 aa, Homo sapiens
EDPRGALDSSGINFPGFGGDQLEIQLTEQLRSLISCCDVIKFTEGEPKDLNVLYR

SEQ ID NO: 978563 - protein, 156 aa, Homo sapiens
PVFRVKVEKWQEQYRKNEDTRKAMARDRDQRQRLIRSAVGEAQKGSLSGELHADDEGSFQLLIGDEHHHVPGTQSEKGGHEPFVEGSGPPPSGTHGIVRTVASATVLAQVRVHVSRLDHVYRGGDDSGAEACPKGRSEVTREVICHEVGFQEGILD

SEQ ID NO: 978564 - protein, 100 aa, Homo sapiens
CWTLLIKQYCRESGCATLLEATERRRYGTSTYKIGSAEAESVEETPENLQDFAEKPAFTAERMYDVTPPGVVMQLACTAIACSTLFVETSLRRPQDKDAK

SEQ ID NO: 978565 - protein, 42 aa, Homo sapiens
THYWLTHYWLYWPHYWPFLGFVISPFGGYSLEEQNQEKASSG

SEQ ID NO: 978566 - protein, 81 aa, Homo sapiens
RFTITCGPTDCCLSLMYFSQQALRRQSSMKAISGFRKTRLESSNSMTGRMCTPITSSFYAYSHALSSESNENLSRCIWKQP

SEQ ID NO: 978567 - protein, 180 aa, Homo sapiens
TGSWNPPAAVLMVLLSSLCLLLPDEDALPFLTLASRDPAKMGKLSASKRGLDRYVVTVLIYSCPSIYPTVLPSATCWPHMLHTLLGSTLVPGPLGCPRSWQTGSSVPSVPNDLQVTTPSLASPASPRWALRIPIAFGTLVQLVRSFSRRTGAGSKGLQSSYSEEYLRNLLCRKKLGSSRR

SEQ ID NO: 978568 - protein, 65 aa, Homo sapiens
KAVSWEKLFFNINAHEAAAMRAVYQAAALSPAFKVKPFVVRDALVYPILVEFTREVEEEPGIHSL

SEQ ID NO: 978569 - protein, 56 aa, Homo sapiens
VYSPLRFMPSLDKFRDTVSTVVDLPRYRFSWSLVDVYFTTGGMPPLYKSVEREPVL

SEQ ID NO: 978570 - protein, 80 aa, Homo sapiens
MGVKYEHYKNIHTLLHLALNWITEIDNSTAYRRMSKYPRHHSFNLMTPSYKLSGRSYAIISSISDIGDFKRGTVIERLTH

SEQ ID NO: 978571 - protein, 59 aa, Homo sapiens
LNADTAYRSMLQDREDQSILCTGESGAGKTENTKKGQLSDDEKFLFVDKNFINSPVAQA

SEQ ID NO: 978572 - protein, 41 aa, Homo sapiens
MTEACMHALQDDVQRLRCRPTCGAPSTREHRAALQISLSWS

SEQ ID NO: 978573 - protein, 68 aa, Homo sapiens
EYHYLLAINLNNRDISLTSILQVLHARKKHESETDIHFSGNNSEKPVVIEKDIHIQDNRDEHEHNLHL

SEQ ID NO: 978574 - protein, 72 aa, Homo sapiens
MTIYVCGHMDNLCTSSTIFAAAHLIGWYDPKVTRVFHAGLGVVLGEDKKKFQTRSGDTVRLMALLGAGLKRS

SEQ ID NO: 978575 - protein, 41 aa, Homo sapiens
DRDGHNGGEDEVTEVVLSNKIPKMLRDLTCAYYGSMGFFPW

SEQ ID NO: 978576 - protein, 75 aa, Homo sapiens
MIKTIALGRYELDTWYHSPYPEEYARLGRLYMCEFCLKYMKSQTILRRHMAKCVWKHPPGDEIYRKGSISVFEVD

SEQ ID NO: 978577 - protein, 94 aa, Homo sapiens
MSSSITYQACRHMDSHQTLIFFSAHSCLLISRAPALALDFRSVGGVSQDGSCGHFQAVPLSLWLVPTVPHCVSVLLLWLPSRPSLHSVCSFLPK

SEQ ID NO: 978578 - protein, 144 aa, Homo sapiens
IADFLSIKRRLADSEIVLKAVIVDLKPTINGHLGCSFCTPMKEPRHALLEKAYSKLLGCYEALGGLTITELLCLHDTLAETVDMQKGRYTELVEEKYKLFGELYKTFTKGGLICCSIESPNQEEQEVETDWGLLKGHTYTMTDI

SEQ ID NO: 978579 - protein, 160 aa, Homo sapiens
RCLAFIDLGASFLPVRSSSKPATWPGCRGDQREEAWALHDLAWGSSNIHSASTHGFCHWFSSPSTLKRQKQAIRFQKTRRQMEAPGAPPRTLTCEAMAQIRYLHEEFPESWSVPRLAEGFDVSTDVIRRVLKSKFLPTLEQKLKQDQKVLKKALAHSLQH

SEQ ID NO: 978580 - protein, 121 aa, Homo sapiens
MAIPEATPGGLWVPKAGAKDWVQCRCPVSWLKRTGCRSSGGGRQRVSGELQVTPVLQPVAAEPFPEAAHELQLRVLLHEPSSRRGVQSSGLRVRITGFRDACPPHTDSALNLMKQGLHNTP

SEQ ID NO: 978581 - protein, 125 aa, Homo sapiens
SAFSLGEYSKRCLSPRELRSGSQQVLVPLYLPEHQDNPYRCAASLAFAQGSSIPTVSSPGVAEVFASWRHGVQQVCGRPDIRERIISASLFLRFLCPAIMSPSLFNLLQEYPDDRTARTLTLIAK

SEQ ID NO: 978582 - protein, 38 aa, Homo sapiens
LGFLLHDAVRGDGERGQVEGNTTDEEGTENGHLGGGPL

SEQ ID NO: 978583 - protein, 140 aa, Homo sapiens
YGLCQVLPGKMMSVILRLIRTVVLSLAEMEIFSSMDTLAVGSGEKESAKPIMSEVFFVILSKLLTQSDDLSVHTTGPHRPPPLTPLGTPQAVPSTLPQSSCVKCCFYVPELTLYICPISGDGGHADASLGAGVLIMRDKL

SEQ ID NO: 978584 - protein, 89 aa, Homo sapiens
MLHASDYKYRLELLQLKVNLAHVTLGADQVFHFGYEHHSRPLEPLYGFQGLYKLPSQGQVLGFLLPGFCLSSDPLIRVLGRDVFLLDYN

SEQ ID NO: 978585 - protein, 113 aa, Homo sapiens
YAINEETRYHHDQVVLVQLMNVLAHDILGADQVFHFVYEHFGGPLEFLFGFQGLFKGPSQGQGLGFLLPGFCLSSVPLIRVFGRDVFLLGYQLIKFPLLLFQVGHELPEEEND

SEQ ID NO: 978586 - protein, 142 aa, Homo sapiens
HREALSNCYSQAGFLDLIAGSMVSTGLWTLRRVSTSVISTTQVQQRFLVVALSVLLDIIVQGLAVLSLEFRPNFQHVHFTAGDHDSDQDLISRPLALHGVIQPISKIQGLVLNALNQVQESIFQVSFNLFPDAVQHVIRAVT

SEQ ID NO: 978587 - protein, 89 aa, Homo sapiens
TRIFFFFRDLHGGCQNLVPFELLVELPQCLSVLGICIFQIIRRLLFGLLFIWVYYFHVILHMIEVRDIELVQIGGVLEGDDVLPEEEND

SEQ ID NO: 978588 - protein, 48 aa, Homo sapiens
RTLTEQATEIVFARLLVSPQSFLLRPELHNHRTLQVRHEDRAFVLDLF

SEQ ID NO: 978589 - protein, 106 aa, Homo sapiens
MVPDLTCQRSRPSTPTVIIGIDTGIGRILGVVNIYWVDPSALVIWVVDLPGLPLTLVLRVLNHWGFPLSVHLFIPVLGLLSIRVRDMLGLVPVLRLGVCGIIDLGP

SEQ ID NO: 978590 - protein, 77 aa, Homo sapiens
KGNMNPCKYLAQLVSSSITQLAPATLFFLLCTPHMLNSHLLPHPSSPCCPGNIPYRTCSLALHASPIALSLTRFRTH

SEQ ID NO: 978591 - protein, 51 aa, Homo sapiens
MSMYLGVNPSVLVIWVVDLPGLPLTLVLRVLNHWGFPLSVHLFIPVLGLLS

SEQ ID NO: 978592 - protein, 187 aa, Homo sapiens
AIFMQSVYQAGWIVIFHTESIPTRDDVRSYGVTREYDDLMDPSHMTESASETLHPEKENASLSTICTIDVSMIMVKCWLIDADSRPKFRAVASSNSPKWPRDPSATPCHSGGCKECICHVLTDSNFYRALMDEEDMDDVVDADEYLIPQQGFFSSPSTSRTPLLGSLSANSKHSTVACIARNGLQRC

SEQ ID NO: 978593 - protein, 125 aa, Homo sapiens
MQVSSAVMGIVTRELMLVDTCQGGKGSAVKIFNRHKESQQSRKWQLLVCDKKLIDKYQKFEKDQIIDSLKRGVQQLTRLRHPSTSYCPASFRRIQVNFYKNLHSRLPEQIVKNNLIFEICFKYCQ

SEQ ID NO: 978594 - protein, 90 aa, Homo sapiens
MKCRDISPWGNSPRRRSLGWKRKRECLDESDDEPEKELAPEPEETWVAETLCGLKMKAKRRRVSLVLPEYYEAFNRLLGRRTPRGHFASR

SEQ ID NO: 978595 - protein, 64 aa, Homo sapiens
LACLTTTYVVVKHAHVDHDYVVVKHADDEYTEQGRVLPSPTQGREAERVLTGSYVVVKHAGTDA

SEQ ID NO: 978596 - protein, 33 aa, Homo sapiens
CFTNHIEVQRKEVQARAVFYPLLGLGGAVNMCY

SEQ ID NO: 978597 - protein, 157 aa, Homo sapiens
MGMKALGHDAKALDFMSETFHAIRKMTCEPGPVEDTLCSWTVVYVTRDGLIACLLPHAQPSEENFRQPSVRVAQDAQGPHGRQLPAVQPTLRRRPEHHDSSMHKALGILAGPNLHTPVLEKICSICKAMDTWLNADPHNVVVLHNKGNRGMKALDMK

SEQ ID NO: 978598 - protein, 78 aa, Homo sapiens
FSDDDCSLGLSSIVYLKRYTLDTARVNPSSLLDYNKTIQYHLLFKLPTGKFQSKDVLLSYKNLNWVLTHLLHVLQIIK

SEQ ID NO: 978599 - protein, 141 aa, Homo sapiens
VAVFEFPLLLVQSVIYSHNWTRTKRSSLAICGSRSNSNSLLKACGPTVVYVVSVYAQNPMRRESRPLVQTVVTTIPAPTDLNVHSGHDPRSLSAQWTPPNVQLTGYRVRVSPKEKTVPMKEINASPDSSSVVVSGLMVATK

SEQ ID NO: 978600 - protein, 76 aa, Homo sapiens
LRALLLRSSYDPTVDAQDACELTNDEDREAKGLKDYLEPLFRSSCYGSVLKNATSIHEDAGLILGLAQWVKDLALP

SEQ ID NO: 978601 - protein, 143 aa, Homo sapiens
MCTVESLAGAPYTRNSCAYQQPDLRAEVSIQRRVNSGCMQNPSLWRKPSPSPRELQNHTEPQRDVWTLFQVDHATNRTQFGEKIHNFGLIQEKLARMVMLQYVTESMAYVVSANMDQGATDFQIEAAISKIFGSEAAWKVTDE

SEQ ID NO: 978602 - protein, 105 aa, Homo sapiens
MLIRPAVRRSFPVTTTLNHSELKDGIHPRKLYCKPKRTLEETNSSSGHSSQYKTADTYQKDELPQDHDRSQQQTAYYAYLKTDFRTLHSQQNDHEPGTHFRKMCL

SEQ ID NO: 978603 - protein, 85 aa, Homo sapiens
MGPCEGEPSPLLLSSKKMVDPHGVGNLSLSDTVACCKRIFVRSSFEKWLVLKASCYISSPFDLKNERVRLDMVFGRHVKSKEVDL

SEQ ID NO: 978604 - protein, 70 aa, Homo sapiens
WRMPDGVGQMDLEPEVEEAATPYGTWSGVGGGYSPSSGRAIGGGLSSVGGGSSTIKYTTTSSSSRKSYQH

SEQ ID NO: 978605 - protein, 80 aa, Homo sapiens
MTVHGSYNSYILLKSGTSVNIHKINNCKIFNLLGDAVQDLVHLHARRIPVVADADDDHAVLLREDGLVHLPAVVQVRGLV

SEQ ID NO: 978606 - protein, 121 aa, Homo sapiens
MTPLFAFQIFSKDLFRLQVQGDLHGANPGSVISLYHKSKIAEELKDPGTPNQFLRDFLKGEVQFGSWFEHIKGWLRMKGKDNFLFITYEELQQDLQGSEERICRFLGRPLGKEALGSVVAH

SEQ ID NO: 978607 - protein, 113 aa, Homo sapiens
GLRDIRSSLSPHYPPDANEMTQTFPGATSPYNSENCISRSSISLTHSTAASLIVLIITISELSSSDSVWLPLRSSSLSSSSPFISAAESPSASISSVSKLGGWTGIWTRGDLY

SEQ ID NO: 978608 - protein, 87 aa, Homo sapiens
MHFLDTDWWMYTQTWIILRISYLGGFQLLGISLEEHGGHRLQGFCRPLVKPVNGTAVDQGGKLPQTSSEDLSDGAHAQHHVNIAAHT

SEQ ID NO: 978609 - protein, 125 aa, Homo sapiens
GADDTDRGVSLTIGDRSGRDKYLHKHDLDHICTSTPGGRKTATSSLPSGSIDDIYNYSYPNTSGAFDNTGAMKSVDETLMCSFQILKPDDKNKGKYGQFSDLNPGGRPITPPRMFAEDTLESLLL

SEQ ID NO: 978610 - protein, 62 aa, Homo sapiens
ELESGVHKGPWPKFYSVEMKVCLEFMVLRTSPVMSKSPGACFNALSSVTRLLPPELPFAILC

SEQ ID NO: 978611 - protein, 34 aa, Homo sapiens
RLDCMALYSLKEVQRELFLLSITSQGHKVGFAHS

SEQ ID NO: 978612 - protein, 62 aa, Homo sapiens
MDGTPILCLFTARLQLRVCTLTLDSGKLPPCLCAMFFIHPDYSASLLPDWANLYASSKSCVI

SEQ ID NO: 978613 - protein, 71 aa, Homo sapiens
MLRTGLSSSSTRCRGSDSLRMVGSIYDSLIDVFLDAQNQSYQYLEKLELLNSYSRTFRPFSKISSALAPRT

SEQ ID NO: 978614 - protein, 76 aa, Homo sapiens
SISSRIPVSDVGICQCFPPSSSHPPGRNTALAVSQDGDHGQLRVLVIPALAIEIVCCSLASWIATRSSSRISSLLL

SEQ ID NO: 978615 - protein, 107 aa, Homo sapiens
MKVDRGLTVYKLEKIDSSMITFQMALQPLYPPAIRPLLPVGQEELPLPSGDPGRDLPIRSTHQQGPRSCPWEERHCRFRYSLDGHNWARRVFEPLGRPLDSVLQQLQ

SEQ ID NO: 978616 - protein, 107 aa, Homo sapiens
ERAGGTDALSDLMIWRCVDTKLKEDPLDVLDNWMISSISSILLIATILIRLLSIGTAQACFWIMIHLKGTSEPAFVFPAFVFRNTKAGRGILGQWCSHVLNVLVPSH

SEQ ID NO: 978617 - protein, 118 aa, Homo sapiens
QVDLAIRLYTGILSRIQQSQGFQLRHFLDLEKIHCLPDPYSEYRICPLDPISASFALTYQDDLYLMECLQEVMLYIQPDHTLVIVIHIIDAHFHHGLCYKKPIIGSYIEKVNILFFSV

SEQ ID NO: 978618 - protein, 70 aa, Homo sapiens
ELVPVLLLLLIEEGVMLQRLRAETVVISMSGALSMAMDDDIGEILDLLGFLTGCQVKARVITTPPRFQFG

SEQ ID NO: 978619 - protein, 145 aa, Homo sapiens
VDSIRIPESDLSRVMGIPPAVPRRFGIAFLVIPRTCFLIICNLRLAFFFSEPILVQVLSLLRPSCAVSDIYNPCGAIRMPPGPSLLIMASVPKTNKIEPRSYSIIPSCGIQAARACFEHSNFFKVNASGPAGHSAKSIEGAPRSD

SEQ ID NO: 978620 - protein, 123 aa, Homo sapiens
ALGVLSDGTQPVDHVDDEALISSAKMGYPMLSDLSMTNTTCRAATALLTVAAPAALPHVGHDVTLRETGAPGRPDSPSGPETPLGPRGPGLTRVTRIRRLSFLSFPPRISFQAKVASVSLGAA

SEQ ID NO: 978621 - protein, 52 aa, Homo sapiens
LIGTSHSRLPGPWLAPAEAPDFLFLERSRNFCHQPFSFVDEDLLHVVDDLLA

SEQ ID NO: 978622 - protein, 94 aa, Homo sapiens
ATPDLTVSGVLGLSLYTTERDLREGFSKYGPIADVSIVYDQQSRRSRGFAFVYFATVDDAKEAKERANGMELDGRRIRVDFSDNKKTTYANKRL

SEQ ID NO: 978623 - protein, 97 aa, Homo sapiens
AQRRVIVVLVYYTAVELTFKLTVDVILGGTAGSASVRKLLMSLASSMPSAQAQVNLGEWGYDLRGKGGTDTGSRHCSGWSSHTSSLLLGLSEVVERR

SEQ ID NO: 978624 - protein, 69 aa, Homo sapiens
RGRMHEDDSRFVAGLHHHFVSSRTGGRRNVRHNNPFRSGYVNLGRGEGIRADRNFSQFLNPFLLLWLSE

SEQ ID NO: 978625 - protein, 95 aa, Homo sapiens
VMKAWVMVHIALGYDESCGVGRFYLNVGWGRITNGNVSCSLCQKPKAGTISNVFVGWIQTDSEVFMAAPVHSSHRFTSSPSHLPSLCDIWLLVPL

SEQ ID NO: 978626 - protein, 60 aa, Homo sapiens
MECQHGCSRVEGTCPVMCMHRIGEYTSTKAPSFRAWAVSTVLTCLTELVQGGMHRSGEYT

SEQ ID NO: 978627 - protein, 120 aa, Homo sapiens
MLSTVCCVLLMYCVVVGYFCTSNVLVLVFLPCCKTVESCLFTGLGSIEVCVSSVRFLLRTICIFNNSTSSRPSRRNERGLVSSPGASLRSFLWGGPSELALECVHLAAHGLVALRGLILP

SEQ ID NO: 978628 - protein, 123 aa, Homo sapiens
STCGGRATYHPRHQEAPMRFTCFSQTGEAAMKTPSAPWHKKEMPQTTPLQKTDGIWLMGRGSAAVIGLQSEPKGLGEQTQLLSTLRHETPGEVGSTGPSGLRCLLVGLVPEFLEGGRHEVRPL

SEQ ID NO: 978629 - protein, 117 aa, Homo sapiens
LAALYSAVVHHVTSSVRSHAVLRGFFLVEARGGRSLVGMDKLCASNARDGDTVLVASGGTAETGLMICIGSTSSFTLISGTGGAKTEERLPPTVTDGGGAAANGGDGWSDGDRSRNG

SEQ ID NO: 978630 - protein, 80 aa, Homo sapiens
MSTQGVANKSTQTMGSTLQLKPLQITPAVRTVPQYKYAAGVRNPQQHLNAQPQVTMQQPAVHVQGQEPLTASMLASAPPQ

SEQ ID NO: 978631 - protein, 85 aa, Homo sapiens
LNTDIAIYGQVSYYIEMNITCYTVMSGAKEPSSTYSLGPLPHITDVFHVIFSYNATKGNHTTESDIPQNQVCAFYLRTATALNSG

SEQ ID NO: 978632 - protein, 112 aa, Homo sapiens
MKTSSHDLMLIRYVRDLAKITDVVEGPGADPARSQYWGPPGYASRWGNIEPEEFLRPRSLQCVSHHLLSNDMCARAYSEKVTEFMSCAGLWTGGKDTCGVSHPYSQHLEGKG

SEQ ID NO: 978633 - protein, 161 aa, Homo sapiens
TSVIPAVQSAAHKMNSVSFLRVSSIKLCHADMRWRLTYCKTPGGAERPLSSMLPQPEAEQVVPSAGSWVGRPRTFTTSVILAGSEQAEQHEVMAGVCIWSKALMLQKAHIVERVWEAVADRDPLACVFRLKQVVPTQPDLAIPGEEGGGCMRREKMGKGMD

SEQ ID NO: 978634 - protein, 100 aa, Homo sapiens
MARSCTASVGDVMAALGQNPTSAEVLKVLNKNNLDEMNVKVLDFEHFLPMLQTVAKNKDQGTYEDYVEGLRVFDKEGNGTVMGAEIRHVLVTLGEKMTEE

SEQ ID NO: 978635 - protein, 35 aa, Homo sapiens
FTVRAFMPYKFTPAHTHAHMEMEKGGSRHEGPRHE

SEQ ID NO: 978636 - protein, 88 aa, Homo sapiens
EYEIRGLRTLLCRLCGEAGIAEVLEMGQTLDRLERLVSVVIPLTALGGGSMMGIGDGGQGKRLVSQAVVVMVQMKEEVVSGCAGEEEG

SEQ ID NO: 978637 - protein, 47 aa, Homo sapiens
MERWSSNVRPGERGLQAHEQQRNNLWGGGQHLKNNNDKKPHPDWSPV

SEQ ID NO: 978638 - protein, 159 aa, Homo sapiens
DLKRTPPVTVIRTLAKLRENVLKPLNTILATADELYPLSVFLGYCQIQRVGSKLFFDKRDNSDFDLLTVSETANETTLKMKVIPINSPRNLAMEGNLINHNFLPTVLENGEGKDTISPNPKPYVEAAMEKNEIASVAYRYRRWKLGDYIDLIVRCEHDD

SEQ ID NO: 978639 - protein, 40 aa, Homo sapiens
PRGFMSMFRGLAQADGTLITCVDSGILRVHDKDKDTSSDP

SEQ ID NO: 978640 - protein, 106 aa, Homo sapiens
DLELTGLDIETEQIIEKDCLITDSDLNIKAEGPNLIIKQPDELLDSNVRLVKEHHGKSGLTKAVKESTITLQQAEYAFLSFVTTADSSRALYHLQEIQLHEDEEVS

SEQ ID NO: 978641 - protein, 183 aa, Homo sapiens
EDPHRWMQWEAELHELILRFCVNVPGQQDLRQASAEMSLLIIPLGAHPVAKYLGSVDSKYSSSFQDSGWRDLFSRSETTSVRAKLAVAGRVMQYVNGAALRHTSFAWPEAMLTGRRMIPDEDSYQKFIPFIGVVKVGLVEDSPSTAGDGDDSPVVSLTVPSTSPPSSSGLSRDATDTPPSSPS

SEQ ID NO: 978642 - protein, 151 aa, Homo sapiens
MWSGTGKADYRRIVPIACCEGRVFNQTHLHHANEGNKLLIGVFIRELDVGMSAWCRARDAECVVAAPLTYCITRPATSSCSDTGGSERLNRSLQPESRKELLYLLSTDPKYLATGLRTEGDDEEAHVAKPVGGLVGQGLDKEPEDGAQVAL

SEQ ID NO: 978643 - protein, 166 aa, Homo sapiens
MLRFFVKSLANKTSDWLGYLSLLIIPFGSHPVAKYLGSVNSKYSSSFLDSGWRDLFSRSEPPVSEQLAVVWKVMQYVNGAATTPSFPWPEAMLTCRHMLPDEDSYQKFIPFIGVVKVGLVEDSPSTAGDGDDSPVVSLTVPSTSPPSSSGLSRDATATPPSSPSMS

SEQ ID NO: 978644 - protein, 176 aa, Homo sapiens
AQVAACGTQSYLSSILRFFVQSLANKTSCLAMRIYAILIIRLVVSRCGQILGVCRQLIQYFLPGFWLETFCSVASEPLLSEQLAVALEGDAVRQSGQPTTHQLPVAEAMLTAGISEPDEDSYQKFIPFIGVVKVGLVEDSPSTAGDGDDSPVVSLTVPSTSPPSSSGLSRDATATP

SEQ ID NO: 978645 - protein, 74 aa, Homo sapiens
MFCSGQALWSSTHGEVLIRNTRDSSCHCKITFCKAKYCSSNVHEVQGAVLSRSGRVLHRLFGKWHEGLYRGPTP

SEQ ID NO: 978646 - protein, 55 aa, Homo sapiens
MLRSWSSAKYELVIRWSLSHAINMVYPLGSSRSCSLNFFETMLSALANRRIESSD

SEQ ID NO: 978647 - protein, 117 aa, Homo sapiens
MKLLYIYNRVIVGASYSSLPLPYTAGFQAHSSSDLYSHRACTPQPERSVRMLLTINGSTSWFAGGTAGLVHKLCHHQLLEVEISGLLNHRDLPCSLLLRHPLRMSLFPVDPCMPIRL

SEQ ID NO: 978648 - protein, 68 aa, Homo sapiens
DPTYCSSSSTNEGLAPHPGYKQGRGGAFAITEATYRSFIDAKRIQGHSGKEFAIMAPPKKNKSARVFP

SEQ ID NO: 978649 - protein, 84 aa, Homo sapiens
PVPCNNLPFNPYQSPMHTTEPTPKWLFHPEKAFPGNGGWCRQRSTHQIVEGIGQLFDHLQLPAGWHQVATFSQIHVYGPQVYKF

SEQ ID NO: 978650 - protein, 86 aa, Homo sapiens
DSRGPLFTPDMVYYTKGKGCHSHSADGPSEYGGGDRKLTGPVLYDLTAVAWIQLKKNMAQCCLQNLHKHQLVYDGSDEKQNGLEDK

SEQ ID NO: 978651 - protein, 74 aa, Homo sapiens
LVLALTFLKSGAATIVDMVPGEPMCGELSNYPPLSRLAVRDMRQTVAVDVIKAVDKKAAGAGKGHQVCPESSEG

SEQ ID NO: 978652 - protein, 57 aa, Homo sapiens
RVYCKNGGFFLRIHPEVEYDGVLLEELTLTSSYNFKQKREELCAIKGVCATRYLAMK

SEQ ID NO: 978653 - protein, 132 aa, Homo sapiens
TTWICSTSGTIWHRNSCPGLHLSSLKPAPPTCVCPQSTAPVYACNNHNRFNPEDSTTYQSTSETVSITYGTGSNDRHPRIRHCPGLKCISETNQIFGLSETEPGSFLYNAPFDGILGLAYPSISSSGAHPVF

SEQ ID NO: 978654 - protein, 108 aa, Homo sapiens
YIHGVKSEELKHTLCLLHHSISAMLNRVIRLPVWHHPAHWELCATPYSAAGSVHAALLQWNASSQRTMLQINKRELEHVKKNFSKGEGISSESFLISWTWLQKLFGLE

SEQ ID NO: 978655 - protein, 160 aa, Homo sapiens
MIAEDAILPMINRMLLLCDHIHRQSLKSTTRGSPGRMTLNLVPIEQLSVHMCIFAFRYPVKARALLLPPRLEADVVFSSRTSSCCAKYNGLSFLLMFPHSVLEPFEGLHAFCSQLQSLISISFPGFGVFIVSFSSLSLAISSCIKRFSCSRSSFSSVSET

SEQ ID NO: 978656 - protein, 58 aa, Homo sapiens
RILIICSKLSTLTACIHGVCARCSTPCTGSTVYIPAAAAASAGLLLCSHALPHRNPFK

SEQ ID NO: 978657 - protein, 108 aa, Homo sapiens
FLTLAGTGDWTPLMVKTMSRLLMAELLTTMSPSEFSLAPMSLLDVGNGAGWSGQQRGACVNNGLAALSAADGLSVHGDAHGDLPVTLTVTGTQFRLPVWREAVYQCGE

SEQ ID NO: 978658 - protein, 107 aa, Homo sapiens
TLAGTVYWTPLMKFMSDRLLMAEQLTTMSPSEFSLAPMSLLDVGNDSGWSGQQRVAGVNNGLAALSAGDGLSVHGDAVHGDLPVTLTVTGTQIRLPVWREAVHQCGE

SEQ ID NO: 978659 - protein, 66 aa, Homo sapiens
TVRSDSLLMLVMGLLGLVDKRGVGVYNVSGWPQRRRVASPVHDDAVHGDLPVTLDGNRHPVQTSSV

SEQ ID NO: 978660 - protein, 79 aa, Homo sapiens
APVLTIFGGQHGAHVSTELCTWEACTGSGEYTVDLAACMRDWEVSYGAHVYERNLSREACTGSGEYTSTMEACMHARVL

SEQ ID NO: 978661 - protein, 38 aa, Homo sapiens
ACTPEAADYDITNVLEGIGLIEKKVQEQHPVEGCGAWL

SEQ ID NO: 978662 - protein, 34 aa, Homo sapiens
MTAPPTSPASKGAEYQHFIQQCTDDVRLFGIRIH

SEQ ID NO: 978663 - protein, 37 aa, Homo sapiens
GPEIASSRSGTNASSMWMHGDWKNIPTWTRYHESISY

SEQ ID NO: 978664 - protein, 147 aa, Homo sapiens
AWAFDPGWSLQNVLQGTHGFLTGHLEVIGVLVCPLQVHGSIQVPIANKDGVHFANVHPDAFHHHGARGIPPPSDPQHNQVVAALRGGLAGAGDDHGVGAHRVQHVHHPQGFLLAVDLPATQYLGLKLFGRVNVCKRDHFFLVDGEEA

SEQ ID NO: 978665 - protein, 59 aa, Homo sapiens
MVSVTVVPNLEPENRSGIPEGLSMSLYITVTRGLALASVGTNKHWLGKTSAEQVILAVC

SEQ ID NO: 978666 - protein, 81 aa, Homo sapiens
YSNSSRMAARAPPFLLVQALSVTQGGQAGHVHNTSQEPGFPRPLTPRAQADQVQQAAGNVQKLCDGLLQPQGGGGRTQLLV

SEQ ID NO: 978667 - protein, 166 aa, Homo sapiens
ALEDPTMLHLALYSAKQWQPSPKGVCMAKGLGSHFTFQAGGVRGLGGTPPTPLPARGHDFTFNPKSCILVGSDNASSQLSIPNGVMTRQGRTQAPSFQLVTVASTACPCPGDNPSPHDGAAKVSSPPGPQQQTEPSTPGRTEAKSEAAAVAGKEQPAQAQGSPEVI

SEQ ID NO: 978668 - protein, 100 aa, Homo sapiens
GGWGARPGPDEGGLARSRRPPPKSTETSVAEPTGEKPGGAGWDGEVLGKKLEDRGSDKAYVVLGQFLVLQKDEDLFRECLKETCGANAKQSRDCFGCLRE

SEQ ID NO: 978669 - protein, 43 aa, Homo sapiens
QGAEVLLDSVMPLSDDEQFSRKQMPHERDDGEYSTAVLQVNKL

SEQ ID NO: 978670 - protein, 117 aa, Homo sapiens
SAVGLVTIETDREACTEASEVELSVNTVTGAATCSRSSGNTSDTCLYLHELRTGVYHTFLNLLKKKLAKIRVNRTCTVAYTSVAQNRNLRNTDNLRRMNCFHKSISNDVAPQELEYL

SEQ ID NO: 978671 - protein, 154 aa, Homo sapiens
PRRRRKEPQYVASVLKCKSLRIHEGEEPEESWNSLGGKKDYQNTPLWKPKMKTIHLGYKGALTKVEDDVIEEIPGEYTQDDLAEDDVIELDSWKQIFIWIGKDANEVEKKRISEICQNVPYETRTLLEETRGHQLSSKKRAMSHPHSQAGPGLG

SEQ ID NO: 978672 - protein, 75 aa, Homo sapiens
KWCWCAGFRSLIAGIVYLDHLHCCPCGREEITPKSSQEYWAYSLRASLAMMLISSVSLRQPRHTAAPTDPADGPV

SEQ ID NO: 978673 - protein, 97 aa, Homo sapiens
ALGNWYVSDLVPRHEAYMVRWLQVLAPYRTTRDAPTASAQSFPSSRVRLEYDLTAELIDNCRCLLGSQLFHFGLPVLHNFFLLFIITELQYLRIVHF

SEQ ID NO: 978674 - protein, 90 aa, Homo sapiens
AKTKYFHTVLSGNEPVLFLKVLCFILREVPLASANSSTMFRLVVLRLTEVQYLMILGWYRCFKRAISLTQSCLALGSIISKICPFFRASV

SEQ ID NO: 978675 - protein, 53 aa, Homo sapiens
GSFQCQCLSGYHLSRDRSHCEDIDECNYPASCIGGDGINTIGPQIFLPQEIGY

SEQ ID NO: 978676 - protein, 88 aa, Homo sapiens
QALQCKRNSKRSRPRLVLLRPPVATLILRVSVMTSTSSFVSLAKKVCCNFTSKTYFMSQQSIRTCTDRGYQALPVFLLLQYLLHSSTL

SEQ ID NO: 978677 - protein, 43 aa, Homo sapiens
EVHGELTDVMVVMQAKCRSIHWFIRKAKHRQNASSESNSFKMP

SEQ ID NO: 978678 - protein, 130 aa, Homo sapiens
MGQPGPWITHDPSRPYAEQYRIDARKYSTPCFSYVSPWTCGANTEILAERTYRLLDDNMDQLIEFKAFVSCLDIMYNGEMNEKIKLLYRLHIPPALTDNDRDSQSPSEESSVVNIETPGLLGNPMVMQLI

SEQ ID NO: 978679 - protein, 88 aa, Homo sapiens
SHLATVIMSIRSNAAEDKEHVIEALRLVPRYKFPGRQKIHISQKWGFTKFNADEFEDMVAEKAVIPNGCGVKYIPRRGPLDKLRDLHS

SEQ ID NO: 978680 - protein, 56 aa, Homo sapiens
DPCDQVSHLAKVIYAIRSKLQNKEHVIEALRLGPGSKFPGRQKIHISKKWGFTKFN

SEQ ID NO: 978681 - protein, 176 aa, Homo sapiens
MSTSGRGLMAGRVTSVGAVLQALPSAGGLPLCGVMAGCTTVPISKGSRPIDTFTDSPRITKPGSIDSNNQLFAPGGRLSWGKGSSGGSGAKPSDAASEAARPATSTWNRFSALQQAVPTEGTDPRRVVQRSSLSRERGEKAGDRGDRLKRSDREGDRGDRLDRARTPATKRSFSKE

SEQ ID NO: 978682 - protein, 78 aa, Homo sapiens
ALIEMCLEAGTAEDVMTVLTPLTEKDYEGEKRVPRALQAHKMAWPFLEPVDPNDAPDYYGVIKEPMDLATMEERVQRR

SEQ ID NO: 978683 - protein, 115 aa, Homo sapiens
MSASVVSCHFAVLRRVLELELRSVRSCWSAYHAVYTELTGALQFGYCLLVGTFPFNSFLSGFISCVGSFILAVGLRIQINPQNKADFQGISPERAFADFLLASTILHLVVMNFVG

SEQ ID NO: 978684 - protein, 107 aa, Homo sapiens
MCWKRHYEICLTDNCRLLRNAWRKPTYSSIKCLRRLSLFSEWKHSKKALTWFDIKDFGSGGLRRGKCWGCFPVSPLVLGTLHVNMVGLNPQLLAVSLLNQYLRAKWN

SEQ ID NO: 978685 - protein, 73 aa, Homo sapiens
LGLYECGRYLRTPSLRRVAIEDEDEALDKRISICSSDKRIACEEEFSDSEEEGEGGRKELFQPSIKAKESQRQ

SEQ ID NO: 978686 - protein, 85 aa, Homo sapiens
YQAVGRAESMCRQTFIVRESDINAGGFFPNGYAFTTGSDDATCRLFDLRADQELLMYSHDNIICGITSVAFSRSGRLLFVGLQHM

SEQ ID NO: 978687 - protein, 125 aa, Homo sapiens
LIFITVIVKVPHRLLNDNDSNRINLFVNSLDCWCLRLSIALRRLDSFTSKPANSVRIDPGSGPTSSMNTLPNSSKERRQGPSSISWEITIPIKLHCGLEDVRGGPSLSVSAISASKPLFNCAARS

SEQ ID NO: 978688 - protein, 135 aa, Homo sapiens
CYTIQLVPHRFAGTLMDVSWRQEERGCTPRLPCSHVEVQAAAEENPVGLAVLDEEKEGVVGAEAGDESGTPHHHDGSCGGCSLRAFLIDLHKRLVHDLGQRQVCLGHSREVCLAQLEGISHAQVAQDTLHVVAFL

SEQ ID NO: 978689 - protein, 117 aa, Homo sapiens
MKETIIALAWEAPGSKSAVLDERLRGYLCLSTSVKNNGKIELIKMFDKQQANTIFWSPQGQFVDVAGLEEYERCLSVVWTLRTARSMTIAKNYNGYPDVEWGSYLALRFHLCVLVEP

SEQ ID NO: 978690 - protein, 107 aa, Homo sapiens
MLTSSLTPLASGFSSLVCSSSVSSSFSSGSFSFSSSVWTLLAFLQLEEYLRPPSPSSSESENSSSQAIRWSEEQIEMLLVRVVFVLIATLLRYGVLRNRLHLTRGCG

SEQ ID NO: 978691 - protein, 38 aa, Homo sapiens
NSCPAELPNIKREISETEAKALLKERPDAEHIIIATRS

SEQ ID NO: 978692 - protein, 131 aa, Homo sapiens
SSPPMKRSTNKIYNDIAACLTQHKYLKHTCTYLYLIIYEFTTYEKCLTTISFVYGVIFIFHPLHVTVISFLTFPFILEYILCQFIFLLLNILEGKVFFSGCLHMIPKAGYVPLSFWLKFSLQPSWVLRFGS

SEQ ID NO: 978693 - protein, 123 aa, Homo sapiens
MRENIQRPKIAWSITGERYCADDEGTGKIIHFIKYDTGNLCMVIGGANLGRVGVITNRERHPGSFDVVHVKDANGNSFATRLSNIFVIGNGNKPWISLPRRKGIRLTVAEERDKRLATKQSSG

SEQ ID NO: 978694 - protein, 96 aa, Homo sapiens
EVTAFSKRNIVKISCKDELCPLLFSHSFGRERKAAGKANMDENHLEQLSRAGNLIPTYTGRSALTVEEFCYQKLVCMFVDSSGEWQTFFSFSLSPI

SEQ ID NO: 978695 - protein, 68 aa, Homo sapiens
FNYANEKLQQHYVAHYLRAQQGERMGEQEAGPSIGILNPFLTFQPQVPGSDVEAFCSFSFYIYIDKVI

SEQ ID NO: 978696 - protein, 85 aa, Homo sapiens
MMMEIAVMDAGPSLQVLVMMEIVGLVCGALPQVLVMMEMAVMDAWALPQVLVMMEIADIGAEGIPQVLVMEIAVMDAGASRKCWW

SEQ ID NO: 978697 - protein, 94 aa, Homo sapiens
VLEEYSNTREREKHNYNRASAKRLVAHLYQNVCACVRQPSQGPTCGIKGTSETGPWVVTGDLLLLQSSQAHATYDTYGVFNSFQHQECHSHKPL

SEQ ID NO: 978698 - protein, 125 aa, Homo sapiens
ITDDAACTGRRHYLEKAAAQRKARLGENSAFLQFNWKADVVESWIGEKENSLKTDDYGRDLSSVRTLLTKQETFDAGLQAFQQEGIANITALKDQLLAAKHVQSKAHRGPHASLMKRWSQLLANS

SEQ ID NO: 978699 - protein, 73 aa, Homo sapiens
MGRARLRSSPTAVLDIQVWVVTATFSTAGDINVVRAEGVTQVGMLAHGGGCTASYHIALVFRFVSAGGYQTLI

SEQ ID NO: 978700 - protein, 141 aa, Homo sapiens
RGSPPHHCKVGMVFDLDDFNTPMCVCHDRASCPSPIGDLDMVCCNDNMTFYSSCHFFVTKCTLEGTNKGHMLHLDYIGPCEYIPPCLDSELTEFPLHMRDWLKNVLLTLCERDYDNNLLTEKHKLRVKNIHDNDKRLEAGD

SEQ ID NO: 978701 - protein, 115 aa, Homo sapiens
EKQLVLITGLRTYGGLLRWRGGVTTLTCAMAETFSLCLFSRAFDLCTRGADVRIRMNADPRESVFTNERFPLRMSRRRMVRKSRAWVLEKKERQQAQGRDVRPDTQYTGRKRKPR

SEQ ID NO: 978702 - protein, 146 aa, Homo sapiens
MLGYARSDRREMIQEYYFTLHLDVPVASASRCVYTFSDKKADMGTGRFSKNPDPPDGLVLIPDLKWNQQQLDDLYLIAICHRRGIRSLRDLTPEHLPLLRNILHQGQEAILQRYRMKGDHLRVYLHYLPSYYHLHVHFTALGFEAP

SEQ ID NO: 978703 - protein, 80 aa, Homo sapiens
MSGLRLLIQVRVYLNPEQSGEIMYDCDGDEIFHVDLAKKETVWRLEEFGRLASFEAQGALANIAVDKANLEIMTKRSNYT

SEQ ID NO: 978704 - protein, 161 aa, Homo sapiens
QIVSELGDGATREWESVPPVAVGIGVTVTRNTSHVLGVAHVGLQTSGCHQPGPPDELLGTQASTRQAHRRGLHQHSRELGVTEGLVHARLEEALQADDGLHVCLVLSELVELLEHADHILGKLLWGAVGRRQLLLEAATIRSDPGATGLVQEKAERQQLMQ

SEQ ID NO: 978705 - protein, 72 aa, Homo sapiens
VECTELNAELLCVACKLIPQASASSTGWAMKTFIEHLPGRLWEGSTSRERGSTGTQLCKALVLEQLTPALNS

SEQ ID NO: 978706 - protein, 157 aa, Homo sapiens
KQLLVNLSQCDHQLFLFALFTKDIDILFPEGAEEEGVNLGQPCPLDQVIELPEGGVSGQWLDVLEEVLLLGLKELADVGDEERVGPEGADVDPDHLGGVDDLAQGPHEGPVHPHQLLRLDLSCLVQHHADLVLMVLQSLDHFRELIGDVQLVGVEVQ

SEQ ID NO: 978707 - protein, 66 aa, Homo sapiens
MSRAINLTQKLCTTVIAAEIMYDWSQSQEELQEYCKHHEITYVALVSDKEGSHVKVKSFEKEDAVN

SEQ ID NO: 978708 - protein, 70 aa, Homo sapiens
MKGCAIGSQPLWLFPALFDLSIGDSSLRGSPLSEFSRGSCWAQPPQGPQSRCLGQACGGQLEAAAVCLLV

SEQ ID NO: 978709 - protein, 104 aa, Homo sapiens
SRPIPHAFRLMAPPGASAVSAVGVAANACVMFVPENLGSVGLSFLEGCTEGAEGAGKWGRGWKLIGWWWLPGLKRVVDVKRGILPAGSVLDHSWVLKGVGTRMF

SEQ ID NO: 978710 - protein, 139 aa, Homo sapiens
MTLPSYLSRTSASHLLLHTRCTKKISSLFSSSSSLSLRLTGNPVTYTLRSLNWLDTWIVVIHGTSSNGWSCIRSRHSSMLIVLLLMLQHLFSHFGVIKGDQSRARVAEGSGSANWKLQTYAAIRVLLGVSSEYQGDLGH

SEQ ID NO: 978711 - protein, 126 aa, Homo sapiens
MSLTLLDKYHWLPRKENGLEASVVGSHNSSFPEVIKLHITEVNVILHGKLAIPAVPRLSTTPMVGKAPPTYRCRGATPKRELPEKLVDALLTEGAYIAEQISSCCALMADMAEYPNPPLPNAVSST

SEQ ID NO: 978712 - protein, 122 aa, Homo sapiens
ISQQCNGKYDCVDGSDEASCPKGDVRTCTKHTYRCLNGLCLSKGNPECDGKENCSDGSDEKDCDCGLRSFTRQARVVGGTDADEGEWPWQVSLHALGQGHICGASLISPNWLVSAAHCWLMN

SEQ ID NO: 978713 - protein, 120 aa, Homo sapiens
SQHLFLHLTDSSDLQFVQHLTPTLRSVNQALLNGKPAFTTHQSGMSVEPNMEAMLITGFRATQALLGLWVLTNQVAGNEATMGTTHKGHMACIKVFLLEHLFHCKLDILHILVAHIAWEG

SEQ ID NO: 978714 - protein, 174 aa, Homo sapiens
AVVIWVMPVSDLMRFDEIFLKTRVYLYGYVSHQEVKEIFMHSGLTQNLLAHIWALADTRQTGKLSKDQFALAMYFIQQKVSKGIDPPQVLSPDMVPPSERGTPGPDSSGSLGSGEFTGVKELDDISQEIAQLQREKYSLEQDIREKEEAIRQKTSEVQELQNDLDRETSSLQEL

SEQ ID NO: 978715 - protein, 141 aa, Homo sapiens
NRNTAITRKDAIPGAAITGQVLYRARPFNPPKSTTALYSCNSTPFYHIDVTYQKLLACNRRLLIWSQALVLPQLQQLPYPPGACDFLAWRRMVFRRMVFAYGFSFNMILKFFSGFFFRTLDGSSCVVLEGLFGSLGFSRFC

SEQ ID NO: 978716 - protein, 158 aa, Homo sapiens
FRTACNYCKLFPWTLSLTVVVSYFEVGLCKLNSIKLGHLLTQFHFAQDSPELGLVNAGEEPAVGIGKGLAEKKALEPAYRATTGCMMPNVGNTQVLAEGHYIGISKAHPLHHLGCCLWSTSPQLLIAHIVGNGVALKHTESIITLKCWDLAGKENAYK

SEQ ID NO: 978717 - protein, 196 aa, Homo sapiens
SAHLGLLASLPVEPFSLRGVSFLPLVSQQYFIASYRAIDSHSDTAPKTARQLGLVKCRVRNQRWVLGKAWRKEGSENRLIEPQQGADNCDVSQCHSCAQQKSPRLQVSIQQPQNSPHFLLCILSGLFVVVHDAQGGEHPGTGWGHYIGISKAHPLHHLGCCLWSTSPQLLIAHIVGNGVALKHTESIITLKCWDLA

SEQ ID NO: 978718 - protein, 43 aa, Homo sapiens
LGMETKNGIPYWIVTNSCVVPSGDCTGYFLIERGTNMCGLAAC

SEQ ID NO: 978719 - protein, 169 aa, Homo sapiens
VRRLERLDHLAVVFRQKASIHEGWTDGKEAMLKHRDYETATLSDIKALIRKHEAFESDLAAHQDRVEQIAAIAQELNELDYYDSHDVNTRCQKICDQWDALGSLTHSRRGALEKTEKQLEAIDQLHLEYAKRAALFNNWMESAMEDLQDMLIVHTIEEIEGLISAHDQF

SEQ ID NO: 978720 - protein, 153 aa, Homo sapiens
APLAIHSMQVHKETIDAVLYAIPGRTDIEVGIYGMEGIPDNDMHERRRLLEQKTHESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENI

SEQ ID NO: 978721 - protein, 39 aa, Homo sapiens
TVTKKAKKEQQRKTEEKEGHREKVEQNSNTAVRNVKCHS

SEQ ID NO: 978722 - protein, 38 aa, Homo sapiens
SHITSSIQGLATIHAYNKGQEFLHRYQELLDDNQARHT

SEQ ID NO: 978723 - protein, 78 aa, Homo sapiens
RPSVLGRSRGPACGSEGGTSCFSISFVDATVCVGVRVVVSGMSCPAALGFSTACRLVHRSTSMMQFAASAAGIFTRLN

SEQ ID NO: 978724 - protein, 80 aa, Homo sapiens
TGDLGKEIEQKYECGEEIVITVLSAMTEEAAVAIKVMDKITGSQGGGGGSRDPLNLIMSPCRGWPGSGPVLMWTPPTEFI

SEQ ID NO: 978725 - protein, 82 aa, Homo sapiens
SLSVQKNYECVVGLKGRQNGGACGAVTTAAVCSAKKASYSYEGDEHGDTELDFSVVWDGDFPIDKPPSFRALLYKCWAQCAS

SEQ ID NO: 978726 - protein, 75 aa, Homo sapiens
MHLRQETEVELYNEFPEPIKLDKNDRAKAWQKAAVAEGAVRVEHRVLHKPRTHVGLQHNSPLLFQDKTYIGSSHY

SEQ ID NO: 978727 - protein, 61 aa, Homo sapiens
MRAVGEPCVHGPGSIRCSVIERVSSRSHTEEDMQEKLFDFLHARDHCVTHKLFNNLKYMCG

SEQ ID NO: 978728 - protein, 137 aa, Homo sapiens
KEPFTDQDTQNMNRKVNKDEMQREHHCEMAPGTGRTRCGLRTQADWGRCLHTIQTEDRVWSNAISPLHQLFSDRDGLMRALLTPENWDLNSGQLMTHLGSAFPPGAGVLDVMYESPFTLLSCGYDTYVRYWDLRTSV

SEQ ID NO: 978729 - protein, 50 aa, Homo sapiens
MDQREFMLTPPPSGAYLQSPDLLKNFQVQRDPKDPVMSPCELPASQAIAG

SEQ ID NO: 978730 - protein, 48 aa, Homo sapiens
MDLTAQQLPFHTPSLWHQYAPYRKGPKQSRRCGLNPQRHCGPPAYIPF

SEQ ID NO: 978731 - protein, 52 aa, Homo sapiens
MVVTLFDSDPITVTVPVEVSRKNPKFMETVAEMGAARRPVRYRTCNAPALGT

SEQ ID NO: 978732 - protein, 117 aa, Homo sapiens
AREGIGHRHLHKWTYRTDLRWLTIAAFLPEYLTSCDGMDANQKSVLGRNFKMDRDLPSFTQNVHRLVNDLRYYRLCNDSLPPGTVKLYGLLLPGDTDFCCCHLRQPYLPPQMSPRWA

SEQ ID NO: 978733 - protein, 70 aa, Homo sapiens
DVVIRRNQERAHQITDESLEGYEENPGEAIESQDAGLKTITMLDDQKEQLNRIEKGLDHINKDLRETEKT

SEQ ID NO: 978734 - protein, 83 aa, Homo sapiens
MDFSLTVSRSPYSGCRLCFTYTRKCGQLEVDYSPSDMQDSSLSHKIPPMEEPSYTQDNDLSELISVSQVEASPSTSSAHTPSQ

SEQ ID NO: 978735 - protein, 69 aa, Homo sapiens
MPKRGAQVRSRAMYIVIVQVTGLAKAGGAMLHGDEGSTQVEPARCGRGTRQWGAGPCWPNCQCTVKMYM

SEQ ID NO: 978736 - protein, 124 aa, Homo sapiens
LIIDITRFVWTIHPQKTATLLISDERGRREHCCRAGTVVASGTVVGVVLYTGRELRSVMNTSDPRSKIGLYDLEVNCLTKILLWLPWVVVSLVMVALQHFAGRWYLQIIRFLLLYTNIIPISFA

SEQ ID NO: 978737 - protein, 117 aa, Homo sapiens
EPSLYPRYRSLTDNAVPVIYQVLPVLWCWYFHNDACVTLCSNTNEQLTSPVTIIRGYLREFKNSHSEVPSLMVLSSPSPSTTPPPLWERSASSACRNPSAPHSGFFSQPIPLLCFPP

SEQ ID NO: 978738 - protein, 71 aa, Homo sapiens
IVGSDHDIGHNELVINSYVTATIEPLARLVPPPLVYKEGNGGHVLSQLQGSLVLLFPKTCSNYFYEQYRYL

SEQ ID NO: 978739 - protein, 42 aa, Homo sapiens
YTGVRERIRVRVGVTPEYEHESMTVYQIPIHSEQRRGKHQPW

SEQ ID NO: 978740 - protein, 78 aa, Homo sapiens
LISLGVIPFSFRSRPLPVTSIHACISCASSYFIPRLLTSGVTFMAVRRSLYPQTLTRDEGGDIIRHCWVRSAGNMCRT

SEQ ID NO: 978741 - protein, 121 aa, Homo sapiens
DPLCIANPFSISSLTTGDRQVVWSAPNGALYCVVYHKSQHRQLIAVFRTFLLLQPASWMARLSATLSWKAVVGFSLHSSTSSRSKSPLSRKPLATRPTRITPRRVLVMCSVFCSPAPSLLS

SEQ ID NO: 978742 - protein, 116 aa, Homo sapiens
GTSSITDMYGLNIRTSSSVPQNIQVLCDLGMVSIYLGIQLYLHWHVLHTLGPKIREEFLTGKGRGTVLTLALRGGCSQAGDSLIGLVADVQPPTGPVSLGRELQQAALPEQKIEDE

SEQ ID NO: 978743 - protein, 46 aa, Homo sapiens
MCSLLVAVRRLLKDRLRRCIVCTQNSPLSSHPVVPLSELSTLCANS

SEQ ID NO: 978744 - protein, 97 aa, Homo sapiens
NGSRHALELLRAGSVRKPPEESSCFERPCFKWYTSLWSECTKTCGVGARMRDVKCYQGTDIVRGCDPLVKPVGRQACDLQPCPTEPPDVSCQDQPGT

SEQ ID NO: 978745 - protein, 44 aa, Homo sapiens
MHCTFHKHCLLIILLLAVLLCQDAKRLGSSLNDCAAPFTSKNHD

SEQ ID NO: 978746 - protein, 34 aa, Homo sapiens
YFSDMGSHWEMGERRLERLSYLCSDTACAVPQRL

SEQ ID NO: 978747 - protein, 105 aa, Homo sapiens
MCLSRMYMRPTWRDDGTSDAVGHDDSEAHTASMHTWLQNSYWKAWFCLTFLRSAAVLAMIMRKVYEDETWQPQQLHAIADEGRGDDIVHKEGTLVRQEDALQPDG

SEQ ID NO: 978748 - protein, 136 aa, Homo sapiens
GGRSPEEVRCAIAHLGPADSHAARIVTQRLEEDRHRHLVHVRDRLIGQAPVCADLHGRGLTLLRTVTHAGSVDQQGHHAESLLFQWVEEDHKPGRGIQLDHRALWEGVVTEASVIHLEEGRLRVTVVGLLVPQHQH

SEQ ID NO: 978749 - protein, 105 aa, Homo sapiens
MSSADYYSTEVLLQADTHLEGKGVFEGGTNVLGHLLQGGAPTPFDRNYGTKLGVKAMLWLSEKLREVYRKGRVFANAPDSACVIGLKKKAVAFSPVTELKKDTDF

SEQ ID NO: 978750 - protein, 87 aa, Homo sapiens
QALQVMDVHMDCWKPFPGAKCKSPATLLTSKKPYTWQPSFFCSCIFWLKPSRRHCSIVSGFLKAQPLRRYASRTVFTGVTALDIFCL

SEQ ID NO: 978751 - protein, 84 aa, Homo sapiens
MTPATEHPAGMRLLERWGARGLQDSDCLLVGLVSSPCLRVRRHELRPLGRAVIPLQVLLEAEEQRVHTHAIDAEETVCNQVGAN

SEQ ID NO: 978752 - protein, 111 aa, Homo sapiens
DTEQAVKPGLSLISRACVEIVRAQLHTGPTAEPTSDSTVVSLTAPQHKGDGGSETVTLWGDTSHHNGSLMDAAAVVLLGTSEHVLGRAHLCFLSGSTSASKKTHSFHGSGL

SEQ ID NO: 978753 - protein, 49 aa, Homo sapiens
GPPKSQCHEELSVKTIFGRHLNPKATEEKMEAIELSVDPTSNKRQCLVF

SEQ ID NO: 978754 - protein, 119 aa, Homo sapiens
KCQIQSLKEDHVLFLGLGKLLFQVINCHNQFSNRPLCKFSTGLSLLQFVRQKFHFFFIFVLLYRILFRCNLQRYQIEDNILEFFFQVTTFKFRHLRTLLCPLQLTLQDDQLTNYLLVFA

SEQ ID NO: 978755 - protein, 45 aa, Homo sapiens
EVASLLLDDEELEKKLRLGQEEKLATGGNQLSERAQTVCLGSWDP

SEQ ID NO: 978756 - protein, 77 aa, Homo sapiens
QRLVGVSQLRQDQSLPLPKHLYYPGENTFTQDRLLFDDGLIVFQGWRQALAHGESLAGHLCMLGWSQAMPGQLPMSL

SEQ ID NO: 978757 - protein, 62 aa, Homo sapiens
ITEYWSSARCSRDRRNLYREACTVCCEYTSTRLQLNDYLEVSTVLTCRWNLSSGCMHRSGEY

SEQ ID NO: 978758 - protein, 165 aa, Homo sapiens
LTYTYIALLPFETRFRPAVPMWDACVVRTVCLPPGGLQLPDWTECELSGYGKHEALSPFYSERLKEAHVRLYSSSRCTSQHLLNRTVTENMLCAGDTRSGGPQGKFARRLPGGIREPPGVSERWPHDFGGHHQLGPGLWTEGFPGVYPKVTNYLDWIRDNMDRDQ

SEQ ID NO: 978759 - protein, 36 aa, Homo sapiens
ALSLPLAFLFTFSSTTWDSPSCHKGFVRDALRLRCL

SEQ ID NO: 978760 - protein, 35 aa, Homo sapiens
SLADLAGASPGTSGIENELRGSAPPWTPVPLVLSE

SEQ ID NO: 978761 - protein, 71 aa, Homo sapiens
PCLVLSSISRLSWDVPATEAAPPPPEPVPGLHSAPATGPVVWRTLFLTDRLDRMLPEKDTHPRHGTMKNGV

SEQ ID NO: 978762 - protein, 44 aa, Homo sapiens
LVAGCPCGLAAAVQFLRLLLPAATPPRWPAESSGLVVFKGWIVG

SEQ ID NO: 978763 - protein, 74 aa, Homo sapiens
MRYHLHYHLRSTVERDGPIKTSALQCGMCDATGQHSIPSGDITSKTPNGLIFVVDSNDRERVNDGPGRADENAG

SEQ ID NO: 978764 - protein, 149 aa, Homo sapiens
RYRAGFSGLDGEGAYEDAGRVQMAGFLGAQKCSPVLDNTTDHGVPVDVSFSTILNILAVHEEIAIWRGWGRGASIGLGNRPAIVTPDIRLHGLVALENLDGIFDFEPLSLPPNANRIFPILQQLRDSQYIHVRFVLAILVLFEDAQEPA

SEQ ID NO: 978765 - protein, 107 aa, Homo sapiens
DKAKNILVLTVMNEIKYQFCGLSLRSDSSSSCKELSCSFSRIYLLFELIQYSLKSVLESQIFHFHDEILLSLCPVLGLLELAFHVVNLVLNSHNQLIGSFIFLVLYI

SEQ ID NO: 978766 - protein, 111 aa, Homo sapiens
MHDQMDKRGWYRGSSVQGLSSSEVVVHDTVITDLMELIPSTTVRDPDDQIDIIVGDGDDHIWDIVGSVQVTLHSGSHGIHGAAPAGCKSSGNRDEGEPGSHMAIDADTGRN

SEQ ID NO: 978767 - protein, 124 aa, Homo sapiens
MCEHKYGNAPRVRIKGHVAARFPFIPMPLDYILPELLKNAMRATMESHLDTPYNVPDVVITIATNDVDLIIRLSDRGGGIAHTDLDRVIGYHFTTAEAKHNRNPGSAPSLAIWTCIVAPSQRLA

SEQ ID NO: 978768 - protein, 162 aa, Homo sapiens
FAVAVRVLGLRCCRYTSRSLRGPESMDDVPQPLGWSHGSSWSTVRILSPCPEDAAAVPGWSRAVRIPSVGVPREPAHHPVRVPRSTGVLFARPGCFIFRIDPGMGQRQAGLVRLINKLFKTTWLNVESVLLARKLYNLTKSLQVDILALGLHAPKLSVLVMA

SEQ ID NO: 978769 - protein, 34 aa, Homo sapiens
MIQRIDLYSARFYSFSVLQDTIPGGDKKVMVAIP

SEQ ID NO: 978770 - protein, 86 aa, Homo sapiens
MMEGRSRSYSVLEIHICWKVDSEASDGAVDPHGVLALRRSSDLDLHCAGLPGQLISFCILSAMPGYMVVPPDSTVLAYRSLRMSTS

SEQ ID NO: 978771 - protein, 42 aa, Homo sapiens
YSWTNISKKQLTWLVNRLAGQKDFLRSRLLLGLQRSALENLP

SEQ ID NO: 978772 - protein, 77 aa, Homo sapiens
SPGCTAYTSTIPKGMSHSLSSCTIYHMEIIEEEAFLAWKEDITQEFPGQGKALFQVNQWLTWLETAEEEDIRGRHAD

SEQ ID NO: 978773 - protein, 137 aa, Homo sapiens
MSTDRGAEEDMDECEQALAAEPKDKDPFAHLPKSTFVEDGFKRKYSNEDTLSVALPYFWEHFDKDGWSLWYSEYRFPEELTQTFMSCNLITGMFQRLDKLRKNAFASVILFGTNNSSSISGVWVFRGQELAFPLSPD

SEQ ID NO: 978774 - protein, 129 aa, Homo sapiens
YGEREAYTPGDAYKRRNKVCACPMILRKEMDECEQALADDPKANDPFAHLPKEYLCVDEFKRKYSNEDTLSVALPYFWEHFDKDGWSLWYSEYRFPEELTQTFMSCNLITGMFQRLDKLRKNAFASVIL

SEQ ID NO: 978775 - protein, 63 aa, Homo sapiens
PGVARPTKHGGGGSAQSYAAPAQSTNEDLSDQSSHPTHENHHTPETKKRQSQLETGKEVHSYG

SEQ ID NO: 978776 - protein, 100 aa, Homo sapiens
SQDMMVTWIGRMMREKVIRRCSEPALHRTEQNHSSSLGGPAHSWFQVSPFLAGLKGRLYPSAFTYPDIISMSLPNFYQCISLFHTVLLILSLNRFAQKET

SEQ ID NO: 978777 - protein, 68 aa, Homo sapiens
IEETFGGAHGVWGVNDDHVECRLILYHELKTVTHMWGQLRARVANGHAWQELLGDLYDILVDLTLDHG

SEQ ID NO: 978778 - protein, 50 aa, Homo sapiens
YEFIRTIASSIFFFLSSMRSGVSIPDGTDEKPPGDDKATVCRGNKACLIW

SEQ ID NO: 978779 - protein, 59 aa, Homo sapiens
RLQLNDIWRSARCSRVDGTLSREACTGVVNTRRPGSIYAISGPPRGAPVSTELDQGGMH

SEQ ID NO: 978780 - protein, 62 aa, Homo sapiens
GQTQTWNMRADSMTDDTPLLKINTELNKTEAETVEMDIRIGIVEHTLLQSKLKEKSNMTRVG

SEQ ID NO: 978781 - protein, 114 aa, Homo sapiens
SPMDQLQNVVCENAKTSQTMELVPNFQGIVGTSVSPCALSLSCAHPQAARGLATSSSHSLPSGFAPEALTFTTTQPQGWGCPQRVGNALDSERLHPLPLSLWSHLPLFQALSRC

SEQ ID NO: 978782 - protein, 124 aa, Homo sapiens
LAFLIQVLEALCGPSKSAVSSALGTSSRPPKLSNPRDGIIGKQHREADRGPHATRLLSVMKVSASSGSVSEARVATDIFLSASARQTVLSWLTQATRLPLAEKQTPCTQPQLLLDSNRRIGLQG

SEQ ID NO: 978783 - protein, 69 aa, Homo sapiens
YRKKTGSMECVETNCRYKRMLAIEICKHFELGGDKKRKGQVIQFYNFGIFFFNFEEKMDEAIEKLPEGK

SEQ ID NO: 978784 - protein, 128 aa, Homo sapiens
ERSAMSLHSLEEGEIAVWVDQARECVCTHESLVRVASSERYIRSESSGGVVLANKPRPSPQVTRMSSQLPVEAVRAHCQQNSQRCPKSIGIGPPVPPEVCLSIHAVLEHQPAAPISLHVAKTRSGAAR

SEQ ID NO: 978785 - protein, 35 aa, Homo sapiens
MLVCRSSCLPGDLHHAILGLDRQLARSRYMQGYEL

SEQ ID NO: 978786 - protein, 80 aa, Homo sapiens
FIDLAGSPCMFGVRRHVLKRRVRARDERRSRERASPIARGPSLCSHHLYNLFIIDLAFSIDVSLPDHLIHLLMGQLLPQV

SEQ ID NO: 978787 - protein, 125 aa, Homo sapiens
KPPQNNVKTPQVRIFKTAQDGPGKNQRGELSGRLRLLLAEATALHVALVFAVPVLLVSEVAPVGALLVAKHPFVVLHQAAQLFGQLQSQVLLSSGLSAAHHHCLCWLVQGGHQLLINDHFADDGH

SEQ ID NO: 978788 - protein, 112 aa, Homo sapiens
PRHNFKTPQLKMFTNPPEDSERCEGMYLYKKIQVLFERNASLHPKRFTPEAMPTHRNLCFLKTPGKPVSMPHFVQATFRMIAAESSTELKECAEPSTRKNLMNSFEQKISRL

SEQ ID NO: 978789 - protein, 64 aa, Homo sapiens
VETPPETTLNLRDKEFFGEGDENYIQDRFNLTGLNEQVLNYRQALDMILDLEPDEELEDNPNQS

SEQ ID NO: 978790 - protein, 97 aa, Homo sapiens
MCVDWQCPFEDFAFPPSVSENVLKISVKEQGLFHKKDSANQGCVRRVYLKDTATAERACNAIEDATVNETAAKIDEAVISETSQTPIAILITDLRGS

SEQ ID NO: 978791 - protein, 84 aa, Homo sapiens
MKDCIHPSDWCHSPILVHHPKSFDVVLKVPWCLVLGDCLQHGQKVLKVQHLHIHLITLGVPQDLEHLGVGRVLAQGPHHIPTLA

SEQ ID NO: 978792 - protein, 130 aa, Homo sapiens
TLEYRWVCLTLSKSYRLTSNMYYQRAVKPRAYLHDGSTGCRVVEEELKIPAGGGPRSQAKVYMRFLPRIIALCMEQVYPNTLPERPSPDVKAELIELLFRTLHHNWRYFFKYTVLASVQRGIAEEQMENE

SEQ ID NO: 978793 - protein, 107 aa, Homo sapiens
EDIHEVLKTALIHDGLSRGIREAAKALDSAKPIFDCCASNCDEPMYVKLVEALCAEHQINLIKADDNKKLGEWVGLCKIDREGKLRKVVGCSCVVVKDYGKESQAKD

SEQ ID NO: 978794 - protein, 79 aa, Homo sapiens
RHLEQHVAIPVAAMMTWISSTGLQAFWDRGYLEGHRAMENLGLASNKNMTSLFLKGAPGLPCVTQFFPSVCPAASLFLR

SEQ ID NO: 978795 - protein, 109 aa, Homo sapiens
QLRYVSLQHSCCTSFVVCGSLKLSSSEAFGSPEAAAEPPQPTAVPLELAKEIEMASEERPPAHAVEIMMGLKTTDMAPSKETEMALAKDMALATKTEVALAKDMESPTN

SEQ ID NO: 978796 - protein, 38 aa, Homo sapiens
SAESQNKRRESWHYSSDIMSFELLSEEIRYSFHTMQDR

SEQ ID NO: 978797 - protein, 66 aa, Homo sapiens
EHTECAISKDGSVLSLGTTRNSAPTEKDEYDRPVNQVTWSQTQDSEVGSRHVSSIMEVGRCRIRMG

SEQ ID NO: 978798 - protein, 85 aa, Homo sapiens
GSCSMPGVVRVCEPCLPLSEAQASGVELERQQEETVLKNIVSFLYSGPKEVGKQGQEAKSHTALGIIQSIVWLTPGPGLVSLVNT

SEQ ID NO: 978799 - protein, 64 aa, Homo sapiens
MQHENLIDEAFNTQITALIMLYECEDTHLGEEVDEELECMWLTQQYLFDRLAHEIEALKSFSKS

SEQ ID NO: 978800 - protein, 156 aa, Homo sapiens
MGAKTVIANHSEIMKDLSRLSTYRDSLSGWWLLWKRLNPWADKVKVPDMAEIQSRLAYVSCVRQLEVVKSSPYCEYLRPPIDCFKTMDFGKFEQIYDVGYQYGKAVFGGWSRGNVIEKMLTDRRSTDLNESRRADVLAFPSSGFTDFLFVEVALGY

SEQ ID NO: 978801 - protein, 85 aa, Homo sapiens
MRAPLHETKDFVHLLALEGCDLGIALGFGDTENGTYVFGGVPELLSQLLQVPQPHLESGLLLLKGVEGGIQWELTWVSGLFVEVA

SEQ ID NO: 978802 - protein, 153 aa, Homo sapiens
ERTDVRACHTWLLYISVLIDGDCVKLTSLFVSAKNVRSFLHTDHYHQICLHEFSMAYTKYVGDSLQPKTYGRSSVEELLGAIPQVVWIKGHGHKRIVVLKKGHEKSCEFTTVSPLALMKTSPQEGERILEVPESHTASELTLGADGSGPSHTE

SEQ ID NO: 978803 - protein, 52 aa, Homo sapiens
SGETEIMFRVLLQLQYQGSNGSAGKGNLEENKVTMTLSEHLSIQLPSAYDWV

SEQ ID NO: 978804 - protein, 156 aa, Homo sapiens
MHNEQDKREQGDVKDVRPKTAEGQSYSNQMRKKKTAAKENKSHRRERKQQRDETHRGTHQTKRAGQPAEQPHTITSPRHKTRQDKHKRTEEARTGASSTGHYRTDEQKSTRKQSSTSEQKQNRRRRQQTRQNEGQQKLHEKKRKPSRENEQKKNKR

SEQ ID NO: 978805 - protein, 33 aa, Homo sapiens
FEENEVLAALIVGGIVGILFASLPDPTAHVPYE

SEQ ID NO: 978806 - protein, 86 aa, Homo sapiens
VTPDRPIPAMLLFLVMCLSFCRPPGGLLCRLPLCADTRRDWYLPCAKCNAHSIAYRPLLTVITVWFLDILKEDSATSLVLAASSVP

SEQ ID NO: 978807 - protein, 77 aa, Homo sapiens
GRKMGSRAPDSRVSEEENLKNDPKKKMTMCNWSLELSVLEDDGHRTLLIRDKDSCGIATQGTTFILDDDAIEADSER

SEQ ID NO: 978808 - protein, 69 aa, Homo sapiens
RLRNHMAVPFVLSRGGCHALYTFRVADQKTDGILSDFYRNYDVMQQIWTRDRAKAGTLFTQCKSNSCDI

SEQ ID NO: 978809 - protein, 60 aa, Homo sapiens
MYGGQHGSSRVRRNLYREGMHRSGEYTSTRLHLNDIVVVSTVLTCRRNLSREACTAVVNT

SEQ ID NO: 978810 - protein, 103 aa, Homo sapiens
MSSQIPCKNNSTEVLAPAVKSPGPIRTCRTSIHLALCWAPYGDRDDVALECVETNSSRNWRVISRRGHTDRLLNMRNSVPAETLFQDINEVQLKMSGEKPQTP

SEQ ID NO: 978811 - protein, 406 aa, Homo sapiens
MCATVCLTTPRETVVYNIIPRSQIKGCANIYYHRRSSGTQYDRQGAHFYTTTRRHCVATDLPLFIKPPNVAILQHTLQFSRPFLVVSYPSKNFSTGSWGYEHSSSGIIIPHSLISPWGVVTSSPSNLEGRYTTVEVENGRYHKTPKLSAPPHLGVHINPISLPNKGRRNTTRPAIIIYITPYSHAPPNRSPDSTLSSVVTHFIPRGGQHQRVVYHPRKANCCLGGAPPDRINKATRRPRKKEGSQSRANTCGSLTQNILVIKIDGGHVHQTKRPEPFLPTCATAAIFQTDVLLFHATPTRLCGCVSRASRQRLSLINTPQRRRGALTTYTLLIRKARPILSITLRQGQPVGGTHSHSSPQHVSIRCSGSGRQTSLKTDPPQLYLRHARGRAHSTLTKQEERTCVLV

SEQ ID NO: 978812 - protein, 122 aa, Homo sapiens
MWSSHLHKFRGSVVIGGNTRIIDPVEVLSGVEGSFGTGAMDVPAKRVEEGDRSCLLGCFRKREVLLALMAETAKEEKEDILPYTYCTFQRHKGLGEDRETGLTGENKIFQIKKINLEVPVNI

SEQ ID NO: 978813 - protein, 134 aa, Homo sapiens
MEITALVPSTMKIKDHLLLLRRKVSPLVGSGGVHPESSIGPTLSQQDRGIERSKGVMTQSSGPPICPALNIGSEGEEYDSQWLFTSLFFEQNLNIALEKRKDRGYGYGVCICDEFRYECTSLGTIIGVLESAQF

SEQ ID NO: 978814 - protein, 306 aa, Homo sapiens
MTDDRLHMIGDGLMGNDWTNVDGMTYLYITYRRLNLRQKTTVGNKEVEENLNKRFPRRRHNVCRKSPPTTSVGTLGHNKKHNVSGEGVTPQGSGGPLTQQTAGNDCPLKSGLGDVNTDGGVNGVTPTTKHNVNTGFIGPTFNTTIDHDTDHLTPQTAPHDHRVGPRRAPGPPPTQHGPHSDHTNASGYGQQGGAATDTTLTMPNFCHIKTRIDHRKGATRGAHTRNKEAERGTTHQEDKETTAPGGDETRAHGVDDETNKLHAEVRTRHYGRDNTRAELVTQHRACYMTDDTRRNNKLPPTHIREW

SEQ ID NO: 978815 - protein, 109 aa, Homo sapiens
MADIQEQDLMVLMSQYPTIIEPDGTMYDDEVACRRVPGKGTCKISPERNQRGSHHGDDHDGFTVRRSLSTNTVSRAGVLLSNVEGERYTRKRIRDVMNGSKGSGRGSGW

SEQ ID NO: 978816 - protein, 55 aa, Homo sapiens
MQTQLPLTPTLCLCKWATHFFIYIFLSVLWGNSNSDNLGSCSAPLLRSTVEQADE

SEQ ID NO: 978817 - protein, 397 aa, Homo sapiens
LRKCGFCVWPCISSKHKQGTCFPLSTFAACFCHVVSTKCSPSACQTKGQTTYGANAAHMQTSSAHWACQHRHTSHLFNPGLHLGSLQPQHTNTQLQQLLHPLGGVGSNSINPTRPTHSPHPRHPPPHKHPTPTPTQHHHKPPTPTPPPPPQPPAAQTAPTGAPNLPRPATKRPHAEPSPPRTQDTLTTPTPTRPQAHTREAPPQETNNPRTYTNTHGGPKQGTPNQQPHTRHPAPQRTMRRTTTHDHPQLATITNPPAPHPTTGPPPPTCPHTPAPQPRPGHNGPHMATRAPPLYPPHLCNTNKAPTTQPPPHQQGRGNALDTAQIQHPRGSHDGQRPNTPTPPHTRPPANDGHPPRGGAASANRRPSWPYPTPVATHTTTRRPHHGHTLLPPDQQQ

SEQ ID NO: 978818 - protein, 356 aa, Homo sapiens
DTDLQRLGSRAMAPSRKFFVGGNLEDERAEAESGWSSSAPLNCGQGAGRDRGGFGAPPTAYIEILPGKKLDPKMAVAAARPATKGLMGLSWGQISPWHDQQTAEPQWTGSGGALQKDDRHALRRDVNVQLAGAPDQWPQAYGTQRDLGRIPPPCHWRAARLALTRGQSGHSPGPKGAPQTQNTKGHSPRSSGERNLETQKDRTLGPNWSTTVVDATRALGKRPRQNAPTRGPSSTRPRQTASRRTGLDPTQRGPHQSCGAGPNSATPGLTHNRQSLLRTWRPNPDNRTLGHSTARVERQEPPCARHGKPTTTSERSRETPHTRHTVAPHRPHRTAPRKPRSKSRPKNQRPGRTGQS

SEQ ID NO: 978819 - protein, 93 aa, Homo sapiens
KPRGLIPEPHALILCPGTSSVGPARATLTAHSQVCWELRCVLLPGVAGISASTVAKWTIDEADIVKIMSVKLGPALKIYNAILMFKNADDTLK

SEQ ID NO: 978820 - protein, 109 aa, Homo sapiens
MVLEGHLDVGQDKGSQALAKLTSPRDRRCASLDERIYEVVRPLVSLLHLNCSGLQKFEELMALRNLVGLSERLRQKDPDGQKVVPMIEGYMFEEIEMIRGQHGVMCTWH

SEQ ID NO: 978821 - protein, 61 aa, Homo sapiens
PISVEYYILLSKRMSDIQRTKYRIWEEVWARVNAWKHLDAIYFDSSRKLHMNNGEQNLDIR

SEQ ID NO: 978822 - protein, 258 aa, Homo sapiens
MHHIIIIHSTYHHIIIIHHHHTVLHVLVLISLSKSPTPIQATGRIKPHICIIIIQRVYSKLKRAAEGMKLLFKRTKKRFKSNWGQMRVLDNGVEVKHYINKVLLELHDKHGKKLNTGVLMERRAQKPSSIDDGQPPPIALLEEMKDTPSSHTQLSIREDDTKLAKSPMYFQTTTFDPSLRPRLLQVRSHTNRKARLLHSLLHTFPRFPWISQKPNGVAARIQQQVMRAKTSIRNTTLDDTLSESNKKQPPKLAIAQQP

SEQ ID NO: 978823 - protein, 113 aa, Homo sapiens
EPFCFSLGYRMTWVSQCCPLRGAVTVRYSFTFMFSLSCFRSYCMRHPDVLCMRTYMWPLTLCSRSELFSIQEQAPLSSYQAAGSAYPLEVCLSACSVEPVPSIYHRSMSRATQ

SEQ ID NO: 978824 - protein, 58 aa, Homo sapiens
YQYSQLEISKRPKSIRRTASITLVILQLVLKADAYSDTHQSGGSDIEMDEQLINRPKH

SEQ ID NO: 978825 - protein, 117 aa, Homo sapiens
MAQINTTVWTTIINPILLTLCLITQAKNIKHITTTLTSRHRRAKKVTKRQQKNYSCAPELLQKKGFGHQGSVLAAANYARGPCVRVVDLQTPVNWDSGGRDPSYWLMKLSRDETCSL

SEQ ID NO: 978826 - protein, 107 aa, Homo sapiens
MAKLVISPGAIRQQLAAFLEGFYEIIPKRLIYPSYTEQELELLISGLPTIDIDDLKSNTEYHKYQSNSIQVSCCWNPSSYGPLTLGNASKCEPNKPVVLLEEVACRR

SEQ ID NO: 978827 - protein, 80 aa, Homo sapiens
MDLVVVRGKNGWWWWSIRRIARRSLDGVGTGREKKCLKDAVDNGCSCSGSEYFYQSASVGDSVDVSSGKNKFCFCIYLRS

SEQ ID NO: 978828 - protein, 72 aa, Homo sapiens
VARLLLQAGLTWFLATIWLSGESIDKSMHEAAERGNLSWLRECLDNRDECSVAEKKLEALPYTGLDTGDTKI

SEQ ID NO: 978829 - protein, 92 aa, Homo sapiens
SAGCGRWPPLTMDRGPRLYDISSWFAWGSVHWCKLRGVEGVRKGQVLVAGWNKGSAVCSVRIADRRLLGSDVNGLFVTRCAQDTLGIIIVAS

SEQ ID NO: 978830 - protein, 112 aa, Homo sapiens
RTRNLNKVLCIYVVLLQPARSGSLSITTVVNDYKNNIKSISPQLIYSFWVRFPNPWGVWLGFWSVGATEGKPEVKEKCLAFFQLATARIKVTALKMSTSTLEEEKNLITEKK

SEQ ID NO: 978831 - protein, 55 aa, Homo sapiens
MVGSVSAGTVEYLYSRDGSFYFLELNPRLQVEAPLYRDGGLMSISLLHTLQIAVF

SEQ ID NO: 978832 - protein, 351 aa, Homo sapiens
RVLPPLAAHLGSQEPGGRKTGSGHVAQAGLELLCSSDLPALASKSAGIYSSDSDFERMFGMLYHSATLKTSHVDVARPQQTNKNTHKNTLLWGGKRTHKENVFTENTMVEGRLGRHCWGQSDTSGDNKVAHKEEDTRAQVQTELVELSTPKIKKSRTGMNTTQAVYDKPNIHESGANTEGDKKGDSHNKERTPQRRRHASTINSPAVRGETSDSTASRDRQTEVREQTNESKEDAESRTEQTNGDTQARHKKSRNEAREAKHERSNTQTSEGQQQTERATNQNDTKTRGTNRHTQSRRHEEDETKRQEEEARAQKATTPNRRKRKHESAAKKKKTQTDNQREEGKDRNNET

SEQ ID NO: 978833 - protein, 70 aa, Homo sapiens
PPNTGISCPATFCVACLSIQGTVPPHAGYPTGGLLRSQVPPFDSHEVAEVGFSSNDDEDKDDDVIEVTGK

SEQ ID NO: 978834 - protein, 33 aa, Homo sapiens
MEGTCSGCERSFSFLEICDELEDSSYDHHLEGD

SEQ ID NO: 978835 - protein, 81 aa, Homo sapiens
GSGTAGVVKGSEQLSCDESNTSEVIKGMIPHQPTALCRQKLNEEQLTLHNATLFTCTSTNRTINNISLFTKPPPNTSPHSH

SEQ ID NO: 978836 - protein, 53 aa, Homo sapiens
MLVDRNSTVTSTWAHTFLPTNSLRTPAQNYYHLTSRRSPRLHTAADTGFGKLL

SEQ ID NO: 978837 - protein, 108 aa, Homo sapiens
GRATVYAGITCVVGGESVGKLAVLSQLHKQCISVEKYIPTVCDNYAANVMVDGKPVNLGLWDTAGQEDYDRLRPLSYPQTVGETYGKDITSRGKDKPIADVFLIRLFR

SEQ ID NO: 978838 - protein, 57 aa, Homo sapiens
MGLPDGITMLCNCVFTVCRPSVIKIDEVAPPYRKGHGTRDEEIAGTHIQHSQGALGK

SEQ ID NO: 978839 - protein, 73 aa, Homo sapiens
MPSSMFSADDLWCSISFNLAVSITIIICFFYPYMEGASTVRAGLPSHLICSLAGMCLDLAVTWPSEEILPGKL

SEQ ID NO: 978840 - protein, 244 aa, Homo sapiens
MTFLLDILRASPVLIVCSLRVLREAFIPKRRNSVTGEIVLIQELAPGLGRLTAYEFAKLKSKRVLGDINTAWLWRKPAANCKGLGATGSIPLWGQLRTREDFYSSAQDLVTGRNGRCQYSTYIMLGSLYIRFVCYQDPQIDTPLTVHVLALFGLQGLFPAMTRIRMPYVVCSGSGLSRSSLLVMFKQVRGWFSPWPSPASILVHPVAIRTVSTRVGPGRGDGVVLAVPSYRGRRTPGVTLSFFF

SEQ ID NO: 978841 - protein, 39 aa, Homo sapiens
MYACGALQLLVLVSGPGLSLSPASLSNLLILGLDLSDDA

SEQ ID NO: 978842 - protein, 259 aa, Homo sapiens
MARLSPPNIKERRGGVTRQACLEQTPKKDAGKRHIRRSLQHAVVTRTVQNMKITPASGAIIDPDYYIRWPSASKWSPNARHTRHSDTLAYDSLLGPSISNPSPDQNPRSRGNAAKQTLISTGHPVREQAMQANIMLQTTTTHALHSHQMQQSCDNSGRTKTPNRPTAHLKPRTNAPPVGSASQNYRPPKRSSPLTRIRRTVHTGHQGTAQQRTTATATSAPTTHPRANPTRQERNTHNTQQHSTPTTHPTTSTTHPAHQ

SEQ ID NO: 978843 - protein, 132 aa, Homo sapiens
GSRRCHCLHVAAPGGGVMMQPDDWRLVVFITCFRDKIPNLELCKAGLQSITAGQKVISKHKNGRFYQCEVVRLTTENFYEVNFDDGSFSDNLYPEDIVSQDCLQFGPPAEGEVVQVRWTDGQVYGAKFVASQ

SEQ ID NO: 978844 - protein, 191 aa, Homo sapiens
MQDTGKERGREKKSGARHTKKEKRREQRNKTKPNSDHNEREHRRRTWTQGDETRDPGATNARRGTREKANDTTQNKQRNTRKRQAPCATQKDPGKAQRRPDEHDTRAELRGQRNRRTEADEAPSWDEANHKKSNESSTRERENTRQLTRRNKTGRKAKNKSTNTLHIHTHHTTKATHSKVSSTTTHNHTTT

SEQ ID NO: 978845 - protein, 51 aa, Homo sapiens
EEELRERSGRMGTNIEQIFRSFVVSKLREIQHGAFHVKEVKASVNGETKYT

SEQ ID NO: 978846 - protein, 118 aa, Homo sapiens
RDLSADVPWIALSLGLRDASAYPGLELVSFLNEKKKNVEAPSSLIIGLSKCAYRFEANDEIRVESVGCDRWLMSKDIGERGVPGWRTELHVSLAGLGALTSCIQDPRNVRGSPRPLHL

SEQ ID NO: 978847 - protein, 128 aa, Homo sapiens
MSCHGSSYQRESLQAESLNFKKTLQEEKAELLRTTLMESEENERSNEEHAKCSSIFDWEQQTNFNTVVSKRENETRKCNKMILVDEVETYNAATGTGERLDEESLSGRSSSLASGKEKAVKKNVSKSA

SEQ ID NO: 978848 - protein, 78 aa, Homo sapiens
GEEYRAEGKRVSHGMVSRIFQMLCLEMVECSVQSPLVYRVFIPVLQSVQPELSVTHHYMEMFGRGWNSSSRQFSVLFG

SEQ ID NO: 978849 - protein, 121 aa, Homo sapiens
MSANYYSRALLKNSPPSYVKLPDVVIASHIIGKCLRASPYPSRILIDVPSKTLRLSILSLAMNLLNYNIHGTELIIFYIFFETHLSPPWYHHPRGNQPERLNAGTYFLFYTLVGSFPYSSH

SEQ ID NO: 978850 - protein, 143 aa, Homo sapiens
PGLASAVCQKRVVPGSAHRGVRGRDAWREEGTGRGPERRRRCSDTPGLLECITRRYKPQLCRAPRRSAPGPGLGSLVALWHRERFGLALRGERILALNPGVVAPAGKGWAARRLTRVMGLRDRREIERPSASSHPRGGTTTAN

SEQ ID NO: 978851 - protein, 143 aa, Homo sapiens
TVRRSRGSVSCINSVGTDTDPGTLFQPPTASDSPLRLANSGVPSSTAISCFWDLPDNRIVVSSFLQTIMSSQIRHDFIPPIVKAAVQQSWSICNLQVIINHTSLWASISTAMTVALEVRPPKFLSAKLVVESNAPRVLATAVS

SEQ ID NO: 978852 - protein, 295 aa, Homo sapiens
RSNHHKGASRSRAPRTSNRGLPGSGSKPEAARETRRCAGPSGRIGHAHFRSAPGSASATSCGGGLACREAGQRPGGRIGVRSVRPEVGLAAGRGTRQSAICCPAGRAPVGSRPLGRFCLGDTGDRAQAAPSSEGFNLLFAASALRAARQFLVGAFIQNVGRRLGPGIRLMFGPEGPWPCGPARAFGGRRFVGRRNPEAAVLTSVGVRPPGWGGLVVLGAPEVRAGPKAAMYWGGASAASPGSAEVSGPLLSQAVGAPPEPWQLCREEFIRGSPGPRPGLGLGCCGGARAGEFPHA

SEQ ID NO: 978853 - protein, 70 aa, Homo sapiens
PQPGAAINGGAGLGRRGRPQCSWVNYRAHWSSGVLLGTDHSSWQGEPRLAAHEPLLTQNKECQEVIAGYP

SEQ ID NO: 978854 - protein, 70 aa, Homo sapiens
ARSLTAGLSLVASEPRRTGQDDHGRAVAIFANMLGVSRFLLVSLYHYVAVKQSPRSRIESGAFSAQGSRT

SEQ ID NO: 978855 - protein, 218 aa, Homo sapiens
HFALQLLQLQPDRERAKRVQQLAERVAGPPSGHHTDSPLPAASPYWADPKGNKTLGAAVQIVYFPPNHMLEPLWAKRFGQAGFTFFPHQQPGELWGSYGGVSGWEKLLGHAVGTTPKSSCAGGRLRIFQTSRVTSKYRTVLNVSGGPVENQIYKGGCAVWSDFHEKQWGNTWITLWEPETRNWKTKIVSRFGNVTFDTTFLTKPQDRNGVKLKSSNKR

SEQ ID NO: 978856 - protein, 37 aa, Homo sapiens
MRRQGKRSNKTKSSQADGPEDGSQRHTVGNKRKRATT

SEQ ID NO: 978857 - protein, 143 aa, Homo sapiens
GRNADPEARAAPLVVGSGSVGCRDWERRSELARITGGPSCEECKPGTSISSVKTVDNEIPKPRMERRRVYKTAFKKIKSGCIRVCSISCLWEKGTGCQSTSSEKQQMIPKLKTRCASKDSGARVYQGSLQRGSSDELSGRPDV

SEQ ID NO: 978858 - protein, 157 aa, Homo sapiens
GSLSEGGRSGGSFKMRLLGGSPNVRRSLAECLSATHDGVCRPNFVVRVSPHDQRLIYRLIASTASCGPLFCIKGFARILLVSLEGFNTGRGVVWRDGNHCCAFQLTPCCVPHGTFLHFDNGDDEHFTSSPSKQNNINEQPVKAVLFHVVQLFYKILR

SEQ ID NO: 978859 - protein, 210 aa, Homo sapiens
MLVGGHHGPTQRVQGANMGTKRVCPQEENRGATRHIGVRGFSPHYIKHSAAGVTTESVSGEKHLPRGRSYEGATHAGALSRRGAQRKKHEYTEQLKTGRVGTKMEHHTHKTQKGNTDAAPTATKSHTNRGNHSENNSKNNERKHQPQHDNNIEPTTKKSTTSEREKPNSHNTHITKQKSNREKHRHPKREETPRKNRNKPPTHHTKRKQN

SEQ ID NO: 978860 - protein, 143 aa, Homo sapiens
MYARPFIIISLICFLVACNATIYLDSSQQKHNEVVSNLRGSGIETTVLNNRARHHPEFLIAFPDSPTAVLLHKQIDGQTIPSLTIKIQLGHPNGSCTRSDYNRTRVRINLTSCHTITVPSFNTLETGDVAYSLGVDQSDVGSP

SEQ ID NO: 978861 - protein, 125 aa, Homo sapiens
SDMLFRCCSHPYFRHDTTVTHPLLILPNWVLDLKVMDRPEGPTLSPVIPTDHRNKDDIRNHLMIIEICHPTRILHFTSNDMISDRADKSMVICDDLYHHSFCTKTTTTVITTAFVNEQGLHRIEA

SEQ ID NO: 978862 - protein, 109 aa, Homo sapiens
MPAWEIRQGPSWDAISKTYWYRDPRPHVEADCDSPSLPEFSDFTDHLVETMPDSPCSGFRFQVWLTSIGFFCMIQSVYVTRVTVDTLQIPMRKRLLEICTGLGRSNAKI

SEQ ID NO: 978863 - protein, 196 aa, Homo sapiens
MRLSYDINGLPRRRSCEAAAIYLQSGIDVDDTRHIVTSGSIIIAIPNRGLSVIADSYTRTEAQYEMICCSVSESWALHLYLFHRIVACSCACVLRKSSSLDIVLRRDVLRCRPQFDYVLSIGAVLAIIGGVRSLISPILRTMTARGNLRRKSDFAIIFIGVDLSLLPTNLARGIRNARRYSEYADAYSRVKHPMIL

SEQ ID NO: 978864 - protein, 171 aa, Homo sapiens
ARTKAAMGLETDEGGRTALHGRRLLQPPQRLEYADPRSSRTRDRTGIPTVNRISSWAFEDVIAEPVTTHSFDKVWICSACLFEISKYVKCTMFLTVSWPIPLAFIGGNPLAPPSAVCTIWISMPFVKTCLMVLPSVQDTYGSKCDQMSSLLHLCTTRRTMLSSVSLRLSQD

SEQ ID NO: 978865 - protein, 144 aa, Homo sapiens
ERAHRAYLGCVFSPLLFVANAPILACPCKSHPNSALCPSIQSPISISHLNGYPVSVPRRCVLAPCALSVPLLASTHGAARRCKSSWVTSEDPVSFPEELSLAFVYGSGCPARDRAQFKDQNEMLLRAFCVHRYDDRCLHGFQST

SEQ ID NO: 978866 - protein, 257 aa, Homo sapiens
MPSEIIYSPSRCGSGRSDKDALAHIVAIVGVLIPYISSSGPYIEQREYVVLLKEGDDHHFPPEFGRRRKSARVTTESSCRDSENHRVGGRALLQRDHQKTTLVNSVVVDKTTKSDEEMVVVASVEKKLCPRPLWVFQVPGGCAPQRPNICEILWRHIQIREGERYNDDVPRTSLHISRRGGREGRGRGFTRKGPSKQNKPWTEFKGLIERWESPNKAFNLNRQGNSSNKKKCRRNKMREKGHCRHPQLLKQPPPEYK

SEQ ID NO: 978867 - protein, 135 aa, Homo sapiens
EAATVESRSRRLNLLVQSRDVRIEVLVTKLAPEHMTCKMREDVISSIRNFLIYVALLRDHVQLHLRREIVERWHMTAWEPSRIWTCADYGRARVYTGSDVLRLHGEIGPRTRCRKTLRVDVTTSACYETSCGSGS

SEQ ID NO: 978868 - protein, 70 aa, Homo sapiens
HGRQSRLSGARLSRVDSYLVYWVNLLYRILVRSSDSTSQRTELIMTYFLCATTVIATWDNQLARGEESMS

SEQ ID NO: 978869 - protein, 274 aa, Homo sapiens
MTREGGSSRSTRMNSDWSFKYTRTGDYCDAQHISIEQDILCLSLLPVSSIDERVVLIVVVGRTQSELSAKMSSNGHDREVYCTHIPQSTTGCSQIAPRRMKQCLVLLLLAPCFINGIGLDDSVDSRLHVARVHRTLSDAKMTCGFQVWRRKCLADGGRGFQMKRVTKKFCGGNTPCPLARNDIMVVPRLRASNKAEFLEPTFLAGFPTTNGWFLNCVSQAPVPGCKGGRGLGVKDGAVDVEVCQTNCAAPGGQGPGGRGTPVVEGQGFFPREDS

SEQ ID NO: 978870 - protein, 278 aa, Homo sapiens
QLREDPAGSALSASSSVRDGTDPGKSHIQALDLTSDFLSDYETLRGPICIGHHPGLTEGPAKRADNGWVSASFLPKPNTVRLPRNAARDNVIHNHTVGTGQPTSKSALGSNIVVTLAGTLPKHLNLLLLGAFLIFGPRRLSIVGPSMRKVPGCSPTFISRRNFGPGREIKVSVKEQTHNGHPVDAAMTNTPQDRGAGRPGTPTPRSHQGHQYQNETTPKAWHAQAQDEREKPTPADGTGPNGTTDEGHKVGTHCAATHKAWNYPGHPFRGTSYQLPPV

SEQ ID NO: 978871 - protein, 238 aa, Homo sapiens
MRQRQTTHDRKRTETHTQNKHQEPQKEHKQNEEPPQQAKLHNEHNNSTNSREDTHDPGARTGAARREGKTTGGGTERGRRTEARRKQRKGASGHERERTDEEAETERERDEREEGPRQTKSREENSEGQTPSATERRTQRRAEDREQTDTERREDTGRRETKKEETRKNRKRNRNKEKKKKKKGEKGDERDKERRGTGEQRRRKGRRKKEQERERHRGTREKDEEERRADPSSETRKS

SEQ ID NO: 978872 - protein, 250 aa, Homo sapiens
NPGKGWEPCDCDRSVGRLHDYDKHFTILFKRHSTYYLRVGQPLPLTADLFRETTYKTTHCPLWCYQRSALSTDRSNTAHDLLTRRSHTRRYVAAKFNTTTRSITVHHSNNDLRVDRALTRHTRLDLSMGFTPQTVLSPSHGTLLHYWSTHALSHNAILPTCLPHGFNGGKPRHCSSRSTLGMDTIARETRPFAHPGPLSWVYVGTTTWVQHTAPSSQDTGPFNPPQHAFHVGKKANSLHRSLRRMDNQLG

SEQ ID NO: 978873 - protein, 136 aa, Homo sapiens
MHSLGSDRYNRRIWKIPASRGKAESLVVAKPRGIVDVARNTGMGSGHTERTGHHKARSWNDNQEPTGAVEALHFGGAHYTKGPIQDSDLKLPVTDLAKPKVNEVLTAISRNKDTQTGFQGHCTHSGQGVFTGGYAK

SEQ ID NO: 978874 - protein, 227 aa, Homo sapiens
MRSVGCGHYHGMIRPCVLTCVVPQETRTPENTPWREEVTSLCDLPGIRYRIGSDRGDRRVIASASLLNGRRVKDSGCYGVFVNEFKIGSAERGQVNHSSGGSKHRGRGPKGAGKACDSVCPGHSLSTVCNGTSRDNLVPGFNMPGSQRYQWCWAQTAQTGRHEENRRDVQGWSAWQRMATQKVEKSHTEYYWGSLTVGFPEKDAGMESPGILGVVNNPGLRERGAYS

SEQ ID NO: 978875 - protein, 272 aa, Homo sapiens
MSRYKTVDITHGYSCAVRITDALFHLNKIAFGKQYSLDEPMVQWFRDEHPKEFDKNKLALKRLRHMRPYHWQEYGRALDIAGTSYTEGLHKENVEKSQTALPRLVVLNIGHSNCWSLVVHEMSHLESNRCQLGIYFGEHTTIGTNHNSGELTANTHIGADNVLDIEASTDQRITHNPIVKTRKGTTKPTREAITEPKPYCREYIENKRHNTEDTSRIHRAPRARDPTQATRRDRRRPYDHNKKGHTTERRQTEKPRNKMRQQQRKDTKNGPT

SEQ ID NO: 978876 - protein, 168 aa, Homo sapiens
LRTVVAAAWALERIVSCWLSGWEERREGSAIFRRDPRKDECCQRVSPAWGECVQPPQMTIWDLAIGRQQTWVMNEENTKVLENLWVQEMKEHTGRLDKLRRSQINHLTFRTGEEAPDNNYLNELESQYHATVWTVHYPGQISATFVDLGFSEVRKTMWEQVDVAGDDD

SEQ ID NO: 978877 - protein, 318 aa, Homo sapiens
NSVVATAQTQTSLVLVRLAWLFLRKPVSDQTRLWLTTRRNFDNVEHLNERPRDRNETTTPTCLPNDNDLQQEQAKQRELVNDGVAPSKYALVPFPQRMAILISTFFLAGFTLGKHAHRGRHHSLNDVCCPLSHSPDTTDNARPAPAFSPSVYLSGWQGQDRPCMSVTDDSAGGQTWGGHRHVHIYELKPCWPKAVLSGLVTGTSNQSGHSPLQVQLHSTSWAVAHTFSNYCTSHEVFNTIDPEHATQTDSYGEIWPWPPTTPGTPPARDQATQALPHKGATPSKDTPDTQRRRSHTKHRRGHQRLEKQHEPTRHVAQT

SEQ ID NO: 978878 - protein, 223 aa, Homo sapiens
MWCRGPHLHTWLTKAPVLPGKLPALTLRPGPIGPTCLPEGLLPWQFYTRALQFLATERIEGVDTMYTGRGINAYTWALNYNLPGRGSNTLVATALIYLGALWDLLFMAQKSPPCGPKHRTNHFMGDALHFVAKFVRGRPGFGTHWNSHAQAWEVGYGHTPSANRRTGHLGTPRIPQWHNGLGYTRSWKAERQRNKRCRQRADNGKRSTRQSPAGDSIRGTGHE

SEQ ID NO: 978879 - protein, 105 aa, Homo sapiens
MVRSKADECHQALTANRGGMFEPHRKGAWYLAKLVATRLLTTRFLSRGKSWKTSPILQEGTPVWHAPQTPKMGTRGIGDMLVGCTTYKTLREKRIRFVKRWEGDG

SEQ ID NO: 978880 - protein, 316 aa, Homo sapiens
MLMALPTESSSSGCLAIIANNISTKTIDSWMSDHGAQEGAGDPAQVHSCSTNRLEGAADTFYGIHGHVRFIKRQIWQEITRSDKPPCFSYLCKRGKMEVSEDGTKASAATNCNSHVQDHRRPWEIVDRTLTVVHPSIILQGAVYSWGTINQHPDTSNPQETMQKDTTYFGNAERLPFPDIFHNTWLRYSWVLLAHYKNSFLGDQHMMRTGTSHARTIAGRTHSRIAWTHGHSRHVNTRVPRGPEASTHQSGANVNNRGEPQGDPPHKSSRSQNVACPKTIQTETYTDSSPFQQQTMHTHHSAHRSKPNQSMVASTQ

SEQ ID NO: 978881 - protein, 44 aa, Homo sapiens
MRNKATSQSAFPRKGYHLNEYYTTPTQRTGLATRHKKDLHWRPQ

SEQ ID NO: 978882 - protein, 69 aa, Homo sapiens
DVISYSNTKKQIQACRSSLSAKEVIWVIISGDSRYGRETALITMFRQGRQERGQVVTYPVVSHPEFAYV

SEQ ID NO: 978883 - protein, 43 aa, Homo sapiens
MGYLEEPPEDRKRGAASKKGPRVEQTYPTGTPGGESTNEGRGK

SEQ ID NO: 978884 - protein, 299 aa, Homo sapiens
CLGRLCHRAAISSAGPVAVETSSTPIASSTTSIVLPAICRGSSIVVPSLLAHPSLLSLLHASSSSAFNQVTNNTALPPSATPCWAQVAAQHRTKSVWASRLVAQPASSATPTGQQPQGLAAQLWYHSPRVFWTRQPFVAGLSLVGSRRSSAASVFCFSSAWVQFRACFRSSLFLQFPHPPGQVSLGPLKYQELPVPLMGRRLSQQQETAGGPRNGPAWGEQVGQGRPLVDPVHQSQHLGPGLASHVGRNGRVATPIAEVGQHLRTRGHTQGPGGHRHNPSGGATHNKGSRGSTPCGTPL

SEQ ID NO: 978885 - protein, 118 aa, Homo sapiens
FLSPRRLEAARAREQREAPRCLASPEPCRRGGKPARARTLVGAPGAGLSLLTRAGGLRLSALGSGPRPVQFTPPAPSDSFPSVFILPAPVADRFRNCLQFVRGPWVVFPNFPEAPFFL

SEQ ID NO: 978886 - protein, 112 aa, Homo sapiens
MFKALKNMNWEGSIQDLLGVVFFQVMEIRPYTIHKCVCCPESDQWVEVVMMTGVWGALQSCLLRLCGTGGCKDFSFVTCETIYGCAKSFITFKPLLMVGAGEQGYGFSIKVS

SEQ ID NO: 978887 - protein, 67 aa, Homo sapiens
YRHIDVPMCAINENEVPVAIAGEGQGTSVVKREELFILQANVRGALYHENDACVKIVVCAKTVHSVT

SEQ ID NO: 978888 - protein, 81 aa, Homo sapiens
VPQLFLRPPNNPPPNTNYLILPLTIMEANAISSEPLSLKKIYLSILISLQISLIITFTATEVIIFDIFFESKLSHLGIITR

SEQ ID NO: 978889 - protein, 71 aa, Homo sapiens
AGASAITARRAADTVRTGLGARHLGRTGGTRGMSHDKSFRVSGDNYPPPQPLDIRGVPQANSLPTSMLKSP

SEQ ID NO: 978890 - protein, 67 aa, Homo sapiens
RERKIGERHAVVESQCSLSHGEDLNEIHDDELWVGHSTRIWKTVSRHLRLLSMDRMVELVRNLLGML

SEQ ID NO: 978891 - protein, 116 aa, Homo sapiens
MCGGAALGPRKEGFLRTNRGLGRAAGPEEVYKEATWRRSRGRTRRKFRATKEIGAWEFSPTKLEKRPGGQRTRRVFGKHSPQEGVRRSGHQRGLLTNTGGPEQRPGIIKLRPGGGM

SEQ ID NO: 978892 - protein, 115 aa, Homo sapiens
MKDECGVTFCCKGRTYSRLDSPRECERGRNFGVGKCSVKVGWEEHHLEMVPHIEGYKSVCAELLRDCRKIYTCLKVVKAEQEVKNEGDREGSRISRWKVNLDVEGGQCVLRIDFT

SEQ ID NO: 978893 - protein, 81 aa, Homo sapiens
LPVSVVTMKAVAPLLGPGGSLNSSSSGGEQDYDYLNDWGARVQETLRDMYGGGDDLNFRVNWLVDEYEQFQRDIPNKHARS

SEQ ID NO: 978894 - protein, 110 aa, Homo sapiens
MKIIKWLENVCLNKGHRHWAYLMQKYEGANLSTFLKDVKRNRQRDHFLQFFNGKKNTFKRRLHHTRNSLVSDWLLTNSKTNRTLKIEVILSEHSDIFCFLRSTIIQLANN

SEQ ID NO: 978895 - protein, 72 aa, Homo sapiens
MFDKSTKLRKQNSYEAGTTDFQNFGAGIDIRTPSLLSKPPDQQIRNPFKYHSLSAFIKVNLHKQIKLDDTQT

SEQ ID NO: 978896 - protein, 182 aa, Homo sapiens
MGDKKEPRQGQKRQAETCRSTKAEGIVASAPFRNSADALLHAAICDVSERHLHQKNLGSILSWWHTHSGTHKYATPTPPRKDDSSDQTLPPQDNRQSPAGTGPSAKIQLPSWLTKPVVAASQDPADTQTCFSDGLSTTRNNFSENNYVGAAAHKCKSTVGHYVYTIGPCRSNGSEPQQKNPR

SEQ ID NO: 978897 - protein, 376 aa, Homo sapiens
LLFPWCDSVLRGCSLEQRSFISVRLLSYLSACRHPMERLRLDMDHEPPEAPDTYLFGCELNGRQTTYHLLTVDKDETLTHQITLLTDTGQFTGLVQQDRRCTIGSKQTATDTYRTGSPIKVTLATFENGLYRQKDFPLEEGFENNNTTDGSIRLEDAAFQGPVAIITMRQQHSSQLVGGTACHQSRHDCTARSDSACANLLQVIHLGNQPDLATLEKRELGNEYTHKVTQTFNKICLACMAQTLHGTAMTMTCNDRDCHLHDTALSCNTPEHGHVMAPCTVDGNKTFKRTTNISCHPCCDEDKHLFISAATIQSRGHKQSCDAQDAFHSIQKSVETTVTKNANFLEHHQQLARSGKKTILYRSKLGDNHTPDNTQK

SEQ ID NO: 978898 - protein, 409 aa, Homo sapiens
ALPDSRQHQQLPRARPRCRRPAWREASGQGPATRRQQQTVAYAPKSGRRNRTRLKEQKGKLNTEKDAEAHEKPSREQQEQQRAHHEKGPQETIHRDKKIEPTDDTHTKDTRAHHREKMNRRKQQTKEQPRRTTQKKKRRKWRKTTNNRYKHGATRTHRRAKRHQTENTRGTKVTHPPRLRVTNIQEQPQPAEDQQTEDKRKQKEATTRERNHKGDKANRNKTHTHRREHNERNRKRNTKTTRKNHQYRHTRGCNTAKNRGEKQRERQPPTGAQPETKRQNEEHRREKTPPARRTKPNTHDGRKATKQRTHRADKPPPTVDQQPTDATQHGSEEKKTTKEEGGHTNDGISHTHEETAQKNKQKRTRRETKKINQTQTYNTEEGERHTTPPKGERQQYHAEGDNEEYHAST

SEQ ID NO: 978899 - protein, 86 aa, Homo sapiens
MGSPLNSGLARGYSSFDEGSRKDQVYKAPGPLHVKGRNSKDGGSRVGLRVNRAGGRYRENYPPGADPANMARGKYTPRGGALGRTT

SEQ ID NO: 978900 - protein, 74 aa, Homo sapiens
VSTQSGHYGRDAIPKTYTDFAVTLNVVYCCILSGVDNKSPDIVTYYSGKKESIMAYIGSGLSYDSQLASIGCIV

SEQ ID NO: 978901 - protein, 184 aa, Homo sapiens
MLSRDVDEYLGRGVRTRCSAYYGSGPTKPLLVAPCQSHTDLEHLESILSWQLRKTRPAVFRGGNTAMLLLCRETVDSDIPGCACPDQEYLRWQGPGSRGNHQARGLPEKLRRGTRDAQRSMHDEVTADNFSGRGHGALAVEMSERPVPPNTRDGRLYGAGSRLETARQRQIKRPNLEKKTVGNT

SEQ ID NO: 978902 - protein, 115 aa, Homo sapiens
AVFQSLAKCSKFGDDLYSGCLAAVLGTKLEVQFWHKTVGILPSNCSDIWQVLNVNQIAVSLDQSAQRFKQLQRTTPNVCVSPKGPWTCVGDMNRKQERSNGVWAHLLLPRCQVLW

SEQ ID NO: 978903 - protein, 98 aa, Homo sapiens
TGGQDGGDSSIGRLTRRKSEAVVRLVRCPSTHACLGRWSYAVSWWNYVVTTTIDQACANIANDGNELSLLEILGIESVLKNRYVFVEKYKIVVEELGS

SEQ ID NO: 978904 - protein, 261 aa, Homo sapiens
MGGGAGRPQSEYRSDTSGQMELVPQRDNSGNRNTWAVGFSPHKKTAPRGGDRAVCAKTNTHREGSAEETRGGFTTQGGVTREAQTDYYKNIGAPRGGEYSKLDDTMRADTYTRPTNDRQKSAGEKQHRETENSTKRGNSVHEESQEENRQTTSTSTEQAAEERQDERRRAEGERQRQDDGNERQESTSDDSRRRLQRKRAQRRDMARRGERAERPDVTVAGRAGSEHNADDDRSAESVRELRRDDIDDKCNTETQPADSRR

SEQ ID NO: 978905 - protein, 101 aa, Homo sapiens
MEGWGSQSIRKNDEQLTGGFKQRETCPVEERHGKDLKQNIKAKADEEAIRQPMEESYIENQSSIPQMKKYAGLTAKLKNEEAKGEMKCDQDSVKKNLTKSD

SEQ ID NO: 978906 - protein, 125 aa, Homo sapiens
MVSIDPQKLGAGKIPQPKAIKSVITSSYYGWFNSPEEGSTYEKSSTIFTPLHQDRLLLTMSPDERIFHQWARIPDHTCFSHSFRLQTCVSVTKNIASRKIKTLEQYLPGSGSKESLRGTRGKFCV

SEQ ID NO: 978907 - protein, 35 aa, Homo sapiens
TKNKNPHKIEKEGDCIHIGPSLSEDERSELGARKR

SEQ ID NO: 978908 - protein, 86 aa, Homo sapiens
MYSCKLSRLAARVPERVGTARVSWAARLRPARVSWAAPPRSRGEAPTGRRGPTCLPSASTPGSRSLAPAALVHGADSTAGTPHRGR

SEQ ID NO: 978909 - protein, 185 aa, Homo sapiens
MFKLETVKDKPQEEPTTWTGYFVKVLMASTSYLPSQVTEMFNQGRAFATVRLPFCGHKNICSLATIQKIPRLLVGAADGYLYMYNLDPQEERRSVPMKQAPVCDQSWKRPIEDSWTSALFTTSAPIDHYRTIRASCCKEKALPQDDSGVSSEVGALLLGETESQAPLRSGMKDKRGTRHIDFFET

SEQ ID NO: 978910 - protein, 70 aa, Homo sapiens
PPPPPPPPDRKKKKKRKKGKKEQKNKKKGKKGKKKKEKKKEEGTELNMGQEMESKEYNCKEKLILKVNKS

SEQ ID NO: 978911 - protein, 107 aa, Homo sapiens
VGALNELRTEHRPCTNQLCACNRHLEECPLDSSLCSDHSCSSRAPFQSSTTSLVPVHLRRRPILPPTSPSPSPALAFWKRVRIGLEDIWNSLSSVFTETQPVERIQR

SEQ ID NO: 978912 - protein, 30 aa, Homo sapiens
VPAPARGPPSAPAAPPSPSALSLSLLRVVT

SEQ ID NO: 978913 - protein, 180 aa, Homo sapiens
DTEIKDDAATKDDSPEKKPKKMVVEADIEDIKKTQQRSLMDWSFTEYFQPKVLLQVLQEAHQQYRCVDSYYHTQDNSLLLVFHNPMNLQRLQCEHWNIALHSNVGFRNYLELVAKSIEDWVTQEEAKYQEAKMAEELNRIRIELELKATVKTSASKIPGPKRSKTNKVSSKTELSDQEKD

SEQ ID NO: 978914 - protein, 131 aa, Homo sapiens
MTGRSSSGSCSDPFKRRGKPLADPQSEEMRPWQVPPWPLAARFQHSAPFSSLHLFPAWQLFHWTGPACTWTRLPGLPTPALCIFEPGTANLWNWVGLSLTDWQLGPKRPSSKFHCSESTSNTTSNKAQAES

SEQ ID NO: 978915 - protein, 164 aa, Homo sapiens
KLSAFAAVSLVLSGLLGMVAHMLYSQVFQATANLGPEDWRPHSWNYGWAFYTAWVSFTCCMASAVTTFNMYTRMVLEFKCRHSKSFNTNPSCLAQHHRCFLPPPLTCATHAGEPLSSCHQYPSHPIRSVSEAIDLYSALQDKEFQQGISQELKEVVEPSVEEQR

SEQ ID NO: 978916 - protein, 72 aa, Homo sapiens
MSQGWLGTLSFPLSANVLHPRAPRSTVQGEHEHPQSLRPSPAQLFRGAQNLSPSLALVASHCPPHSAGHLEV

SEQ ID NO: 978917 - protein, 109 aa, Homo sapiens
QEFGTSCPEGEQEPPQLAPSVPPPGTVDSEPRVSPVAPMESGIFPDKYSLQFGFGPFELPPQWLSETRNSKKRLLPPLGNTPEELIQTKVPRVNRVERKMSRNNKVSIF

SEQ ID NO: 978918 - protein, 43 aa, Homo sapiens
VDPNLDLSIREVHRILPVAAIKGVVTRFIEEKSSFEYGQVNHA

SEQ ID NO: 978919 - protein, 76 aa, Homo sapiens
RGGGVVKHHIANANLKAGSLMALTQGPDQRLSLGARSGWRHSPSRSMLTPPWSYPRLVAETFAQKMDALTNKKNED

SEQ ID NO: 978920 - protein, 129 aa, Homo sapiens
NQIDKPHNDPCKKTARYEYEMEDNNQYNQGKNNSIDTCTNKILKRMETIINTQTENTLPPGQFTKTTFYTICKTYSYLPPPLKETVFPSLPTEFLPPRQDPHQSLRQRTQAPAVAQHRVFNKKNKVNKR

SEQ ID NO: 978921 - protein, 130 aa, Homo sapiens
QHQRALPVDAHQAHGPEVPDRQQEGGVVQGHVGPEHFPKVEIGEEEQQHQWRHDQPAMDELVAAELVEHIQEDGHNHDDADHDEGIQHGEEALAHRGCVLSEKSVDELAIILCGEAHRLDGGIIRSTEQA

SEQ ID NO: 978922 - protein, 133 aa, Homo sapiens
KKKENRTKGGKTKEKKGNTKNGRPERKKRPKDEGRRENTQKRNEETPPTPSLTPRDFEKPRPGKLPNLKVTTDGPPDRRLPPNSSHNQRRGPLPKIGTPRVGGETEGGVGDGTRDRKGAGQTVEGGKAGPGTL

SEQ ID NO: 978923 - protein, 118 aa, Homo sapiens
LSSLPRLQSLRVPAFFTESSEYGCVMDDQTMAVATGGGTSSPQPNPFRSPFRLRAADNCMPWYCNAFIFHLVYKPPQGGTVRSAPGPAPRPPTPAAPPVPARRRRGEKKAARGPRRRR

SEQ ID NO: 978924 - protein, 131 aa, Homo sapiens
MPSEVKKPASMEEKDSLPNNKEKDCSERRTVSSKERPKDDIKLTAKKEVSKAPEDKKKVSKAPEDKKKRLEDDKRKKEDKERKKKDEEKVKAEEESKKKEEEEKKKHQEEERKKQEEQAKRQQEEEAAAQM

SEQ ID NO: 978925 - protein, 181 aa, Homo sapiens
GDRRRRCLELITRLRRSLLRASTFCRRLLDGCQCLTNRAYVTVPLLGVPAKSGTDLITASRAWQRCPHDARILGCSLQLFLRARHAGNGVTECGVRPSGLDGALFQFCLRFPCPVGLLCRRHFELGSRFGEVVQLLLALVRARALESLAVCDGLIQCAFGLVEPGFCRRSFQQPPILQRGR

SEQ ID NO: 978926 - protein, 121 aa, Homo sapiens
HSSLSDRARTCLKKKKKKKNLPWVSDFLFVCLVFCLFLTELVLSVKQPGQWLTPVIPALWEAEAGGSQGQEIETILLNTVKTLSLLKIQKINRTWWHALVIPAIWKPEAEELFEPGRRKLQ

SEQ ID NO: 978927 - protein, 109 aa, Homo sapiens
IVTIQLTCIMETSKVSALVRKVKVIICMTGQVLSYGPYLGEEMSEVRFKHSSTEILLSVTGEQYGRPISGQKEVHGMAQTSQNNYWKAMEGIFMKPSELLKAEAHHAEL

SEQ ID NO: 978928 - protein, 127 aa, Homo sapiens
SYVIADMVADGLGWAILPVNIAEFGDLRPHLRQRACEGLALPPLTVRMLWLEGLAPGAEALWMRQRLAELLALMATAERSGLARALRPCSGAGSGCVFGRRALFRSCLACGQHAQGPHGDTGQQRHH

SEQ ID NO: 978929 - protein, 141 aa, Homo sapiens
DKRQGRLAFAQVVAGVLAHVLDGARVVEPVVHDLECGADPAPVFGGGSLGRRIGAREYRAQAGRRLEQLGCLVADHLHVARFVDVRIVHVEELQHLAFGNDRRRFGQDLHHAHLADADHHLERARVEVIAYQHARRVAEQR

SEQ ID NO: 978930 - protein, 127 aa, Homo sapiens
MPMRNAVKNRGRADGRRTYRNCCQREAPMLTRRDLASRSAAAKPSMSPMAIGKNVARAITRTLGSNPKPNQMISNGAMAMIGSVCDTTKSGTNARRSHGEKSTATASSQARTRETAKPTRVTCSVAA

SEQ ID NO: 978931 - protein, 65 aa, Homo sapiens
MSSRPQMYRATGDRDKRASGRKNLKKNKIQSSSCPGHIGLEAGPIMSSPPQMYSATGDGDKRASG

SEQ ID NO: 978932 - protein, 78 aa, Homo sapiens
HLELKPIEDVGKLLDQGAFERVYLCYHVDTVRELAVKQVQFDPDSPETSKVKITAQITLSHYKKLYSLLFFNIKPLPF

SEQ ID NO: 978933 - protein, 125 aa, Homo sapiens
MTKKQGEDGGPVGSRGGGASMTRNNKPRDTEHRKRVHQTRDERGMIKHVDHSKGATGSLSMNKERALKSYHRANICQFSHKSQYPHKPGQREYEPCQLLLSSKKKNDQLFKGVRRVAKGNRHCHY

SEQ ID NO: 978934 - protein, 79 aa, Homo sapiens
SIITITIREILPIQQAGKNMSASVTVVCKQCPLFRKGLNYIIMGQVGEDGRGKIMPNSFIMMFKTKNQKLLDALKNKQC

SEQ ID NO: 978935 - protein, 140 aa, Homo sapiens
MGISVCPYGGGVNVAGVTLQSLNPAIATDSDKEHWKNVHKQVVEGGYEVLNMKGYTSWAIGLSVTDLARSILKNLKRVHPVTTLVKGFHGIKEEVFLSIPCVLGQSGITDFVKVNMTAEEEGLLKKSADTLWNMQKDLQL

SEQ ID NO: 978936 - protein, 108 aa, Homo sapiens
MQVASTLQQPYRKLQYMASNPRTQPWQQGSGNGMPPWGHTNRLLPPLCTMGGRCCVEHLKSSLQDRMPLLSPAPIVPLNARSGGGKREEVGRKVMKTPGHSLNKLDFI

SEQ ID NO: 978937 - protein, 107 aa, Homo sapiens
DSCLVPLSHLETSYFQPEEQILQELNKISLDPELKIGGSRYDLTSLVPGNLQPGTETGNHEVEDAQSLDDLDAFTQETLDRMNCHWSRTQVLPNNISGWRNQRGKLK

SEQ ID NO: 978938 - protein, 106 aa, Homo sapiens
MEHVNGLFHEASTGGVRVPIKLHPIIESVRQGALQGAPHQLAAESHQEEDDVKEDADSQAHIRTVDEGRFFFTCLYTLASTSVGSYFFRIPAYTEGQLQHQPRGTS

SEQ ID NO: 978939 - protein, 65 aa, Homo sapiens
NVFPNQTEGKRLLQTPGFLKLLLNAPPKNPNYLPLPKDNQDPIHPHSSDPHPGPGLKGFQLPSYP

SEQ ID NO: 978940 - protein, 102 aa, Homo sapiens
MGVDTYVPPPFNPDMFSFDEKLCSAPAEEREVGQMKLLINLIKRKPQMTEEQIKTIADGFTAMVDKCCKQSDINTCFGEEGANLIVQSRATLGIGAYRHGCQ

SEQ ID NO: 978941 - protein, 168 aa, Homo sapiens
AVVVHINAAVQVHGVRGAWLVAELAAVTEGVLGKIVVVVHVGGGGPHENAAVNHFAHGVQVAAFLQVQHLPTHQGWGARVAGCLEGTEHGIGFDGDVIVHVQDVGGLFCGCLSSAVGATHGLIHDAGVAAGTAEVTLLVHEQPTFEMLRSIGEAWFVSPRSAREFSSS

SEQ ID NO: 978942 - protein, 92 aa, Homo sapiens
KDKPTYDEIFYTLSPVNGKITGANAKKEMVKSKLPNTVLGKIWKLADVDKDGLLDDEEFALANHLIKVKLEGHELPADLPPHLIPPSKRRHE

SEQ ID NO: 978943 - protein, 186 aa, Homo sapiens
MSYVDGCVIAVPTANREQFIRHAKAAAVVFKEHGALNIVECWGDDVPKEQVTSFPMAVKLKEDETVVFSWILWPSREVRDAGMSKVMEDPRLKADANPMPFDGQRMIYGGFELILNTWGQVFTDGRCSLIACCRVGPTTEPMQDRYENSAKQGHDAICLKNRRVDNPAGWAKFKVDAAANLVVVVD

SEQ ID NO: 978944 - protein, 30 aa, Homo sapiens
EVYMWVGTQTSQVEIKLSLKACQVYIQHMR

SEQ ID NO: 978945 - protein, 175 aa, Homo sapiens
LQVNSRMEPESIEICPYNPHHRIPLSRFQYHLASCRKKNPKKAKKMASCKYNACHVVPIRKLAEHEATCVNRSSVEEEDTLGPLQVSLPQPQNQDTLQVRWLSNPDIWNVDGANCHPMFVLKILFPKNLFVKVTSKSHGEETNAQKILRLGPGRQTSSRRKRALKCVDGSRISSE

SEQ ID NO: 978946 - protein, 137 aa, Homo sapiens
NEINPECRGMEWNGMQWNGIIRNGMEWNGMQSNGINSIAMEWNGMERNTLESTRVEWNGKDWNGVEWNGINPDCRGMEWNGMQWNGFNLNGMERMESTRVEWHGLEWNGMESTRVQGNGMEWNAMEVDPAANLVVVV

SEQ ID NO: 978947 - protein, 116 aa, Homo sapiens
TDSSAQTAQTVQHRQQSTTQTAQQSTAQQRQHSIAETEQHSTAQTEQHSTPQHRQNSTDSTAQHRQHSTDSTVQHSTAQTAQHSTDSTTQTARQSTDSTAQTAQVYPAANLVVVVD

SEQ ID NO: 978948 - protein, 37 aa, Homo sapiens
HSSFDFHLGPLAERPRGIVTLLTVVTVHAAANLVVVD

SEQ ID NO: 978949 - protein, 79 aa, Homo sapiens
SPIHLYVTGPPVPVEAENGSHVLLTQLEVEDLERQEFQNHHLASNLFDLGNLHYYGVFWLGTRRRKRAGVKITMATVCP

SEQ ID NO: 978950 - protein, 121 aa, Homo sapiens
RWHLWGIRGRKVPLVNLLLGLYPVTEGAIMVAGNDISQVTPDALRRRIGVVFQDPALFSGSIRKNIAYADRFIKRFSQQYDTLVGERGIKLSGGQKQRISIARALLKDARRRGREFSSSSD

SEQ ID NO: 978951 - protein, 110 aa, Homo sapiens
LSLRGCCQDAWSLSGKQQVAKENQQVAKDVTLHQALLRLPQYQTDLLLTFNQPPCHSRSLGPENLSCPPWSLSNFEQLVTSLTLHDPNLFGPQYKKVETQRATEDSGTQL

SEQ ID NO: 978952 - protein, 36 aa, Homo sapiens
HLPLTHSTLSTPSPVTHSTLSTPSRRRGREFSSSSR

SEQ ID NO: 978953 - protein, 136 aa, Homo sapiens
SVCAVVCCAVLSVLCCAVLSLLCCAVSAVLCSAVLSVLCFAVCAVLSVLSVLCCLCCAVLYCMCCLCCAVCAVYAVLCCAVLCCLCCAVCAVLSVLCCLCFAVLSVLCCLCCAVLSVLCCAVLCVDPPANLVVVVD

SEQ ID NO: 978954 - protein, 122 aa, Homo sapiens
RRYIQRRIARMLGVPRITVRMLSDPFGRRVPIRGDRDKAVIGAHQVQEDRFIMNNVLRNPFTTAPEVRTRLFEVRNLSVSERTARRRLPERNLTAFRPARAPELLTQHRRGRRGREFSSSSR

SEQ ID NO: 978955 - protein, 94 aa, Homo sapiens
LLQMKSTFEKKMQRQHELSESCSASALQARLKVAAHEAEEESDNIAEDFLEGKTEIDDFLNSFKEKRTICHCRRAKEEKLHQVIAMHSQFHAPL

SEQ ID NO: 978956 - protein, 114 aa, Homo sapiens
MALWPTFRVEVMYHVWPLVGGWYTCSWHTLAEVAGCSLSQLGLVQHAQASVQQLCYKWSHREETSSRLRNQVCAAFGAPVHASGVVWHCRLLGCQEADQQDGVDTPANLVVVVS

SEQ ID NO: 978957 - protein, 66 aa, Homo sapiens
IITTEPQVTLDVAVLGTGLRKSNYETKVMEYPPSGRNTEQLIDSFFAASQTTKWPINQENQRNQIR

SEQ ID NO: 978958 - protein, 138 aa, Homo sapiens
FAFLTLGGPASMIGFAIARDYNPLSRVGTATGVVNVGGFLATTVTALLIGILLQATGGNFRIALLVVVAMLALGASRMLVWWRRARAHVFAAEARGEEVPVRIRRHRWDRAPEEAVAAALSHPRRPGSTAPSMRPGRP

SEQ ID NO: 978959 - protein, 101 aa, Homo sapiens
TRRTRARAQAQPEMADSDPGERSYDNMLKMLSDLNKDLEKLLEEMEKISVQATWMAYDMVVMRTNPTLAESMRRLEDAFLNCKEEMEKNWQELLTETKRKQ

SEQ ID NO: 978960 - protein, 146 aa, Homo sapiens
GLESCELVELAWNPLEGVSRRTASREAEHQQDYYSDWDHYSSFSIFNKVAQSLSGNGCWKLAESLGLSAAPTAQNMLCIGLASPSILNGHKSERFKRQENASHSLNCGPGSGERVTSIILYCSHNDFQQIGVEGMFKSYHNIGPNV

SEQ ID NO: 978961 - protein, 109 aa, Homo sapiens
MSDTHVPIREGITPHCDAGTPHPQRIMRSFNGWRSGDIEAAIVWMPGKIGLDLFTGSDIVRFHTGIRITDIRVLVHVIGRCQRNTRCHPLITGRITVDHGFRVRISRRD

SEQ ID NO: 978962 - protein, 140 aa, Homo sapiens
GCGGVGSDRRFGRAWRVGGRKHAGGACRGCQRAACLERCDSVGTVVRERGRGSVMPGSQVSGVHDPAGAAPATGASQPRPSSLQQLLALKNRVLMELQKHGIGKQATTTGVAPAPAPVPAAPRPAANDTSAPAAASTAGE

SEQ ID NO: 978963 - protein, 138 aa, Homo sapiens
LREEGATRRGRRPKSDIAKAAAAAAAVASTSGINPLLMNSLFAGMDLTSLQNLQNLQSLQLAGLMGFPPGLATAAAAGGDAKNPAAMLPLMLPGMAGLPNMFGLSGLLNNPITATTGNATTASGQGETEDGASKAEEK

SEQ ID NO: 978964 - protein, 72 aa, Homo sapiens
EEEEEEVKEGQLQPPEFQAKRPDSTRRSQNSGGSDSDKILPDRQRTRNQVSSAQSQRDGILNLIKIRLLKPK

SEQ ID NO: 978965 - protein, 81 aa, Homo sapiens
TRQVAQAGTHSFGRTSAQMDPEMSPRTLFGTLFGKKADCNLGRCRQGRGESQMPPCPLPLHIRVLCVLCRLIYSLPGLEFR

SEQ ID NO: 978966 - protein, 120 aa, Homo sapiens
RNSARGKTEASEPKKWTGTQFGQWDTAGFENEEQKLKFLKLMGGFKHLSPSFSRPPSMTIRSNMALDKKSSEMLQQSLQQDYDRAMSWKYSHGAGLGFNSEARKVFYIDRNASKSIKLQD

SEQ ID NO: 978967 - protein, 145 aa, Homo sapiens
FKVGTEEDKYRLTYAYFIGGEAGDAFDGFNFGDDPSDKSYTYHNGMRFSTFDNDNDNFEGNCAEQDGSGWWMNRCHAGHLNGQYYIGGVYSRDTGTNSYDNGIIWATWRDRWYSMKKTTMKIIPFNRLSIDGQQHSGGLKQVGDS

SEQ ID NO: 978968 - protein, 51 aa, Homo sapiens
FTKVEMYNLFNAQTSGIEEPSETKGCRKKANSNISGFLNDEDQNKGFVINL

SEQ ID NO: 978969 - protein, 142 aa, Homo sapiens
QRPDPGQLLQLQHLVGLQLLHLLCHLCRARLHLQQLRAHPVLAPVVERGQFRPLPVDLRWVHAVLLVQPDDGFGAALGARAHVAGVEPVLLAQAQRLAVQEGVLSQHLVNALLAGVQLLREQRVFALQVTARAPIAAARHPR

SEQ ID NO: 978970 - protein, 55 aa, Homo sapiens
QRAWGEIAPADRLLLMIDDSVEAGDEWGDELREILRKLPQGLSITVVRNKIDLSG

SEQ ID NO: 978971 - protein, 73 aa, Homo sapiens
QGLEPHRPRTLQQTEWPPSCAILGHWAHRVSNIRDLGTQAPVLQECPAHAPPPPISLPFGKDSLLSVLKILFC

SEQ ID NO: 978972 - protein, 106 aa, Homo sapiens
RRRRHQHQGVATIGHALNNGTLATTEAVETKNVFEDALSLFEHNHSKNHQKRLFKGWLKIHRFHEKNRKQAFPSGPEGQQRITKRGSIPERPTAMGGAGRLREFSR

SEQ ID NO: 978973 - protein, 38 aa, Homo sapiens
GILTSGTAAAALCFESANVICQSEPLCSPSWCKKDTES

SEQ ID NO: 978974 - protein, 169 aa, Homo sapiens
LLRGECGQWRAFASRDRKAMVVWANTGGAGQAMCPGWTLSLPRDHTQPQPSPGPHPWTQPVPNPALHLALALGTLIVVCDLEAHPQNGADVLLLQGCMHRPQTQGGPRGILSQHGTAHIQDTSHNHCPAPQPATSPSAPRLPGGHAMSCPGAVHRDAQGEGGCSRCCAA

SEQ ID NO: 978975 - protein, 75 aa, Homo sapiens
MRSIAPVVRFSFGLTVKEAHSEKRIMGSSQGIRYPVARSKVPSTRHPLGIGHSFSPGPRYTRRGKGAAGSPTLRP

SEQ ID NO: 978976 - protein, 50 aa, Homo sapiens
PSRISKPMGVCDSLGGGIQEPKRGGRQAGGKGGAQVEGYYEIASIKPVAV

SEQ ID NO: 978977 - protein, 40 aa, Homo sapiens
RRKRCGSARRPLTFDLRLILSLQPPLPPQLTVSGHGGLAA

SEQ ID NO: 978978 - protein, 52 aa, Homo sapiens
MARGKPKEEGSWKKFIWNSKKKEFLGRTGGSWFKILLFYVIFYGCLAGIKCS

SEQ ID NO: 978979 - protein, 152 aa, Homo sapiens
MSVWSSTAYRSHDVKTSHVRQLERTNSVASPRKGSPSATERSESPDTQHSADEPGTRNASEMSQTQQAKMLRNSASVKKQEQAVAQRQEVDSGLSGAGAGVGGQLLNGTGSAKVLDLEEVVVAQHGECVDVAELCTLIQLIVNFKLCDFYLN

SEQ ID NO: 978980 - protein, 40 aa, Homo sapiens
RGAGRCMNLEFGELRWIRVETLQACVEGAAFGKYAGVDLM

SEQ ID NO: 978981 - protein, 42 aa, Homo sapiens
MVITTPSRAGAARFGTKQSDIEMEGEPPEAAQILNKVSTTPG

SEQ ID NO: 978982 - protein, 87 aa, Homo sapiens
PRIRHEGKRRESMSFNIFPMNVTISYGSLTASNKLALNLSKNKRMPGEPTGLKEELNDKHGYNGNQGSSEDFGLRNLLTITLSAPFS

SEQ ID NO: 978983 - protein, 60 aa, Homo sapiens
LLILSGKDVPLTCKYLVIGLLETISRGYVHSHLPVVSPVMEQILKEALGSAWALKGQSQL

SEQ ID NO: 978984 - protein, 152 aa, Homo sapiens
MWRYIHTEQLTDTNYTTTIGIGLEPRFGTREELLLIDQQRKWFLEMKSTTGEDAVNIVEMTTKGLEYYVNLVYKVAAGFERIDLILKKFCCEENALKQHHILEQTLLLKEESINAENFTVILRDCHSHLTFSNHYSDQSAAVNIEASLSKTQ

SEQ ID NO: 978985 - protein, 110 aa, Homo sapiens
MQPLREPRPGSSPSPGCDSLFEVLWFLVFAELLNTTTFPGASWGSWLPCTWSSHSLTESQCLFQHLELPAPLQQPACLTVCSGRTPWLVVHTPPATPHLVHPWQVWDPGW

SEQ ID NO: 978986 - protein, 130 aa, Homo sapiens
PRDPEAQPGPSAVWEPLRPLCGAGGKRPRGLLGILTRVRTLEPALVSPTGRAWEGTVWPGASSVPIGLRESKAVALNFSPKLLCPESGKQEVVATGKEESALGAGQRLQAPRPCPSHASPGTVNHPPTQL

SEQ ID NO: 978987 - protein, 90 aa, Homo sapiens
ILDAIDLSEVARAEVEIIHPCHLSWIDQKIVRVHQQDMFLVPKLRNSHSGLQSNYVQGLPGISHVLKLQMRTTLQCLTESCELKQAFPLL

SEQ ID NO: 978988 - protein, 98 aa, Homo sapiens
RHEGWSDLFLELCPGAGLGYWRGCSHLSATLGVHNSLLWFRGSKPSLESGPPAARARSWPFPLDCRGRTVLDLGVGSLGVSLGVLALWEEGSTYSGER

SEQ ID NO: 978989 - protein, 74 aa, Homo sapiens
MDNTWWGIRLPDSIPGSLYHGVWMLKTWSHRWQGPAPGESTSAPSVLGSGAHRACSTKGHSEDLLPRDPGPERG

SEQ ID NO: 978990 - protein, 72 aa, Homo sapiens
VYWNMSCAPIFSETTLINRVCDLHTLDIVRFVSAARAELVTCWVFSHPSWPKMFQFFSVYAACEIDDYGTQK

SEQ ID NO: 978991 - protein, 116 aa, Homo sapiens
SDLRLKPDYGDSSTDQEATAWAPELTSSPCTDEERSHETSAQSGNRALFVTSCLSGGPVMKALPDWAQGIQKGQLVFAIVCCFSITSSPKQHWMNASRGSHNSFQDLVTIVSVPVQ

SEQ ID NO: 978992 - protein, 85 aa, Homo sapiens
ERLMIIELKMKILENQIFIRWNKMNLHGRSDIQQSFVLKKHRMRRHESICSTLTELYIDFPQLMSLRRGDLYRYWRFTSLKPSHR

SEQ ID NO: 978993 - protein, 66 aa, Homo sapiens
AHLCSLGSWAALLARAVVTGLMAISTLTLYVAVINVHSRHDVSDNDVPSIPASLQILVKKTVIGNV

SEQ ID NO: 978994 - protein, 57 aa, Homo sapiens
VHNAQNLMQSVKESVREPEAESIKIGTDAGYTLRWLQKDSLVPVGTQLGLTGTESST

SEQ ID NO: 978995 - protein, 68 aa, Homo sapiens
CYLRDKVVVGTLLWNIYNRIPIARKIIMDGEQHEDINDVAKLVNTHEEMKPHCGIGKRSTSPERRLNG

SEQ ID NO: 978996 - protein, 128 aa, Homo sapiens
RLEGRRPSKGLMDVTSQGFAYHTDQSTGSLSLTTAAKGIPSTLLPDTWAHPRASCGCPVTALPHCPGTFFRGAVLPAFRTAGGVGGGLPSLSLTFHADGPGAGLSRGCIVLGVTSTYYGSLTLPTGVL

SEQ ID NO: 978997 - protein, 110 aa, Homo sapiens
NVRLEEEIAGWRRRRPPREVTVGPDLPPWGPDLGLGAGIRGTLFPSWAQRGVRTEVPSQDSPGSCELPSGEHVSPKPWNDCFKVRKGGQGRDGGRFWLTERTHKIMFLPP

SEQ ID NO: 978998 - protein, 95 aa, Homo sapiens
ARGDSVRQTQEYQRIMDINSRMEQVIATYRSLLVGQEDLDNNLSTHKAFEAAACAVCAVNWRVSSGSRDGKEGTITPGCSPDLPIKIYASREKKK

SEQ ID NO: 978999 - protein, 43 aa, Homo sapiens
MACWGQHWKLFNGQTATDLLKPVGFAVCHMSLEDRKHDILLSL

SEQ ID NO: 979000 - protein, 89 aa, Homo sapiens
RHEAFLHFTGGNHELCVSSAPGHVVMLDEPTWQELRAPLGAEVVSEQQEIEAFSSNNCKELNLAHKMSELGSGSFLWLKLNANLASQTP

SEQ ID NO: 979001 - protein, 44 aa, Homo sapiens
HCKANYARQTIMQVWVSCMMCSLSCSRLYGCQTSIDGSRNVIPG

SEQ ID NO: 979002 - protein, 143 aa, Homo sapiens
PLHPGESLPFHSVYYEDEYDDTKDGIQVVPNDADFDDEMITRRPFTILQVLRSKVPREGQEKDDDVEEDDADEEPPKPDHFVQDPAVLREKAEARRMPFFSKKGHRHDSSTAVAGSPRGLGQIRETTQRRPGVCLFVGLTLAQ

SEQ ID NO: 979003 - protein, 85 aa, Homo sapiens
RHEGRSQALLRGEAAEAQREFERGASGPEVLWYPVHPPQLLARVLSPSLPRASGTSRLLQVRGLVSPAELELVLAHECHAPLLPP

SEQ ID NO: 979004 - protein, 175 aa, Homo sapiens
GTRLAGRFDARYKILLGLGLTSLSLWEMTAFTTDISACDIVRTGVIQGLGLGFIFVPLSTMTFATLAPRYRNEGTALFSLMRNIGSSIGISVVITYLAQRTQANHAVFSEYIDPASLAVRQAVESGAMDLGTPLGLSLVDAQVTRQAATLAYLQDFRLMMWVTLSAIPLLFLLRP

SEQ ID NO: 979005 - protein, 65 aa, Homo sapiens
QVQLVHVGGVLDAMVATKVAPVSTRQHAQIGDVLPQDERWTARSPSTLDRHIGARHRDCIKKATA

SEQ ID NO: 979006 - protein, 37 aa, Homo sapiens
MQIRNKAGFWHMDMVSFSTVAKFMNQPVNVETHVIAS

SEQ ID NO: 979007 - protein, 55 aa, Homo sapiens
YDRTDETDAEECDPEESYSTGVTTVSIFHVLVRPNSIDCKFNSVYVHINKHISSP

SEQ ID NO: 979008 - protein, 34 aa, Homo sapiens
RQQWKMRHQMEHASSTLQELLGECLVVILLNECP

SEQ ID NO: 979009 - protein, 113 aa, Homo sapiens
VFICIKKKEAGSWPRLLSQKTKCPWLKTDFNRWKDEDDSEPDMDGNNFSNMLSQMSNFGDYGGDDGIDGHLDSDDEDLPDLEMPNADANKSEENGTEEEAEKKTPEKEASSAN

SEQ ID NO: 979010 - protein, 81 aa, Homo sapiens
FGKLRHESGSPHAPPHHSPTGSNARAPLDRGGGYEVDFLRLVATSHQHHYTGTETPPLSQRQSDTGHRSRDPTERKRAASG

SEQ ID NO: 979011 - protein, 39 aa, Homo sapiens
WQMEICVRRVPQQLSEGTVCSSDGNGPGLNNKQSQLHGG

SEQ ID NO: 979012 - protein, 130 aa, Homo sapiens
DRAVPLAVMTRNRKAELRLCNKLVALLPTLEEPQERFEFAHMALALSITLPDRLNERVAYHRMAAMQHRLGHGELAEHLYLKAMEICNSPLELDEETLSDVKVYLVLGDSIYDLKDPIDAPRKKQNNVGA

SEQ ID NO: 979013 - protein, 149 aa, Homo sapiens
HTCQSLPEPHELAGKSKGLPTYSAFASLLQGAHLDSGLGQGAKHTFEPHRSLVPPMAEQFGVERRDDMRGPPDAVGLGDQALAHGIHEVADMDVDGSVGTLGVVRRLGFRCHIASGNPRGLKAGVMVVGVKSRRRHGRDSRTSVTTPGN

SEQ ID NO: 979014 - protein, 69 aa, Homo sapiens
NVQTWTREVLSSCSFEVLLNHHIHQQWNAKSRTNRRKPAAKPGQFQSPPQIQDCRNGQEENHPLLRLLL

SEQ ID NO: 979015 - protein, 69 aa, Homo sapiens
GTRGAPPFRDTDGTHLIRITDYMTLSSPRVARMQGGCWQGWFNTDDVNRLKTMPGPQLPWRVVAMGLLS

SEQ ID NO: 979016 - protein, 125 aa, Homo sapiens
RHEDRINYDWGDDVDSTAAPASRGPSASVFLRADPCGYKRAHARCGVRVQVSEPASTAESTLLCPGDHPRFLTVWPLGSVAAPLPPSDLSSVVAACSGAPRAHAEHQEVNLGSNSPRGLGRCCPF

SEQ ID NO: 979017 - protein, 84 aa, Homo sapiens
PAGLGGLALEAMWWANSETEASLGGTEVPEPSCTHAGRVPYLRSFLGRTCVVRRETGARGKEEPVVPGRPADARLGMNKEAFWL

SEQ ID NO: 979018 - protein, 36 aa, Homo sapiens
RLQAFGLTQAWSPSKNLALAGGRTHGTLNKDRIEDA

SEQ ID NO: 979019 - protein, 43 aa, Homo sapiens
SRLSAEERQREEQLVSFDNHEEWNQMQNQEDEVSITEQDMERI

SEQ ID NO: 979020 - protein, 77 aa, Homo sapiens
MAAASEVLIMNPALRQTTLMSSYINVLRIPSEPPAPVVHKPWVWGDGVRTHHLISLTPRHRLGFCVEVKFLLNVSFQ

SEQ ID NO: 979021 - protein, 137 aa, Homo sapiens
PFLTPPPLALPAAVQVAVGARGEARGAWTRFPVAVLAVFRSGEERARRGSSALWVPAGDAACGCPRLLPGRRYLLLGGGPGAAAGGAGGRGPGLIAARRKPRATLEGRVDAAPAEAAATRTAGALQRRLSPPAGQGG

SEQ ID NO: 979022 - protein, 141 aa, Homo sapiens
PRRRQRDSLAQRQTVRVGGGSRSSGIRDERRFRESGSPGVEGSEMKAGSGAPRRRVRCLGNEDPRWKGAPGSVSGAPRRLLSGREPRVGVGKLFVKFRKGGDTACAAARATESRESPPPRRPRNGTPGATHAIPWRAGAAA

SEQ ID NO: 979023 - protein, 48 aa, Homo sapiens
MELRAALVLVVLLIAGGLFMFTYKSTSEKIFRFQDTGLLLRVLGSLFL

SEQ ID NO: 979024 - protein, 129 aa, Homo sapiens
FPCPAPSQDNHPISRAAPALPAAVPAWCLSPGQAAPAAPRPSPSPSPSPSPAPAPPFARPGTSLPGKGRRGPLGLRQGAQAHRVGCVGQGRQPRGDLAGAGGRSWRREPGRQGGSCGGSARGRPISMRP

SEQ ID NO: 979025 - protein, 85 aa, Homo sapiens
RHEGPVGGKRLHHVEDGGLVQRPALDEIQEGFLRLGRRRTAQALMVHGHTVARYVRHEARRQTVRRYGPIVLHDVGTVAELKLSL

SEQ ID NO: 979026 - protein, 53 aa, Homo sapiens
MVTVLKEMFRYPCLSSPDWVIIETQEQVTTVFDHRRHAHDGRRTAQVPQPCSL

SEQ ID NO: 979027 - protein, 61 aa, Homo sapiens
MPANMYRVGDYVYFENSSSNPYLIRRIEELNKTANGNVEAKVVCFYRRRDISSTPSTPSRA

SEQ ID NO: 979028 - protein, 163 aa, Homo sapiens
AFDNRVDAERLDGLHTFHPAHRAECLAVQRIADAVGIGFHRHIDVVDHRDLRLGKHRIGELFFQTLGSRLHEAGMERCRHRQWQGALRTVGLEHLTGLVDRRLAPRDHGLRGVVEVHRFHHLQSAGAKCGLGLCAASNHALGVHAEDGGHGAGTDRNGFLHGG

SEQ ID NO: 979029 - protein, 138 aa, Homo sapiens
SEPELAPSTSVKVLYRLQLDGHADWRAGEGRLGAPGQVQVQGVCVIPSSAPSSDAAMQGQGTMGCLWDLPTLFQDPKAAWGAGKRTACEPGNAGHERAKLDPGDRENDPQGPCSAWAVSELSQRPGCLEAVIHRKVCG

SEQ ID NO: 979030 - protein, 57 aa, Homo sapiens
PRVHSRSPPVVAPAPKASGSGGRQGSVWRFALAEAQTWVRSLASLQLPSPPGTYPAA

SEQ ID NO: 979031 - protein, 67 aa, Homo sapiens
GTRVIGVVRAGIQWICGTVTLLDDAAIIHEVRGALQGYLQVMGFTSVLMPPEAMYHVPERQAGRLRT

SEQ ID NO: 979032 - protein, 113 aa, Homo sapiens
FFPFFFPVPFIFHPLAPNWGEAPPFGFSQTGFWFGVPWPPPAPFPPWIPRPRKGGELFFPPGGFLVATSTGFLRSRFFPRPLKLLKLNFVKALRKEKVKGKLEVGKEEVKRAR

SEQ ID NO: 979033 - protein, 104 aa, Homo sapiens
RHEVGARLRGIPETLGQVAKPLEKYPAPSKEEEVGVDGHSEAPEKAAQVGLLFLKLLGKVEIVKNSLVALAWQTALHHLPGPVYIFPITHSLEHPWPTPSCVCW

SEQ ID NO: 979034 - protein, 123 aa, Homo sapiens
LSRIPFDTCVAFILSYRLLVEPHHCWMLFPSCTMMQSPVLKLSHDTDSSLARTTRRPLTWMSVCTTTYLGISFVNLADYTSVFVMQARLEVAEEGGRLEAMGLMLVHGPAVELLCHMHGEVGG

SEQ ID NO: 979035 - protein, 131 aa, Homo sapiens
RERCCEPMRMCSRAPECGGGSQSHIYGSFVCAVFSTHCESCGGYLVETVSICHNIYVPRKYLHTQPCHEDPYTEVVSVILPRGETHVAREPRDGENPTLTKPLSCVTQGAAVSTKFFCVTHCGAQRNPTSR

SEQ ID NO: 979036 - protein, 46 aa, Homo sapiens
SGPSGPRGPNKMLLMMALACASPFPEEAPGPGGAGGPGGDLGGARP

SEQ ID NO: 979037 - protein, 97 aa, Homo sapiens
MSEADYHRDAGTTDLRPPLTETIDPRTTALRPPLTETIDPSTTALRPPLTETIDPKTTALRPPLTETTDPRTTALRPPLTETIDPSTTALRPPLTET

SEQ ID NO: 979038 - protein, 135 aa, Homo sapiens
ILPLLSISAPCICRQMLKSAPTQPGWQLPKATPRHCFSPSRLLCLPPSRASVSSSQFCPHSVSLFALVCGQSPGRATGNSSCPRSFPSSCLHPSHATNPLLCGNAGGSPAHPTSFPSSCLHPSHATNPLLCGNAA

SEQ ID NO: 979039 - protein, 149 aa, Homo sapiens
RFALLAGNLGRDAVQIALALAGELAATVRVPLDHLDGFEGLDGLAGGATVGPAEVGRSHTVALAATVDAADRPDAGRAVVVQAAQDRGTADVEPVRVGRGQLLELGGLDQIHILRHLQLSRLLEEKGNTLNHFVLINVLYGDSRHLHCG

SEQ ID NO: 979040 - protein, 102 aa, Homo sapiens
SYWPLASPHACQTEIPFPLCSICRHRPTFEGSIQQHFLGNPFLTSQGIGTTPFLQIPLGPPAYTYVTWSQACLPYQTWAPWDHSNSLQTDTGSGPKEELHTH

SEQ ID NO: 979041 - protein, 130 aa, Homo sapiens
IRHEESTPDELPSDAEEQLRSGDQQLELSGRRLRRLPSAVCALSRQKLYVSGTGLRELPEEIEELRELRILALDFNKLERLPDGLCRLPRLTRLYLGGNRLLALPADFAQLQSLRCLWIEGNFLRRFPRP

SEQ ID NO: 979042 - protein, 73 aa, Homo sapiens
YWNREYRQQESRLVMSPAGPLPPRALPLVWIRGDLHFEEQYGLGASNVHSVPSFTISSMITISNSNSNSNSYS

SEQ ID NO: 979043 - protein, 65 aa, Homo sapiens
HEDLPHDCGNPKRKSICINKISEKFIHTTPVPPRCRHPPRECRPAGRQSSVRTQRGTAGARVDRG

SEQ ID NO: 979044 - protein, 121 aa, Homo sapiens
QQKRRGGLDPPPERPKKLVLISHLNPSTLTPSTSLNPHGFHSEAPPPGSVTIAIPRQAPDDRCHLRQPGRLEEKGGAGWGGDLASANQQGRLEAAVTRPGRFCRRRNHGLGARLWAAGAGG

SEQ ID NO: 979045 - protein, 104 aa, Homo sapiens
PNLPFPLPKVNLVGPPWHFPPREGEEEEEEEGGRGKEGVGKPEGGEEGDLLPLDGSPGEAKPQVRGFFFPRSSPAPGAPKSRLEGSGGQASSGFGVGGPLGPRG

SEQ ID NO: 979046 - protein, 63 aa, Homo sapiens
MYSKEVNAMGPPPPAPRPQPPPLQPLPGFFSRGDAESGGDSGSGGDGGQVRCARGTELSIAGG

SEQ ID NO: 979047 - protein, 153 aa, Homo sapiens
MASSWAETAPGCDGAAVSRYGFLSLWEGTSPHSPEPQLEGHRARQAGFSHPLTLSPMGPGAAVNCAFSPPPPPTLEPPTPLLPALAAPGEEGAGSWQPPQPTPYKAWARPQARPRPARRRPQALPLSRAAASPGPDQSGGIAMLLRLLLAWAA

SEQ ID NO: 979048 - protein, 61 aa, Homo sapiens
ACCHTIVGDRAMWITTAADPRMAILKLLENNPIRLMIINVRRLCEKLIPLKFSHLWNSVTR

SEQ ID NO: 979049 - protein, 44 aa, Homo sapiens
MRDRHRHHDEHHQHTESVTTSVIGCRGSWDLSCRRVNITFKRGG

SEQ ID NO: 979050 - protein, 56 aa, Homo sapiens
LAGVMKYRVLRGLRHVWGICVRDRHARTIGRRGRTVGVTKKKKVCRPCLVINSFYP

SEQ ID NO: 979051 - protein, 142 aa, Homo sapiens
GRLQNQAGSRCVGVYAWMVDRGCVWGAALWGLELQSPSFPVRDPLKGLRATSHPPLAKGSREMGAGTLGSGLWGWQGRARERPDLPFARHRGPQERACGEPGADGPLGARTSGGVGFAGEQSPLRYLGQADRGGGAAPCSPR

SEQ ID NO: 979052 - protein, 48 aa, Homo sapiens
IPPLRGSTEWGRRRGEKGRGGRGRRRRLWTRAGPFPWITTQMRRASRP

SEQ ID NO: 979053 - protein, 119 aa, Homo sapiens
PRPRRGGRDFGGPSQFCPPCPPGFPPPVAPGPPWVFPAFSAFPGGVEFVLGGAVTHCPPPLSPGGPPRVPPPLPPPSPRGPWRAPPGELPEGGGGPFGNVASPPWPVAPGTPGLGGGWV

SEQ ID NO: 979054 - protein, 137 aa, Homo sapiens
FHVVQGEVHRVAPELGLFRNHPLGFARAAGVELHRQDDALAVAAHDHEGFRHIALLVANAAQETFAQEVLHVHRLARAQKLRSNTVWAIVSSSSPPVLTWKRQSSMPLSQPEYTRLKSSSFSATTTTPPAKSLYLRP

SEQ ID NO: 979055 - protein, 96 aa, Homo sapiens
EGGEQVFIIQYDDLRIHSERIFQWWGDGDRRGGINTVRLLMCDVRDSYWCGCLYPCQMHGDYDGAFFFNYFENFLSVTFTCLYLNQENPCGFCGSV

SEQ ID NO: 979056 - protein, 76 aa, Homo sapiens
AGPTPLQPQVSAPRARPDPPAATASCEPLRQALTVKKTEQSCSHGAMAVRSPSQAVLCAPAARRCPPPHSRGARRP

SEQ ID NO: 979057 - protein, 160 aa, Homo sapiens
EFVQEFMEAAVRRFGRNCLIQFEDFANSNAFRFLDQYRHDYCTFNDDIQGTASVAVAGLLASLRITRTKLADNRVLFQGAGEAALGIAQLCVMAMKRDGLTEEEARQRIWLVDSKGLIVKDRPTGGISGHKHLFAHEHAPVGTLLEAVRELKPTILIGAA

SEQ ID NO: 979058 - protein, 120 aa, Homo sapiens
PRIRNEAELCESLFGRLGPDFAGDRAAGSAVRSGAAAEEPRRPPPRDTPSQSSPDPDPDPSAAGRGREGERLPDRPERAAVQAGKRRVKFTSGPRAARGPRARLGQREAREAEVRVAAAA

SEQ ID NO: 979059 - protein, 78 aa, Homo sapiens
KRLVAASTKKKKGSKKVTPKPASTGPDPLVQQRNRENLLRKGRDPPDGGGTAKPLAVPVPTVPAAAATCEPPSGGSAA

SEQ ID NO: 979060 - protein, 42 aa, Homo sapiens
HSLTPPLPTVEFLNFPPPLGEHSIGSAAGGEEYRETTGTGGG

SEQ ID NO: 979061 - protein, 56 aa, Homo sapiens
LEAHLPHSPAPSRKPELHREMPHSQKVVREMHTLRAEALYRLSLAQHVRVRVLWRP

SEQ ID NO: 979062 - protein, 37 aa, Homo sapiens
GTRSQQSQPQSSQPNYSKAWEDYYKKQSHAASAAPQA

SEQ ID NO: 979063 - protein, 106 aa, Homo sapiens
ISSPPPRALLLQRPCPTSGLLPSWLPFPSRPPVSASPSLFFLLGFLGFPRRPPLTASPPPPPSRLSSSLPTASPPHSRKPDSRGCPSAEETPGPRAQPLLEAPQRP

SEQ ID NO: 979064 - protein, 37 aa, Homo sapiens
MAVQCIKLTFMGVFMTSSEASLWNIGWYLQREASEEA

SEQ ID NO: 979065 - protein, 36 aa, Homo sapiens
ARGHHPWIRRPFFPFHSPSRLFDQFFGEAAGGVEKK

SEQ ID NO: 979066 - protein, 180 aa, Homo sapiens
DIPSEFQKTVTRLYKLWMFYALVMVVNILGGLVILIHSGEFRTFGLSIFYAVLFTPASFLCWYRPAYKAFKTDSSFNFMMFFFIFSFQALVTTIQTIGFPGSGTCGVIMAISQFSSGWGVVVGLFLMCIALAYGTCAAGNIFMLTKIHQIYRSGDKITMGKAREEFQSQFMSNSIVRDAA

SEQ ID NO: 979067 - protein, 43 aa, Homo sapiens
SEAWFPTLVPTAPQLIVNEGEQREEKEQEYGGRPSTEAPPRRP

SEQ ID NO: 979068 - protein, 149 aa, Homo sapiens
TIAPSLYPFLPSAGGSALTDFDLIRVLLELVVRTYAQGLATRLSCLAYRAYLLIPFDSTALDNISLSPTRCAAKNHSTTISPSCPRSNQPSVIITHLHQSFAVRYLSKTPRLAQEISTRRFTVRRETQRRLLVLMGVALYLVHNHLLYV

SEQ ID NO: 979069 - protein, 345 aa, Homo sapiens
MAYVNANYDYRILPLMALLIVSNVINKPHDRRHDHSNPPGHIESVLQITGINPYVINSSENVFSILCCDGFLYDACCILSARPYALLTHPIYGRALGLPVQGTYSRINAPIESQILRRQSGSYLCYSWSTRNAPVMLTQYVKYETPSSETNTDFKKLAALLSKCYNWGAHTCYPSVQSLRGTLEVSLHHFRLGIYGSTFPCSHRLSTDFMSSLASTLSAVVCCIRQQYVTLLSNITLASKPAADTDISYDCWFDYFWYVPTYGEARKKNPKQTQLIHTTVSAPPRKTPRGATNRHPRFEKRPKEGPKKRRRQTRGVKKEPLPIRPRGCTRSPQCAANQWIISGAV

SEQ ID NO: 979070 - protein, 254 aa, Homo sapiens
MMKTLLLFVGLLLTWGRVGRSWGTRLVSDNELQEMSNLVSKYVSKEIQQCCSTRGETVYKTLIDENNTKSARHWFSNLEEARVGRRGGCPNMRPGNRVEAKLDGAPEVVCTVRTYAWPSGKECKPCLKCALLKFYSDAFAQVCVRPGWPAKLEEFLNQSLALLLLDALVTVSNPCGMNDPVEDAHAWMYCRNISDGASKYHRRLFKERLSTRERQEYVTVTALNLPTELNLIPSPNVEMIASFRERDYTPVHPS

SEQ ID NO: 979071 - protein, 47 aa, Homo sapiens
MPQNPTVAYTGILWTNDIIDDLRIYSELEREARPDKPKTVKGPPDNA

SEQ ID NO: 979072 - protein, 193 aa, Homo sapiens
DAWVTTSTTLSWALLLMILHPDVQRRVHQEIDEVIGHVRHPEMADQARMPYTNAVIHEVQRFADIVPTNLPHMTSRDIKFQDFFIPKGTTLIPNLSSVLKDETVWEKPLRFYPEHFLDAQANFVKHEAFMPFSAGRRSCLGEPLARMELFLFFTCLLQRFSFSVPDGQPRPSDYGIYTMPVTPEPYQLCAVAR

SEQ ID NO: 979073 - protein, 48 aa, Homo sapiens
MAIADTEHALTPSWAFCIACFLLFSHGLTWTPCPEPDDRMEGGYGQLA

SEQ ID NO: 979074 - protein, 151 aa, Homo sapiens
MPPTRYREERDYWTQTQQNLQEKNPKTQGGRPQLFRDLSRTGKSRVHVTKELKDLHGPCVREEQSGPYGTDPAKGYTQRKRNDKKVRAQGRQDTTTEKKAIGKAKQGDRTANDAKKTEAPTWKGNHEHRGTEQDSGRTGTEHHTQKLNNGR

SEQ ID NO: 979075 - protein, 220 aa, Homo sapiens
QEERAGTGCGGLEGVLRRPELDVLDDTTLLLSVSLLADLGRVSQRAWRDQYWCSSLVNSMYTVRSREAMIPIHVLGMFINACHTGLHGGLTDSSSRTNSKYREMRMRLVSGQGYKKPKEEDRRTALEMRPGNLIHAVDLAVSVAVMSMSGPLGRVEALPETDLHEVLRTRLQKWLQAWFGRQLEESLNQSSPFYFWMNGDRIDSLLENDRQRRIMLDVMQ

SEQ ID NO: 979076 - protein, 233 aa, Homo sapiens
ELIEKVRRAHQETFPALWQLGKYATNNELMNNVSLWIIDLWDKFSVISRDHRCIRLRLWSSPRHGLRRASPPLTIRQTRCTAPHRLSCLARSMILRASWTADTPVARDIAVILSRERADRMNADPGCTKRLCLRPPLSQTMSLCRSRNASSLHPLEDVMTVGRRGLAGTPSHHAARSCESTRLGTLADYARDLVWTMRAGTPVHGRRRSRGLSVRKSGWPQPPPRVYAQGMRR

SEQ ID NO: 979077 - protein, 70 aa, Homo sapiens
ELREPYYKPEPWGDARISSPSSPEEDVMVGSLTFSVDYELSRKEAPELVTTPGVPTVLRRCMEVTQTQWI

SEQ ID NO: 979078 - protein, 79 aa, Homo sapiens
GKADAADQGTTERTVDETRQSVRTSGESDTEAAHREPGWSLGEKSHQENKCQVTEPASKHGGASIVLAMSEQDESTEYT

SEQ ID NO: 979079 - protein, 300 aa, Homo sapiens
MGYDTIWGATNQHQENRETRGGHQREQRIPRPPKCELSPQNKTKGERHTRKAEIIHDTTAPGKQNRKKPRRKCTQNNRKGTCGPTNVGDCARKKKNTEEEREGQNNSEAPQGNNKKPQLKKPPITNTRPLRIEPQHKRNKQPMVEELQHAQKRPKLAPKQLADDIDNTVRNQHPPTSKYDARKGARRKKENQQRHNHQTKKEEVKGRENTKDERAKTTKVKRIEKRNKANSNTQAKQQEQRQTRDHRQNQTHATDKRTQTRTKRKKETQRGEVNKNRWTGAQHKQNKTVHSEQTHTHNTT

SEQ ID NO: 979080 - protein, 130 aa, Homo sapiens
MQQSNTPQMEERTPRDVRRFCQQIIFVTPERKQGGGPPTRANNSVVWHPPPTYVGGTPRLLHTHKREANIIGEASTMWGKHHKTPQQVMRGGATSTPSGGAISHQHKDEKNSWVALPRKSKKAAGLGAVN

SEQ ID NO: 979081 - protein, 333 aa, Homo sapiens
PTRPGEGGPTQRGPRRRHPARPGPVLRGHARQGRGRARGSHRRSTRAQGPEPPGSRASEPRGCAAALMAWRPHCASGPAALQRVHPGLRPVPGPPAGPRVFLPDPSSPREAGAGARGRQAGPMMGKAELGSEGGGARRLQREPGTPMAQDGSGAALERKRERGQVTPKRHRWAYLAGPEKGPHRTRDLGKREPYKDPKQADMAKGVPEHPTRPDGAKGGPMSPQRRNRDTQKGPPWQRDQNHKSHRTGNGKPEHPGQPKPLKEPDEKQGPTGGPQKVTGLTRNTRGSTAGQEERHAPGTGPGPRHGAGPREAHNTGERQGQEGGSQQRSKTTG

SEQ ID NO: 979082 - protein, 296 aa, Homo sapiens
LFDSQSGIFLCVASRGHIAETPGEKVKVGVNGLGRLVGRLLTEGLLVNCWYKLDMCVPYNDPIHMTVNLHGFDIVANNELPASWAKFPLVTDAEAMSRRGKLSADRSGKIAPNHRCFSGRPRSSRQKSKWVLMLASDVRSVESYWSCFNQPCERRLGLQFAGWELIRVYHIHDPLLLTAPMFVMGVNHEKYDNCLRRSSADACCYESKCLATPWSRSSMTEALVSWKGLMDHRVHAIHFYQEDCGWPSGETGREAAGAHQKNILGSKGAARVVGQATLSEGKLVAGRLSPWHVSWG

SEQ ID NO: 979083 - protein, 251 aa, Homo sapiens
YTQVLFLIGKEKVTAQGPMNLKQKGKNFSPPSWEREIMYGKGSPGSGGERRAQGGQWGVGVLLPTSFTLVPYTNTDTVQVPGRNKARGFLTEGHKGKGEDTTRASKSHTGQRVSHLYTRGETHSKAAGHVVTGCADREVVTPVAFKSELSPPYQLSGTREHMVSRDHRLQGEPGQQVTAHEGGWRGGEDEPPIYRGGGAWGTTPNCVTSGKVYLRTPHPERGPTKTATLCGKGCQSPMKGRGLHENPRDRV

SEQ ID NO: 979084 - protein, 178 aa, Homo sapiens
EPNSKLIHRDRDWERERRLPSSPLPPRHLKAMSRSRPMTVSSRQDEDEPEAMQTEFRMDKPSRCWECSGGGSHSNILHHRRHMTTMENSLKSGKGAAAMIPGPQRGTEIRLFLRSSGKMSSQHYGPRGNSNSHTSHKGKGVLKGSKRSHTGEIRQTGRLASEAKSSDMLYQVCYENDH

SEQ ID NO: 979085 - protein, 373 aa, Homo sapiens
MHNHNPNTQKNHTRTTNQKNEHNNNTQNTTTHKRKQQNQNTTQQKKHNKKNKHKKKTQKNKQRKKKQEAEQTKNTQNKKQKQKKNRRKNKKQMNKRTTNKEKTNKERDRRARPRTKREQQERANQETEEATEATAPKHETDTKKKEQTNSHTHKQKHQDKTHKETTHTKENQKQNKQKKAQRTDKTKSITTTEQNTPNKKPKPKNNRPNNTKKTRRNKESNNESENPQKKQTTTHKRAKAENKTKTAERHNTTEKQKTQQQKKKNKQKKTKTKEEQDNHREHSRRSERKREEKKSRETKHTKKKKKTHTTEAHKHQHHQNTRQHTHTRPTHATTRTQQTRETNNKHRDTPRTNNDTEQRVAGKRSESNKHESN

SEQ ID NO: 979086 - protein, 256 aa, Homo sapiens
MRLLPRATRQLKLRLLRAEDEFRRPESPSKTTWTKVADPRAVRGAARQEHAERLTRLDDVIQTGVDNPGHPYIMDLRAAVAGQTTESYEDVQKDLIDDTQSSEGPARQAYKAQAMSTRDRSLQDPTTLTGTERQNLEKPKAYRLTEKHQPRCRNRSRKTLTWNILASPPSNMQSRREKQQEPITRKSHSSDREQPLGPQDPDTERTQRTEGPEKLTTAPKTEIDQHSARQPKKTNTKTDTNINRKEKTQQKNNPPE

SEQ ID NO: 979087 - protein, 259 aa, Homo sapiens
QASAGLAHRLAPGALFVWVKVCGSPRRMRRHCDRQKANLADPLHIPSLFQSRVHSLPRLAGNDPRNMNMDKGRLGKEGAVVNGSNVNLLTKGERRCHEDQYHARFSPWMNAVPCCVGTSFLVPFRPPCPLRGSSFLPIRFSSHSPLDVFGIAVLSFRQVGTGRSTPGWTKLLSDGLSCWTVLPFRQTLESEQGGPAGGPSASPLRYPRIPSRVYLPRFGVLLQGSWLEGEVDPCVRPLARRCASRFRAVLAFVGDLASK

SEQ ID NO: 979088 - protein, 123 aa, Homo sapiens
MKVVPLMGVFNHALSLTKRHRGPLSLATLAAYFPAANGKQGEKDKEGHVDQGLREQEPNGRANIQTRGVRNTTEKDKRVYHKAGITDKSGDPSKKERGETKNSYNDEKKSLQRNSGRQTQERT

SEQ ID NO: 979089 - protein, 126 aa, Homo sapiens
MTARVCTTLCLEGCAQGTWSQPPTRDCSPVHRNTTRDHRHIVSTAQSFRHQIPRTYYESSITQQYSLRLQYTCGQSATSIQLSGPKSVSIPCQSSPRQAVLEWVGTHVKRRTHGPQSIDASIALQL

SEQ ID NO: 979090 - protein, 165 aa, Homo sapiens
MILLQEKKLLPRIQYQNLTLRSWLQKKHRQQEAERRNKHKTDTTCIKLQIDSDTYKTVVCATHCCQQRTISRSLQVTTKSMQEVHIKTQEDIKLEKALRVQPSSESSHQLPSTQHEDQSRGTGELLRITKTNRARQEEKNLQRTELQVDISEASIQNRSYKRLTR

SEQ ID NO: 979091 - protein, 202 aa, Homo sapiens
RCHQVPAASEVPLMEDSRWAAEGPPKRPGGSSPLNAVPCEGPPGSEPPRRPTTCPPHDGDRKELPPGAAVCLPGPHVAHELITKHTGTEDTEPWPQFVPSRSDHGPPKSRFGSQVHKVTSEHIQPYVARETRLKSQSKETNSDQVTDGHSMISRRLGSVLPKCCCSLLSHNPENRGFQGTVSREPSSSGQRLYPEVFYGSAG

SEQ ID NO: 979092 - protein, 248 aa, Homo sapiens
MLVMDAPNRPPAALERPWTLTETWAGSHSMQVFQTTSACPGPAAGEPTHSSSDGLQWTTRSTVRFDSRRRESERGAAGAVDRAGGAGVSGPEHTDLQDQTHRLTERACGTCCGYYNQSEAGLITHLQSMYGCDDGAGRAASSAGITSTPTTAQAYIDPETEDLTLHGPRPDTDELRSASATWTRRARGARTQCEHDSPYPGEGDPEQSAQPGLQPKLHMSTTPEKPPPPERRAANPTQQNTHVTPPTT

SEQ ID NO: 979093 - protein, 249 aa, Homo sapiens
PLRSEAVISRWGGHSSADVGVAEGEAMLKVYCVSHCLEAGPANAWAHSCTGRPGWKDRLEGTGADVRPWARWMRLWGRCGKCICSKYLHYSRKVLRSFTLEGTSFLSLSLFLDLGLRLRNARRMCPGRDPTRAAKTKVAYLGVSQGTLVTCLQTTSMEAGEVEGSGDESGKHQLVSLRCETRRRKQPDAYVNPTSPLPPPGSHPRKRDRNQDKGQVRIERGETELADRHRATCKRKVHGGNEPGFWLTT

SEQ ID NO: 979094 - protein, 246 aa, Homo sapiens
MNTSRPTDTEPNTLKARNNLTATTELIHAQRLVGVEPGSRTAQVTGEGHYAEIRPAESLSTYVCSGTHINKTLAPAAKAAARQSDTHDHATEPRYRTTHRRMATQPTGAQRTYLQQPTRLKTASTTAQRHPAHNHRSPMSSNKTTTNPHKDPKEQHITTQTPHTPNTPQQTNPPNTGAAPNRPATQHTDTHTETQRVRPHTHQTQHKTPAKRTRPTPETKQDSTKNAEPQRKTQPPTPPNQTQYPS

SEQ ID NO: 979095 - protein, 159 aa, Homo sapiens
HASPTRPSPSPSRHHGRRSDPLMMPKIVKKRIRKYIRTIADRYVKRKRTWRIARGIDNRVRKTIQRARLLSAPSIGYGKQQKRTHALVLPQCACGNVPWSDEGQMELEGAADVQAHLTCAEIASQGLAPKNRQANRGKSCPTWPSTSHQGPEVPGLAAR

SEQ ID NO: 979096 - protein, 172 aa, Homo sapiens
PRRPVGGAPSRCILALQLESPVWFSSDFTHAYTLSPSSRSERLGLWQLPFDRASLLMASKFPGYEHTRYWPYERTSGWSDHRWSQRWSSPTVSTDHAGSTRATKQGSNKRRQRRSMDPSTCCGRSSRCPTTQVSPLIHALVHLASLSRRTRSSLWVRTRHVGHVGGSAANQW

SEQ ID NO: 979097 - protein, 126 aa, Homo sapiens
MRAGKEQHPILTHPRGGGAGGRPTPNNRAGRPKTAYSPEQRTNAHLSQAGPPTTGGPTTLSTTLIYNDTGTTQHGGVTHTQTTAMDNNTHGARATLRKRRAILGDKTESEHKTVTSTSPNIKQHRG

SEQ ID NO: 979098 - protein, 252 aa, Homo sapiens
MGTQIVLRTKFTQVAIPPVPTEVVTFHEYRASPHHTTVTKPAMDWIYLDLRIPTEDTMSLITPGRMSKTIDLPLVETGHVEPPRRIVGPRGGNNTHHSKCKGNGTHHMAGRDRFIRHIPPRRKRRYRRREHPMGLQTDPRGIKQHRAVNTLRTNSWRANSRPPGRMPGHHNIRQRHRDRQRPYTAERGASNRATREHTENQPTTSQQSANYRRHAINKNTEQERTHTTKVRAETSQHDPKQLVYQQDPIGGP

SEQ ID NO: 979099 - protein, 225 aa, Homo sapiens
MAIQMMMLMHGSATRKEIWALVGFCDEVKEMPMESLVPAQKWTPRMSSLPWNLGEPMKKHEVPAKVGCGTVRCVKFRVNGGDHRMMTKNKTVRKKYSTLFDNNVRSNGCRSPMSEEWQEVGTRYGSVPLAVHPCWRRVSALSLVCKQCMTPHLHLASRMPGPDRSRDVSQGTVDFCEKCARSWWVIRTRKAWSKDEAPSRRSVGLLVDKAAACWRDPVPEAGDPE

SEQ ID NO: 979100 - protein, 158 aa, Homo sapiens
VSEAHEGVKPVGTFLYGHSCPRSRRIRYIYSSALRVDREESRSHLGTPGSHKDGILLCGCSGLVYNEALQPSCSSGRRELLPGCNRIMEASNHCNSYVKAEEITCATKSHVVSCSVASLASFAKIVPSPFFFFRCGMSVYLCKYDVYVLLRYVIHFTG

SEQ ID NO: 979101 - protein, 240 aa, Homo sapiens
MRSMTTASRSSANDSCHHQLFRTPGAQVNAMTYLGNRGRDCMTTVHGINVTHKTVDGPSGKFDVMARGVPPRTSFCLASYLAHRLKDVEPRVISLIRSLGDSSTCPMAVALCPLSDRGSGRWTGDPARHRWDSCTDIVMTYLRKVVRNKAVQRWAPIEGGNLHGHYNLSTKGGLRLTFHEPTIHSLSAWDRMEACVTSSIKRRELCDLCSMLRWVDERPNFVLRARRVVSPHGPNIGTSM

SEQ ID NO: 979102 - protein, 153 aa, Homo sapiens
PSLRKSQEGFRRPENAAQVWHVPCPRSAPAEHGGASDTQNEMHPAHDGTPGNPAILEDPPVVQSWKLAGFRALLVGIGFQSSQVLLAGKCRARRGWAISLEAPEVQPPTPLQGPGGPRTATRTNKSAILGTESWKETLIGFGNLRRNARHPFY

SEQ ID NO: 979103 - protein, 134 aa, Homo sapiens
MNAAEQRSDWGSSQERAEENRDHEGERAAEDEKGQARHATTRAAQEREGHERRETREGRKEKEGAHTETSGQRETRREREGETKARKRDEREEGEASASEEREQRERKRKNNNARTERQERSQARRRRRRVLRE

SEQ ID NO: 979104 - protein, 344 aa, Homo sapiens
PRVRMDEETHHLRCSPLLRLRQGEMMVGGSWRPGRACLGVPGDPPSSPWVRVPPLTRRTSGLVFVPVSGALNAGFKETRASERAEMMELKVTALPCYIEKVRFLEQENKALAAELNQLRAKEPTKLADVYQAELRELRLRLDQLTANSARLEVERDNLAQDLATVRQKLQDETKLRLDAENKLAAYRQEADEATLARLDLERTMESLEEEIRFLTERSTRQEGRELQDAAGPDSKVHVETDGGQARPHAGPGRENPGRKDEGMADQANMPGKAAPVGHRHQGDGRTLTERSAGHGNRRQTQHGQATQTKKNRGHMPALEPANGGGFVDEREETQATTKSTTEQA

SEQ ID NO: 979105 - protein, 141 aa, Homo sapiens
TRSIFLCRHYGSSSGGYALGMEYLRQQEVSYMRDLDCSKLRVRDDMTGLCCGLRPLYEKILTGGDYLPAKAAVRRRMPVKVDRHRKCCETESTQVNSDVWAFGVTNVGTSYSGENDSLVLGSRTMRCMSYLLHGQQVEARP

SEQ ID NO: 979106 - protein, 150 aa, Homo sapiens
MIDTAASSHYNARATQKHAERTHTLQPAQTYINKIMTRTVRTPITTEATRKALHEDAKYHTHNSAPRSNIPSYTAATEENQHDTQAKRLLRTTHTEDATRHSLLYMEARTGEQTPSSIDTTILKDALVELHQSSNTTPHWQRLHRYNGKC

SEQ ID NO: 979107 - protein, 164 aa, Homo sapiens
MASTQKDNKRWQLDLVPAGLTRSCGVCACPGLRGFSRGYPVARAHRLDSPVINSSPYSANPWAWFCEQVFGPGIYHLGWDVASSGAAQPCTYARSALTGYPPSGVHNVYTEHTGLPVGRDFNAASCVSLGHTDSWYTTGVLLKKPIRANKNGGASHHNALTNSC

SEQ ID NO: 979108 - protein, 132 aa, Homo sapiens
MAGGAGLALALWLLMPPVEVGGAVPSDIQDGEFTIPVAVRGGSSVSTSPCRSKQASRPNTMVIGGAGLDVDFKTGEPSGRAVGQTSPARLMGYTRWSQRRPRTTNCAIDNSYRHHLQKSMVTYELLYDSLQG

SEQ ID NO: 979109 - protein, 200 aa, Homo sapiens
AAKAGGSRALSRQSGLSGRQVARGSVADATRTGPVSYKKFREASWRFTFYLHALALPVTGRSIVDKPWFYVHEEPVGRDIPDTEHFPSQVWGLHELKVSFQLVRCSSGIASDVKRKDFQQEQIIHHVATIILISFSWLPITSELGLYSWLCMTLPITCLESAKMFNYAGWKNTWKQASSSSSPLLFIITRLVILPFWILH

SEQ ID NO: 979110 - protein, 159 aa, Homo sapiens
MNTTRVADTHQHRAQTHQGHLNHGRSGELTNQTDGTQGPGSNKNKPGGTQHERSTRQTLQGHITDKRTDKRTGPHFGQTQQSSVTHRVDHTRGHRQQSLETTKRPGVKRTNHPTTKKAGDGRSHSHTLGDTTQHTHAEPAATPRRTQRRREQTTEQKAH

SEQ ID NO: 979111 - protein, 113 aa, Homo sapiens
MSLEIGQQANPWAGKRRTPRLTTQKRARGPAQRRATEHKRPPGTRPAYKGRKEGQLGDKAPIGGETGPAWGGQRGTLEQGTPSDTTKTPRASTHTCGPDAACPSWDTWRESDR

SEQ ID NO: 979112 - protein, 225 aa, Homo sapiens
VRAPHSMEQLLRAELLHRYPCGPSGGPVLPAASADGPEPTTRTQGPVFVKVNLEDCSARQMLEGGGGQALDGPPRCTGLRAVVPEAHEVSSTCLGGGAQPYVMEQFELMNELEQSSIKTWTSKMARICIFTTQQAQGARSHREALRNTGGARKQGEGVLTPSDTGGTKVRAFHNWMDADLRGFQSRKGGTELGRDLTLGPDTVYNAPRDHPGNPRGPHSYGHPIQ

SEQ ID NO: 979113 - protein, 105 aa, Homo sapiens
METQATKICISQRQPIGQEKILCSTPLAQMCRGTPFGPQDTETIHNYGEPNTEGTQPRVPTASQQLATKQHGHEREDKTNGERNKGDENGQREQTTINRNTQSRH

SEQ ID NO: 979114 - protein, 511 aa, Homo sapiens
MRTATRQSFLSDRSLRPYDVSACTKSLSGQCRYECCNSERNKFLRSDDDHRLRKRLAYTIRHGPLIGSYVRTPYGSTSIKNSNINGVPLVRRQGIFKHSMRYYITACATPVHMDVVLQREYGFCSYLMENTLPLSQLILYTREVGCIALPRHNPNFGGVWNAWSRMHANALMGRFQPWMLFLNPSEWKQMAGWAIHNLATGSWEPQNRGSNRYSSLRSNFLRLVASRSTIGYPYNWVLDEIQLRENVIGQHGGPSYRFISRQKLYIPNWKSKRNLAFYDNRPFGVPNVIQIPKCTKPFVWFDPVVPFRELPDDPTKSQLAQSNHGRSPETERGGKLEHRYRGQTLWWGDDQRQGGASPMKGFLCPLPYFLGGSPTVSVGAQRTLPLEVRKSGQSSPGAYVPCQVVPHVANTAPVVGPSKLARLGKTAGTNEERKRKGGEKRAGKTHKSTMRKLGTAVTHEEGTLHHKRSSTQQGAQIETKAPEESQERKKSKHRKTELRRTHNREVRVNKQ

SEQ ID NO: 979115 - protein, 311 aa, Homo sapiens
AKPYTPPERASWRSIDAGHRHVWWGSVMGTRVDHAGILTRAYSFHMDMSGRVFPVYSRCYDGAGEWAGKVLVIVNDDVSARAVPEALRAGGTIQGFLGILLDHACAFTVVELRPRGTPISHRAVWSCFGSSCWASVARDLVLSRASSALGSDLVMWLLASDWCVELGSLHSEHGPLFASLLVGQGVLLERQPNVPGNRSRTPRGSCVLPLMAELAGKRLLRSRRFWHYSSGLRSMAGRLSAPSDSRGRCLCAWPIGIVASTSSLVFDTMGRLFPGVVVPSRAWIRLPFWLRGLWGLDRGAPLGRKPQEPHV

SEQ ID NO: 979116 - protein, 59 aa, Homo sapiens
MSRSRTVLATVHRDGGSRSNNKRWSAWEGRSWRCNPGGAVQGRLARRGTGRPDGVAHPW

SEQ ID NO: 979117 - protein, 39 aa, Homo sapiens
HRNLCLPGSSDSPASAFQVAGITGAQSETPAWTIEGDCL

SEQ ID NO: 979118 - protein, 104 aa, Homo sapiens
MRHNSGRMDIYGGRALICHDEIPKVLSKTRKRGIYPDIVSAPPRGRNANLRSALESKIEFTLWEPRKRSVVVWLADTFRRIAYASNGGSKGLLMVPFSGTFTHL

SEQ ID NO: 979119 - protein, 107 aa, Homo sapiens
MDAPGEGGVYRALQLPRDNTAPTDTHSSLSGPKRGYAIPFFSYPHNKEPVGGHLINIHWVSMGDGFSRGPMDLALSLTCSCSGLRNRVPGWPTLGLAVGHIKSDVEG

SEQ ID NO: 979120 - protein, 302 aa, Homo sapiens
QLVQTWPRPGCPHGLHGWRPCLGCFVGSRFVHGLWVSAGTPVCIRPSWHPAHWVLGPVWGTLYSAMGVSGSYLVCERWLGGFTDNAVVPWVLYTGAAGPELGHGPPSSLVPDKWVCALVVSPAGQWGLAAGHYRGLVPMVSLLAARLLYPYLGLAGLRDHCQLRAVMAGQSMAGVRDGGCQSECPATGTASAPSVAITLVNVVAVRFHDHWCLLVCQGLARVVHELLGGPLKPHLEQCLCFLMLNLFLTWIKADKFGRYEKKGAQKIQGRYARLQGQKVKAAVTEERTLRARERQTKMHGYK

SEQ ID NO: 979121 - protein, 125 aa, Homo sapiens
MGENELSRIQYVSFCPICYHDLKECHEYYDVENDANGKSTEEVRHWPVYPKQMSTYMCLSVVTVVADSPVTDRSRENFYWASQFKATVGSTQGSTLLVCELGMEERLYASSPAVWGVVTAQLCYR

SEQ ID NO: 979122 - protein, 273 aa, Homo sapiens
VTRGFQRIVESVNVIISHLRRRAESGPMGNIMIDPCPRYRGLRVLASTGVAFTLKQCEPEMYVSQDSTAKGEGHVRGPAEPGQDKYEDMMKKLWGDRYLDPANGKFSKSAHQTLKGRSCHDTFCQLILDPIFKDDSAATHDITRKTATAQLTDDNREHQHWDQPTDKDNEGKPRERRLVMQPHGWPDGRRLDCTMTHHTSCHSPDDETQEVPAGGRSRYQRRTPRERRRLANAAHYTTQEHPQRTIQKHDSEPQLVTTYRKRPDIGQGTTNTE

SEQ ID NO: 979123 - protein, 165 aa, Homo sapiens
MTLSISGISRMVLWQAGFVNQIVTLGREEGEEEGLRLLWGESLPLQRGFYPSQGGGAAGDPSAESSDPPLITWPVQKRSCTPVLHRCARNNHSRVRTHVPRESMMWLQTCPHGTIANLRLETPGQAHRGEIHSTKDLTTTPALTPPSMHLAYLTGGIHSRDKNRG

SEQ ID NO: 979124 - protein, 326 aa, Homo sapiens
LKRYGSASAIAVAVRDRSDDTENQLQHDDADRLEHMDRLIEIRSSARSVRAMGVRALMLVGYTSRYDEAARCPFFALHAIECSTNDIQGTKYCSASSGFSHMDLPVLMGLMHVREDIDKKGQSHTSPLKAKTSHTGNRRAGRIRTQTVKGAKPIGEPRTAWEYTTRPLSYKRETSTMHADSTGKANALRERLDKRTRMRPTRMEKAPLMCDTNQANRIQGRRKPLKGELAETPGPSEGTQEAKDEELRTKNPGDKEANSTQCIATTPVGPEKHTMGVKSNEIGRYQRYNGERKTPNNTASHRTKTTKHKNSTRTTNQGTTPMHKSW

SEQ ID NO: 979125 - protein, 159 aa, Homo sapiens
MMCHVVGAQDTGILESGGFRSDLGRRHQCHLPSCETNPSPLDVVGPQGLDEVIPEFTCTCLPPGAEPSEHTIAPYFTETGAFKLEVNLEHSREGASVVLLCYFFLLFCRKNRKIMPLLLLSLGVWGGGREPSQTRFMQRLPRHRVRRTHPHSPAAFTPF

SEQ ID NO: 979126 - protein, 230 aa, Homo sapiens
PEHGFCEQPGECRCLEGWTVPPLHGCPVVQQQNDSGPGARPLIPPDALSLGLGPCDGKPCANGGSLYVRYPGPLNAPATRGFYGLRCEVSGVTCADGPCFNGGLMCRGCRPVTLPTICHMPPVYPRLQLVRNEGWTGAACRTCTQWRQLWPCDPGAKPMALCQMTRRPGLRGVPRLRRNDHVTELHGARTLEAHKKPDTMMMKATAATPTDRHLRTMGIEQADKQLTIEG

SEQ ID NO: 979127 - protein, 392 aa, Homo sapiens
MVSGAPGHNALNGRLQVGCARQVLSIQTCSLVHGEEQGGAGDATGENMLVSALLIRTPSLEFYSIVASMSRQIDLFELRCCAFVDSLMTRAIESLWNHLDPTCCHRWMGIRGAQGRAMIRGSALDSLSSTTFACDPQRNFHIRGGADTSWDANYGGGEPRHSGAVRQTRGRFAFNLRSASKSIEQAQGGFIERLSVDFVANSNAAQKAGLSRWAQLEMATPCVSKRGPVRHAFPDDSGLPILTGTTSGVVALWLSLYPRWLEGLEVRGLGPWYGPHFGGTPKGVGLAVDGPQTKGNTGCDHGTIQGISRADGGREIPMRHHRYTAADGLTTGDGRETAGASCAENPKEGHTVEDWCPHDGSTRVGDPCTHSGISPGIQDQQHRGESKNLGGN

SEQ ID NO: 979128 - protein, 74 aa, Homo sapiens
EMELVAQAGVMGKVSVHGNLHLRGSSSFAGRSLPSNWDYGNGPPGQVNFVVFYSYKRGFHQFLKLRDLEGDPPT

SEQ ID NO: 979129 - protein, 340 aa, Homo sapiens
HALALNGGPKWEQTGKLGWRTQCGEVGWTLGCGLGILERKWKTLRAGQGILGAELTGRLWGMGLETVGVVLEDLDGMWLQGPWPLAPGPRVVPVGILVAWKDGILERGLEATGWDSEGRQLKFQPAPPVHRGPALFSVARSAVADCATCRAVLGWLPSPSLATSTTCWPPAEPAGLVLGSPRVTWTFLSRGPGRQRCWWRGELRVKVNRGLPGIRVGNCLRTPASAHRRLPGAELSWAQRIGYLRCEASTAIEYRQPTAMAAKGTRANKHHRRRAPPGKDIPTPRGPTDRMWPAYAPQNGHPGHRHIAAQPEAETPRKHPGNYTTTNEATTDTQDTANTR

SEQ ID NO: 979130 - protein, 177 aa, Homo sapiens
MGGNEEAAGCPLQGGCALGLLPARGALGPGVPGQEELGAGRPLSPACLEATSGLLSRGDKDPGRAQAKCPIQSPLGISAHNCLHFWAPKTPCWLPGAPCGKNGRQVLRRSHRGAWSALFPGWPNTFPALAQGPSAGCSLHRCWVHPWGKGLGGYHNHNAKGPAPGPRARGRSYPEPA

SEQ ID NO: 979131 - protein, 365 aa, Homo sapiens
MRWVFEDNYYIRHYSYSPEDRARTDCRDALNFITGRIELHGTVWLNRRESNAGLASARGCARFGCWASSAPGELFEVSEGPTTDDVSGSGTLHCLSRYLLECTYYSDIMFPGNDIFIVGTWPCTLSQKSRGNGDSVTIHATRLHYTEWLVGSTDMKGQIHRRILSEWRVRLSSVGQHRPRACVDSLRHESSISKSVTHGWVALRGTKSTRKGLTDRRHKSQQISILTPPIHGVRKASNDSLIPPEPFPNFMVWVPSATGQSCVGYELVLRGMGWKGYPRSRTLVSFPLPGPSACSGSSVTAGGLPPWVSEGLGVPSWLVSQRLRCGGGPATWVVCVFLRLAWVPCRTKGLNSLVRMASCQLFVRP

SEQ ID NO: 979132 - protein, 163 aa, Homo sapiens
MRVDFRVFPGLGEGSFSGAQDNSDGPCPNVGENMTGMKVGHTGAGGRAPSSWLEDVNPGASTFGGGSEGTWLDLDQAPPKSSRFKPRTKGPEVYLRASASPGSCGTHLNCVSPQVRDVLECPKEAHTSFPSLKWRALVSLHMWPGHGGKPLQRRESPSRRAGI

SEQ ID NO: 979133 - protein, 231 aa, Homo sapiens
TRSAYTKVADDAGAAGGPGGPVWAWAWGTAGGFRGGFGSGIRGRGRGRGRGRGRGRGARGVQGRMDNGVNCPVTKLGRFVKGHEDRSRCERDLSLLPCHKRNQRSLISSVGTSLKGGGPEDYASAESKNRAGERTKVQGIGGYRGLQLDTSGLGELSCSKEVDKRHPSGAIILGQSSTSSPCARSYLGEQRFYKAPNLYLAKRVTGRESLVHVYASSLDPKGKWHLLPHLA

SEQ ID NO: 979134 - protein, 195 aa, Homo sapiens
GGRVQQVRLPISGPLDLQPRLSVPVRAEREGPGVAMLVRWAGVVRAGVGVAGWDRGFSIEGDGSHRVLKMENEKAGSVHTCATVGTRPWSSVRFHRGAFMSSRVCVLDGEHRPGVWPFGGGGKRGQGVGSREWSSGGSRCGAGVAGPLAFPTKEGPPWPARRSPLVCSLLRQGVLGKPYNGLGSGLWNDGAGLGL

SEQ ID NO: 979135 - protein, 132 aa, Homo sapiens
RSEPALRALGLLQVYQRMIDKAEDVCLSERSPGTGGAAGGAHWLNLSSSHCEPNACTFLRISKSDFYENHARTDQCGCWVRLHTVESAVMSPFVRQNGLRHLTVTCQLVALWTARLYRQGDRSELAIKSCIN

SEQ ID NO: 979136 - protein, 230 aa, Homo sapiens
MWVLLVEWRCGPSRSNHPVPLLQAQWRLQKPRLVSDLCRKRGRTVARSGSVGWRLNELSDVIRMHARESAAVTAWLVRASRGAADRRRGQLCLSWGALMSASQVVQELHCEEAARCWFEFLWMPGQVHQSPAQHGLPRDPQHLKHTAWQQPCDSHKTPRSRHGDSTYTQTQRVHWPEGPSNKTTHAENTGQSRGPLQEHNPEVHKMTFHRLQYTASKSSRNLTWYRPWTN

SEQ ID NO: 979137 - protein, 187 aa, Homo sapiens
MDNSAIPILESISHNRVYDLMYGSGHPNGAGAIKGSFVQPIKVLRDLSCRPEYSRSVTIYFKCLPVRKDRDIKGYFRKRFARELISSQQLVYTQSHPKERVFPGTQNPFDTPTEETTRKAGKKDTSGEGQTKQSTGRITGPSEKYEKTKTHINTEQGNNREGQNTSEEGKTHKDRTKEWTITERIKN

SEQ ID NO: 979138 - protein, 101 aa, Homo sapiens
GVNLCDASTCVLCERARRQLHHHCHCCVLNLDVPCINHEMVTETSSLHSHCQTSKRHSNARTLWLHERRRRIWSTLFLNEPTRLGNALESLRTFDLVPSTQ

SEQ ID NO: 979139 - protein, 305 aa, Homo sapiens
QNTKWRMTPCAAGMALVCALVALVMGEPAVCFLLECFWHVCILWAWVSRACGLWCLCGPMCLLCSSAVSAHVPRTRGVGLPYSTNANVASFEVQVTMNDQGPVAGLIMIYLLPQPNLPGTHVRITRNFSYRLSVGPTSSERSGGAFRQSNLVAQRSHDMAGNRDDQSADSHPGGYNRAHSIALCRTFRRRAYSNLMSQPVTLHWELALHRLGIHKMRKSLRPIHGQFPDREWPLHSPCAPNAYLSQFEIPPREPSKRKGLTLEREETNRALLGHSAHPQPIQEYHYCETGIDHGPSNSRGSIATP

SEQ ID NO: 979140 - protein, 223 aa, Homo sapiens
RRRGPSCWLLADTQWNGWRVPGVPETPVLFPSDALVTLPCPGADALHLSAPRAGYNGGSAIRSLSVRPPSPGTRAGSQARPLSGPRAQAGLVHGRQRSAQRVSRGHPLQKSGPVLATVTCWLDSGNPLSEDHRGVSLTNPNRIRPDLKLPSPLWLPSASYIISSLNLKGDFCVLTQTSPSNTKVAGVSPKPYWVCIHLCLQTSESDSFDPILHTPRKFCLYFN

SEQ ID NO: 979141 - protein, 111 aa, Homo sapiens
MKLQSMHLYQLPMRCSGKVLLFVIDLRIVPPGAGYQYYEGFCMGQLCANGPELTHSLEHKWLLGRNNFFSLTTFIFHAHIPYRNTNPKIQLTKEVTPCVHFLNRVKSPGTS

SEQ ID NO: 979142 - protein, 339 aa, Homo sapiens
HRHPRAEITCCPADPCPFLPDQQLEALTPAMAPLLVSPQTVQTNHTVVCLQLYREKASHHALVSLAVAFTFPFITTVTCYLLIIRSLRQGLRVEKRLKEQGQLRMNGIMMVGTTLPVVLCSLRYNMIKRCRTMLAATSRSHGASCATQRILALANLLTSCLTSLNGALDPIMYFFVAEKFRQLPCANLLCGKRLKGPPPSFEGKTKRELAECQVRAVSGGAVQAERSNVRTQQTQQEGICPFPGSSQEQLKSHEMAHIPRMARPALKETAKGQRNLEAVMVQVYNQVPGGQGPEHPKRATHRPHPEDPAGTTPRGSKRTGERTGRAHRARRTQAGGTIS

SEQ ID NO: 979143 - protein, 76 aa, Homo sapiens
LHSESVRITDHPWTQQVTDQKNHYIARETSGSLLHVARYCLDVHYESMLRKICHGIVSVPGHYTHYYPPSGTPLVY

SEQ ID NO: 979144 - protein, 386 aa, Homo sapiens
IFVSGTKMEPLQPTGDSDAERLWVMRKYQCGLSPCANGRKDGRVSHFDANEIHPYMTMLEKNINIVRKRAEPDAADTTRRQIVIWTPGLTPTSQETGREETRSIPADDETGPRWTMQGCDGPDEHMLQDSSAAGHDPKDGMLPIQPSTCDHTDRSPGIGRGRRNDHDDTGNKGHHNHGNDAEIIPEQTARCQNMAEGYRNAWDSGTYNANKNNKLRKKIIDEPMRGTYLTSDTELPQNTPKMEGRDMREHTALRTEREAMTEMTMRHKSQLDLRNQHTESNKKRRPQKDDMRKMKKARPPTHSKETHKPKTGTSERDQNKTRGNKRGKERTKHRNNKATERNTPKYDSTETDPEHEQKKGEPNGYIQQGKIRKTRRKKKQQQQVRK

SEQ ID NO: 979145 - protein, 120 aa, Homo sapiens
QRLPQSTMPWSLGKRLGLTEAEGQTGAPARPLKGSRCSPSFQALVGVGGPASMGLGSSHRRTAACPGVGPVPCPSLPFPRVSHPSSPCGIGLGGRARLVSGTPGGAPVAPRDMSDEVQEG

SEQ ID NO: 979146 - protein, 304 aa, Homo sapiens
MTSEEDRTMKKQYERTKGEQGPCERQTGIGTTWGDTMKKKEAGGHPLGMKRRDQPEHHPHVGAGCHPTNDGDTRKQSQRTQGRKFRESEPVDAAKKHVTQRNDTGVTKKGGWNDQSTETYGASREQGTQIQRTPSEWITNKKINNELIDRTGNKGATKRAREIEDTQRQRAPPTHHADRALDRKQHKAPKTRDDHTPPANNTRQEDTQGSHTAKKEETEHTQRQVGPTTPIADTTKSRALPNTRQHPEKHNEHTTGKATQSQNHTTRTERGNDEEVQTRSRQKQNDNDSRRRATEEHKAQTARK

SEQ ID NO: 979147 - protein, 238 aa, Homo sapiens
MELYSRVRVRASCCKRVKCRLSSLNSWILRQMVQLSDLLCVVLNAIRIRCDVDDPGERAMRQRYCWTRKYADHLSIKVPLVDQRCCYRAIDRFTCSDSRSELDELEVVSKYLNIPQLYGISHCVLIDRLSAWSNMCEDRSHTVDSICGVGIGDEPRGGFVLSNDKVTWIDEPKLRSHKALPFYKGYTIEIYLSIIDTYTSTIIYTGNWSQENAVQETGVMHGERLPSVAPYKVETPRV

SEQ ID NO: 979148 - protein, 378 aa, Homo sapiens
MSAPVAAAPVVSFQPVEAMGTRGSPPEKVGRGTRYHPTCREPRIRANIQAQESVRPAKSQFYVQGKATQVTFCAETPKLLPGAPWGKRARSIERSHTGSQVQPSPQDGHTTFPGSGTGPRQGYSITKVMGQPKGKGLRGVHTSQTQKGHDHGAQGPRRQGPYTKTTCMGSRALKAMYISPGTTIHNLGQGRTRESETKRCWPGHGRMRCKGRRDGDHARRGLPKELTSKPWVPLEHIPKEEAEEKEAERPTTTSGSRGIFPRNLGGKKGQEHRETHQEKAPTKRHPKEGIQQTRSKRKWTQKKPRKGQTDGRSTKDTQEERTNDTIRKTTRRGKTTPEKVRLARIWRNNSKKEKKTHIPHSTRNQRIQTKEKEKQPTY

SEQ ID NO: 979149 - protein, 105 aa, Homo sapiens
MVRHVDARSGSGFIAALDVRTDPEPCRLTVPAAPNACGDPPGDHCMTDGVHQDLQRVLACEQVYDLERHAGPMRTRHDTSCRMYAAVHHQLHVKKKAASNQMRNT

SEQ ID NO: 979150 - protein, 176 aa, Homo sapiens
RPAVMSERLQSQEKEKEWQRKSTSIFPPDKKKNKALSFRIPGTQSLQAVTVVGAAAAAAAVINSPDRVSGPEGSLEPDHGRIQPYHASARARAVLLHVPRPVYFHINQIPEGGPFPQPTVPRAALTEMCRQYTCLLVKGQRCADLIYQLTTVFEQKKWHHEQMAPGYRAFFSNAPT

SEQ ID NO: 979151 - protein, 138 aa, Homo sapiens
MLLLWRPEESYPSTVRELVASLPRRLDSLSPNIRTHIDTSSPASRSTRCLCISTHETSSAQDARGLLRGDPRSPPCSVGIIKDGPLRVRHHCPRSASMVGPPPERQINLRQQFRAENNLCISLLAYALPTSIPCIATT

SEQ ID NO: 979152 - protein, 191 aa, Homo sapiens
ASSEESGEHIIAGAVLSCTCEICLKDLEEDHACIPIKKSDPVCLVPARRVIVKSRTCSASPMSPKKHQAAVTVNGAGPFPLIGLGRGHPITYVQTGGNKNQIQVTLQTPSWETSCLTPLGHKGTNSGHRQLERPRWSLEGAPWQTGLPRVGYTGGPPIETGATTGEPPKTSTHTNPAQNFNTQNGAGFGPR

SEQ ID NO: 979153 - protein, 235 aa, Homo sapiens
MAPRALLLSALGGVPGPDRDLGLLPLHEVFLTRALSRPRPRRAPVHLRWATWTTRSSCGSTSDCLRVRSRARPAGSVWWHAREGAGVLVTGQTQKYKRQDMADLSEPAVTCAGYYNQSEDGSHTLLEDAGCDLVPDGAASSCGCDQSCATTCKDYIALTEDLRSWTAADTAARDSPSRIVRQCGPVPVDAAESPTCHRAVRASGSGDTWQNGHRRRCSAQKSSWMTTVTHLKTLV

SEQ ID NO: 979154 - protein, 57 aa, Homo sapiens
MGYYDHMPIPEGECDSAVHVVTALIDNNVRCELQVANGRTNVGWVTNMLDNAYNPSI

SEQ ID NO: 979155 - protein, 618 aa, Homo sapiens
MHLLNRRCPVSSCMISSGPSRPRMLQHCAQRDTVRTASRFDVEPYHPSWVTLPLPSTIASTQWDIDKSVAAQITRWALAPHRYPQADCAQRIVDPSRERPVAERHAELQPTLRARVGDKERRTGHREKRTQASVHRYSVPTRQASGPSPQGTAADSSHEQCERGRRSSRSEGLSNATHRIEAIGADSVHPCSNAQDCNLKADSRLEPICGPRRYRQRHTTNNSEQAIPPTIYATPQRGVHTTMGAWKPSPLDPHWGEHRRCSMPTPSHSNTQDGHTTVTIDMVRSRNNTHGMETDPVAWLPIFHQAEECGLSTPGIESSLAAMTTLRNRNQGLSPLVTVVQRNDIPTGETGQTTQIDTPFSNTQDPQTTASKEKRDSQKLEEQATLSQQEEPATQRQHAKTIRNEHNQCSNCLHSEGDTTSRISAPLRRAYTPTVHTSEHTSPVVRSPTTEATPTRRATTQYTATRNHQTALTHSPSHSHTQSINQRHTRSPTTSNKTCSHHNTVPRPQHTKTTDQRHNRKVATEDSRATHKTTQDHSHTNRPQEPAREKRSAQQEQSSSTPGHSNAKQNQQEHYKQKTRGKNIETTTQTQKQKQREDSRNNYDTRHRTHTPTPQPNT

SEQ ID NO: 979156 - protein, 112 aa, Homo sapiens
QAGSLGSRTPWFPGYGPQCPVDLAGPPCLRALLGGLGGYWRALWSGHEKGRTMNLGPLNFSGAQVTDGIIIVGDEILKGHTQEHQTPVFLCRTRERSLWVQVCRVLSWYVMR

SEQ ID NO: 979157 - protein, 356 aa, Homo sapiens
DAVLAARRRLCSRRHRRQPVRPRLLYPACCSHSPACLAMGAAALACPCDMCALLLAPAAMATKIDKDGLPVAGCTTVVLLDDGSAVILGDFEHMTGSTICPLAEQGAEYQALHPACAQMTVRLYGHSCASPPGDAMSKRSKISPHHVDSVRTSAGCKRAKTGDGQDPGDRGRQTFAKELGDPVTPTGAGVTDSSSSEPEESAERSQLQTPQTDTNPKDPTKPPPSTGQSDRHPGGTTDRTATEYTNHTRHNRANEQATRRQGHEPVGTTQHNRQKYLETVQFQSRRAMNVYMKIKDNNPNKEEQNGKNHNEQQTNTTRPRNPDKAKHTEHRTEETTKTENRNMSTASRDRPNTETP

SEQ ID NO: 979158 - protein, 148 aa, Homo sapiens
MRWALVGTKVRLSNHGTVSHSLRMKDHRARSSFDIKNIPCVAKHQKRGPLKGHNVHAHIEHGATLLYNAADRTLVSLLCPKQGARLASGRTLAEGMAKIRRDCKSDGRIREWGHKVTARCYSPGPNFSRGMTPRETRRYMITPQAHSG

SEQ ID NO: 979159 - protein, 265 aa, Homo sapiens
VSVFFGWSLHRGRNGGRCLKEETVPSVVAGRSRDRILCARADCRSFNPKECEAVVAWTSDAAITALANAQLEHCLAGQCDMAKYFTPGTPNSVVNVGDECHAFKGERNHCECNGSTRGPCCGRVRYSAMECPLEEMVVSEPDVERRSVTPATGAGPSVYLSVSQCMRESTGAEDNPTKVVFSDSSVWNAAWQACNLRGPKSIAQVSCMRLLLVPWRQGSVGGDRTSRIIAIHRGMAQEERLQRYQQFKDFQRRIRGGTNLFVPGD

SEQ ID NO: 979160 - protein, 379 aa, Homo sapiens
RQLEDPRTRPGSAVDRLADGSEACDRGGHVACNQWTRVMYTCVTCAPVGRAPQGEPCCMWLSGIGSTPSGVTALCEDYETLRQIDVHIIQCSVLDVWTKLTPGEVCHPWASSMWYPTCAMDTSTDPHRRHRSSIWGGRNDTEGACNVHLCLRRQYAQVVHTPRCPGTVYLGPGNGHSACVLGKIMYNIRRATSRQCGHVSTNDIHKLAPSNHDTWTSYLYTGQPDRWRDFTTDHNPGTGQWYVQEDVPNRKEPIHNNNEITGTEIRALTTELQMAGLAPNQMLTERQPGPHRTMRLPSGQQDNKQGTQSDRSNETSLTPGPYTGGQRRNSDQLGRERQTRDDDDCSTTSAYDTTPRPEKHLKLHENATPKRKPHTPDKQ

SEQ ID NO: 979161 - protein, 197 aa, Homo sapiens
MIDELNQAIAKCMEDRGVDRTLNYTERGIKGNAQHGTLHSQSTCQRPWNDSGKEETEPEVRCKDRLPSVDPKAKQSTVTSVVYEKVEVMHTRGREGEGSQHKIQLTGEHEQYISGTAPIKRTKYQRNNNREKSDKYENIAKPPHEMEEARDNGETEISTRKEVRIESNAIDPRNAERRRTRTRHTEHAETIKQHENQ

SEQ ID NO: 979162 - protein, 52 aa, Homo sapiens
KEEGSSDFNMCWLRHWPVATVDVSGPERAELEVVASLSLGAVGTLLCGTEPG

SEQ ID NO: 979163 - protein, 127 aa, Homo sapiens
MSCSRLPCWAPGPGLSLPGPSCASVDQGLCGRCLGMLLCRSGEVRLGGRTGGGVSRCCMLCSRNSYLVESPSGCVGMNCAETCPMNSVQIQTPIVWRVLKQISRSEEEVLAGGASANVECVVAPPRK

SEQ ID NO: 979164 - protein, 438 aa, Homo sapiens
TTEVALTGAQDVSWTRSRRKYNTDCVQGYDPQQSPGDPGPRMGLTALTPPAITNPKSGSTLYAWIDSIREAIIQSIASRTQDGLYTLDYPEAPNAQYPVTRQHRVNRTHTYQDSIKHRNPKAPITECLGHGDQIEIEIPSTPWSSMAYSYAYHKPTANSGPYRQTYPQRTTTIETRYHHIPSAPHPHLALDHTPQQPKKDAHIERVGNYHGEEHNTRPRHSHKLKLGPTSLRKTHAPHTEHGGRQIADPEVYPRSKTEPPRWTVLRAHRKLPKTSETFRGQTSIPLRTRNMHHNRTHIGTHRYSILTTQYTNDLHSQLRDASSSPRRNSLRPPTGKEQRAKQTKNSHTTTRDPHPPVERHSRVRTTRHTHKQHEQQVKHRNHKEQHTTPEDAVTTTAPHSTTNTWYHTYTGNSTTRNREKTNSSAQRNQMRTKTRNNN

SEQ ID NO: 979165 - protein, 68 aa, Homo sapiens
DGGVMAEAEAEPWCLRPSDRPVRGCGLANAGSASVSPTTPMPVGCENACDILRSASPGDACTSMTWPW

SEQ ID NO: 979166 - protein, 120 aa, Homo sapiens
MSDKLTYKVDDIGWLPGERKALAIAENRDAGHCCVCGSGTRHPISVKGARYRWLSAPDLWKTAVLIEDPRSPWVLRCPVVQLLTSSPPRTHAWRVAHMPKAGYSRAVLPEKGAKTGIDGR

SEQ ID NO: 979167 - protein, 74 aa, Homo sapiens
HVVRSRCGICCLTGLARKPPRELQSKAMESLNIGDGGQGVPYMGGFFSSIFSSLLWNSRHENLLIFGIRWSRNI

SEQ ID NO: 979168 - protein, 246 aa, Homo sapiens
LQCTLLEDYMAVILPPHALDGPSLWTVGRDIACSPPVYPAANAACVAKCDWTYRKTVRKPEEVTSGTPVGLYSVTRKLSPVMDNHGCLRAGNRRGRTANQEPAGLDEEPRGSRERRERVQREPVARRKWRRGRRPPVSRCTDRKDRKRRAEGSGSHGMEAREIERTGPLVKSLRRRASKMGNPRRNQNAGPRGAHVGHFQLTQECKPESKGPVHIREHPKRKARRFGRITQFGTIRPDSADIHFQP

SEQ ID NO: 979169 - protein, 103 aa, Homo sapiens
MASESHLSSEALSGEKLYLSILLSYKSPDYNLHSPQELIIFDIFLRDRHLIRDLGYQSTLMRNSTDLLNRMRHTSYCNTLGRVLTLFIWLNFKFTTPRLTKYY

SEQ ID NO: 979170 - protein, 76 aa, Homo sapiens
CAGLGITSSVRCTIPPAAVGVGALRGSSRISESVGLALARNESPTESAAPHSLPWGVGLPLDLAIGVGGVLDVPAP

SEQ ID NO: 979171 - protein, 260 aa, Homo sapiens
GNERVRSFLNNQWLMPVILAVREAEVGGSRGQETETILAHMVKHRLYYNTKISLVWWHAPIGPSYLVRLRPENGWNPGGCGLAVEPRWHQWNSHAWRQAVRTPSQKTTNKEKKQQGGDPTQKNTTTQERHKHKSIRKTPTGIYRETKGGAHKKREKKYNKRKDTGPRNTTHKTSRDLGTQTSGQHGAENRGERTTKNQQAQANNRAKNTTNTGNNSHNVHTHTRRRRPSREHQTANKRESDHSRHEKQGPRRIHEGPLYN

SEQ ID NO: 979172 - protein, 223 aa, Homo sapiens
KETDLLLDDSLVGVYWESTYSRGSPCVVQDGIAEGPELWNQMAQCLTCSLATIYHLTALEALGGVTSSTTIPISHMTRPCAGGPCNLECWPDFLKIKNYVDNSRPTKKQKHTNNKKNRKTHNKEKRNRNEGGGAHDHSTTGGRDGEKRAERRRKRESSTTDGKNTERNRRRETNTQRERQTNRAEHDIITNTSTSISSTQNNHIRTRQKHIHYNYTQLPIIFK

SEQ ID NO: 979173 - protein, 265 aa, Homo sapiens
MSEPRGGRWDEDEQWSVVVECEDCELIPADHVIVTVSLGVLKRQYTSFLPDQGCAIKKVAGIHRLGHEAPSTYIFLEFEEPFWGPECNSLQFVWERTKRRSHTLNYPPELWYRKICGCDVLYTAERYGHVLRRLDLRVDEMALVHEMNDVDWGWPMMSQMIWTEMLASVSPGNPRIPETSWNLDARVLEGSRPLLPWLPISYHAGGLQWRGCGRSLSRPPAVHRGSSKVLGPMQVLDRGEGNPSCVPNPPTKGSGVRQAGRLAAH

SEQ ID NO: 979174 - protein, 114 aa, Homo sapiens
MEDLAEWLNALYWSWVSLGGGDGFLTGLARARPVPTCQRRDLMAARALACRRPARGVAFQAHSVVPGPSWRAKRGHLHRLVPRGAGCAEVLMYETWDLVLRRNEKSGGAVPAGG

SEQ ID NO: 979175 - protein, 194 aa, Homo sapiens
PSVLARAVSACSLRHAAAGLSACTRRRPPEDGDKLRSARDHPSPGCSMAQLFLPLRGSTMVLAHELLQLYRCSGKRDTLTGDRAFRVRIAGRRATCKGVLRLAPITIPCHVHYTAATDEPPGLCWALRRVKWTIPVPWAGRQRCWWRRGVRVKGELRPTGYRVATDLRTQRTHQPNDLPVLLSGRCSHKRTQVY

SEQ ID NO: 979176 - protein, 252 aa, Homo sapiens
TLSGRVWVLVTSLMSWWQPGVRGRMSGGDGPSHQPPGSSRRPARMSGCRGAGVTRAGRMGRRRAPSCPGSFPLYALQVDPSMGCHRWGGEAPPMTGIKNGVHFLQLELINGRLSASLLDSHDTETRATMNLALAVWHPCCRQDAHCQLLRFQATSKQDNKAETAGSKEQGPRQKDWEQAPSRRTNMWRRKPQQRGAKNSRVEEYGRRCRQDISSDPLAERWVLHHDEYLLAVDGTDGKSVLERASWEGLELK

SEQ ID NO: 979177 - protein, 100 aa, Homo sapiens
RFPCRNSLEEYLCVLRPRTKDDVACSVCVFLLPCVGKEGTVWIEGMGGSPGSNEGQDTSSAKRRVSSRAPSPPLFLVSRVFQNSTSISFRVFWDMLLGRL

SEQ ID NO: 979178 - protein, 174 aa, Homo sapiens
MAEWNVRSAPLENGGGVLTLVSLELCALRSGCPLSSQYLTTKEQFHQFLECQMGSENDFLVKPECSDDPAWQLTLVLAPMSAEAVILTSDGLGTMTGCDRGMMLDVTCMQNALVDACYKTITKEGSPGETQHQQVPSAHNDRHASQKPTRPHDTMSIVVPVLSIKVPRRRVKRV

SEQ ID NO: 979179 - protein, 117 aa, Homo sapiens
MSDILTKVHALSALIGYPTDCGMANLSVVDLCWFTDVNAFALIAHEMGAKPEPDEGTRPARNSDVIGENTILINPEDHRLEKKRNLNGLCCLIPAWYQPSWAGNQLSGNQWMELTVD

SEQ ID NO: 979180 - protein, 74 aa, Homo sapiens
HALSFCVKTHDRYCNYMVDPIWQSAMAVSGMDVIVTVGLEESTPQFMNLTRRVRLLDSSTKLGLSCIKKTLIFW

SEQ ID NO: 979181 - protein, 245 aa, Homo sapiens
MGVAVFVRCQVCPPRLGFDTCGQPDAGQACRALGRPRIGIPIGQKYISLAMVGQICGPPPKSGLVPPIVRRHVFEERIEAHTRNAWVHWRQHRGLCASLCAQLDAPRDTNQFGTERPRCGGVYQILMRGPLRLPPHFYGVPRNIPYKAVHVTQGSGGPQVVLPSVCGSRSLVSPPVSHLTGSQGETVVVTTRRKSDLLVNHNPTIDAPLYSELENDSYTPQYCVLHHNERRASRQLTTADRRRYT

SEQ ID NO: 979182 - protein, 69 aa, Homo sapiens
MHEMCHEHNQLQLTVTPLNSRAVAHTPGSASPLLDYVCVDTYLVRMITKGTHWLVTGAAYSDKTMPTTW

SEQ ID NO: 979183 - protein, 293 aa, Homo sapiens
MTSEKLRGKPQEDPVTMVAIAGGGEDGSSARAYQRTGGQSPRGRVDHVNGCSGTRRNPQASLVARHVWAGKLWRHLSPTPNGAEVFILILGVLAPSKSYRLKDRVEASRPARQSQGRCFSTSGGEDDGGWRGYLTGREWHHGSTTILKTQNGPLSQALIKGPRLEPPYGGWPLLCWTISGPHGLTQAAPKLLVPLPMRGPLKPKLFDHGHGVCSPPEAPVLGRGPKGWTKQRPKHSPEGPIYTRKAGACERDRYYKKPSSRGKRRLAELRRNSEEISEAPDPVIRHRQKCWGS

SEQ ID NO: 979184 - protein, 137 aa, Homo sapiens
MDLSRHIHTPEPDREEGAGNRALRQEANRTSPALTAQAGPPPCPSHDHERRPTIALHYLPPNNEDTGKKDHTGQMKPATALPTTGQVIRTPIKQRQGHPQEKKSTKKNKKTDRHTQECAQHTPPPKVTPETREKTKT

SEQ ID NO: 979185 - protein, 127 aa, Homo sapiens
MALTQRTGAPERDCLTTLAPQNPTHTTRDHRNRQPRQGVHREHRTPHQPQDTARTADASTQRERPQAPGSQPGDTSQETACRPTARTQGHPTTDQAQSEHRNPTEQAPGQRNRGDKKRRARDQNSKE

SEQ ID NO: 979186 - protein, 280 aa, Homo sapiens
NCDSRVLAGMNLREISDYALEGAVERLESLSFYDIAMLARVPSAGDWNRCPGSRFSMSLRTMYPRPCAGTVGRGRLCLTSACRTCTWSVGNCNTTKRRRAGSPCDERYALCERSRAKLTIAGTIDHITLTAWSFYYTPHTVHFTHAILAPSSCVDPSMASNKQTATADVLCRPMARTGVMYPCPESLAGHEERPTQLGKRTRSPLARSAGRFAACGRSGTGVGNRSVVPAFHSEPCKVTSPLVLREPLRERVPAALRGFPLQGLPTFPGTDLAPGHQLVS

SEQ ID NO: 979187 - protein, 163 aa, Homo sapiens
MTRGLPVYGPSSCDGLGWHQHTFGFCISVDGDNGKHMTHWTTRTVRVCTGALHVAACECPVPGLVAAEEPPDTQGTQFPFDQQACTGAGPGTPGVVMSSKLGDDVYLDASPEDLPCQTLRCLLVLCRRCGYHGDGAWPGTEPHSLLLILPLSSDTTTLARLTC

SEQ ID NO: 979188 - protein, 255 aa, Homo sapiens
MTTIPRAQLIASLVTCTVNPGKTSLSLKVGTVTVTADIPTPSRMEAGDKGGSGYVVVTSWCQIDPDWSPVQCLPEAQSEPVLTHIWVPMNGTFPHHHTPLKTKRFLPGTITIRNKNTHYTFLLEFIASTFQKHHALMVYRHDYDDIADQTTRAHLTHHGGTSTRALVHILCPWNLTSIDTLNATCPTYNSTGVIHIYLLVQERGQHNEKEPEPTHNNGRPVNTNETPNTETMTTTRPQEVHTDMRRPKTRGDLTQ

SEQ ID NO: 979189 - protein, 196 aa, Homo sapiens
KLPPLIVVAPGMPGPRTCLLIVQTAFPHELEGACSVRVGSWLSILLCDLNCHLPLGQEVNLCTASTVRVCMCFDGEGDLYAPILTTHAMPWQPSNSVIKTLRLWPGVGLTRDVIDGGSMIVGLPGYYPYLPCGVDGNLLVAHGHLGRPDIARTIAYRLHKGAVREEVARKEITPSRGRLGIDLRPVGLAGKVKERE

SEQ ID NO: 979190 - protein, 105 aa, Homo sapiens
MQFHSINAPHTRPTKSNALNHIPMMDATDLDRESAYHGQLTLPMLFSQLWSFLISCVVHSLLYNLRSFGRSQDYFCTPCTTPVLAPYPSKLGGDWSLRSSASNHG

SEQ ID NO: 979191 - protein, 128 aa, Homo sapiens
GCDVVAYGLSMEPCAMTLHSFALTSIEAAGEGTLTPGGIVRDSMEGRRDSMLEMAKHCYTIRSPLRGLMGDEEEWLIHVHAWSIGVLRKLAAAYPIRFTCCNLQARLVTTLRRRSACPVYPRRKIHYH

SEQ ID NO: 979192 - protein, 78 aa, Homo sapiens
MDKYTLAYDPGRYEIDIPVEVVTVREVVSEIDILEVVKISRRSSIDEIAQGDRSHFQVIGCNNVAGSGNDEMAPRVIH

SEQ ID NO: 979193 - protein, 125 aa, Homo sapiens
TCLDDWAGSSPRRVSGVKIAPIQRRHIVFRSTARDTVAERGGGVPPDLAPTVCPEGCHAGECTSLVGDVVRFHVEQSVDVLDTTPRRSRRDPIPSTSPKTRTLDIQVTAPGGQASRRHQAGPVSG

SEQ ID NO: 979194 - protein, 71 aa, Homo sapiens
MAPVLTSLALYEDKDDFNWWGTLSHNPGGGKTMTHCKNATLDHRKRGFKHSEQRKVGQVCTGHKKLPTFSS

SEQ ID NO: 979195 - protein, 273 aa, Homo sapiens
MALSVTRESTYQGHHSTDVSKDRPIDSGDNPIVVTLRSFFASSRIVCLRPVYHSSLAPYPPDVGGQMAPKQATHLAESPLRSPTPRNTIRITRIRSIKSAEAQHSLIERNNRKQIIQALFITMVLGLYFSPPYKPQSSSSLPSPLPRQLRLNIFGSHKASTEFTSLWGQLSSLSASSATNIALYIQTSLGLEAPLILAYETCESMRCLVYDEVLQKEETRHNAMKAGGGAKRTQGADQTIGRGQRGEKEEGKPGKRGENLGAGPKGGKGALAP

SEQ ID NO: 979196 - protein, 49 aa, Homo sapiens
MVARRSGVRGVHGCAMKCTVFFADSGAVNGLERMAQVCGCSPDGERRGR

SEQ ID NO: 979197 - protein, 340 aa, Homo sapiens
METAAAVRRDRSPMAPGPAPAQPILTKSKAPLVATHGAPLSNCGAESIPGQWAPSKYTCAKQVNDTVRDCVLWMMMCLLTLYDKVPERCGDLNQDCCVVYLSSLNGVTENQGGVKPADKGGLLSVQTKDGHCLWTLAIATPGGEELIVCMVLERCARCPCTIWYRKTFIRAWQFCDFMPYVSYFHGFRSQTCGLQVPPALCLQGPHRLCDMSAKRNSSTTVSRICPESSRQHEAPAETTLNDSEPPRSKKGWLSEHRWAKERLRDKEPRAIRIHETDNIMSQKAPDRCDEKTIRPQAHKRRNNSKKEDGTQQSKKKKEEQEKDRTNRSNNAISKQKTAQQ

SEQ ID NO: 979198 - protein, 115 aa, Homo sapiens
MRKIRGPNKTSGTNPGGVKPAIGHSVTNSWGRTQHSVRSKKESTYSTQDTTEHEDNKCRKQVPEHSHHGREQHEDETQPDRHTTQLREEPRRTNRTARPEKKVSRHLLSCYIILD

SEQ ID NO: 979199 - protein, 119 aa, Homo sapiens
MYVTFLPVRKDGEIRPTFTESAFPLCMISSSSFSINGPTQSHEPGVGTSFRKMETSVKLTCAAHPKMRIENQRRHTIKRKGAKPGDNKAKARYNVKKKMYMQSPVRNEQPTSTKDYDLR

SEQ ID NO: 979200 - protein, 243 aa, Homo sapiens
MTRCEVSSMGRKRPGGEGIAWPGDNGRWGRSIITEFRRSDKGGRCMDQRGALEARALVPGIIGKYAQRVAQEPRWLDWRDWQAKSIGGYAETTLGDFACVDSGPGDGKFRRGPPMEIDRCRGRRSRPDTEPPIGKPWGGHITPNETTGTTLTASSKKQQRPGSIRNWTGFHGTAFTERKATNGHGVSQRHVRTQQPMGRINWCPTGDRNARRTPRWAIPRSLDGAPLYHQTDPGIYARELELN

SEQ ID NO: 979201 - protein, 78 aa, Homo sapiens
MVPFRLLHRTKFYSSTENLKLIKHSIIKLTAKNYSSPEATIYMTSYSKLVRKELFEVHLILKPVSQRVKIADPTGGSP

SEQ ID NO: 979202 - protein, 319 aa, Homo sapiens
SSQPQHRGQRVRQSHMVETLAEGFESRLHFILTECTCVCVCVCVCSVLCMQRPWVCVIWHFVVASTRARRTCFPGEGPGGTAGVAPPSSFHKSPWPRDSRAQACLARVDDGEQALSHITSFPLRAPCPAASNLWEGRCLSRIRVCVVTLAGAETQDSRGCARGVPSELLVCHVPACVGAIQVQLFLVEIITTPRETCDDIKRVCNSGESVVRKIFGVGEHRGGATSACAARDLSQCLAQNTFNTESENPGPDVDECTPGSNQCDSSAICYNTGVKQTAVRQGGSQKGTPKTKDMCGKRIPTDRPDKTTTIRKRREPKPR

SEQ ID NO: 979203 - protein, 200 aa, Homo sapiens
SKEVVTGIRGAIILAKLLREAEVLVARGVRVTVNEAYRFRVVLPVYPASLTDVSLALSELRRNRTQVIYRCEVQHGHRIDSSDRCERSRSKGSSFSTERALPAYAFSFSGAQDGLCPYRSPSLATPETDSMSGISLGWASESTVSAGLAVGIRPVRYPMPDPPTRGPSRRHGWTYPGVPELVVCVDPDDALLMCTVMRKT

SEQ ID NO: 979204 - protein, 233 aa, Homo sapiens
MTLLILGLLTNRLTIYQGWARCTTRKASIPGSPQHRPCPKRPSIRDNPIVIYAREVLCVCAQDLLWSAFTHSQPKPPTPHNGRRARGPANRHRPQRKSPVRSPHVAKAALRVITLRDQEYRISLSSADSREVEKESRKRNKVRSTADYKFDWVSIVTLLRASEYCESPFTISDGIYRLNMFVVATGFQRTSRHYRLNVFLTICFIRQLIFHFTSKASLGLRSPPLILASVDVV

SEQ ID NO: 979205 - protein, 214 aa, Homo sapiens
MLRHEAYTQATAYVSEQCIMTHCRHARTRSRCTPWLPDDSLLNCVNTVRRTVMHDLEWGCRSEFIPTTMQSGIPGEMARSLRELGTPENSFTVSCARMMYEAPVRGHWNPLLVLDPWYPMVQLRYCGPRCSLHVYPGDAGRESPDQRGSTHRGEGSSVAGKSFTRVLGIYRSILDWLRHRIYTENYGTTPCVMEDAWYDGNTRWPKMRESGKGS

SEQ ID NO: 979206 - protein, 69 aa, Homo sapiens
STCGTIRAISVTSCAVVLISDAMAVSASQWLAPDDRLSRRVRETPKEVFQSWVIAPVTRVQRHHYTASL

SEQ ID NO: 979207 - protein, 83 aa, Homo sapiens
MVLEQPRKQQRSDLKWTLTSNNDSRQTKVAIDFPSFVGWVPQGPRANQKTSSTGSSLLPITWGPPSCYQNGTFQKHQNDASAG

SEQ ID NO: 979208 - protein, 99 aa, Homo sapiens
MSMTCPALPVELRTVVAHITYDCAASEERAMRQQQQCVSQNGQGGGRAQGILLSAHLHVERTDQSRRTTSWRQEKITRTKEEALELINWYIQKDQSGEE

SEQ ID NO: 979209 - protein, 180 aa, Homo sapiens
LRVGASGTHRARGFSDVKGADVRLRRPRVTCLFVFLERPWCTLSDVASARIYGSPSPVTRVPVAVAPSQDFDSVQRSRPPRLRNEDTKVLEHRPRGAVYRGPRAPPAGSCRSALKPPWLLQGSFSGVQRVPVQARLLFGRRPVQSAGRLVSLSLSCMAMVQAWPVFRSGLLCADDASWTS

SEQ ID NO: 979210 - protein, 291 aa, Homo sapiens
LRYRKSSAWSMELPARVNLSAAPVPESLRVPTGATLQDGPGWRVQVLAQVLALEKERVALSHSSRTAELQEVEKELDRPDRARVAELEHGSSVLQSSTMPSMISIPIRNNYIVQPACGRALPDLYAFTDCMWLRSRSSGTGQAAPSPTQCPGWANEIVLLYVLGHEPMDAVLINDNVAQVPLSLKDTVLLITSASAGPQGMAYGLAYAWTGSCMGFRVTNLADFGSRINASMVIPYLGPERDTLGWPVLVPARPFVGELPGLAWGNAALPARFWVATDAPCGVSREPWGGL

SEQ ID NO: 979211 - protein, 176 aa, Homo sapiens
MSKLPPKRRELCKGSGYSPARRNDDVVNDVPEKRHPTIEKEQHWRTPIQSKDKRVESEKRLDTHNRVNHTVTQEECPLAAKVPQGDPKHKQNPRVSSKSRNPIRYEPQNISKGYAKRVRFHNSIAVKVPFRTVDGGGVTVRYHRYELYRTELDNDTQTRNSQNMREKYLDSKIIGA

SEQ ID NO: 979212 - protein, 293 aa, Homo sapiens
ARGTKKPAALCRVNGDVGMGLPGPMQGPAECAAHGCVLVHRQDCVHVTLESIGCCSCVRPYDACCVMAVWMALKCLRTCHREAWMLMDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCILLNEIEKEEKEKLWYYSQLQGLSKRLDELPHVETFSMLMGLIRQPLEFEARTIRSPDGRAHREPRTTLVRGDKIRDLGLGADVQELMEGRTEEKGG

SEQ ID NO: 979213 - protein, 263 aa, Homo sapiens
TSSRSARMCYAGVPGWQQQSGSLWEPWGGVTKRIVLCPPWQKRSLCMEAQSRSRLEKRLPGMWLPGRFWSTARCRGCRLLRAVTPWVLSQAPAGVRRAVEEQKPQTMTCPYSVDAPCCGYTVVLLTCPRVSQWPGGLGSCFLLRTWRGRAFWPCAGGLCFEGAVTRLFPQALPSRRQPPGDGARSTIVSDAGRCAVTNARRDSRIGALGDSWRCREAAVLWTSVYTDLCFTCLCRLRQQETRPWPGSPLHADAGSGLSGAWGP

SEQ ID NO: 979214 - protein, 172 aa, Homo sapiens
IKRTPFYGGKKGGLISRDMERDLIPNPRGTKNIFFSKERKGGAKKRGGAKQPKKFLAAGYFTATPSEFLAPSSYSVPRKTTLNPEDPHKHTMQQGGRGPTNSPGWGKGGAGNTGVGPPATSALRGYPLWGITPVVFVPLCAGCVPSGGEEAVTKVIRGGETRTRDSAQGSTS

SEQ ID NO: 979215 - protein, 67 aa, Homo sapiens
STTVASVGRCCVDYCALYRTAGPRFAAGVLDWRRFVLRVCDISKFHDNAVDISVPHGTPVRAPRVIP

SEQ ID NO: 979216 - protein, 168 aa, Homo sapiens
DAVLDVVRKEVESGECLQGFQADPPRWGVAAGSRKWARCSSVGSGRSSADRVMNTFSVGAPRPEKVSRHGWCGPYNATLSVLQLVRRMRMRPTASTRRLLYDGLCPHPQADHPHLRGPQPPGVGHHERGHHCLRFPGQLNADLRKLAVNMVPFPRLHFFMPGFAPLTS

SEQ ID NO: 979217 - protein, 113 aa, Homo sapiens
MGAGCRKTHNNRQGRTGHNVEPERNEEKQGKRPQTPPTPSDTENPPLKQHKTRNGHQNRSKPKRDRTHPTHTSTATHENTNRNNKTKKRKTAQQQPPTRTTPPTHKRDTIKTH

SEQ ID NO: 979218 - protein, 261 aa, Homo sapiens
AGVWLAVLWPMAGWPQVAECGWTAVAWWKGRGGSLQCADPPCHEAPRSLCRMTLAVTACISDALCVKRPVGWDLSAQQIEERTRELIEHDQSACMTRKAPRSFEDVSYESTLKALADVEVTYTVQHGISLTSPSMYPPPRDIRTASTEADKKLSEFDVERMSMREDVYQRIVWLQEKVQKDSLRAAGLREYLAAAYIKLEPETMGFNLPRETQDNITTHQEEAETSVTDFNKNLNEERPSDTEPQELRGLPTDFLNIPEKL

SEQ ID NO: 979219 - protein, 461 aa, Homo sapiens
MVSCSAGVRWPRGRLSVADSAVPTVPVEARTEFLVAYVIVSLNWIGVGGVGQKRKSPITKDHVTGGEAGLLEGIEKPGRYPCNYRARPYGRCRDSTWRAEATTRENPRYWAAKHRAVMTTAELLNVNKHKDKKVSDREDHRRGLASPTLYKIFAQANLSGEKRPLYAEHCAQDRNAEGHTGTTYPQCPQRDATPQPRCGAQRGGHATPRRQVQESGLKRIGGKAVPRQEPRWGRPHSHGAQGDRQKTTPLNPQRRGDQTSQTNTQNRPPEPNIERQQDHNKATDKPTQTTSEGTKLAPIYITPRERHKRSRISREKFKRHKSRFNHSCSADINSSYHSRKRKRPPYDTHKGMETHVHTHRGRMAEQDAVSIVRNTEPQYNIERTSGHSTGEHGTTASNHNWTHTLHPHRRTDPQRVLSDNRTSSGIPTNNTEKQGTTTTRPKADPLARGPKPHKPPTDAHT

SEQ ID NO: 979220 - protein, 279 aa, Homo sapiens
WKWLYINGILKNLGFISSGVIFPIAVLIEFRRKPSGRARGSPQARSLSEGKAVPRSSVRGWRPHPSPRGPRYHKNRGAEFYQEGGKIGRVAAWKTAALMTVDREHAEMRRLCRRCGVAKRRASSGGEETGGCDEIDAPTIGAPGPRYHFPPRREKKYGKDGATRITRGGGVQKGGTTGSQGRAKGPPHRMRGGQHYNAEETHFRGRYRERRAKGSPGEDNGIPRGGPIREDKHTVRGFVPQTQIRDTRVERQEHSPQQESAPGAHPKAIHERGDTTIGK

SEQ ID NO: 979221 - protein, 272 aa, Homo sapiens
DAWAASLPRHPRRGARRSGLRPAAAIGGPPAVSRDLRFGLGSGFLLPRRRSSALCGGPKGPRVNSLPARGHESLPRHPGPRRAQNGPGGRRFPQPMPENELTLAPAHPSGQGDWRPIDEGDASGRGCPGGNASSHSVSERKSMDRSMRGQSIEPKPDLVDQAPTRNGRGVLGAELAVQSDCAGTSPRKPRHCNPDYKPPEMKGGTPLRMGTRHRTWLAQRPRTSVGLNTQGGKYNQLDNKYAEEQRRITGALPTFRAVSTPGHALGYRAPVP

SEQ ID NO: 979222 - protein, 235 aa, Homo sapiens
DRGRFSTNHKDMEHYTYYAAHEAGVLGYSSKPPYSKPSWASQATFVGNDTLSYDTVIRQHALIALVSNTSSIDNYHIYHSTEAFCANVGHEVFPKVESGASRMMAVCPAVRQTIKLRTLYSPLVFLTPCSASAYSGGRTQEQGEQSTPPVRRQVLPPRGSLGRPKTSVLLVQPLAGVSSIYRGAKGRSFITTIINIKPPAITQYQSAPLRLIRPNHSSPTSPISPSPSCWHHVYY

SEQ ID NO: 979223 - protein, 165 aa, Homo sapiens
FTVQVCLINQLPGTSHCGTLGPPARERCRPASHASPEPTSAAHAYLRVTVMGLFWEHGAIRACSCFTPQLLPSKGLSGHLLHRSPAPSVWAPTATLSLMMPLQTSQVSSRALPDPAHIPSAGLCWSHEGHRALIPLRPGPSCSPPHLPSAVPVRGSCCCRALCDF

SEQ ID NO: 979224 - protein, 81 aa, Homo sapiens
MRRIDSEYNNGNNCPLYIPHGATPQIINRLLGKPPQREKEQDTFEAHSPPQSPLAVGYALDTNYTRVTPYEKRDDNDITNS

SEQ ID NO: 979225 - protein, 93 aa, Homo sapiens
SRSSLAQGRTTLEGAVGLMLLQCGTRSLPPQEGGRGAQGPLCPTPSHDQTMNQMRTPEKHSVTVDERDTNDEADPTAEERGEPADRREQTQET

SEQ ID NO: 979226 - protein, 60 aa, Homo sapiens
MCRLQYVVHSCLREKLKPKWRIFLTHLLPWDGPGNILLGKQPKLVIGGRYKEQYEAPSGS

SEQ ID NO: 979227 - protein, 302 aa, Homo sapiens
GVQGRDGFPGRAGRPGMNGLKGEKGEPGDASLVIWHEGECPVPQDLQGPQALQGTPVYDSRVCLAGVQPARASRSCQGIRALQDPRAPEGEVGPRRSEQGQSLAYRAYLADSEGSQMNGRRRGDPRLIAGRDTGEKWGGAPAVCWTGALSRFACPVPSPTRGAPRRTPSGLARVGLPEVDNRKARAYQRVGAPWATHMETSAKGEPNRSTLGNTKARRNKEDPQEYHGANTLTKTQTGETPTPKTQGEITNGGKRIIATGLNHEANTVTLETQHGNMRGKKQGTARNARKATTEAQSQRGED

SEQ ID NO: 979228 - protein, 225 aa, Homo sapiens
MIQRHPCPPPYTQRTLTRTHSYPPPTQAAPTPNNTNTKKNNHNITNQHTHKHYKKNNKTRTHTRQTKQTEKHNNNTQTTTQHITNTTQSPHKNHKPTPTHTNHTKHPTTQTNNNSKQHTQHHTYYPTLTPYHTNYKNYTAQTTHQERTTKHKKKTTKPQTNRATQKPIQQPSTKPNIIETARHKQDTPPKPATLSTLIYQTQATTRQTDTHITRNTKHGLDTPKP

SEQ ID NO: 979229 - protein, 82 aa, Homo sapiens
MELDTGVTLRGSDWIKRNELWKLLAHKTGLPGPCTIPPPPTRKSANTDTTQRTLLRQQQALTPHPPPQVHTLADIIVECKNK

SEQ ID NO: 979230 - protein, 171 aa, Homo sapiens
MITSHEEALLVIVLLSVQMGLLVLAGFGCEPYSGRGTPSSCWFCDRQMEACKRLQNRRHDEDSAAVVGLLLTWESGHGPGGTRRLSDNELQEHCPIREVKYVNKEIQNAVNGAETDKDFIEHYNTKSARQLLSKPRKKARRRSRMPLNDHHGTQRQKLNGAPRRCACDHDG

SEQ ID NO: 979231 - protein, 101 aa, Homo sapiens
PAQAALCPSHSPPKKPPSVTNQGLREGELCLPHVVVPPWCLLGTVSVREKAEASVVTSLRRHVDVPDDDSLDTKEQEDPYVTRSRITSVLLSLPYYSHRAQ

SEQ ID NO: 979232 - protein, 461 aa, Homo sapiens
DAWERIPSEPRSQVTAAVPVSRLVSVPPSRHITLPLCSSDHDPQPGNARLEPLTAETGATGGIEGGRRQRTQNGARHSLGESERSYVKSLKTRLTLLCAWTLKQDNGSTFSTSLPICSDPLDRTRDKYYHRYDTPGMMSKQALGRRDTYTLTNTSMILAPRDMSNRTRFNVSLRQSWRNTKAWDAGNAARVEQERLGHIHNSTLVQEWSTPGDLAQSNWLVLHQIHPIKQGLTIYGTVGQQAHWVDRTLTKKATATATNHTSNIATYGSEVNKEQDPGAKRQQEDTVGTLTPREKTTHSPQWQAPKHNPRLTGHRSQLGKNTIHDQQNGANRTPVETRHNSMTMGHTIVPRTGFPQTENQNVPPETLGPTIDDDYPKRSTKKTPKDMWETRSQGKAKTEPHKPTDHGSHTCTANQKMRLTPHSTLSTHLSTHEHTTHVGSNTDAGETSNTNKRQNGKDNHR

SEQ ID NO: 979233 - protein, 101 aa, Homo sapiens
IHVGSVLHSVTAHDDSMYASLTLERASCAWLYSCPCLVLNLTCLEGCQRVCWHHMWETAAPTAGPARTQCAADCVYETQLQSSSTSPFCCRTICDEISHDM

SEQ ID NO: 979234 - protein, 270 aa, Homo sapiens
ADERYVTPAALALPLLSLPETWPSDVAVSDGVINGFNDMKVRKSSISQRESEEAAQARTVHFCLSERQEEHHPAGGQGDPGGRCGPDMSTTPTPSIVKDAGSIRTACILPSMMQYYENQWYRQATIDLVFIFMEPPESAPPRRVKNELMCQVSKERHQEESDMGSTHEIWPANVLATRRSRDRCTPGRPTAGGGSADISLEGKALCRAPSGPLTWSSSGKTPTTLPHCGGWQVHAPLYLVIPGRGWVVIPSRGRGNPLSSNDGQKETTST

SEQ ID NO: 979235 - protein, 80 aa, Homo sapiens
DKVVVDEGQDREVPEENKPPSRHAGGKAPGVQGQMAPPLPDSEREKQEPEQGEVGEEAWTGPGLVMDGWVIFEDPLEMFP

SEQ ID NO: 979236 - protein, 175 aa, Homo sapiens
MWRLSRGVRVARGVSTGECVYTTAVCLPRGVEGCGAPCEEESLPRGSHTPLSLWRHNAVGLQPLSSQSIFCERGVSHSLWFSRVSPVVETPQRISLSEREIGGPPLPTIHKKSGAIWGGDPPRERGESIIQAQGKRGKNGECTKKNAYEYSEDALWGGVWDHSPKKTRRETATPE

SEQ ID NO: 979237 - protein, 248 aa, Homo sapiens
RVGQVAACFLLMWGTGDRSGKASPSDGLHLMLYTAESGGSSWFVGAAILSPDRGSSFRVAPDYGYAGFQADQHLGSDEDTAVPRGAKSNGSQVGVISVEDANVSVHLAARGDKTPTPRTAVMMVCPHCQPWSLESPATGALVGLMSQVFTVLLQLVAMPASTHVGTTEGTSLTPGVRPVRSPRRTCSCGDLRFSLGCASVVSPALVPLWVKAAFHGLYICDCCGHPKTHVSWRPKVQGPSDCFTEVLP

SEQ ID NO: 979238 - protein, 283 aa, Homo sapiens
GRVGPRPGHARARTHTPAASHNRTHTYTHTPANKGSGHPRCQYDASIINKHITYQGHTYVQAKTGQRRITAKERTHIEGELLSPDGTHTIHYTHNNKILIIHKQTVNNKHHLKQKSKTNTLSDTNNKHTHKNFTTKTTQQTTKTTKAGYHKMASHVIDDKGGEHNRSNELNAIENRIIEITLTTTSQLNYDKISYKSHSQYTATNINHNYIDPLTTRTEKREKRGRRRDETRRTADNRAKIHTEESKTRKNGGRDSRDKRQAKLTTSRNHNDDAHTRRAETQN

SEQ ID NO: 979239 - protein, 181 aa, Homo sapiens
AGKKQLPRRQCGAQAGGDERGRMPHAPRCVSPPLNPAVPYPPLHNDELVWVAGHVSLGDLPRMWNPALRASSSSLRLLKGPRRAVSRCPACTPGARGYSLMFAYVIGWMSAVLKCCSRGHPLTYPGAVPSSQHPMGDHRQPRSAMEHTMDAECSEMAGDDRSFPGPVPSKQTGGANCLADP

SEQ ID NO: 979240 - protein, 212 aa, Homo sapiens
RDALCCIAGPHCQKLEAVMVPLPVPCLAGSEQPVPMMNEPLPCPTPAMGCGCPAVCCPRVVLSASAPWVREGPSARRLGAVTALVPFLARLQRLLPPGAERPAHLCTGTLGDEDGAGESEYLGYRGPQRHLVLKSGQNDRTGTGETHDVTGTAGLHDTESSAKRPVTRGQRSSGAEKTVKPESLYQYIQWRENGRKDALSVANGPRVSEGVP

SEQ ID NO: 979241 - protein, 427 aa, Homo sapiens
PRVVGRPPRDEAECPVWGWPEQWMGPTTIHGPLQERPLGPPGTQEMGSIHDQMEKPEQHLRTRRPMGHDPKPRSKPTPRTRHRRLGEGQGPSADPDKTVHEAASNLRRPPRKRQNANNKSATKQRTTRQRPHGSQKHTTDTQTQALTLAPKPITNEHINAKMQDTHERNAQRKRKRMTTNTTKKEENNRLETPSKKDRPQTHKTKQKTQSNTRETQTTKRRHNTEDNKKANKRHKKDEKAQNKKEPKPITKKKTQHTRRPDEKNNMKHNNNKTPLQTKTPSAKTTGKKSTQKNETKKQGKSTEEKEDKTNKKQHQKKGKRHNNPNKQRTKQTETTTKTRQTQKKRNKRTKSKEHREKHKRHRAEKTKKRAEEDKKQNTTQKKRTHHDTSSPTRRTLQGTYSTRPPRRQPSTADRTEKIKHKQKHDTN

SEQ ID NO: 979242 - protein, 282 aa, Homo sapiens
MVVVCGGDHCAHPLLRAHPWLLHTRSAVCSGVLRTCDVLGAVGGGLCCDVTSCAVMLCGIGRGAPLGWAGVTDLLLCDQTCDLHQRMSRQRNQARCVFISLTTQGAGINLCATLANNGGGSAAGADAAYIIEEPVSTSGICSPRVEHHDRRKNERPPSREALCSEMRAAVQNYNSDFIYQLYSEEGKGSDDGRKNVLGHMQTGWGTLSIWIETLEQNLCQSYGVITEKSKEAVAKGTTLTTDDTSGVREKPKKSTSNLWTDETETDMSTATRESEDNEALVN

SEQ ID NO: 979243 - protein, 233 aa, Homo sapiens
MAAVALMPPPLLLLLLLASPAAASGPSARDPFAPQLGDDAELPAAVPDLRPRARSPPGGAWRAASESPYDRACSRSALASCGCRLFSICRFVAMKLQAQMPPKLSVKPACVEAYVKEAEHAGLERTAAGAMPAGCLSPEQEEKGPGGSKVGPSPSCDCVIATLCKVTLSSQPRGFCLHPPGHTTLQTDNGKVVVFQTQPISGEPRIPGGRLKRVEVSWEANPEALEVNVDLYA

SEQ ID NO: 979244 - protein, 262 aa, Homo sapiens
RLSAEKGRLDRTLTGAELELAEAQRQIQQLEVSTLKGQLQQELLKELSTLLPTLRPPREMSSCWHLENTPDAWDRGGPFILDSPTTPRDPDPIGGHQAGDGTEEDASAWTVTEDRVLQLQAWQRLPSNTLTGPATPLHRSEPQAKIIKVPSLERLSRSHGWEESPGSRGQPLEHGIDGKRRRGNSAQGRGTRGPRPMNFGYPENLIATLVYRANVIEENSYSSGSGVPGTMTTIHNNGNMVQKRGIMGDTKPLMYNDNTAKT

SEQ ID NO: 979245 - protein, 331 aa, Homo sapiens
PDVGVTEMGRLGFLTRKRSEEADRGKVKSYPKDEPYMTVHLTDFLGEKDVMSHIVREVRQGGIQVKKKEVVEAETIVRDGSRSGGWWDIGGLCGNPVRGLEYVFSDMSLLDRLPVMECYEEFAIKNRNKGLELKDLYQSKCKEMGGMRMGKKELEKEFRRAGKKYWKSIQVMVHTRRCALLPPGPDEGPSWMKIQVNGGTCGREAGRAARGLEEQGTCEARSEGHDEMDRGNGVTRARVSKGAPAGGLPRKTHEDHRGRAGAVWGMGSVCGSWGTVTYGTTRDIRKTAADYSRVLKRLLSYRTWCDTQTANRGDEKEPRRKKKNRTRNKEE

SEQ ID NO: 979246 - protein, 275 aa, Homo sapiens
AALDPVPRTGAAWPARHLASVPVCLTCALARCLVNGRAAQRNVGSAEGEAGVPQDSDPTEAKPGDALDPELCILLLQMPSVVNYSVPAASCLGGQQTCGWMVAVPGAETAVAQYLPTPLLAGSPCRQTCCSAPVNELSWQGTIGVPSYSNQWLLCAQTHPKGPWENIPNVTGDKNSRDVRSLLGVHLVTCNSHRVANRLHEPTGNRPHWTKLTTGPGDAGTRQVPGTYKNLGYNGKQKAPPGGQGEQHSDPNSVGVPDPLGIKAGEFQKAPERSH

SEQ ID NO: 979247 - protein, 238 aa, Homo sapiens
ASEPPKAGFKPTPLASNDRFSKNKKKKKQQTKQKNKTTNNNNNNKERRGARARQNSLSPPGGGRPVSPRATHPVSLSSEQPTRRRALTYIVVCARSSISIYTRHNGNLSAASGNLTNTRPPSYQRAPHHTRRERPTSERRLLISQTNKTPPITLSLLDGGARATPHHNSQALDTLHYNHTSYISYLYLITHYSAPLSSASFYNILIPNHLSQQSVVLTSRHEPCDIHHHQITTTLTQS

SEQ ID NO: 979248 - protein, 343 aa, Homo sapiens
SLEGAWLLFIGAVACRPRQVAAPCPGACVCYNEPKVTTTLPPAGLQAVPVGHPCCQPAHLPARRTASRMCQCQLPCLPQPHHPVAALECAGPELDADAFTWPAPPEEQLDLRLIYATSSGLWTLDKFHGLGRLQKLQLRAGLQELGHGALFRRAWLAPEIPLHMQDNAAGEATGMIDTLPAKRGQPITTHSSLERANLATPGRALKTPPYRGLHSHSTVITTGPRTVLGPWYTGMPSCETFGRLIDTFYSRLANDYNQELAHLSAWPRVLVAVKELDGHGNPCFLACRAASYSTGRDSKKSTKMHNDPEAGRRYVNCITSLQVAGYYSNEENINNDPDQNKKR

SEQ ID NO: 979249 - protein, 222 aa, Homo sapiens
MLPPTGGCRSVEDVRGAPAEDPRVHHPGPVKNPQFPFRMMDVMLEAPVESELYQTKPVPTWHANQLGCSKAGNCADGSRLCCSMHADAWLRTLDAGMVAPDDSSACDYLACLSACLPRVLTLLWGLASACGRLAQGVCLAATSAFSPVVGSCQWPHDLDTFHRGGPQATRLRCMTTSDATLPRCLGCLPASLPSVLHFIARDWMVTHHMLGSRHCSDTAGDP

SEQ ID NO: 979250 - protein, 226 aa, Homo sapiens
MRRRCMPGADVLDACGSHGLLTGELTRGPFGMVGCKGEGAPDGSWERSCDGHLSKWPLVSTEDAVTLLGPENMCWGLMAGFKARRDEIQSEVKCHLVLFRIPSLWEYPALSEGMKTRDNRRHEWKGTHGKGPGARAERGKKLTWLLCQQGSHVCTPSMRQLPAMAPCAWHKRCQMACLCFPLTIVFLFFTWFSLFSNTECLIRLKLDIALPSDCRVTDGLKTLFST

SEQ ID NO: 979251 - protein, 98 aa, Homo sapiens
MGDLTKNPTGFGCKQLYGRSGLSTSVAGGRGSTLLRCLDRRGTAVMAAMESTLGAGIVIAEAYDSSVDCWLLGSFSGLIPDRYPLGYYALRVWGICGV

SEQ ID NO: 979252 - protein, 67 aa, Homo sapiens
MTSFSWPAAAAAPGRYDSSDPWGVAPLVASISSGMAGPNVRPARRLHQVPIVRPAAFPSSRQGVRTG

SEQ ID NO: 979253 - protein, 405 aa, Homo sapiens
LNHDVLQRSCSPGGPVRRCLVTLVMAHVCLLPLWGDAAPEALVKARRLLELVDGAWGRALVGLQGGPFGLYAPGRPSSRSSRPLPSLYEPKEVRFGGAQRLSGAQVVSPIDTIQPNDHNRNRQIREHRDTQRSTQGDKKTRTTFQGRKPECEDLGTKVPNRLGANSRHGQEGNPNLRAEDKPGKPRLQREHIEEYDKAASQQINHRGKKPKDDTDKSQMARHRRGTNDRLVEDNNRTMENQFRKNQRRHSRGQAWRTMNENSRSPRTVEKEDTREKKEKKRTKKRTQKERGNKREEQKNKKRRENKKVKKKTKKEKEKKKKKRTDKKTTRKRRKNRQEKRRRKEEESEGRRKREETGKGTRRKRERRRQKKTRSKKKRKEGGRREMTRGRGRGRELQEGRGEKEH

SEQ ID NO: 979254 - protein, 354 aa, Homo sapiens
VAKRGGDNAVVGARDVSLSSAKALRPSHSGPSSIAHSGAQIRGSGGCGSLSRPDVGNPADRHGDAPPSETEPWYDQSEHPINGPRYCSMNETWGSCDEMRESSCLDEHSSNEMMGSYAERAIRTGDEASSTEPRRRRRHADSEAQGRPLVLVLCHVRTVRGWRVIATLGGTDQAVPCALTHTREPTPGADVGEYRALGMDALALSLALVLMLCMIRLNVAFIAYVSSAVQVFMAVLMHDVIEASGTGAWTELLMAVEPYETIAFKVPSSRDRQGGGRVLDTLEPGRPRQVFLQFHFTDGKKAQSVKQGDNMKGPLGGNGGQRARGKAASHGPQPRGAGESRATATGSRQEEAQE

SEQ ID NO: 979255 - protein, 482 aa, Homo sapiens
SSYLGGRARSAGGDESGAQSASPDAGEPTDITRATHRTPCTRELAGAGHVALGDLSSECRNPPLRASSSSIGSEGPGELSDAQHAPGQGQSHISVKPDTGRRGLVVTRARGGIITHDFSAECALISTGIPMGDQTRKAQSIQGLRKTVDQMKGRNWPGQKDTITMGPRYPKDRRTERGLRNVAYAQAHGSGTDRPSHTPYHKKTRKNEQTRKTGSREQHGKDTAWHGHHQKRNSQPLIHRGESKADARGATTMTWYTECNLTYGELPPRVMEHMGIVTTGCGEENDQRGTPHGNSRNQAPPAREKVTHIGRASGAKTRTTGANGEQRPDEKTNPVGQQPETKRTTLATEEKREEAKDSQHNEEQQRHTSKGKTTRHREPQRHTSGKPHTWSRTRGEIKEAGYDDERQTRGKATQKERARAETAEQHEPTRRAKESKKRAKEENGRKKQRIHIEKTEKRRAKQTTANRTQRRTETKQRRREEA

SEQ ID NO: 979256 - protein, 147 aa, Homo sapiens
VRAAIQTRSRVTLQEWNDPLDRDLEAQLIYRHLLGVEAMLWERHRELSGGAEAGSGAHEPWQSPRVYSYGPGCYRVLAGPSREGPEHPSPDAAPQPLRAQHDYLETSRRRGTRHYRLHPLLEVTPDHNALRENPPPRKLLKPPNTHH

SEQ ID NO: 979257 - protein, 100 aa, Homo sapiens
TRKVPGLSLLMGRQCLDSSSSLDLPSSPSHRPTYAAPDYRRPGELIIKDDTSVLTLNTRTRNLKYRIDPMIVITDIPLLHTQSTKHTMNNINIQFNTKSK

SEQ ID NO: 979258 - protein, 234 aa, Homo sapiens
RSALGSGADAMSAHLEWMVVRNCSRSLIKRKRMSYSTEPNTLEGPGRFLPLQADVITAGNDVWAVDAWYAERLIGVVVVINVGGSRPSGNAWHPRYVLDHHTNKKCRRAHASAACRHMIRKEQSIDPTCALVSWGVGDHGVGESGPVLWGHGPPIYLVASMGWDEGWMSWLCSLAPHHPVVGLGGGWCDVYEVLSLALFPRPQVAIRGPERILGSQTPVMVRKNAGPWRRPMSS

SEQ ID NO: 979259 - protein, 227 aa, Homo sapiens
RFKQFLCLGGRGCRDHATEALLPGSSNFLCLSTPKVTADIRGVTLLTPMAAFIRIAITEQTGLAEHKCKAQEIRLSEDHYADYTGKAQPQHIEHSHKKGSIKRLNKEVIARRTRRNTQSAKYHKDVYSKKGEPSDDNSKYRQEHEEKVTPTNTVGGKNPPLGRHLDTYRDGQNQIPHWRKPNSKNSTSKNHRGIWGDGIHRKLNPHYAIKAPQDDSHSHSGLVERHM

SEQ ID NO: 979260 - protein, 237 aa, Homo sapiens
FFFIFWGFNQLLFLDFHVGLWVFCWKHAGYMWVLESAAVQPEMHRPSRPPPRPSDCARHRTDSAWCPGALATSLGPLDTHNIQDCVPVVPHHDRQSVPQGPRVVQTDAAARMVEVSVSRVLERVGRRCGLCPKLASEHRDDPARQGPQPAWARQRGANTCGYGKLCYVTGGNTSTVSWLHGALGVSFKYTLIGCNLTKQNNKQKTKYITDKLTPQFEQIPKAIPVIPNDESNRPRVL

SEQ ID NO: 979261 - protein, 135 aa, Homo sapiens
MIIEQEKLPDASYSNSARPHTHGTDPEGTDVRMNEPEQNLKNRTQGNAVSRYYEKKDQEAKMGKLQDVRNGSERGHVVIACDVGCEQEVEVTVWSVPPGVTISCASGAVLEASAGAVGSVQRRSEKGLDGKMKHK

SEQ ID NO: 979262 - protein, 272 aa, Homo sapiens
MVGEQFYNTAPTVGSKVPGSRTNTLTTLKCLLRYVGEFKINPIWQLGLGRHNHRIWCCHSGGNVFLTPDDELCGGRAPFQRGANLPQPLQIRETYTHDDASSPNVSDNSNIQPSLITRRCAIKWRRRAAVTLWTKYRTSTAVQTHNHGAQDGGPHTPRRHYHMSIPHAPLYYHISLTLPPASYPATTSTTNFSVCHTTHSRYHHSHTHLSLAAQHPPTTPYQLTTTILPPPAPTPPTTPTTPHPHIPYTPTTFHPHHPHPHPPLPLPLYYTP

SEQ ID NO: 979263 - protein, 227 aa, Homo sapiens
RAGSGAQVPSGVSTVRAGAVQVGLWQAVGSHQRGTPWRTPPSPLAEGSVVSVDFAGPRRPSGLDSATTNVALYCVCAYCNDHSCRARDPTYFSFSRGDVIAISPKMLASRGRCSSLGCVSGTCSVAMFQKAESVARAQLHGDMPGVSAQLISLARCVCTSGPGWWRSASSGRRGALADSLGRHNSMREGSAFVHASGRQPPAETQDRNGPTLTLARCICRCGSGGVR

SEQ ID NO: 979264 - protein, 411 aa, Homo sapiens
HASSGPAIEREHQGHRWASVRACDTSYLTARSLESVDAKSESEPEHSLQSQQAGPSGTHVHVTGTREATKQREENPERTHTHESYNETEEDMKHRETRPCNSKPNNKDSIQAPRRGETHQEQEEHRENIENTKRTHKTYTKRKMQDKEETTTSRHDNRHEHTHRATHTKRPQEVEHHTKQNKHQWITQGLRKNKGPMNNRHTNTRTQMATRGTEGKTTEHESHATVTQEKDHTIATAKHYNNTPTRGGDSTGQSKDKRDSSNYNHEMSNNTPEDETKSQTAEAATKDRKSTHTKSKNPNEQRIERNDHRRTNQREQTTQASHTKRELTWITTRNNKQTTKRKPNRQQTEHNTKHDNTPPEKKQQKQTNKDNNTTNHKQKSKQEYDEATPRRSKKTDTTQQRHKEQQTHADR

SEQ ID NO: 979265 - protein, 266 aa, Homo sapiens
HSPSCRAGPFLAELEKSTRHLWHRVLLPQAALRGAQRTLKPGRPRPQCHGPPTCYIYDEFLQQRRRLVSKLDLEERRRREAQEKGYYYDLDDSYDESDEEEVRGPPPCVAEQPPSKLDTSSEKLDVFATFLAGPPNSRKEEFGWAQKRRKRRRIAGEREARRPQQFKSKRQDRLHRGLALSNPLQPDEMNNSPKLSKKRRSSWSIFKPDHISAGNEARPQQRLVDIGPCLEQEGHVSRQGRSLTNLQGRGLAASLIETATRSSLGV

SEQ ID NO: 979266 - protein, 500 aa, Homo sapiens
MAEWLSRPRVTQAGSQGASREETSEPVRRALWRRRKWLTRELTYSWYSSHDVVHVAMDDIEGDSRSIEMICVSAETNGSDIAGRAHSQSQQINLMGALPCGRRLQRSLRMTRRKMNDEVHVPWGTRLCQRQPRQGLRRLEENKTLGPHAHGGPDHSSGSGGGPGILGLPCPMVPGPSWYQVGSPALPGVERRGNSQYGRHRGRLAQGRPAMGAPCQGALDMAEGHDHRGSRDGQVSDEGYSQEPGGRKNTRGDQRDIFVANGKPWGGKGPSSSDPIGANRPNTYRHAYRREGNASWADKRNDDIGKDMRHIHTLTPEGGESSEEAIENNHDKWQRHTELVMARGANRLPRDEPRSQGREGDKKDTRMIGERAQSHEQGRHAERDTNSVTQNSVSQNQGDTCETQESTERLPASTRELVVDSHWAQAHTGKRPRSKTTDTGAGNRERHTKSKEHKRRYDTRLIDTQGNMRQRESKQNESNRTERSAKRARKQENTKDKLST

SEQ ID NO: 979267 - protein, 154 aa, Homo sapiens
IGDVLRVGTWLMNCRGGAELFKLKEKETQAWGGVQEPSTGDNIREFLLSAQIFRIFIALWNIFMMFCDDVCCSGLLNPSRMKRRNSTFPGCRVSIPPFLMTVTNVCGPEIAEQSSQKSPEALWWVDKSVRQGVHGFPATSLLFKDSVTFGSLIS

SEQ ID NO: 979268 - protein, 374 aa, Homo sapiens
RPPFFFFVWTDVGPLYYWGSLYMWNRGPPHPKPSVPRGTPITRYTSPVKRSPYKITNSKKGAKEGRPDRPKGWGSSGVGRQGHGNGHEGRVGIRPQEGTWRPQPRGRSPDSRERRRSHKPPGDWKDMVVRRIVAYNTYQEVSAGAMATEPEMGELRSGGGALPGNVRETQGTTTNTTDRQRGRETHERGHVAPERRDTVPHKKRTKYLVAFLPVVAFVRPQSSEDRRAAPQQRRETHKNPPRKSPPKLAPMGGTPKGGPTGGDAPKAQTKRDSPLGAPPREQPPKDKLGHHRRNQSGEGERHYAGATREEQKPGWRAKHPQDEKPTNDNPHKTPALCYPRQLTPCQMGEQSHPNTRPTQTSARNTEYDSKDRQR

SEQ ID NO: 979269 - protein, 237 aa, Homo sapiens
RGGPGLAAAAFPRVAAVTGGSAQAPAALDLRPASSNPTAQEDRRRGQALMLVSGRRRLAHSSAAGSEGVPFQPSRDMRLVQFPGTPPGVGLTWAWQTREWWRGVSSLKCLLNPITTRRRCRECPRDRVEATPSHVATKSPGCPVASPTTVGGNLSGVQSHESDKVVCVGAEFMWSHCKELERARAKEPIIFSRFESIVGPYDEVVLPTLEPGGRLRSGAGRLIGKRAAHQGPDAMAT

SEQ ID NO: 979270 - protein, 77 aa, Homo sapiens
DAWVEPRVEDAWVMEMLPRSGEKSMTVNKQESGIGWMEYPSASAGRLTLQVLAYVTKRHDLSHIHGEKHDQKARDKI

SEQ ID NO: 979271 - protein, 47 aa, Homo sapiens
MAIEAYPLTIVPRLLTGASQVVAQSLALCSFDAGLLSCNGLISGGRP

SEQ ID NO: 979272 - protein, 174 aa, Homo sapiens
ERRRAQLAESAAERRCMLGFRRYTVQPRGDKVVQQSEKAGSMSYDRDRMREGKKWVPRYSRQPLRRHYVIEARTDRIKSKDEKPTPTKRSRKRHKETIDTKKTKAQMMKLTPHKRVNNKATKTPKDKPGNKNKKQNRKTKKTTPRKEGDATTKKKVNKTKQRAQKTEQQKDHNN

SEQ ID NO: 979273 - protein, 372 aa, Homo sapiens
MATVSKQRAFYPPTDPRAMEVIIHRLLSMFHPRSLCEDPTETHQGDCGPDLTCHQRHYYYTVMYRIHAEFQLSEPDRLPLFWLLPLTQFTVHIITSPKDDQPRTDDYRDLRDTTNHRSHELVDNGRGPKQQAKQHKQTTKATVDTHREQQYNTRLRASEGDQARHTHTMAGPIQEDSPWRNCKDGTSKQETKKDQPRTHNRGRRTTEATEIQQERNQTAPLTHRAQDTKATHRKEPRDDLGRLTSRPHTNTQGSRQQGTDHPATPQPAHKSIGNTPDDQQEPGRKIAPTQKPQHCRNHRGTTTGRTSQTSNTEPHRPNEVKRHATTTRGARTIPQSHTNEEKRKRQRQRKEQDHKTAQNRATHEEQTNANKD

SEQ ID NO: 979274 - protein, 253 aa, Homo sapiens
MELRLLATVRLHDQSYTLLCVAQTKPGQRVSQMLISTPFPKVKAMVRQTSGTQFIDTDTEVSYSCLILQRKIQSKSYVKVTRLGACEACQDCPVISAGRKLLRGYKDDMAVEAQQKFNIDKLDARRVYEILRLLVTDMSDAEQYRSYRLDMSRKTNSHIRKSREICYDETTVSTEEDVTDEPMELSWTEHGEHSSRLLDIRGYDSLGRKHSAVAAAPCRGGTGANRRAQVIRWGYSHVAFTDTVSLEKGAHHK

SEQ ID NO: 979275 - protein, 229 aa, Homo sapiens
MGPHVGRGFRTWDINPKGCRDQSGEDLKVTSPTGSRNTAACSHRGVNNGDEGYLLAAENCKATFANIANTCHNMKDVRKRPLISSPPNRGQSEHRENQGNRTRDNLGIKKGSPTRGSSRREDQKRQREPVIHRTRPSDGGHPNLIQIGAHTKGARGPPNQQQPPQRETSGVYGAQKKSYQSANAKQCNVEKKTQDTKENPLGVQQIKRHKIHAAHTHARHKHVTPNRRQ

SEQ ID NO: 979276 - protein, 70 aa, Homo sapiens
MREQTECSVKRVGDLPEEFESNYQLMPGTAEGRTDDELLDQWGGWSSLNVRRWVNGDAQARVLRNHSQRQ

SEQ ID NO: 979277 - protein, 128 aa, Homo sapiens
YYALAPLILETRERQLQKEKKVDRTCGAGEVPKFEGELPLASFGLPLSCQQKKVKNVTQIEPLRLETDEEEVSLKVTDLDSTSWKKNCDSGQKQRCINGSSKQRALSQEPFVPKKEKKIMLLRAFLVL

SEQ ID NO: 979278 - protein, 105 aa, Homo sapiens
MRRWRPFPSRWRKTKAAAAGPGMLGLARSPDSVGLLARGQTVGACAGSLAPPLEDSPPPGGSLHPEVKTARVCALVPLDQHLHRLACVQWHSTGLEVGVVSARLC

SEQ ID NO: 979279 - protein, 102 aa, Homo sapiens
MLNLVKPAHSSKGKEAIQGPLIGICRAVEELERWTPRLKVAAAYQHNIPYMNVKGHNNLVTDPATEQNERGDKSRNITSAFHPPRLAASGNNERRNREIYHQ

SEQ ID NO: 979280 - protein, 221 aa, Homo sapiens
GQSGKLSGNLLRVSGVPTQNPTIRAGSSTGTESGGFTCEIQRGPLQEAILEVLKEGRGRSQNLRVRETEAVIQQAPLGHLRRAAPLQQCAGRASQPVTTRVSATGTPWSPPEPECGGPENLINRAPLCQTVKTGDSTDWSSSGHLARSSRGLHSLGGDPAGNGDGTVTSRGLPNIGQRIGNSKVSRSTSSRRHYRTHLRLKRISAPAGQEQRMITARGPTE

SEQ ID NO: 979281 - protein, 35 aa, Homo sapiens
EPMLAASEEAYRHPPTSLMCLEPKKMGSSTRNKPF

SEQ ID NO: 979282 - protein, 91 aa, Homo sapiens
MALGSIKYKPPTLLPECLKPPALPLELGGGRKKGSKDRNGTNPGGDAPQIEGALTVVQPIGNPTQKQPQVDEGTRKPGMSRPKKRTLSYHT

SEQ ID NO: 979283 - protein, 61 aa, Homo sapiens
MCTKGVKFNPPTAVREERYKEERNEEGTEKEKKKEYRQETTRSKMNPGEGGQTTNERIVQR

SEQ ID NO: 979284 - protein, 188 aa, Homo sapiens
MLKRVSEPARRVYDPPCVVSILYAVPKSGEQQEGRRNTETNERGRPKRRTGTRETQEREHNETHLRERKTTATTQPTTTTADTQTPVTTKRKKPHKEGEGTPPQAQQKAETTEKQTAGWYQQKEGGAPQREIKTELRHAQAKINKANRTTRGVTARGSAKTKQAQQRREREETTQRGSPDRGGTHLVG

SEQ ID NO: 979285 - protein, 110 aa, Homo sapiens
MNGGSTAIRGCPDRISRRGYWSPFRPYWPIPLAALGTCGVWARGASLAVTLPSVERNPFEAQSDALAGFPRGHCGAPGKIASVTVYAEAGTRVAPGLPARGWPPLGSSPS

SEQ ID NO: 979286 - protein, 322 aa, Homo sapiens
MSVFPVALLYTWTMATWRDWCADLTAGVLSQAELPSTVDAGARRVEDVGRRASAERLIDGTLAWPQEAISSEVSVASSDRLKDEDGGWEFRHDEERSAYEPLVQTSVDFSDCTSYSDSDEACSCSSTGIACIRVAPSRELVRQVANHVGSFEHDGRSVNIAADILLRLYERPFWWTGLLLAYVQDRHFSSRTLDEMNIEIIREHPLQGLTGSPSTSSGPYLGGTTVDAMWPYFWEVRKQDAAPFRHRLNSYGQKLSQERLAGPLIAPGGGGKPEGPWAHLVGQKRRQRHTRREKPEHKRAHEREPPRKHTRSLDTKTDAAHD

SEQ ID NO: 979287 - protein, 175 aa, Homo sapiens
MCDRRRNYAYDISTQAIRLRRATEESGTSPPSTDERDPRQTQSRLRRPNGHSELGGTPLSVGTFRPAVRISYLNTHNTPTTGWTQSLPLSATTSTRGPTPTARPPCGCTPHHNNMPPHSQHNVGGNTTKGGDSAHTPRWAHPQPVHWGAPIHTSRRDTPAVMYTPTHKNSATQWR

SEQ ID NO: 979288 - protein, 131 aa, Homo sapiens
MLYKFMARRKEQFGWPDEPPEEFPSASVSNDLPFQNLNLSNGHWEIATQRVPHYDQVELSWRGWVVSCVYKPVESCFADRTISSRKERNKNAAQELATLHVVSWQHACQLSTQQSNEPSGQSGLPAARRTD

SEQ ID NO: 979289 - protein, 355 aa, Homo sapiens
MSEGVELDRYIVLTWGVSHRSPEFNNTDQIDLYDDVLTATSQPSDDRSSRTERTSSCSPGAIYPMPNNNEPCKCSIPTVDCVIDRAAVYVGSYFLVETRDQELIHVIRSIGVYDVVDVEISKRIEQMGSPTGMPEVVEPLKTLSTHLLDSYRDSPTGDKGDREAGHREDLKQNEAQYGTNTSRALPQTNGRRRQHTPRTGPHDGGYPGRTKTHDTECPQNKDDKRENPRAHRPTIYSSFSFSMKQKHKTKTTQTKQTKRKTCNNKHTVQKYNKNNNNNIQTHNEKKRREEQKTRGQTERRAQTRQQTRGRQTKATKQNKKSRRDTNERNNRKNERKSEKRKEQDAKRDRTNNEKK

SEQ ID NO: 979290 - protein, 107 aa, Homo sapiens
MFLSQDASGARFTQVCGFRFPAFSNTVLHQGEIRCTEENQNLPTLIKAINNYHFRPSFDRIYEKGTNYRGITHGPGTEEVQGENGPLQDKTSCSRRATVLNRIVSAT

SEQ ID NO: 979291 - protein, 124 aa, Homo sapiens
MKPFYRTIYQRPLSAAGAAGAAARAPAADEHGRTCSALQRPPFQGSREKPWGSDPPTLRKNISPASSGQHNGHTGKPARRHTTVKITNRTESNKQHTDNTEGDTQTSNETSHSPKTISPTERKH

SEQ ID NO: 979292 - protein, 353 aa, Homo sapiens
MAVVHVKCIVYMNNASRPCTHETKASDTRMDGAGAKDPIVIQHGDHVDTDASQLTHSHHHMDTRHTDHQKGGPIQKLVRGRPHPTTSQRQHDGHPNAHESHATWNTSHITKPTIPHGNLAGKLTTTPPALAPPRDPYAATATPLTHHQQRDTLITESHHTKEQTSQRGDHQEETQAPHHNCEKHIPRTQNKQQPTHTEGDKAHYGTATTTEIRNASGVREGPTTHPAPTHPWGRPSSVALAHTEDPHSHEPTRRKRRLPPRQHKASLPMDRPHTTTRANPPLNSTNGHDRTNKQERHVHQQHKQRQSQTDSTIATHEAKQRPTHKQPKHNTAKGHRQHDTTHPRHTKDQSATT

SEQ ID NO: 979293 - protein, 497 aa, Homo sapiens
GRRPIHTCAAPGLLLVAWPGVGPGAYWVLCETRARACACSWGSLEWVVLLCRLGSLVWTEDGVHRVDRMEGVLRCSASAPFPRPVMSSLANPRKNNQGGRLEEHDNPSMSPYKLRKPECTWGTKSGLERDSEEEAALLGCDYSTSGKEGNYGKSQGGPFLWEVGWGAYGIIGARFNDQLAPPGGPGVGHYGAQFLGGNDFVGYLGVRPLTHMELTATRTEGIEGFTYKIPHTRLVPRQSLKDIGETFTRAPVRVLWVTTQCGKSTEGFQGLPWKMETHQPYGITNSSKLTNSVCKTEGKRGDLASIGAAHTCAPPIWRVHPLRGQYVSPKEVITISNNLKHCATLCDTLPRDPPMTRQNNTHQFTRQEPTFGAPRANTNMIPEAHRWVPPQAHGNPARQHHKATGHYSQMGKNPPKVAKAPQTMGTQRPTPPPQEKKNRKENTPPRKRGPAPPTNKTNGRTMVPPIVVRHHRRRQHPPHRGTDNIARTAQRDLPRNN

SEQ ID NO: 979294 - protein, 89 aa, Homo sapiens
MHLGLCRRTGKHGATQWTIVRKGGRRIHLCEGRTGHKNPNYTSPLGAQKWRQWTMFSSKNATTAPNGAPDMGNTKIPVAEAGQDPRRPY

SEQ ID NO: 979295 - protein, 277 aa, Homo sapiens
RVGPAPRGYRSMLSDAGVPGVEEKMHWLPPATPPAAQVPNAPVAMECASVPECDYWESRGSRYVLLRCSHLGGAPWNIAGLVLRDVWACHRGAARDGRFDTKCLASCTLWRTAFLGPEETLPGHGQLRTGSPAGPDLGMCAHGRKRLVVHLLTARVRPTRMTATVGMLARANQYARSQQSCSSRRCRCPLQKHRLGSDSTSWWQPHTPKHNTELAQRTRPGSTELNATPCEKNPTRDTQNCPPHRDTHPENTADRQDDHNREQRQTRSTDQNRHANH

SEQ ID NO: 979296 - protein, 435 aa, Homo sapiens
HAYGRPLSAAESDGWPGRREPGAGLAVAQLNGCALVLCLAPAPVPCPAVPCVDSSVVPWDVLGCDVPQCVLAVLWIVLSHVMRDTTHSDWCERVACCDLTHFLLLFRTVLPDVALVTCSANHDGKTIRDVQECFNVMTTCRTQADLDGYDCEQTYTHEESPERDSRAASTTTHYQLASDLTIEHAARCIAACIAHVDPSHMCNARTPLTRAPQAALLRIVSLGTQHEKAAGIPKSTPHIYRTRSAHSESLIQDQDTHHQHTHNQTHPSTQAYAELTHARTDDIDAGTTRTKRTRSAHNKNTGDLRARREPRTKTTRGEATQTTQTPENDNCVIYSLRSVAAKNGMDKHGWDPHTCERRTYRDHNGQATELSQTGRAHAGHRTEQSTPVLGAPPSAISTPERGHASTTACKSHAVPRRHHTEQPPTDPPYNDKTTS

SEQ ID NO: 979297 - protein, 57 aa, Homo sapiens
LSRPVAGGIRGCVVRGVWVIERGAGGAPAQCPWPPALSIDIEDATQHLRDILRAGPA

SEQ ID NO: 979298 - protein, 475 aa, Homo sapiens
PRVRPALPQRGTPAQSGDTRQGWATSTFPLEAVASCGCSGHTEPSIPGIPHAWLLTNLTSTQHGLSGTVWVSTFTSCHQARHKALSHLAPYSGTLINHELNYFGVTLDNLTHHSDSLICHADGPLCSMHPLVEHGLSTHSVIHVVGQQHVEGHYVTYTLEHETLASTLVPYLQSSLAHPRERLTGHYTQSQDHRQAVPRFNAITSRHQGTNFADPKGTDWVVSPLNHNKRHTTTQPQGGTTKQQQRQQAKKKTPVQTAHANYEEKDDVGCPPHTRAERLDTRARRLNATHERRDDQQTHEAGEPTHHKQRLTQRTPPPTRSHEHHTQARRHVAAPTTPTQTKRHGPHKREAPPQTWEAPAHDASVVTITATHRPKHPERANTRREDKQRRPPTRALTIRPITGDGHDNIPPTARRRDHQRRSDRPQRKDTNHIATGRTTADEAEDHPPRTPTARGAPTDKARPTTRFTPHCEGTN

SEQ ID NO: 979299 - protein, 180 aa, Homo sapiens
MVVQKLWTGVMDIGSNSLLCVVAHERWRGRHAHWFPVIDRGPEDHSKNMKKEFLHRMRSPYRRDTGPNKGPWADCRSTSIINIDSRLVPENSLRLDAPASHPPEWGDRGPSTTKTSTTTYPYPFPQMIPQWTNRNTARPWLVHQGLREERIILAAYGDFPFPPSEFYPNIAKKAAKLLLV

SEQ ID NO: 979300 - protein, 234 aa, Homo sapiens
GIDCIVFRGLPGRPGRTPRECRSTPQPRSAAVAWQRGAGSEKKECGPGRAEWEVSMACVPWNVGLGPACCDCEWGCLVLLLLLWLVCPCHVPRWDLRTPCVDAAVLLPFVVPSLPCAGRPNAPNCQCPALGSCSAGPWRPVTGASLLSETRHVVAELMGRAVFGPGVGRAAGVSFVGDAAVDRSRRIPTFGSQLTSNVYSAERFHVTPVCNYRRQAGGDNGHYGTEAQVDDAQF

SEQ ID NO: 979301 - protein, 56 aa, Homo sapiens
MPNARLDTTELQDRRERVAHKRVNQRQGNTKNERGESIKKGSKLERRKKSGHKRLG

SEQ ID NO: 979302 - protein, 174 aa, Homo sapiens
TSSRSRAAALFFYVFIFYFFSPGDILIQWETQRWGESDIKSDKNVWYTNIQEAPRWREDLWWEEKAGGTTRWAPVGNREEEERPPPPRVITTEETERDARVATGIYTACVHARGHPHNLPHSGGARQRKRSLLRETTMTQRREQHTAGRRHHIKRPTHKRDARVERPSRDECAI

SEQ ID NO: 979303 - protein, 221 aa, Homo sapiens
PKRDIFFIQGKRQIEETPEERGAPRGGTNPSGYTPLPKREHEGGGRVAPNTLYSGSNRGPLWDPTLVWVRATPMRGEGPHTLLRVGHREDSSGSHPELCAQVRHKSASLLPPQEREYICGGRRGYCVVAQNSEESATVRRGVHTLVWRAVVIAKPSQSEAEVAPQTSGDTCGDTQKNTHQQQLCSRERLEVVGDTREEAAHKEWGHHAEINRVGGVRRGVQ

SEQ ID NO: 979304 - protein, 513 aa, Homo sapiens
RALSWRTAPWMCKAGFVGDDARRAVLAASIVWGAPSAPRGVMREAMGPRMCIRMLGGRRPKQQERHPSPVNVAHRRKGIGRRTHGDDDAEDTRWDDQRPVRTIELAVVDSRGSKARDCWTRGPPHGSPQRAKHCRRNALDRIEITGYVTTPCRHYRALGTLGPWLTYSDARCCEYTLDIRHIHGAGNSTLASPVKYRERHRALEPSEEYQPRKRHFGWPTSRYREVGEVNSDPIRTRAIAPNPIVGIHWEPVWRMGAVWYTWAMDPKGITWTTISGRQLRNGRSKHKAFQHEAQRSTQNAWGTNWDAEWTHHSQEDDTPMWTETDTAPTGTVAHSPKEDMSTGERGQTHEGPTPLATKEEQQNTDPYTREQGDTDHPTCSNRQHVNPEHTRSKQQSKHIPPPGATVKPVGNTHKSNPATPRSDKGPQDTSEKDTEAKTEDRGEATRVTDMTEEHRRHGEAAEKTTTERTRDKKERSNQASTNEDNQQRRHRHEEQTNQSKEKEEKQDKAKNTH

SEQ ID NO: 979305 - protein, 225 aa, Homo sapiens
VGSGLPRGRRATTLEARSWNGGGWEETPAGREPSWDVPCTDAGGTDAGDCAQTFTTLRKLSGSTKRPTGVGLPTCSLWPGREALHPALPAPDCCHMVCNDLHVCPEPATGRGMLLTLCPWGTPNPCTFAYSNGAAAGTKARGCHGRKPPKMMQVSSSSGEAGGLGALLAEEASETVSLQDPIISGGEEPHRKVGNAGGCMLWSYPNIVPGTIHLGLELAELACET

SEQ ID NO: 979306 - protein, 430 aa, Homo sapiens
GPWMRPRSLFVWRPMGRVSRSGGCSCVEVNAAPAILLTVRCASPCDEPCICHAVTPVSRVLIRVDVKHRNLVFALWFPHVGMTRRQLCEHNLNLMDTTRLHHIDVCLYTVSNVVQQCIQLDLSMLTSWEYDTAMYEGTRTDDNAHNGQPKATCTRAPIGSSRPTTHGKGNDRPNLCLAGDTLSPRARLAAPHIGHATDRGLPLPGVKYRLIHHGESPLTRNTTTIPPNVNYSLITIPIATTITNRTSQRKGEEIGTRPQRGTEAPITQSMIGTLRRCMCHLVKFTLRHEVPLFLCAPIRTTWRPRRAGVYIDDAIELVTTRKTVNADGHYTTQRNKRVNIGQRRNRQHNSQRNRPRNETLTTMGMSARQRNPYLPQSYLRNAWAPRSKRTTRTQAQGYSTSIKLTTTRGLDVTATTTSEGGITTDQMGIT

SEQ ID NO: 979307 - protein, 352 aa, Homo sapiens
MQVSKRMLVGGVRSCTNRMCLEGGADPAAGCWAQMLVGSATVLPRPRCDVLTRQAAAVLCQRKRLVAVPEGFPTETRLLDLGKNRIKTHNQDEFASIPNLEELELNENIVSAVEPGAFNKHLTTSGRWVSEETRLKLIPLGVFTGLSNLTKLDISENKMDPAGLHVQDLYNLKSLEVGDNRPRTKNYYTVPSDGLNSLEQLTLGEMQPGPPSHTERCTTCMASIVLNAQKPQKYNDNYREIILTKGSTELTFRNIPLAHLEPQKTKILYKSHKLTYPAKPKLGNETRGHNRAGAPPKENIAEQKDMQQTPQTQKTTETEDAQNNQRATNEVDHHDAKTSKQNHSRDAPENTT

SEQ ID NO: 979308 - protein, 92 aa, Homo sapiens
MYKGEYEAGGEKKRSLQAAHRKRLCDRGKCARAGDRETKESKSHGAVIEEKRTNEAGENPQREDTTPQKAVEGQTQSDHTDQKYKLTLTEED

SEQ ID NO: 979309 - protein, 256 aa, Homo sapiens
MQGPARGARESLARRDQSPRTGLNIQSQGGYDDGQTTGEGMEGQGGPHFQGRPIAEPFNTRGEECRMRGSPSITARDPKSGGWGPAETGEMPQRGQGQGRKKGHRGGGPPAMARKATLGRGSKGGRRWDSPKSHHHYTRDGGPSGGTLTQPDTRGTHRGALETRGKGYIGGRLPHKNKGITTSRRLSRHIGEYKKMGEVAEVAKAQHRDDNKTPRGQRETRSAQKLWTPRGAVANDACKRKGGRGVYENLERTIVK

SEQ ID NO: 979310 - protein, 300 aa, Homo sapiens
MAGKSKVCVAPIHSSFSQGQEKAKRALNLFIRTCVPCDVGSVVHLSHVDLFFHNCALPIVNISSQCEPNTSRNESGPQFRETRVEARKISRKRPSPGGIGTRWTDNEKRPREERHNKSYVSRAQGICDVRALRVTRYVETACVKSSYTSEWPSSTLPLLKGSLLNTPEVDAVGETRCGKCGSHNYPGRISVLRGDQRLAVVHNVRRRSPHKFYYVAKGSDGIGKGPPKKFFTKNGNIVGLPNKVWDHAPPLGCVGVFHPPKRPPVGGYIISNTGVVSLATWVMTVGVQGRHPPHFREKEE

SEQ ID NO: 979311 - protein, 106 aa, Homo sapiens
PSRMGVKVWVHVPEHIYAAPGQKDFTSPGGGYRRQCCLAAHVDPTVPSDHVLGPVEHNDYHTDADLAGGEQLSVWPREPVCVEHVVHRIRESCSGRGRIHHRIAGR

SEQ ID NO: 979312 - protein, 58 aa, Homo sapiens
MMRFSEIPGISEKRIISTQVQVLRQEHAAGQPLLQLMNSIGAVKNWVEIRLRAVGLNH

SEQ ID NO: 979313 - protein, 556 aa, Homo sapiens
MTESACDERWVDDTRIVDTIDVSPMTLVISHDTLTPYLEPRQPIIIMSSDVTDIVMSRPIRTSHAVDPLIYLGGEPVPFINHGACMTPGSASLDVMDKHIDTQEKKATKVTIQGNIPNEVKQKDTQEGDKLSGNDQGKGSPTHKDAMGEANHPEKSSTSQRKQRARPRQQKNTSKCSRATGACTRTGKNAKTNQCKTKWRSSTYNTTVYMATCPNKDKKRDKDPTEPKTDPKDNRWNIKKRGDRGHKEETKIRGQIKAINKEEERRTEKKKNTNTQVYPLFPQERRATDKQNPARGKPKTKENTLTHPAKKQRHKHTERNHKKDIDNEPQSPNTKQQHKPPHTDNTNARARQHHNKNTPTESPQKPHRTNTNQNNSNPHTTHTTKNTATAIQQHHHTNSATQDTPTRTQSTKQNVATTQTTREYSQNTTQTTHTQETTSRRQTHQNSGRTQRHNKQNHTRAHNKHTQEIHSKKTNKRQHTTKTHNTRKITQRSTPDENYEPLNISTPKTTHSNIYNSNNHKHKTNHSTTQANYNTRHKQANKRKAAREHSHTLHPY

SEQ ID NO: 979314 - protein, 365 aa, Homo sapiens
RDAWGKKGAGVGAVGAKWMTGPWNRQSRPNMLDAPSTPCCKNDPTGVEALPLNGPTLHLAGGLDARLPGLLQNRGKLGSLQASHGEAPEAPGPQPHRPDHTALGALLQKPEMRGAEETTLLAPQRGVGLGAEGQGPDAQVPGLGPWQPAGVGTTGTQEKVLHKSQSRLPAMEPLKSLYPQEPSRVMELAVASRRQQTEDDGGGRPGLGESSKGSRDNAKPVWTACPTNKPVEAQELTAGPLDVNGVTRVELSVAPETKPVQRRRIDCRTRPGKMASGNITAKYETRDSRTAHVKVARPREEGDRNKDKTRDDEKAEQRGLTITVKKQSRQHTERQKTEGKSNGKKSPEAHKIEGSKEKRSRKQRQ

SEQ ID NO: 979315 - protein, 207 aa, Homo sapiens
MGSPYDHAFMIAPMAPLCFLLRLGGGWDFSECRLGSLILKSKGPRSLRHVVLLAFACKLEGTWKHTATTGEKRRDGGGARQSKTEIITRCGEGGAPRGSYSARFSHRGGSRGGDNPKKVRHPLRERWEISREEKKRAQNESNRGGPSRAIARCMATGQRKQQLTEYATTLVGAYTHKKAWDKNKTVEAADKRPAGGGADNEGGEQTP

SEQ ID NO: 979316 - protein, 153 aa, Homo sapiens
MTKACGHIHLHLDSVMVWRPWGLCSVVLMLELRQSTCCRASCNMDVLALPQAFLIQKVLGGAQEPTFLTSFLMVLLLLGPHCENLCPSATLAPLSVDVGSYWLPLSQSTHVGGGALSTSWVDIGSHAALKFAGARKRMKAHTSKYLNIVTSRK

SEQ ID NO: 979317 - protein, 337 aa, Homo sapiens
MAGAERCLCRLLLLAPALWSLVQHYTPRAFPAYCCWRVRELALCTPVPEIPPHRVPEQPSHYQIVMRHDLRVITPGFCKYPYTQYELAPVSPYVGSHALRSNTLYVRPATRTHSLSAYKSPAPFIRERRTPAGLDLRWLPRVTHKTRHCSEDKGNRQEGRPREGPGKDTLQPDDGQTVNRKADLRLYKSLSNGQGHHSVHAGCRLVKQNLEAYEEQVNSPIINLDNLNYTQMARGGIRISCMEWCHNQTTKEQYETQSVKWVPLQEQLHTNGLAKEVTLSADTKRTNEQEHPRPQEPEKKGENKKDKQFKNRHRNNGTQNTTHMQERERQPKTAGDT

SEQ ID NO: 979318 - protein, 236 aa, Homo sapiens
DAWVSADWTVDSSMLWIQVPPTPKSTASKGMHPWVEEGILGPLAGSCIPERRRPQASSVGSSSSGHACHLALPRCKPPRYSCVELGHPIIEYRWRSPCTRRSLPQECPRVAMHILWDNRVQSSHYYLGSPVRRIRTGSSVCDMTLQAQLCVTALWLKRMLHQEHEGGREKEHMQVVGATSFWPSLWVDVSCGNKGIDIIVGLGRGAYRTAPRQIIGQASITCKDVVHLHSTWRLTI

SEQ ID NO: 979319 - protein, 107 aa, Homo sapiens
GRSPSCLLRNWQLFLPVPPLPPESQPFSPREAEEASPPVADPPVPGILGLQPASGPYSWRSPEGATSSVASAPPWTPQTPEMRLPDPLPTYGKQKHSIGFPGRSFII

SEQ ID NO: 979320 - protein, 138 aa, Homo sapiens
FLVNLQYRRLYRSMNSQYLKLYSHRNTRSYDIMEMYTCAAISWRDEWLVDSLKQKMAGAAPDLVYVNVGGTRGEQDLPALVKGVLPHRLSHGSRAPATIGTQPRKAPFSCHSCMFSRLPETKQHKYVMTTCNPDSTWP

SEQ ID NO: 979321 - protein, 103 aa, Homo sapiens
MSNRKQTETNNYKHAYHNFHVGLYFTLLRASEYFEVSLHHVRRNLRLNIISSHRTTKELSRHYRSTFLTICFIAPGTYFNLNTKTSLLAFEAAADTGIADVAD

SEQ ID NO: 979322 - protein, 342 aa, Homo sapiens
MSPVTGGGLRWCNLPRTAWALPAMLLALPVEPGIARLQARLGGYRLCLLGGARRIGVSFRLEEPSVGGFRWLLPPPPPPPTASAVSARWCEREETREAGRPPRQRGHRTCVSTSGAHIRRARGEICRNNSNCWIFDLGGDCPWPACRGGSASVHSTRKCVRVCMYVCQSRAPPLPHVNPSSDALGTDNQTEWHIVCGGAFNCLQDKYHPSAYSGPTEDPHRNSMSAGAHNRHVAREDYVQTTYMGDGETTNRTDAPVANGAQHQNTRHSETQPREHTRNYTRATQRHGDRIHVQRNPHREQQQKEQKKQGTQMLSNRSHKTKHRPKRRKPPDHHTTPLAPTA

SEQ ID NO: 979323 - protein, 151 aa, Homo sapiens
MINDLLFPHDTNKHEYSTRQRTEARTWNRRESGRNARSRVAAEQERAGRGHGRTTEDDNANTAPHTNPRDTTGVGDGGQLQDTKTGAGAARARYRQASTSRRNKHNSTRPQHSTRQPKAAAEEQTSDNTTHNNKTKTKKTEAAQHNVIHLR

SEQ ID NO: 979324 - protein, 235 aa, Homo sapiens
MNSYRYQGPRRFSEDVLTPSVMRYVLEVHYSQYRSIDRGCLGREAHTLRSNTGYRPRTVRIMPFGAKLSSTKVVPSVAGGAIGRVGIAPIFTTSRAVLKDLPPGAYFGVARASAAQAWHPCLLASARSGLLLRSSLCPVGNLCCSLGVPGGPFGFPLRLGNDLAGLLGSFLCPANLLSGGSSGLSRERASQGRIAGCRKRSGLLHDVFADLAPHGGVAARLWVQPRETSVLYLCA

SEQ ID NO: 979325 - protein, 126 aa, Homo sapiens
MKVYEYEALKVLGKLGGPRGFRKAVWERALQWIIHLNLKNVRNDTIKYQRELWNKTIDAMNDESNEIKKKREAKIVYLTSDGTNYMKRARESVRISEKSSKYYHLIGVLSERQGKELEEENGTGVT

SEQ ID NO: 979326 - protein, 416 aa, Homo sapiens
GEDMRNKMDSEMRRLQDFNRDLQREIGICKSPPGKLKTQEAQCRQSVTCVAKAAMHRENIKRKQPKCRGYEGGEKGYEKAKAQEGPMGVKRAARRQGTKAATIRTEAQKTQVWGNPLGDPGKTHVLCNMRTHPERYYRGRPTRSEKKPPEKKSAPGGSEDTPEVGSDETMCGFFWGTTHTPNEAEKTPGGNPAISGGDDPNKLFGRGSAHSTTQARGTHHPRKKTKDDGEERRNTLDKKFFTPPDIISGGGGTQRTEQQSRRHDNAPRENKEQKHNLFVRGGTPPHQNRGSTHTPPRHKQQKCRRNHASGWYTGQSTTQTELQTDNNKKGGEKRDDINREAEDEHNTTNKKEKREREEEATQNRDKYSPHPPPRGGGERSKQNKQEASGEKPNHTRRKPPQQKGGERKTHNNTERE

SEQ ID NO: 979327 - protein, 117 aa, Homo sapiens
MSQKQDEENPDGGERRAREQDTQEINEGTSALTKQLQEAPLKAKLSKAIGHKPGGSALSLMTETPEHRARSSSRLQETTTVAEAQMNDITQVAQRCQRSQHIDNLVYLDESTILTAL

SEQ ID NO: 979328 - protein, 100 aa, Homo sapiens
MSDRDISKLGCHPPIKRALGVFTRITRSSVETEGLRPRGNTRGRAPKSTSTITPQYGHGKTTKRTSTNRAAEKNKHARNNSTNTEKRGDNETDKQTKWGN

SEQ ID NO: 979329 - protein, 141 aa, Homo sapiens
MDCVASKRLWVSYIPDVGVSIPIEPNIDPHADRGINVGEDGSSVPWRPMHRHIVRVRRTPNHEDKEYGYNLCSHIYGRDFTLDTNLSAPVLSVLSHHEAPVTTKVRLDSTPSIRPQSPKLRTDSLRHGHITPIGNFPSIIP

SEQ ID NO: 979330 - protein, 204 aa, Homo sapiens
MPGEISEDPNIYRQAPLSSGVHASSRPERGRQCLDAGPTQLRHVSPLMGAKEEKASFPPFHVGAGPPVIPEITSRTFSQDSRDLLKPQDPIRSGPEKVGAPPTGTRAGGANSLQDPERGGGTPRDVGWDIQDEARIGKGVTTDGGDQAQGYPSSLMATTAAKGTGALGPTGSICLKANLNRHSTGERELRLQTKRWEPPKIAEN

SEQ ID NO: 979331 - protein, 231 aa, Homo sapiens
HASVVQLRGNWLQRAHRRDRTCVTVSTLSSCRRLKPVDCQQHEIRDLCGHPSEGLRAVRMRVGIVLGRLSRVQWELFTALKVREAEDPADFIRCNSGMYKMPALLGTLLIHDVRLTVAVEHQLTAMPSTVAKLVLKGTRPLWALLHFKEGTRESYWGNQFEIALVCLPRELTCGTPSRFLRNWNGGAYISKRSSLYQSIKVLPAEITVKMDKPLQRGHVIHKLQSPAPCEG

SEQ ID NO: 979332 - protein, 249 aa, Homo sapiens
MARVESFCDCKKSKFTDTHGPMKKFGRGAWAPRGKGFFRNPLLGGGGAARPGGFRVKHCGHKTPCAPKKNPGAQNISASGVSLHQIIKKPRRARTTGRVLRNTQHPQKSRSRAANRSPGSIQTGAGSQSNAPNIYNSAPRREGEKEKQREALASTAQKGATKERRSKTTQPQATQVTRRPNEPTRKANTPAKRRRRHTETTKTHNDKENDRQEGQPKPKPHTTPATGKDENAPEQRNESSRKKNRERSE

SEQ ID NO: 979333 - protein, 160 aa, Homo sapiens
RRRRCAANGEMDPVAEFPQPPGAARWAEVMARFAARLGAQGRRVVLVTSGGTKVPSEARPRALPGQLQQRAARCKPSCRRPFLARGYGGFLFLCIGARSCLSPLCPPFPTPDCGCPVLRPSGPSPFRAVVSLEAEGECTSGLAEALRSYQEAARAGTFLQ

SEQ ID NO: 979334 - protein, 125 aa, Homo sapiens
MTAQNGQNGWARTDGRTEARTVTGDGTQDGRLNDEERVVSYRAKRAAEDDEDDDVEYQRMKERRTRMTRTARTGEVEYRKKKGGMGIVDRDSGLRNCRLAPLIEGHAGNRGVPGNMGVHATKLGW

SEQ ID NO: 979335 - protein, 323 aa, Homo sapiens
MLWMDEVNLQMDAQERPRGCVLRGIQSSMNSCNGIERHEDTMARARSRFSSCIDVGKELLARSQYAGRGRSQRMLSQLQARRQETAEKWQEHDGLASAGMEVLVVGNEMQGWHEAWLCIQEPLVRSAELGCTVEKIESLIKRLRGLLEVSSGSVRSDTVRWKHAYCTKKSRDQGARHNTSAAAGTLEHIPAGPETTRHMGPPVDLWGGPTGFVHTRGKATSAEEHTDQRGTHGCQRRFVPTLRKASRLHLCATHRARGHTAAPREGGEAPKGRRKRNLEEERRHMSSLAIHHHSLNSNSKLYSKLVAIKKATDRNTKALDYGV

SEQ ID NO: 979336 - protein, 104 aa, Homo sapiens
AGLKRWCWLAGRMNSESKNCAWLRVLSLQAWATACDGRAAEQFDKTQMIKEARGPLPLLSKAGHQRSANAINTHGGPREGEARPAASFWAHTTRMGAFTFWSYA

SEQ ID NO: 979337 - protein, 373 aa, Homo sapiens
DPRCTVAAGPIRVWLRGEQRGHVMPLVARLHLHFDLRDDDDAGRRMGPSGSLVSGCPVGLQWKEGFRVNNLLRADEDIDDLEDDPVVNWGECLGLLRFTRLLWQPCGTNVTGVSRLWNQHESKTGCEMTPETVALQSSLHAPWPKLTESTETQNTDKHPSKSMHRRDSIRKHGLPQISTLHPKKTDTTDTTHMGLEPYRGPGLPLKRPCESTVHLPVLSHTTTLNIRDHMTLAQGDTKGMPGDKHMSGERKSATAHEAHTVMNTPRDGTSGHGPTHTTTRNLGHTHTGNHTVRSNGGQLGDQTQKDYHYKQRKGRPQKRETPETGTDTRYRDGQSTKRDPQQTRGTRPKTAYTRDNRPQGHQRKQEKRKNKNK

SEQ ID NO: 979338 - protein, 215 aa, Homo sapiens
QASRRVPWRMPPLPSHGPVELPGITLDSQLCSCRFCVVVTPVLLPSGPRPALLEVCARVTHGAILCSFSLFEPLGSLSVACAPNASGTLMLTAPLWRLPMCREALFMNRAKAQCLDLCWARVGRVSHVDSVVMPVAGLCSHVLMRDAPLLACGVSTLVLAGMGPGYIARIIPPYNDHRHTPSVNTHLEITEYHSQNLGKTMPLFDYISNKMMQST

SEQ ID NO: 979339 - protein, 128 aa, Homo sapiens
CSGTLLSKEPNPPIDEVISTPGVVVRLVEYLKRKENGQLHVRISLGTDEILLLGHSRSDPNVIEAGAVPIFIELLSSEFEDVQEQAVWALGNICWQISTLCWDYVLDCKYPSSLFLQVIFKANTPADQ

SEQ ID NO: 979340 - protein, 48 aa, Homo sapiens
TLFAKKLALHSGMGATSPPVMMASPCLSAGRVLAKAFPVLVAHRGCAC

SEQ ID NO: 979341 - protein, 123 aa, Homo sapiens
MTKPLHRLAQLVDHRADTAHRQQPSSAEDHTLQVLRRRLEVTISRELKPQLSIPFSDQLMLRATNIVCVCSHKPSVVVAADRYPVYAIYTSTAHVGDVTVLTLADIEMAIRRSDVSTSLFIER

SEQ ID NO: 979342 - protein, 246 aa, Homo sapiens
LPVWRVRSFQCLQGSMVPPTETLPTPRERNLASPSPSTLVEAREVVGGNLVVLSYLEVPRGESEETGSSEGAPFPASSHTGPLRVPVELEAPSEDNSGRTAPAGTSDAGPDQMHDPLTAPDTRMEMADGSPTSGGPDVPRPLTTMVGHAIEEEEGVQMPMYCLAIEEEDHVATCKAHHASCKHRHGDDLHRDSTEYKTQNQHDRKQERRTKEHRRRMDNANAIQNQRIQKNQKETGHQTTNQVTGK

SEQ ID NO: 979343 - protein, 76 aa, Homo sapiens
HASHARGLQLERWRRQMPQGLARGLDLGTPRRARGGGSGASAEGARDAEALLLGSRTGEAAGAPLVCRHPCGSRLI

SEQ ID NO: 979344 - protein, 359 aa, Homo sapiens
MGAGTGHPQGKRMAMAATTQTEKTTNARSPMSEAHQNRDPARERPIQHSPRGTTCTEHPNTQPSPSREAQYNTGEHKTYTPQNRELKDGAYSHMADQHKSPTKGAPKQQHAAEQHNSTITHLSPNRRAQPKQSTTTQGNTRQATPTKKRHELDERIATHQRRKRREQTAYRTDCEQATATEPDKSPPSSTNPVDREDTHTTHVDNHVDSHGPGIKTTERRPTKANRGQKWTTHGKRTQQINRKGKDQKRNLRLRETTTQNQKATHTTQTSNNTTNNDTTNDTSQYRQDQPTHEEQTANLNRDATERHKRTRKHTEQTKQHQGIEKRTTDHPRHMTHPHKRDHRAQTAITKTPPKQTAEP

SEQ ID NO: 979345 - protein, 112 aa, Homo sapiens
ASVTMSALPSVLGFSPQTQREGSLGQMGLVPASGGLVRVPLCGEMGDERLTTCQVWPKPPGGPHSGELGGRGEEPPTGICLPATWPHPWKSSGAERWIGRRARGRPQMEEKL

SEQ ID NO: 979346 - protein, 184 aa, Homo sapiens
MAPGGGVGNWGLVPSLSFLQFGTLLCVPSPFVGLGLKKAPQVWTYGENFTRFGVGPSRGLSAPKEIDKQHKGQPTYNITTETHFFLLEHKTYRRRPLISNKTAFRLKTTPLPQMRQARGGTPTDKRFTGQDQWSRTHAGFPTQENTPGATKPQNALWGESSPEIIETRPRWNTRERPVLRNKTR

SEQ ID NO: 979347 - protein, 116 aa, Homo sapiens
MRGEPSARESVDSKEAYNGPVAHVIMQDDRLGPEEECWYHSNEPTRDCTLQWPTARYIYVTKKLLTLYTMYNVFPLDMSAYYHNGSHPWCSQYLHTRRVYTLTSSLVEQWDSLYER

SEQ ID NO: 979348 - protein, 477 aa, Homo sapiens
DGVVRWHGTHDELCRLPKGVLQSSGGPICAPFSGQCASVDAGEDGRVTLTCVPFAAPPLPPRWPSCLALCGSHAGLQERMIDITNGTIQTMGWLREGVTAHRTRGCLAMTVKSAVAPLQQMTEESTKQAPQCRGAYRDHIGNRHDALVATDCLGRSGRHTDTFLLVLFDAGGVWLKCGPRSYAPLAGALVSTEYEAQLGGTWAYLAPGGPAPSFGVGLVSRPQRQPVRTRPLVAALRCRSGGGQSRRSPHRGGNTHSQNTENGGQIAGHQNTREREGESGPGVRDHQGGRQLEADEQREKFTPGTMGSGSENPPTGGALREMKDSFEAKGLKAAAIHTGRAHCTPIERLWGFESSPRADFESKRTDNMPRDGIVKRITGSGRATEQEMETHQWANRRMANTHTENHPAVNATQQPPNYTQRGHTLIAPRIINHQKKAENSDEGDAPTGERRSTNTMGRRNKHRDKSDPRHASSHPQT

SEQ ID NO: 979349 - protein, 300 aa, Homo sapiens
SFPSGVVSKRSCRLLRVPLLVLTPFRSVLVFRAESLFFVAATEDPVVAMWAARAAAVVYRVMEEQDRDQSARILSEVCLMSKIFAFFETGAGKKAQSVDEFPRFVGTLGVQMNYEAVSSLKPWRVGRNMWHISTTGEHTVWWAKIVFPESRVRVHPLPTVIPDQQDGLCLCLGLTGSKTGHAEWLLESPMAPVGPGFTLGQVSCSFAPRCDPGHVLGAGQAVKVLGAKITFKSGVAVKPLIETVVEGASNVGVVIQVGLNGPDRGQVSFNKIFGKKKNSGGNNWAKNNMFKGSVHMRWKE

SEQ ID NO: 979350 - protein, 368 aa, Homo sapiens
GYDTQSVTSNAILFVQDSYGTSRRRQAPCWTSQETSSSGTSYSSEFSKRLLSTYICKGAGQPAVELAVQVQGVRGHQTLETPYFHAQTTTITSYKSTGEYPYTRPRSELTPAWWQLHTEDCMSASYRAAHRARRSRPYQRSMVKVKDNIARDESTNVIPARELKTPRHTGREQHKSTGAVPHRAPTPLGLRHHTQTRNPPKAPGPLPSTPDPTGDRTQPRTKHRHQKIHSTHPTGKTRTTRKRGGTPVAPLNHRNTREKRTIHKHQRVHARPRRTKWTPDKEPKADHNTHAQRRHNHRAPAQSRHRARGTAQHEVAPSANSSDKRNTTHQRQTAQPHSAKETERNHAHRRTTAETATKRSTQGRQEDT

SEQ ID NO: 979351 - protein, 268 aa, Homo sapiens
GSSVSLGFCPAPRHKLRGGALRLPGLRGRAQQGARLCARQGAARPNRPGTCRRMVPTRFALSRKKSSSNGQRPGLQAPGAGPQFRPSNCGRLGVEQSRAYFQFTMLGLRLHTLRTRLTLTYWQENPARLDPRTWSRNWPWGKPEGVWPRLRVGTQSNFSQLGASLYQGRTMFAQDTTEFFPIFIWFRAPRGGVGILFVGNSFLVAPFRRCGLPFPQRLLWLSSHQKMGGGGTFTHGFGWTSYATSPKVQKRWQGRGSPTVGDCYGSGI

SEQ ID NO: 979352 - protein, 67 aa, Homo sapiens
ITNEELYLSILSLPTNLLNYNIHGRRTNQYFISSFEIQHLFPHLGLSVDAEWRHTHVQHTPCNRSAT

SEQ ID NO: 979353 - protein, 59 aa, Homo sapiens
KRRKKKRQNKQHRQKQKEEEKHETTQKEKAKKNRRTKERNKNKKTKAHKRGEGEGEREE

SEQ ID NO: 979354 - protein, 493 aa, Homo sapiens
MIAGEINTEDSTSDVLFPAHAFVALIWELTAMDVAGEQQLDVEHNLFKQRLDHTMASPGAQRLSGMSLGKVEVTGVWSPELPWNPDPAVKTLAMGAEARRYPVLVPPVKDVREALRRRGLGFKKPEYYLSIGGKRLQARRSQEQKNDGCRVRGSWKQQGGGKLHFACETLQQPCVRHDCELGYNNSATLSARANTVRLSQYSHIIYCRAHTVVLASLLPPSSLSIREQQIITQPNTTNQHNNTHTNNTHTKHKRHHNKLQTNYDQQAIQPYHITTNKSNTNTNTKQKSKTRNITQTLHYNTIRQPVQAREKRQRRQRENDGDNEEKKRKKERQGAEKRGTETGHENTRDDRMTTRRRMEKRYQGEREQAEQDNTNRRAITQENNTEHHNAEQTREREKIEAQKATRLHQSHYNGRRDRPTAREGGYRAASPSAQRQDTTTERQTRARTRKRPTRREQAKKRDRKASGIEPHTRTAERRQRGRRMRTSNKLKRR

SEQ ID NO: 979355 - protein, 288 aa, Homo sapiens
MAYVALARGRPGSLLLIVPGVASSTSGVRRGFRERTWLPLRISAMQLARASGRAPPVVEVHGVTDGAKPQMTNLGASNGRPEQSTSLQGLQKESGQSSVLRRGTKHSDTNKHTTWIVAVPCWPDLHMEVDQSRDMDVKSEDYYEHELRDKCEGANNTPVFIQRESNGTTAACLASLNLRSEETRWRNRYWLLGPSHYLNTSVLIDAPLNRVKDDYGEQRSTKCRATLYLATVRGQTAGSCSLVSALKSPGSPASNWQSISSNNVLKKLSRWLVSKNCTRQVRGEEKPP

SEQ ID NO: 979356 - protein, 262 aa, Homo sapiens
MTPGATANTRVCSERTNSARYTACAVEQPLGGLPYSFVSYQDPHTSSLCPTPRTHDTPKSTATHDHTQPTQPDTNHRADPLQARDAGGRRRARTQRNHATDAPTTKENSRDKTPATAVKGGQTTKEIRHEACGGQRWRRGNEQRTQGGDTEERDKRRPGERTSRARRSSRRRTRRTYETVCERQQEQKRRRKHNESARNDTTTESARSASTPPSTPHRSGSKKQGTHSTARREYTAHAISGRTADQQQLTSGTAKYDCRTHT

SEQ ID NO: 979357 - protein, 139 aa, Homo sapiens
MDGLPCLWCLVLGCGLAGGGLCVLPSAQRTGSALAPEARHQRQPRGSCQRSGCPSWDQPFAGAVTKNLKSERTLVDALRADVVDRKGPLVTLKQATGSTSDRKTRRADVKFSVLPELSQSLGLKEQELQVVRSIWERKL

SEQ ID NO: 979358 - protein, 126 aa, Homo sapiens
MGWNKTKKHPNNTTRHNNNCVGRDGPQKKSLQHPGGRAPTRMATGATVSQKESGEIQWVFPPKKRRGDRGCRNNQGVAVTGFDRGRCISAGAPATTDQHGEEKRRRRHDGREDTRRYERGHEQWQE

SEQ ID NO: 979359 - protein, 434 aa, Homo sapiens
LPPFFPAAGEEKKKNKTKKKNFVGRPWDPCGKGFLINHSRCGRRGSTVQVYRGTRVGQKRGYPREENTGHHANNRARANSLHHNINKAPRGHNRSALLGTKISKKGGESQRGAQLTRGAPLQHPRGGPKARSPRILELYSPRGRGDQRTNSTHQRRGEDRAQRDGRRREGKGTRNGRRERRRREGRRRRARAKRKRRQRGRSEGKREKEGQARKDSKQSSTRREREREEAKTRGAGVQGDGRHTRRDQVGRRRGKVTKEVGGRARERASRGRHRGARRARGPTEGGTATRRRRPHGTGGGGAPREGGEGTGERTGGAGRREGRREEPAAGTGGGEGAGGGGARETGETTEQAQAPEGRPAERGGGRAAPANQPAQAADDGWEEETAADDGRAATNRRGAWTTAPHTKGKEPPDRRRHTADATIERAAGQGGSRG

SEQ ID NO: 979360 - protein, 176 aa, Homo sapiens
KNKKGDITTDTTDIVISLEIIMKQLYAKKLEKLQEMDTFLSPYESIEIEPRSKLENLNRPITSNKIELVIKSLPTKKCPGPHGFIAKFCQTVKEELRPILKLFRNIEDERVLPNSFYKASITLIQQQTDKGSLNNNNNKTYRPTVFYKTILNKNTSKTISKSTSKRLYIMNKWDLS

SEQ ID NO: 979361 - protein, 106 aa, Homo sapiens
MPGTTRFCRRALTDQHYARSTWPRLPVYVAIPLIRGKSGVARIVAHLIIEANCKEFFGGVAFVHDAPVQRTWNTSTRVVSSFAEGELRIDIGVMKADAYTCGVPRM

SEQ ID NO: 979362 - protein, 116 aa, Homo sapiens
GIPPSVLNYKSSWCVRSGFIGSEMPASQLQKFVLVENKPRDVYSTPQEGPCWRWKLKENLPCKKNMKKTQEFSKVREERGYLIGSQRKARGTLRIMQEMQKAAIEKKSMHDQEKSE

SEQ ID NO: 979363 - protein, 100 aa, Homo sapiens
AIILAKSLQSSPMRHEATGENNDRYSPRHCPVVNGDYGLLRLLVSWYGLISLPPRASLVLSSSRRPCCLSKSAHDGHGYVDGLDVTHHQARWSVLAHPWV

SEQ ID NO: 979364 - protein, 117 aa, Homo sapiens
REQLQRRGSIQRRRQQFQSVAYFLLHQNSHYAEEKSLQRIREGKDGFQSNLNRSPQEGSARFVRETLFHKKCETKQEKKYLLRKEPWSKSISRGANGKKGGQSRKLEKEAQENDSCR

SEQ ID NO: 979365 - protein, 126 aa, Homo sapiens
RSPNNPPPNTNYLYSYPSQSWQARRHLIQVNRTITEHTIRLTISYYRKIVAIAQSAPVECSKHVTTRSTNLNLITFDSLASETTVIPTLAIITLMRSKPGQKRLNAGSITSYSSTLVGSLTPTHRT

SEQ ID NO: 979366 - protein, 206 aa, Homo sapiens
MGKQKTQQQKLQTHKKTCVCGGRLCGPPLGKNNAFYKESPIPRGVGRHAGGAPKVWRTQLRTMCGGKKRGREAPTRGRKPPGGGQMKAHKGGAQEEDFPSHTPDDITKQKPAAARREEGATQPPRGKRGMVPLVAEPTKTTLSQTKLMQEEESRSHQGDEGPPINTNRGGEAFYYTHKHTRGGRRCPPRSGGETSSEQYLLLDVVK

SEQ ID NO: 979367 - protein, 168 aa, Homo sapiens
CLRELEILYLYQVFVRNMIRSLSSQISDRLRDTSPDMYPPGIIFSRHILLLRTLPITRIMGVKFAFIENLASELPDSGRIYSTRREWQPYIGLDNLYLHETYTTSFSLGFYYRLVMIVALGICVEHTYIPELSQQTRESNERLLKMINSVVTELISEVQEARLNDAVG

SEQ ID NO: 979368 - protein, 109 aa, Homo sapiens
MDMSPLMAPELSCTVCELKAEQEIITCKVVEMTENVAPVDLVRHRSVPGAVCKVLSLPPLLKADGPCYLRKVSAKLIVSTGGVLNRLSVRPNGILAWGASEYDRATSGS

SEQ ID NO: 979369 - protein, 273 aa, Homo sapiens
AEGWEGCAACASPWSPTDYEPGFVGIASARNVTNAVPQGRQGDRILLYACPENCDYQQEATTGASMSTRSRTMLDRIDPDYREVGPRTPMLAADPRTHPGAKRCGTRRAGVLSQVTTVRRPEGRQCAFLLTVVHTGPKCGGHRWAPEVTSFSPPRVVIKTPKIPIVKKKIDTRKPHFVRRRLSPWEEAFLSQTTLWLVAPARPVWVLVGPVVPRRVSPTRGTLWPASLVAWWFSTHLNAPGAPAGFVDHPRVASAAVGALTGVQERNIRRRGR

SEQ ID NO: 979370 - protein, 102 aa, Homo sapiens
MFESPLTCLLAVEILGHRVLLLTLIRWRQKANMNLQHVDSGTSVRIAVPKIYEISRDHRTHSPLLVEMVLKDRGGSYSKIADFYMRTQLNLLKSFLGDLVTA

SEQ ID NO: 979371 - protein, 36 aa, Homo sapiens
MAHQQARPRDTSTGHTRANDTKTDRAHTNTTARRKR

SEQ ID NO: 979372 - protein, 306 aa, Homo sapiens
EAASLHGGGGVQCGVDPCSGGDCWASCLVCPGLAALLVRLCRIALGWELGTAERHGGSSWLLIAVPLLSSECSAQVEFPSSLVGCVQQWLCYRFPSRLHDISWFRTTLGMSRSFFTVWGAISLHSGSMFNGASCNGDVSQVSHRSAGFRDGPIPSYPGGTSVPLKTGSWWYLPGEYSSTKVTQSMGFLRISRSAILFRLSSRGCTKAEELPRLLLVPTPAGFRDGGPGLPLARPDFRGGGVPLAWSGLRDIAFRHLRCPLPEAPLEGGLEGPASPRRAEVLRRGSRFPRGRDVSLGARGGVKGLAP

SEQ ID NO: 979373 - protein, 154 aa, Homo sapiens
MAQLFLPLLPALCPGPGSCCFRAAVLDGDSSEDRAFLLRICGRRSTLQGVLRVAPVTDPLLRSTTCRSPAEPSGCAGLSDGAHTWHISRVPRTGTERLLGGCGEWALQCEQEAYRFRVVLTCVPSVVTDFSLALSELLAKDSGIYRCEGPQRIE

SEQ ID NO: 979374 - protein, 264 aa, Homo sapiens
GWSWCLGPELDLLVLVAAWAPCCWAAVCLLMAAVSFVDAVMPMCLCLLLCAMNVCNGCDEWIVLLLTLCFVCCLCCAVNAPDEDALSCCSDAQMDACGNLSCSVVCLKCTLDVLAGLATGLLLITLEALLVAVYYTYPGAIGAYPERCKHALSKALCLTCLWLLPWELVDCGQSCEGQHFFLVCSAMLDDWTSYDDGHRQSAAELTCLGQWMQLAELRGRHPQLLFESGEDRMLLGHMHLTERRIQPGERAATPTSPGSLPLEA

SEQ ID NO: 979375 - protein, 107 aa, Homo sapiens
SVSGYGTHYYSRKVHILLNGKLKTLMGTVEFIAAGKHMLAVTYSFSQASQNRAQIGIILYHDPQDVDFHVSLGIYRAYHYTYVWVTSSTWLSDMGISSEFRVIHEVD

SEQ ID NO: 979376 - protein, 160 aa, Homo sapiens
DYTRTCDDSRLEKQASYHYYSDAMNLRGPKEPFYISIMQIPWLAPDKGEACLEGYPVGAQCREALIAKQSGHANLDNHFFHSKLNHRICNSAERGSAHTRSHVSPLSELRVASPEYLERFVPSGNKTRHMAFLRSYTCSSSSPYSRGPHHAYELGGARYA

SEQ ID NO: 979377 - protein, 85 aa, Homo sapiens
MGGLSCPGLKGCLLLARGSVPACIGNIPGLTTFLTLDTVHALAHGLGAPLGKRQWRLVVVDHTKSALGLSRMGRGPLATVIGAIF

SEQ ID NO: 979378 - protein, 294 aa, Homo sapiens
ASLNMAAFCARPLRYRARNSVRTRVDEGGGDGGGMVASRKKLRDLLTRRLTGSNYPGLSIEPFDSHWVLCIEEAASGCSPRGSPRRTAMSPFDVTSAQKTCSDVQLNRPNKRSAMNKVFWREMVDVLQQDFERADLSGGVISGAGRNVHLQVLSLMDMVRTSCPPNGDDVARISWYSVTSSLYAGELQRHREVPQAGGIAAAKGGCMAEGGLVTGCDIRTVPGCFLQGEEVAVRWCEVGHGPAKVSDHSGTEGYAAEEVKPGQGARVPQRSGATGNKPGKQVAEGHNEGHQEKH

SEQ ID NO: 979379 - protein, 127 aa, Homo sapiens
MQIPRAALLPLLLLLLAGALPGAAVPGDLRLLCDCLLTCLGAHNLQDADCMCMSSSSVQPDRRYSVVTENDDYTITYRQKLLTRLCARHKQLYRKIDVTPETEQGSNTEPVARQSLTTLRCAQHVVN

SEQ ID NO: 979380 - protein, 148 aa, Homo sapiens
MEHPPYKTIADSHRHQFTDNRIAIESPHDKNARTNYITGVNTKMDKPIQSQQFTTANRQIIVIRYITKPGSQASETTAQCDDNHGPPIRPYHPNAPDEKSLRLNTEQRTKHATTEANPATRKERKHNKNPNTRLRNHYELATDHSKTD

SEQ ID NO: 979381 - protein, 190 aa, Homo sapiens
MSRIGVPRWDWQGVDLGSLWNLGLRGSKAEFLTSLRSPWSKDGRYTGRAGHNKAPQVKFFGIILKAERMGGFPGHLVGPTGGHLPHPSGDPRGSTPRHADLSHKKGGRLNRGVTVQRPPGTINSSHFNSNNYAEVWVPGVVVERNGKGEQRTTTVGTTQGGGQSQVCQVMYKNRPVEQGENPFFLRHTIR

SEQ ID NO: 979382 - protein, 109 aa, Homo sapiens
DPNERKINPTTKINYYTVTHRLSPLPYRNIFAYDETFGLTPVVACMIPPNIIIRTIPRPCHYSGSTLYNRLFINSPTSFEQSKLCVSSSANFTDSHGRYQLSLFSLPLP

SEQ ID NO: 979383 - protein, 135 aa, Homo sapiens
GCRERGRRRISEELGRQPLPRTLPGSSTYLVPRAPSCRPSEQQPPRSPYPERSQRRREVAAPHAQRITGNRRYKQTQGYRLRMTLKKENWYSNEDGQEYAQVFKMLGNGRLEAIVFRWCTRGYVTIRGNLENTTV

SEQ ID NO: 979384 - protein, 74 aa, Homo sapiens
RLHGSEAGWGVRGFLALGRFFKQSLCQQTQVFPFLHYEERSRDQKLIRKAKEAPIQYPVWNKRVLAAIGCMALL

SEQ ID NO: 979385 - protein, 84 aa, Homo sapiens
TYCWRDDMGGKQVVKGGRKIYACRDKGVCEDLCGPRSSIDIEEYSDTEVQKLPGTNSGRNGNDKWVNGKNVFIRNKDISIKEAV

SEQ ID NO: 979386 - protein, 114 aa, Homo sapiens
MISQANFSLPSQRLPVLRSLANKASSNKFNYTRDWPAGGHLVAPFSIHSMSVGKKGRWLSGARHSKKTLVLDSWPLDEDRRVNSRFLPIKAGGEPVLGTKPYLVTTGTSHGHPT

SEQ ID NO: 979387 - protein, 153 aa, Homo sapiens
CHMQRKYVYQDATSPIIEELITFHDHALIIIFLIVLPLVLVCRFSLSIAQTTSKKVLSICKRLRQLENRLTCILPAIYPSLHRRPIPTHPLHNRRRSTIPPLPSNQWATNGTGTYEYTDYGGLIFRSYILPPLFLEPGDCDSCDVDNRVVLPM

SEQ ID NO: 979388 - protein, 176 aa, Homo sapiens
DPWGLDATAGEMNAPPAFECLALEGEKKIPISRGTPERYPMALFYSTHSTNEETDTLRKLQLNHKFHKKNAQRCLFVLCLAKVSPPTLWGGNKDYFSPEVAKTDGGGFYKPPQEDRPYVTKGAVSPESSYSERGPRVLERSGFCRVLADIEDQAGEGELGGSGGRAGGALCLRGPC

SEQ ID NO: 979389 - protein, 316 aa, Homo sapiens
RTLREARERSGTDPRTPDVCGGVAAMSLVNSFLKGLARVRACREWKCWAALVWGPCGKLCWGGLISGAGGRGRQQGSPAGSRLVGRRRLAGWERDMPHPKAGRSSGRHQGEDGLAQVTKSRDAPRPPARQKLFTLSQSVGRGQRRRDGRGRTSFAEKLLVAPGWLGQTGPWQGQAPREIFMTPFLNKVVTQETALHSEATALLGTLDHNCRQVMGAGIDYRNHRAKRGFGGHPKLLVDNPSQAAGHIQSSFDTWTDRDLWQEETPGCLEHAGFPCEELLKEITGASKGDLLEPTNVARDQAAKLDSRAPGTPRAQL

SEQ ID NO: 979390 - protein, 301 aa, Homo sapiens
DDSVRVYNASSTIVPSLKHRLQEMWRLWPGNPLVPLSWLCPATSRAFLSGPWCLPPLSTATLFWCAQSAVSPCAYTCYQFVTGPQWVGGCLELHPWMLLSGYGMSQAETCVPFPGFEEVGDPTARGAPDGSKILVYHFLAGCLASLVRPRCGLVTRWHTLSGAVQIVCWSQMEAIVVTVLGRACDMLARFVPNVVVRAPGGALARCKSAPIACERVGPQILTPDGEGQLRGAPSMAGPAGTPAGVYREPSSAVQQLSFDHNAVWPLRSGRAPAVFQKARGGRTRIVTCGRMSFLSASSLFM

SEQ ID NO: 979391 - protein, 30 aa, Homo sapiens
MEVPEAIAVLFQRGSQGVRLLKLPPAPWNC

SEQ ID NO: 979392 - protein, 85 aa, Homo sapiens
MVNRLQTGRQPRGFPKGRPPAALAPWRAGGFLHNNKKLPAGGKTGPGLEHNLNEEELPEAPHTRGSQSTRGVHKRAPDIKISPGR

SEQ ID NO: 979393 - protein, 148 aa, Homo sapiens
MNTRPTQSSTTSTHTNRTQLTTNITSTTTYQDNHKHVIQHQHSATHTHNNTSYQPQSDRRVRQESTRKQRNRHRRDREQEHRQTSRAKAETDKYIEEREERNQDEQNKAERESGDARTEQTRQNDSGRMRRSAAVAASGGTERLTDHG

SEQ ID NO: 979394 - protein, 203 aa, Homo sapiens
MGIRGGPKERIVARDYAVWFLSTNKKRAPGGRPAASQSTIPKRGSRRGHPGSYTTALQGEVRYITNSARARGKNTKDMSRDEKEKQLSEQRGEATENQTRENNRRARAAETEEATELGDQYKQRGYTGERKGGHKRRDKHKKQGKKTQKGSNNNNCKTPEQETSKRKQTTGKMGKPEKKEPTAETQTTKAREHKTTPRQRENR

SEQ ID NO: 979395 - protein, 248 aa, Homo sapiens
VLCHSRSEVPAPETQPAPTTNPPRPRFASLSAEPRPLPPAAAHGHRPSRSLCPPTCPLLLAPLSPQVWFARPGATGEPGRRLPARGATVDYVPTPQPYRLWGTARLPPPSTQAGSLLTAFVPSVAGGCIGHGGLPLCRGGLAGRQVVPRGVAGLLAEGPRGGHLSSGVGPRRQFQQPAEFQENTPGPETGVHAWQDAWNWTRLRQVTVDQRLRLHVGQQTGNKDSVFDRKSEQDSRAQGKFRPWGDPL

SEQ ID NO: 979396 - protein, 175 aa, Homo sapiens
LFAQARVPTEMGNVSWHSIMLGSSVVTDETRTWHEGGYKKAHWGTALKANPFGGASHATGIRAATKSGVKPKQGQIPAIYGSVVRVQLYHGNAQGKITSLWLPQLTELADTFHCDGKLMKFWMARDSGSQRDSGCGVIFLEGPDSKVVQVARGIIFGPYSTGTARKAQIHTYHWR

SEQ ID NO: 979397 - protein, 206 aa, Homo sapiens
PRSWRRRSESLDFISAPEPASLPAAVGTSAGWEPHLMVAIRKKRGDRAGNGAVWEDLPPHRLQQRIKFPGGLRSPTCLGRTYIADIEVDRQSSVELGSVGHQQARKTMIDAASLLPGTLMSSSLCFSIESPDSLEKHSCEVTPEVKHFCPNVPIILVGNKKDLGKTSTPGRELPKMKPGARRSEKGREHGNRISALGTLSAQQDQG

SEQ ID NO: 979398 - protein, 181 aa, Homo sapiens
MNRQTTQTRVEGARKKQSKIEQGYKGRTPNRVPQTHIQPDGRITSPRAKPSNNRDKLVRTETKKQANKRIDTRQRTNENKRKHEVNTTTQICVIQQRTTTTADNKSANTETLTTKKREKNRKPKTTGHTHEETHRHGYNTGRSRTTQHTATPNEQNKQHKQRKRTQATRITTQTHQKNTGV

SEQ ID NO: 979399 - protein, 297 aa, Homo sapiens
MLARAGGALGPFAEGLSTGFWPRSGAGLLWDGPRKPPGGTGSVQQTESARGVVGTQNGGRISHREIPWKPCGLGHNSLTSLGVVNDPGIPEFMGGPKEAPSTGKQLGSTPPGWPLNDRGAGCGETPPCAPMWVIIFRGTKHARGAKVSLLKTAVGRTISWGTLFYTTGGPNTALKRGVVGKRGPPAVVKFLVARGFTTHQRLVKDLQKKEKPYVGKELQGKAVRGKNRLFVLSGCHPNTRLPSRGAKRRRRTFSPRVKDVGPRGHIVGAAMFAPYFQQPQKWPVVFDNLEAREQRIT

SEQ ID NO: 979400 - protein, 289 aa, Homo sapiens
MTPTHEDKYTTDFTTLDKIMKLCMTVSQEFALSVLVVAAVYPGDMSLSTHSYRFVRTMTQTVQASTTHETHDRDSNPIFQSSNCCTTCTLVTPDSINTNVTERCEPNIFALRHRRTISQEPHGKRPLLNDDKKLALPEDEELQLGGAKADRSSAARIDYDIRNNTQPLHNITPLEGSFEAEHSRSTVGNYDGMTIIQATDFDDFCATAEEMISRYGTYNSQVTLHTTHVYHTSIIARQGQEVKVYQRMQTSSLTANTARMYVEKSNHPNKPLNDSSLLTVNAYYTACPT

SEQ ID NO: 979401 - protein, 423 aa, Homo sapiens
ALFLSPCRCSSLSSCLFVACVCVFVLVLFLFFFSWRLVGAVVLFGGPSVWSAWCGVSWWWWVFAGLRGRGGVGALGPSCSRGGRAAGWNPRLVGRRVSAWRGHVSAGRELLAVCECACAWRSDVGPGGDSCHQWLLVHRGGGSGCCMDVWRRRAGPSWLIGVLVSRSWLPAVRVACVGGGGGPRGGLVSGARSVLVVGVVAGGVAAGVPLCTCARAMGWVCCGRLRSLGTGKCQLGGRGVEWGYGVGVSVAVVDVRGLYGVGVGYVVVGSGSRAQRMGCCHEGLVLDAFAIVVSAVGGGLVQGGISLAACGVMWCRLRSIAMVCVVFVAVSFCCSYGGRRVACGGRPQWMLLVLCRCGCVEASSRSGPCVVDVIWARWHQMELSCPRVRGQPGPSERSSLDCPSNHAGVTVSDMIVDQTHEIE

SEQ ID NO: 979402 - protein, 52 aa, Homo sapiens
MVPIFGTPLGIRAKDARDLADLSEKKGSLEENTKKRPVKGRESEPKEARHNI

SEQ ID NO: 979403 - protein, 319 aa, Homo sapiens
VSSRAFLLVSLFLLVAFCSAVVRFLYYMLVSRVRLHAHVDPLRLLAAYFLFSLIVLSIAVYSRVGSQCVFSVARCRRYCRLCAVQLVVAALVYFFLGVFRVAAHVMAYIAWFSCYLDLLVFYSRLYFLGLLVSLLWQPMFRFFGGRCLVGSWLPLGLRFSAFGILLALVRASDSTVCWLLMLSVSVSARDFCSHELPAVSEVCSFVCRGTASWLSGQCSVCPMLCERSDDRGLPDLSSPYLDIPCSRASIRYMSAMERFRYMDNESHNLRTATSGLGDAAPRYMLSLKSLCYEVDKQDCLQMFASTGDRWSHDNLGFQD

SEQ ID NO: 979404 - protein, 115 aa, Homo sapiens
WGGEFSPRAPPPGGGQGGKGKRGGGGATYKGWCSRWGLLLLLCGFAWGPFGEEGEGVHVRRETFCGRVLADREVAGALWCWLAPSPWCGISFRGWGVSCVYTDFPMNIKRGGFFF

SEQ ID NO: 979405 - protein, 107 aa, Homo sapiens
LLSPSFFPSCLLSLSLAVVCRSASGACRSSSWSFVFLRLALAVRLLLCTVVRLCARVWVFAALFGAVALLWRVGVVLSRSSRLFPLVVSRCAFVVSVLLVFGRLFCV

SEQ ID NO: 979406 - protein, 497 aa, Homo sapiens
NGSLSLFSLFYVGGETSLSLSPPSSLPRGAIRGAAGGTQGGGAVGVVRQGGTHRSGPTTTTLQGQHGGELYEETRNKRERAHTTPERKKKERERGRHKRETTATHTEGRRKGTHTQERKTYHPPSGERSEKIKRRPTKNTNRGRTHNIRKERGDPKKNEPENTPCEGKRKKRPRKTRREPSHTERILTLEREEPNPTETQTKQTKKTTQRREDRTEKTKEEAINHKRHRERDNTERERRTNPRRETRRHTQDEERKNTNDKENKKQRANPKKKKNAPRQNKQQREPTRQTKTTTTRRKQTTQANTETKHQIRKRHTTKKAKNKLKNTNKETITKPTTHTKKNKTRRRLPKKQKHRACSHPSKKTDHTTTKHMNTNTRRAKPAPVGHTTEENQNKGEDTHEGEEQQQPQPGQSTHHQGDRRDNKQRRRNRADKNQTTRMTNHKVMTQPVTPEQATEENLTHTTTQQRGGTKKEHTFDKHDTTKDKEDKTPPKRERIPP

SEQ ID NO: 979407 - protein, 205 aa, Homo sapiens
ANREALRLLTCPAGRGGPGANGPRARASRPLRGFPGWRRPPAPADVDVPEHDLGSAAAPAVEGSWDGLAGGSGQAGPPMGTRRAGSQPNGALRPPAPRFTCAEASGHDKRTARLPRQEEAQPEPAAPWRCPELAWEGVTGARPRELGPVGRPRSLSVTEGFLPPRIINRVHFLANRVTSGARRRGGGAAWPEKARSSYPITDCHA

SEQ ID NO: 979408 - protein, 290 aa, Homo sapiens
MSQDLSSVAVCVQLVSGWIPGYRVYQSWVTCPPYDSVLCLTQVFVLASCDVVSMSIWCFAVSTGSMDVIACCTGPFRRSATMQSLGLLIPCASHVASFQSTSPYRHRTGCLLGCVQARGSLRCVWVSLGVHLGASLEDIRPVLCGALFPDDGDDGVRVLSSRCRLYGKGYISNGRLSITLTAQILLIAVCDVLASGWLSAEWSLNGPLGLLGNLWGTHGYMWCYVRSVISTPGYGVSPDPMLAIRPRGTFGWSCGALDRWPMWWMGLLLAVVVRPGPWDAGLVTLTWRRM

SEQ ID NO: 979409 - protein, 40 aa, Homo sapiens
MAGPGQNSSRRALGQVFSEPSLLARCKPGGPKGGENRNRN

SEQ ID NO: 979410 - protein, 117 aa, Homo sapiens
ACCFSFSPSRCLGSARLSAGLRSSPPFCWHCRLLHRHASPVHCFALLPWLCSSRCRRVILYHYSISSPFSSRGFIRVLGASWTGSCLRVSGRPRALLSSLVAPCSAITSVPPLCAFN

SEQ ID NO: 979411 - protein, 86 aa, Homo sapiens
MWSLGRLYVVRVLYNNVVYPAMKNRAKGPAEYNQRSNPETSADLPFGKARKGVRMGIGIVVEMNIILGPRHDGRSNQRCPCVGQRV

SEQ ID NO: 979412 - protein, 266 aa, Homo sapiens
AYTQAFLTQAAEELRTPLWIGLAGEEGSRGYSWVSEEPLNYVVLAGRGAASSRGGCTYVDVDWGHGRHHLVCDTKAAGWLCVGLAVGTPSLRRRISLPMAAVPWGLVETSVGWIPFRVGTCVSFHMVAAAGPQGGCRQARAERAGGAVHVVSVDEMENVLSWAAACRAMRGKVAGRLAGDETSTLGIGLLVWQGITVVELVQRVGPPGLGGPSDAEPQQRATGFRAKLGYGARRFGATSMGVAEGFLVSGQSSSSHTGFQRTSGWC

SEQ ID NO: 979413 - protein, 292 aa, Homo sapiens
LFCGILYCSCWSDTRCVVVCAFWLLSFCVVLAVSSSCCLVLLLLSFWVCPVFLCISSVCLCVHVNSWFPVGSSVSCVASVCILGVSFLFLPFLPVLCVHWYVTVSRLSALELVPSLDRFFCFPSVVGMRNLVCVPGASLVFSVSVRDLPHVPAFGAVRPSRGLVLLRLLSSHLSRSVAFHGVVSLYLSFHVTHVGPYTLALLIMARDSRLNLPRSPVAIRPSSLWYVYGWLVLVLLGCVGFAWMDWLSPCLGHACLGSMHACLPLFGLHVAVCVACGWKLTDAPYWWSTPCA

SEQ ID NO: 979414 - protein, 383 aa, Homo sapiens
MVTSEGGSRRGLRWAKLHRPRGPPRGCGSWRRGGGIQDRVWRPPNRGTAGGGAERAGRKPRGREALATFGVARRGVPQGARYSNSDGRPAGFADAGALWHWRRGGPPIGGKPGVNCARTKKQWGPHLCRKYGALGDQKGGLALEFVPLASGSGHRGGHSGACPKWFPIVAIHLRKGGAHNGAGYARTFLCESPLCEPLNQANVPLSTSETSGAEGVNCVDIGERMGLYGNLILKPLGGCGVMSNRTRHKPSWVDIQPIKGGTVTQGGKEGGQLFSYKTPLKRGCWAGEAPLKKKPPAKKREERGSPQRDTGVFAVMRGRCTRGVPTLCGAEKGAHPREVLTRHEGGTIRCIHSGGVNTRHGGLSHTEKTQGQIRRGEKTPTRE

SEQ ID NO: 979415 - protein, 310 aa, Homo sapiens
ALFCAFSRAVRLWSVVLSRLPFRLFCFLSLPRSRVPLLVPWLSVRSGGLASPGRVVPSAAVGGSVRVSALLCLFSVVWFAAVFAGRRLSRAAFDCPLLSLLAAFSVCCRSSSFFLFLFRSFVFCLVPSLVWVSCSLYLFVLLFHLCSGVCLWSCRIAMLVWFNLPIRTVLAIRCTLGGTGRHQSDLYPRHADGSLGPPEALAMPRWRSVALAAIADAVLRGSALLGMTVLDAEHLSLVGVSPQKLCLGLGPSAMSLSRPGETEPIHSVSYDHVARLPAHGPSHRWPLEGVGERPSYLVQSPQAEVLTAPA

SEQ ID NO: 979416 - protein, 82 aa, Homo sapiens
MVLKKEALPKRPLWEAPECTCGDPRKKEEPWGTKLPRANGAFHQAAQTDMWGTNTYQRGTNHRVSRTTRDDIERGGTHYPQL

SEQ ID NO: 979417 - protein, 344 aa, Homo sapiens
ALFCSSCVRVSLSSLFSSFFVFPLVCLAVVFCFVHLLPTVFGCVAVQSALCLFAFVTLACTLFCAPVPVARGHVHLDLGPGFLVHPHPSALAGLRSPVRCRDGSCHRAFPVSAWAWSDLEARPVWVSFPFARPRFTPGRRPSGLRLPWHLPAVRSPIPLCRPLVSSPAATQQVADFQRHGRRRCSDKLMCSTWLGSSRNDLALPRSTKLALVSLILTPHIMTRATEEYGGDCTRCPRVNDDKRGSGSRIPAQPTSDQAEIGYVHPHWLCEPPCWAVSSGSGFLSLFSLGPADWAKECPWSSYRGQHTEIFLDIQIAHMCCTTPFRLVDLELSGMGVGPQMLGPV

SEQ ID NO: 979418 - protein, 395 aa, Homo sapiens
HKRSHSPSGSESEEEERAPHISSAPPEGVRRRNSHRDGHGVVQARRVRRRLELPVDTGGGCVLRLCRYEGSSLSSRSMLGSAASLSLSRKTHGNPNKRRAKEGESTCKIVTLVSCKRWRTSTAVAQRHAGANGKTPSEEEKQGIEEHRDHGDVSQARARDVPLKPVPQRLGATSQRGERLGVWTSVEEKVQRECRVELGEAERGTVLTVSWLHLTLMPNELFLLCSGSVVEAMGSLGHRSCVLSLGTIFAVDLDRGGSTYWLKGEPQSTSTPFVGGPNQGYALACSNGSPTPWNCRQSLASDPGQRMGVYGKVRGGLMPFRMTLVITRGSAGNQSTGCCDANRGLDKGPGSQPARIGAGTAVNWAYETTNFSSPRTSGDGQLCRYITSISRTNRN

SEQ ID NO: 979419 - protein, 497 aa, Homo sapiens
ALLVPLSHHMRRRRLPGLAICPTGHLVGPHYSFKHDMGELARSPWQMRRDRSSAVWIGPSSWITDQPRRTLHSHAPHTASYDLRDLRGNPRRQAWSIDSLITGPLEQRRSRRCYDHTIAACHTTWQNVCTGYVLRNAELIPLGLYGGVDSTCERNAKAKCVKAESRGAAWRRADLLVGAYFASVLYPRYHLRWSEIDPIGFPPSPVAQAVGGLRRTLSCESLRGPVPSPIVRRRIDLLVATSVRAMHVALRLVGDGPEDAPQGFPSAPIHESLREGGAAAHWHGYGGPDKAWARGREQRGAGVSVEPAIGLWIVNPRVALVAPPCSPPGHISGFGALGRGGRRRPILARGVGLFARFPWGAIPQGAQNKLALGIESLEFRLWGFSLGPWSPTGRVWRPGKWRVGSEAAGEGRGPKGGADSGGQSQNMALPKQAGYHRGGESGQNNVCDPRTTEGSYHREFTPTGYKHMGKTHCQTQEARNDTGEPFEHTTGGRGTGA

SEQ ID NO: 979420 - protein, 442 aa, Homo sapiens
LLCDVPRALLYSFYFFCAFCALLGSGVVCHYSDFLFLSLAFLFLEVVSLFLCLLMSLVCYGVGCPRLLVASVVPSAVYVVLGSRSAPIFPFFVPLLCFLVCFVCSFVSRLGCALFDVSCVLWFSFWVADWGDLDCRQGWCPGLCLVPVVLFSLLFGVLVLCSRVGLIGVLRCMLLLWRPVSVVPYVSSVLFRFRVPFSFGRVLGLFVFSCSPLACGCWLTLLGATGSVCCPLGYLSSRLGCCLASFRSLLVVQWPVMPLVSISPRAIVSVGGVCIPVFVVLPCRVLGSLFVPWSAPAAGRVGIPCSVCVARRPQALIAGFYSSLVVLFMCPSPASSPFLPFTRSLDDVRCTSSISLWCSRLLYASRSRLFAALNGMCAPESSDGHVECETGAVACSWCDGHTVPRPLHPLLLPRNAYSLALLLLVLCSKVFLCQSRCSSIVQ

SEQ ID NO: 979421 - protein, 437 aa, Homo sapiens
GLHPPRGKETPCCNKVSSARARLQDTRAQNVAYQRGHRPDDRERKIRKRRRRQHKEDENETKTRRRRTKKDEAGDEAREKEKERNDGEHTRRRHGTKEREGERREREEQREIAKNNEEKTHNERGWRDGERSGRNNETGEKSNKRKREQAERETEDRKTRTDEEKRTHEEKDAERRRREREKKNETTRGKGERNQPSTRAEDGEEQPQTKTQRKQPERGGGQCGKSEEEREGTGESGEEMKSEKAERKRAGRESIRRRREEQKKREKTEKGKDARRNANERVETKQQRRQTRVEEGPRQRDDGEKEQDERGRSGGRAANTHTNTKREEGGGGGATAETAEAAQRTEREMKTRGRQEQRGRREKGKRRRRDTRKRRGRQEDEASAGAVREDRNKEERRAKQRRRDTKTHSKTATSNQRQRREEGGEEREEDQGSDDIR

SEQ ID NO: 979422 - protein, 125 aa, Homo sapiens
MYLEVGQAGLELSTLLGGRWGEQISVSVRSFETEAGDMGPVRSTELRVLRSAQVCRRAAGGPASLASAEGERDIQHGTSECAMRKQRRRPYELPRPERQAWVAQDETATSEHPKATENEDRAWGD

SEQ ID NO: 979423 - protein, 295 aa, Homo sapiens
AVVFSSGWFLLCSLPFFVWPWSPSFFLRLFLSCFVGPFFLVLFRDLVSLLSFVLIAALSFLCRFVASCYVGQVSCLSLYYAVLCVLRVWTRMVVPVSPGLVLFYAANAVVVSLVARCLLSSMIPRFLPAPCPYPSSPPAHPLGQQLPVYELYLLGCNVAIWLWFGHSGKNDLTAITDIHALLDLCQPVSMCGYAPRALCCRIMLAPPIVNGKKRGMPGPGVPLEPDVKRADSFLFLCVFCPASFRIKLDAQRISQSLAWGQESSQQDVRGLRASGLVVPLKPNSGPWPLLASLAL

SEQ ID NO: 979424 - protein, 125 aa, Homo sapiens
AVTAMFPGSSPWRGRGHIWVCRQCVFAIATKRGGALKKGPYALGHAVYERFLCHMDWKARGTCVMLGHLSNRQRRVHCYLWWALGSGTSKMLQCRILSASDSMMPAPSVLSKAPVLYAGAVFYEL

SEQ ID NO: 979425 - protein, 182 aa, Homo sapiens
MSLELLVMKALSVGAGERQYRRGGTLRVHMYPGCSPECWICDRSSGMKDRLEFWCTDVKSMEMLVEHQAHDILTVGPPGSPSSSPLTHLREAFARPTECWLLRRSDIEFRVGGFGILSEVQTVLALMTGLSLMGAQAHREEVFFDGSLLQRCGRSQGLMVITGEKERGQRTGGPLKSVYSEV

SEQ ID NO: 979426 - protein, 489 aa, Homo sapiens
MVVELGVVPDRRSTDGLALQHLGWNLHAVYASTSEGQSLPRESVIISNRRVFDAYKDAGEAYMCDLRIAREPALSCAWFAMNYRQFAPRGVIEVNATTSFHVGGDHCATLARLQLVGTSGCLACRASTWDGRGTPMGFWAYMVRYDARRTRQLLVAATRAPHYVICGGLESRLLPSHADVNVHLTLVKASGHGALEVSGSGGTCHRPCPLVGGKARWSVTLPTFGARLGPFGAWFLYQPFGFAECFRLIFCCAKFSPQLMPMGSTGIAGFFNFRVGAFQFIPPLEGAFPLWVGLGLPISHEPQLAFGFFWGALHTLVTEAPGGMSRPIPSWFPDRRFSRRCQTDGERQAAINASRTSPSLGIVFPLSRHGRGWGPWTRTHGGSHSLPTTTRGFQEVHTSVRCNFQRGLSFARATQLFWRQGRVTVSLTVPVDLLSEKPPNLLQDKGLKRELTTKTRHNYKNKIPNTKQRGVNNEVKTERDDCHNISLVR

SEQ ID NO: 979427 - protein, 355 aa, Homo sapiens
MYGTSSFVKSQMSFNRSAVGAPLHGEWYGRPHHREGGGNHCEGPSNMKNLHKETWRTTRMYPLRLYPKHWRIKPTINILIFPKKGHLRIPFVGTHQGVNQTVIIGGRKLAFDREQLCDGFGMENGPIYTSWLVFMDSSRHSGAARGARRYPATGYPPQQDIPYQIYYPRGRVSLLDDKWVDSTTRILRYMFVLAATSRQAWYVMRRTRMDDAAYKEMTYESERVTPTQRQRADRVHPFINIFGPAGVCVFHSTYRRRGPPRRDSIITYSDQPRTMSDRHAESIHVNIEEQIPYTIENSGDVRTVVEMCVPRKQRQDITHGQQAEGEKVYNGRYRQSAGAKHTNKYTSESHTKTFE

SEQ ID NO: 979428 - protein, 334 aa, Homo sapiens
PARFSATLLLFVVVLGFLSSDIAVRFALGRVYASRVSLFGVLVCGLARAVASCWSCCRAGPLRFSSGGWARVARCPRLVILFAFRWAALVTLPLPVARWDVVPCAIDTLVPSVVTPRVLFRLSRVVVSPGAMCFVLLNYAMCSSSRLCSSLCATPWWVPWRVHTGCLRMGCPRRCSFPISSMVLLTSIPPFIGRTSFGADTCASVPSQTRQYRHYGFSLNALRMPLVFRFSSFSAQSPSRMPQRVQACSEHPATQTQWYYKSRSLSRSTPTQPAEACSIHPSREAAPGCCELVEGPGWTLHCGSPLQTWLAPCIHRNHEWPQNLSGSQGLTCGG

SEQ ID NO: 979429 - protein, 220 aa, Homo sapiens
LSCVSSEAVSRGTSRWSLDSVAAVSDWSPVMACCPRSQLRCCQASASKCRQSGEHLVTHSLQNLLPTCRMSMSAASPIPRGQVPWTSLTVLLGARGAKSIKMEVVFCDGRACCIDVGSCEFAEARAYGRTGLVRTGGMGAHASVQPVDVRAHGEGWRTVMWLGIRSWPVDGCGVLNVVSGRQVWETSVRGAGLRPPKRSTVSRLLCGSWGASEMWTLYAG

SEQ ID NO: 979430 - protein, 432 aa, Homo sapiens
FFFARPSLCFPLPCVVCFVLVVLALGGCVFSVGRSPCVPVVACLSSVLCLRRPVLSFPFFGRVLLVACVLSGLLVGSVSSGWGLRLPVRVGLRALGAGLPSCSASFGFVWCSRRPCTGPCSLLLSSVAGGRGMFVLGALPSCPLGAGGLSCAGAVLGLCLPVGSRFEARVTLVAGCGRVVPAPSVVSSCSARVASYGRRSVSVSPLSRACDAFLCAPEFGVWMLRVVNPGAPRGDACVCSGCHDYWCSRACVLIVASDLESPQRKHKCHYAGLRVKFIGKSSHLKAAPENIYTGVEARRLQSGRTATKKFCALRDVAGRVHTVTHTGDEEVLAAPSVEIALHALADLPVPSTRRLPRQSSTLGMLQSARSWGFAGPGSLERLSAAPTSSSPTISPVQLALSPPQSSEHCLLPPPREFLAVPFVIRIEKRELD

SEQ ID NO: 979431 - protein, 189 aa, Homo sapiens
LASACLLLCCALFCCVCVSVLCSCVLLVARLCRSRLAVSCLARSLVSARVCLCSVRCVALPSSCLSLLSCCCRSCGRPSLSRCLAACSSLSCLSLVRCSSWRRFNSVSSVDSVVPWLGGVPRGAWWSFGLGVCVFRAAGAVSWRFFGLAFCVGSLPRVGLMGVGPRGLPSSRCVARRSLLLLRALAPLV

SEQ ID NO: 979432 - protein, 135 aa, Homo sapiens
MGGETRTGTLIEAVGRGAERERTPQALRIARRTKPLVRRPDWVRADNMTRGAEVCARWGCGLTGGPPILSSSYLPVTVPSAGAGTCLRAVCAAGINLDGYLEDLLTARVRCDCQRLCVFMLGQLQFACTDAVDAP

SEQ ID NO: 979433 - protein, 182 aa, Homo sapiens
MSSQVVGIEPLYIKAEPASPDSPKGSSETETEPPVALAPGPAPTRCSQATKEEEDGEGAGPGRAGRWGSLVLGSLRKRVWLVCGDVAPGATIGVASCEVLKAFLQEDPPGGASSTACPGSNECGDHQGGDRNAWQGWRFNKVLRGGHASTEGVRLERGGGGGRIHSGGGRGPTAFRGPYRLG

SEQ ID NO: 979434 - protein, 268 aa, Homo sapiens
GQPASALACARRVQIAQSTMGNGDRCGAQRIGSYGRLVTQWLLLTLVKWISLSITWIAVRIEPSNYEWCYIVAQVCIPPTGRIVSQWRTIEGLRKAEKLMIESDGRCRINICPGCEIPPKSSGAMLALSTSWSPLDVFHLHDGGRLGLICRGEPTRGSIIIVSPSGAVPLRFVMGVNRCRSMYNRTQDRSAMHVHAHNPTCLVPLAKVIHDNFGIVEGLMTTVHVHHCIQKTVDGPSGKLWVMAGALQNIIPALLGCKAVGKVIPELN

SEQ ID NO: 979435 - protein, 530 aa, Homo sapiens
MLLTRIILTTWTPEHGGHGHRSSSCIVASNRTQWSELIGLDGATLMEPWPGSRGCAALRVGLVLAYKTGPSQGCTSIGTTQHRKETWQVASIARGRPYSLTQAQRRQYYELVRYVIGNQKAGSARKNPTREAQIMHVALGIMEHLLIRTCAEHHYTLNPQEYKRHVSMANSEAWIISVRTTRPPDRDLTLPHHNSPIQVQFQVGGIHGTWVKASKFPIRKDIDWNPFIARRQSAEFGRRNNHPPQYCRNYTDRSTHQHSSTLGSHGTWRHLKHIPNERTRSTGAHAYGRASTTWVIGRIWVTTIGLVRRAPIWIMADHTPMNRRSEGKQAAGNPGADNVQLWDSPVSSIGASRKKGLSPVGEHRGIGVRAPCWTTTESIRSSAIRTSTTKGSDTHFKYPNGAAPPSPGHNHEESHQRECELTTQHKTARRTATNKTGKYGALRDGVRITRRGIKTIVHPGKVETDIQHMALPKGSRTGQQTTRSAPDPVIVAEGRPPKKNYQQTTDRNHPATISDRCEKNQPHADNAAYG

SEQ ID NO: 979436 - protein, 166 aa, Homo sapiens
GCLCCFVVVVRSLCVVWSVLCRVLCWYSHFASLLLRCVYICLAIRLGASVAVCFVLVSSPFCCLYQWAQARVLSVSLCVTGSAVSAILVWRVAGPWVLCSCWLLFRVGLLVWSPSASGMSLLPCFVFEKWILTWFYMSVLIPSLRWACWVPVWPGHITRTFWKRHG

SEQ ID NO: 979437 - protein, 459 aa, Homo sapiens
MASLVLLVGPAPVALCVSRCCLFVAVVVVSALAHSGLFERVFVVPCCSQFGGSLLLCLVWWCGRLWSPCSSFAPRGLFGRVSLFVRSVVDCIGARPRDSSILTSLWVPLFSPCLGSLLVCVGSRVSSRWLPLRGPLLHAFSVSLCPPVFYPFCARALGRVPWRVSWGVASGRLRLPSQGGFPVLFVASPLVACLGAFPGSLRVCACSFTAVCLVVHGVSLGAHGCDPPQGSEGLRLAWSCGGLLSSALDVLPCLACCPRVPLVAGPCVFFAFVFLSGFGLPAFCGDRFLPVAQGSWGDVPLMRTVHRDSSWASRVCGCLPCGGRPLARGSCRGSRTSDPLVSRLLGALPLRFPRHPTQSSTASEVAEIPRRHCSFRGGRDNPAKQKATHYAPSGRADYERFCVRGSIELVSSHVLLRQRWRIGHSIGPLDHLYSQPSHKAVAWRAARRAQRNALADTVA

SEQ ID NO: 979438 - protein, 218 aa, Homo sapiens
WAPGKNRFNGGGFSPPTKIFKKGGKEGGGGGGGRGTTPPPERTRRALLCEPDLRRRRTRVEGRREHERRAQHYPRAQHSSPTGGSRRTGESSKVLPIHIYISQAKTRSKKKTMYSTFFSRGEKKESTLTIIMMEQKKTAGGGGRRTAWGSLCRGGGSEKKRRVNEERRKRRTTKSFERTTQLLRCPHGGGINGAGAPLTGRRVSIEENAQYRALVVHR

SEQ ID NO: 979439 - protein, 501 aa, Homo sapiens
MFAVVATYHGFAAVFLLFTFMCFACVCGALYRSSSVYVYLYLRLSVRGALPSARSASVPRVSLCLLFMSFRCVVPSFGLSRLTFPLLRLLCVSSVASCRFLSVCAPRCCVLFFVVLVRAPSAFVRPLLSRAVVSVSVCYCSHLCCFRSAFAGSLLVFVAFCFLLLCSPSRVLSLCVSSSWLSYLPFNEWIWSSDPFCDASLLLPCLCHASVVLLWCFAFIVLAGVYSCLPVSEFFGSPVRSPFMGCVLLPDRMWIRCSLLCLCLPLLFPLLMCLFSLLRVIFLGVLPFVCPRLVALRLHVSSVWCIFARGLRIFRLLSPDRLVLGFWSDDDWALGMAGLLAIACPVRGPPFLAPEISLGHPRGFRWTHLAMAPCMLWSITGLCSGSEVSLMLRACGSIPICPWIGGHGQVGWAASVKECWSGCSISVPLHPGPIMCTPVPGWPAPTAHVSVSSLPALAQPHATLVPVALPDVVSRLLPPGAGLAHPPLPSTHSPGCFIAEF

SEQ ID NO: 979440 - protein, 271 aa, Homo sapiens
AARVGCVLRVVSFLSSFWFVVLSPFFFRSVVRRPGYFPFFAPCLLQGCSYYRVYVFALYGSTPLQCVLAPLAFRRACGLARACTPRLAQVPTFWIFAGSRPFLCPESADELPRCVVRLTCPSLVCTLLARTRTPVPRVRAGKSSSGLGSPGPAHHPVASTTRRPGPSRCARVRLALSPTRITCWSTSARHTGRASPYPCTLWRTSCSPATTHVAQDTTRAGPHTAGVVARVHRRRAGPAQVAAHRATHPRTTARSRAPSRTGPPAPQPLCP

SEQ ID NO: 979441 - protein, 119 aa, Homo sapiens
LFVFFLSSCFLFFCFSVPVCDRFVSCVLSVSLVVYHFVASAALSSRSSLVALLRSVSVRLVGLSLFSRLLSVPCGVLVLFSTACFVVLCASVCVVLVVSLLSCSCLVLFLVRYSFPFGF

SEQ ID NO: 979442 - protein, 216 aa, Homo sapiens
MMSSPYQRRTSVNIITRMTRETVHTVIERCPKPVISLPSHGAYQLAEVLDLVHRLSTSGYCPQECFLSRVKEVHRVVLAANGSEHPACASPQVHLGNQSLVNELAFILSRKMMARRGPGQWVWSVRGVPRQRGHAMDAALATWRPRFPVKSPVADRQSTNGQPSLYFTCDHSVAESLNLRGVLEHVACCRPIDLVKYRSRPRLRTRKLKTVTFSKL

SEQ ID NO: 979443 - protein, 314 aa, Homo sapiens
FLGGVVCGSVFSCSVPRGGRVALECLWLFLRVFAGLGLLLCVTPSWRCPRAWVVSCVRVRFTCSDSRGALVLAPLSPVFGMGLRGTHCVGPVFLRLMCVRRFVCVWWLSGVRPLSVLRFRAPIVFSRWPFVSPCCLGRCGIPRFPCVWRPLRLCIEFVGTLFPGCRSLGHEWFVKAPEDVPSRRKVTTLWYSRCLTRDWAVPWLLAFIASTHAVVWFPWVPDVGRPRAPLPPSPPVRTPPFARSPVQLRPGNALYELTLGCNRAHLVWLWTPVVTKINVLTETMRCRSMQPASSVDQPRACSAHHVAPPKSTGR

SEQ ID NO: 979444 - protein, 136 aa, Homo sapiens
RTAQGDDRKKSVGYLTSSRSMCSFVTLVFFTSVPHGYLCRCVFSVIPYPCSCSSVSFCRVVSLLFSCFSRCLFLLIVYVLCSTLLSVVRAVVRCFRACSSVPIVFFPVCCCVFSLVVVLRLRLLVLSVCFSVAVSA

SEQ ID NO: 979445 - protein, 249 aa, Homo sapiens
MSFVPLASGPVVPFVCALCAAPVPVNALARFDISLMFDNTEIAVLISLIALWCKACRTQLTMEVLAPFLRDRDPDTIGDGPCTMWEQLSTRAKVLEKFTQTMTVIEARLFCLLNRRMLLSLTSRQRTWTTSCTDLSDRDDSRLHREQLFAVSHRQAPGRERIGTSALVKSTHGLAILRTPRTRKLPRTHPGSSDEQPWRSTAQEPRDYYTSETEYEKSDNVYCFFSKNITVIDVSPKPLTGESKTSDLY

SEQ ID NO: 979446 - protein, 136 aa, Homo sapiens
MLWCSMFLVIVRPGLSGRSGHCVFSWLRCRRASDVRGAPSFLSIPTLFSVGVSRFPFVCLLSVVNVIVVALFVQEACVPWFLIFLMVAVRVTDISSSFRLLVQTSMLVYCRPHHDLIHVSPVERCPQTTRAWIYDG

SEQ ID NO: 979447 - protein, 446 aa, Homo sapiens
MDFGASCIVCGFFVSAFWSGLCVVLFVPGFAGLSHSFYGCLCRGGVLLLICLCCPCSSFWSCCVLCLVLCGFISISGACGPHVGLACFAVLVVLLLWPVVHMCSGCVVSIWDRRMGRLVVWVVCHLWGVSAPGCSCVIDVCVLSPVGHWPGLSWSLREAIVVVVVCRAMSTGCVYDPVWVVAPYGALWALFGCMLWGPRRRGLCVMFVVGIWIRAVLCSRGGYGVVPWVMARDVGMRRDGAVLCSLCAGGCPWQVSAMAAGLLALSRCVRRRCSMLTSVEAVPALCLQDIASLRRVGYRVSGQCASLVLLCLLGPSLDFACSSPSKYLFVCVGWYRQCRPVGLVQSWPLGKGVRAAVGSPRNSSQKPTVLIKQTQDVIALSYGLVVQYSQQTQLLAAGDAQGTVKVWQLSTEFTDIIGSPGRLRTWTAWLAVVCGLRGPGKLRWEP

SEQ ID NO: 979448 - protein, 103 aa, Homo sapiens
QVTRYEELAMSKDRRLDNATWLSEWPFNRLNQSETIPMRHWHGQDHLAGLKAKNGDPIMFRDASSVGPPDTVSVKTRRGEIPVPLPLKEDFRLILVKPIPFCL

SEQ ID NO: 979449 - protein, 254 aa, Homo sapiens
MNVWAWFALAVVLWWASVLSVNTVKVINCNALLIEGVTVGVCWLCSQVQNSDAKPTPCKRTRGHREGKDPPLTPAATASSSRHRTASKGDSANSPVGLRSRRRGSGIRPQEHCAAVPMALGSEGTAWGNSCLAKVIGRAWPVDVGPGAGPGQMSALLVMTPSDYKGGKTPPGLSARALGPTTHSDCAVQCRFWPYVLEEHRGRPEAHSSSVPHMTTHASRQSDPEASYVTTHTPFPSSPAVTWRVSHDLVVLFS

SEQ ID NO: 979450 - protein, 577 aa, Homo sapiens
GRPLLEASPEPAPAPSPRVAERGCPPQPCRASGAARAHPWPAAWATPRATAPPLPPTERTQATSTHAPLSCTGQQPRQRKQQHPRLTQPPLPASHPPSIACYPAAAPPCAHPDPAASPAPPTRSCLPSLLPSAATPAHHSPPSSSLFSPPSRPLSARGSPLSSRLHPTPPGCLAPRAPLAPPPLLLALPGPRRRAPPPPPVAPASAPLPSYCYPAPRPLPGLVPPTTWLLPPSPPIRPPPRPLRTSSWPPLAPLSLPAPPAPRPLPCPPPPGPLPPPPSPSPAPPSHPSPPLPRRPSPAPGSLTPPPLPLSLPPPSPWTPPPPPLPTAPPPQQIHSYPHRTGATAASETHRRAATSHPGRGASPHAPMPSPASPSSSPLSAPSVVLFSSLRPPCRAPQRPPPPRLQTFAPTLPRPPLPTHRSLRSFWRLHTTLGPRTHPHPPRFRPPHLPRPPTPPPPRTPPSHSHTAPPPTPTTPLQPHASPPPLPQPPPPPFSLRPLTSLPSPPSPPSPLSPPLPPPTPPLIISITPFPPALSPSPPLSLLSPPATTPSTLHSTLPPHHPPHTPTPHPDPPSPPP

SEQ ID NO: 979451 - protein, 67 aa, Homo sapiens
RLWSKYRLVGRLFGVCLVIGALVSVLSCVSLVCFSVFDVDRLLVWAGLAFGAGICRLLFLPVLCFFL

SEQ ID NO: 979452 - protein, 330 aa, Homo sapiens
SPSLEESAGRGTAGQGPPTAREAGHDCPRGPTLMSRALATAVIKGRPSPCCPHSRNYWDSASPPHRTVNAHVQHSPPMPGLCSLERLGPQASGPATSLFSRGLDPSLPSRSHHPMQTLAPSGDTAFYSRGQPEANVENNQAMEFEVCMPVCLVTTGFSVRTPAGYGHTRTWDSGKVGTILSLSGAPTKAGKCFEEPGLSRFLCLVSRVVLCPMPHSPQCVHSLVHMPLGGLNTQSCPEADTKRFAPDECQVGSAFTPTLPRGAGLPRVCLLTDLDEVRGSPIRAALRIVILRSFACGFNFCILVITSLIQDALYRTLFGDAHSTFEFSYY

SEQ ID NO: 979453 - protein, 282 aa, Homo sapiens
KRPLGPGLSELNLREYLYHRPVGCAPALENPAPRQFAIGPGLQDVRPQHATGDGHARAGPISHGGHHHDQAPTKELTFLLLLTAPHPPAAAPWRGGRGYWSGRAPLHAPEGPTRAALGFSVLTAAPSPSYPPELQLRFLRNGLADGTGQGDFGPNSDGSFHASVVTNSTKVAIEHHYCSHCADTWGWRSPLKGGAGISSQVLRCFVMGIVIGVLLLTAAAVGGALLWRRMRSGLPAPWISLRGDDTGVLLPTPGEAQDADLKECKCDSSHRPLSHHAIHDGA

SEQ ID NO: 979454 - protein, 140 aa, Homo sapiens
FLCSVVGSLSVLVSGVGSSLSLVFSVGSFAVASVLVTFLCFVCGCCCVLLSGFAMFALFLLSRFCFVSSSLFFCLVFFVPLCFFCLSVYDGLCSCSLSLCSVCDPTYLSRLVYIVSLCLVFMFIIVYMLLFVWLLLQFVY

SEQ ID NO: 979455 - protein, 148 aa, Homo sapiens
MSHAPLESRGETAQNWNYDQPRVASPAWGEEKKSTGNRSEPVSPYEDEKRKKERVQKAIQERLVEKYRTVHFGKTLQEHSSKFQLCRCDGYYRYLKYSKLAVTQERPAVLLTVLKGILLPALVKSALVLSCRHDQLRYRSFLLVIMFT

SEQ ID NO: 979456 - protein, 134 aa, Homo sapiens
MGIPMVYILALYTAGGGMNRSRMSACHSGCGYTENEELRIRSTCTLDYRQRRVRGSEYDDFAGRIHGGSVLPKSLQCKISRCFVSTVSDFLYGCADETKKMLAGASVADTLVMSSSSGDRDGQITRSEDRDHPG

SEQ ID NO: 979457 - protein, 165 aa, Homo sapiens
RRCAHSVFLTRRLPDSFLSVSARLCLCLALVLCASCAVVLVVCFPPLRVCFCCCLLWLSPSFLALFRSCAVSWSRVPLVSRPPVFSPFVSVIFGPGRSCVLRVLPASVGICVWGSCLSHVLEWGSRIELFTMSFQVRSCWALVYCWMIVCFFPSFPITVIIAFTI

SEQ ID NO: 979458 - protein, 144 aa, Homo sapiens
MTDFGVSLLAHVPKIGLTVNHAFCAPFAVSPHATSQTICEDSLFVRVYCYNRRIIVNTQRQYSRTVQGIWLDTSTYAAAEFISAPGILLKFQSFGSILVCFAIVYASWYWGLMRERRGLELRASEKTLHGCSCHSEEPKLLSKL

SEQ ID NO: 979459 - protein, 169 aa, Homo sapiens
MPYIRREVCHLDQYRNSRYLEDVRLWKGSSLWTDLLDLTSCVYWTYRRPIISSQRFYKENLGQGWMTQKLMRMKVYVHHWLLCLPSLRYCTRSEKWVRFKYPKLISYSYMVRGGHFAAFEEPELLAQDIRKFLSVLETAMTHPSPPACHLPPTSALQAFLGEDTTFSEE

SEQ ID NO: 979460 - protein, 263 aa, Homo sapiens
MVSAPGPCFPRRTLYHRVTALAALRHPGIFRLELHGYMHRAIAQGHQSNDVGPRRAPRTRWSSGIRTRFKNLDRMHVHCQPRAFTRASLCIAAMKAQLNIVLMCSLWAPCLEGTIVCCLVGASLVDTWQAGLRASGNLCPTVISHQALETQEDPCELLPSGSKKVISSDHTEPVDWMLAGLEVRRISQNPSLIELAGRSHHNIRAKRNLLATSTGCGHESCGAFLLDGGNHPASSGIAQSHHSRRDDPCWHSKVGLICCPPGL

SEQ ID NO: 979461 - protein, 83 aa, Homo sapiens
MLKKHAVTTRNKTSKSSLVAFAEACEPSVARPERTATGHAPTRELGPWAWVREPPGNQEDGRGAGNSFDAENPRGRRPFEDPV

SEQ ID NO: 979462 - protein, 111 aa, Homo sapiens
CVDPVVPSLAVLARPWSRALFALFLCMSPGCRTRWLSVVDLRVMVGHECLARPEAFFVEGRLWSSVLAGLGGPGSGLSSEHAMRLVPVSVMDPGAPRLSPCPHPGSPQPIH

SEQ ID NO: 979463 - protein, 315 aa, Homo sapiens
QRSFLDIRCPVRCNIKAKRCYIRASLISRVPAHACGKHICAHETWLIVIGREAPDQYTLVDLHLPRPCADERQPSPIHVYTVYQCCMITVTETEVSKHWWTAFAHESVGQKALPGMSLARDQDCRAQSVKDRIWPRLGTSGYADLKLSIVLACTDVGRSDFTRSGTPLGERWRYDPMMALCQVIGFLGTLSSRIQHVQLFGAASGEPVSKQDHSSPALNKSELANMEVYPSREGPCGLQIECRVNERYSKTSVRLYPACYFRIREALDLTIFVRPRPGTLLGTAKGIVPVEVGKHGKQFLSGYVQRQGSPEQGPG

SEQ ID NO: 979464 - protein, 191 aa, Homo sapiens
MFPPKRAQGERKPSTRRYAGRLGGKTGGGRGTYTRPRKGQTRARRPPEGPWLLRAPHITENTPPSRGPLNWDERTPKVHENEPFRHLARTRVTRRYFGQQQTAIRTTEHHTLSATRYPPEHPSYDTPLWGRGAHHSGIATCDTADPREPGATTCRAPPINTPGDTGAQNTPTREAPGPQGHRAIIADVERR

SEQ ID NO: 979465 - protein, 306 aa, Homo sapiens
LCVLPECLETVLLLPNSCQLSDNVVPPSRAAAAPDNNNNNCEGAVRLKQFLGGATHEQQQLALIHGTGNTGGLNNVPSIILHPQGDPEKILVMHNNESGPESSRRQFSLVDTPFRQQEKMGQIIVRWWKLHTTARDQLALRSRTKTLYTGTRKEVEGSRHEQVRDWVLTTCPGRTRKISPREFHFQNTLNVLCLEAMRHKWSHEERRYSLRRTLKVFNSISFSFPNVGVGLGINYGKDGHTSAALMGKKGREMVCLDVGSTDVLTGPVATTTPVSSLGAPFYLGVNSLRRHIQRRKGCSRKGLRTY

SEQ ID NO: 979466 - protein, 394 aa, Homo sapiens
GGVSSMLCEDTGGRAVARDPAKDRAPIEASRDGLSGSRTFKIRSGDLTRAGEGAYRSNDSKADEGVEVVARSTRRGSSTRKELNTYCLVAKESMHAERMDPRNATWEPDSGQYGTWMEWIGYVGFRSIGVDPTEHEEPRVTRGSALTEHSPPERALLAPTRSGGPTERCYSTVPFSADTGHPAQPCKGQFGFLGAPLSRNCPRNEVYTERKSPTNTKRKFTGFLQTEKSTRREWYRRVPRDYLDSLPGVCMELKPTGGANTDCEQDPKRTHHKGTATQGLDTGAVQVTLHRRRPERATGSALLDDNSREGATLDTGTKRTPNASSTRRATFSQSRMGQPAPQKAAATPIRPRTGGTKTPCESQTRDNTWRGGKTPVEAAPNTNEESRWGYQGAD

SEQ ID NO: 979467 - protein, 482 aa, Homo sapiens
MMLLLTVPFSNAMQHNPDTNQDTIDESTLASDELYHSEQDVPTIPSCPSTYNANPGTPGPEVSLCLPVLTHLNHLTRHVYFVIPLPGTPRHDPFQPHSLGSHTRTTQCHQVSVRTHAYWAASTSALSCIHSTLWKPRFKLPDRWTFHVYPSCDDPPCELDSTAHYAPPLGKSFTPWLAPTLEQSAALFDRVAGPTGTPLNLVSHGILPQHTSNAHIQLTMGRTMGRLGIGAITTGPPGQTNSHPNANLIRGENTRYPARSHARVATHSHHPRLAASNGSTAFMGQEILMAYYGWPHTTPLGARKQHPPRVRVPYTITTTTAFTNTYKLFIPSWGVLIRPLAAWRDSLNGDKLPPKQPEQQMARTSTIVPCAAGRRNNPPIATPPGRNRPQTTYAPSRPAHGTTIRQPQVGKHASTAIWTAPNHEPLNAPPRGQLNTTPNNRHQRSQANTINIDSDISTHLRKAASPCHSRATATHMLEVAID

SEQ ID NO: 979468 - protein, 58 aa, Homo sapiens
REAKKVLVGGGGHEVLVIRSSESRVRSEPPPPPQESSFGGSRPTVDKAATPELRHRLR

SEQ ID NO: 979469 - protein, 212 aa, Homo sapiens
MAGPGVWAQAVGPKGPSGSSGEKTEQEWDELFGGHIEKWEKFICKLYHYEGHGLFGVSEERYMRWDSKGVTNLDSVVVQNNRRIGGKKMSEGWTISGIPKLYLIPTFPYEGGLASLGYIRPPGGYNELLSKHFRLLYTWRSSGVRHNTRRFTVRAYGEHWHITRGKSDVYLQEATWVLTRFFPSTTPRVGNGTPKEDLPWELMARPEDVRGG

SEQ ID NO: 979470 - protein, 184 aa, Homo sapiens
VRGVRVTASGIPGCPGVRRWLRHSARHALGVIDVWKPNVWEADRDVVNWDCATGKTEDFFSIWAGSPMMYRSHRLRVKSCLGIRIIQPKVFDLTNAGAHVDFDVANGASWLRMIAQFAWGLVKTILLWQYTGTEGNVWQRLACDTHGARTHGLAHGYVQGTRLCAPAPYVLGSAGARDSEAGST

SEQ ID NO: 979471 - protein, 124 aa, Homo sapiens
MSPGRKDSEVLAALAGPGLGPSPEEIRLAFTIVPRFVSYHSHMPIANNNHVRPLRGSNPMHVGFIVVKDEWWDEDAQREYDPGESFHVHEAEGRDGERRPIYRTVPLDCSREEAMVGVQVFEDL

SEQ ID NO: 979472 - protein, 212 aa, Homo sapiens
MDLTFDKDLEWSQQLDDPHVCCGIPNAQGGVGPLQGILGTAGYEKDGWPRQALGQVVDGPQGWLMDDTQDFALSMEGVSGATVLGHDEWRRGGQSSWRIKNEVKLEAFLGRSGLVTSRDESCSFPGGPNRTQAFHAALLLLLPVGPGAMLEPGPARVSTRTARHEARARRPDVFLQADTPEAGVPVGRDPGKGDMAPPKTGRHQGNKKNGTR

SEQ ID NO: 979473 - protein, 183 aa, Homo sapiens
MPPSMPVVQNGEHWAWPPLSTEIGLTLFWGSESRPAPDSRATLGARLLVQVREALAGRQATRRARLGTSSRPHEAQHPRGGVIGEQPTGKQSGPVATRRWSVMKVRATQGWFTEARSRRRQLLVGISQANGAGGVKPGQGELRGVEKQTAGPAEDMRVRDLSSPRGVEPRGGGASPPLWGGNA

SEQ ID NO: 979474 - protein, 102 aa, Homo sapiens
MPAFSQDTPWIYIESCPSAFSRKRVVPTVLFRGRIGGPKRLCPGDTQENTSGHSAQRSLSVVFHYLAVVKRPTKMRSVTGSVTPHMSTCECVRRHDSISWRI

SEQ ID NO: 979475 - protein, 317 aa, Homo sapiens
LTGTLTGGWRTGERTLGRTRGARAEEPHPAAMSAEVAHSEGVDESEKKNSWGPRKGEPNMRSGDPLGAPDKAPGTTGSYNDRARKHPVVSTDFLRGNIKEGRCLTQWPPRHFYFNINSSLEAGTIGAAPKDHSSLCALLCNFPMELTPEKVGADQGHGGNPLGGNTVRSMVLLPQGLPRKFVERFTYNWGRNERELLLAHVITRYVGDLSGGPGCCKKGGQRALEFPQHRGKGPSLPGRRWWTRPAVRSPTADEAWLTEATTSGGPQVEITDVRGRGHGPKTGGPDSEKRELRGKRGAVYNVGTTPGSGRTQPNSHK

SEQ ID NO: 979476 - protein, 57 aa, Homo sapiens
MPCTSIHVSELKAIRRKEASHLGTVNGLAGAPERSPRQKRSTPKLPKAPTCTEVAGQ

SEQ ID NO: 979477 - protein, 262 aa, Homo sapiens
VPGKRDSKVGRSRSRYSTEGNVARSRSTSRGSENAGAEDKGPRVLRREADREESEPGSENTSDTGKDCFPGSSQRMTLSIRTILLFPPYLGTRDMDNERHALDGHTQETDTATTCKHPHCRAHMRNRGPRHFYPVARTTRHFFSTTRAPTHHQRQCHRVHCSSAPLRTMKQRSSPSGGRNNKAPIPPLCGNLHRTEQKHARQTHHTGGRAQQGAYSLVVNTNLVPSINLCARTSNHILWFPYSPFTEDENTSVKSWRTNQLS

SEQ ID NO: 979478 - protein, 120 aa, Homo sapiens
MCVCLKWGTKIYGKKNSFGLGKLNNGAKRNFGRTCVNSQSHFYIQRRKTNLWEFQDGPFLRKGWKENSHVARVFVDLEQRHSFNIWWGLNAGTQGVFVRAKENLPSFFPFFPKEKENTIM

SEQ ID NO: 979479 - protein, 299 aa, Homo sapiens
WGRSDSGGEEGVGNPPEMALLERPENHLERSVGHIDPLSPGWKSRSYRILLAELVRSTRVPGTVTELLERCPLAPLLDVPLTTRRQAEQAYSSCKPSPARDQDNGLRARRITPQLLRACAPHVPNMTPDDTAGTIAGRTTPLPGSKGLAPTSAQRETQASGNTGIASPETSQTAGPTSPGQPSGTNCWRRHIAQRSEATSAPCGQFECNPTCAQRCPLEQLTVLPTGRHAWQLSGPLSPLGPPLASPLAPANRVYFTLALNLTTADQGGKSGTATGSAAKAFRTLSHRLKRLSGFDHIT

SEQ ID NO: 979480 - protein, 299 aa, Homo sapiens
GSDSVARGATGESRGLKAGSSGQAASVDRWVSGYPVSSCRCGTCGAGGDGHSPASPELRSRETPMISLCHQTRRRFAGCVSPEGFLESPRALQMFRCYQGCPKERPVTPSGGNGLEASVCGRHFNGGESWTLGWKPGSICDHLGVPGTGDHSGWDFLRRAQGHLSGHNGTPAHRLVRIQEMTDSPRLRQIEFHIQTKAPKGRKLLDRFLHPGPHIQLPKVPYGSEPTVTNSRRETVRQILTLADGRMYFDKTLETKRGLTVERSEQRYSPLASTSRTSGTERWHTAVLRRREENAYDDG

SEQ ID NO: 979481 - protein, 145 aa, Homo sapiens
ADSLFGLSPLHPGEINSHVAHTKPVGGSSHGTHEIWCRDSDRGTFLGRSIPHPPALLLCEKDPPMTSGPQDLTSPRIISPISNPLKTDIAREPRKPRRPINGCRGFSVTLTVEEAQECQASEPEVSNPYPLVTGGTHPDGRFLPQ

SEQ ID NO: 979482 - protein, 174 aa, Homo sapiens
MCSTTASSLFQGRCVTDTGRPDGGKIIIAGPGDPQEGGQVYSVPMGGLDGKGRPFAIGRSEALNLWICGMVTTGEGMPKDRVVCNSTASVPRFWRHGSGNGLQWRSDPAGYHGESVEEGRLGRQIQFACITPRIWISWQNADGHYTFLNTETLQGETKNVRGTYTAENDAGVSK

SEQ ID NO: 979483 - protein, 211 aa, Homo sapiens
SYNAAVDTVEEAKEPVEVTSLSSAGTMSPKWHLPDWGTGRPPVKNYKLLENMNKLTSLKYLENDKIWLYNISRNLYRTLTPRNMLDCSLIWIRLNVIEEQVAALEQAAYKWDCLFKNTLERQVQERWRSDEKLIFYWDRVFYFFQHVERNCSNNNRKSLRLHCTGEQSSNNGNYCWSITGTSQRSEQHWQARGLSLQTSLEDRNPVRILQR

SEQ ID NO: 979484 - protein, 32 aa, Homo sapiens
MADCIPTTKKSSGRRQKQCFKKGSNPKGVNRA

SEQ ID NO: 979485 - protein, 141 aa, Homo sapiens
MERSLDLTWHIDKYWLIPVVHGALVNHHRSVDILITPTWEEAPLFPCVHVRGETVERFPVNPETEQHLEEPCSYLRFSVVWPMDFHSEERCRNRQFLRSVVSIRNRVLSHGLLEDRVLTLFPCVLPRRGVVPYRRRGEREL

SEQ ID NO: 979486 - protein, 123 aa, Homo sapiens
IPQEECRVADEHSQLCCVWMVTQCPSLGVSLRTPSVGSWDVIIYIPIDALVCPLTDVCVASPKHRICAGCQLPDSPRHLIHRTWPCRLNVSSEAEEVHGGQFAHFLVLPLFAHSRILVSRQVF

SEQ ID NO: 979487 - protein, 174 aa, Homo sapiens
APDLIPCLQTTMWTTEAARVPCNVDSLSPLVDLSVPRRQFLWHRLTKVRCAKPWKSTEHTYRVSALTRECLITQADRSAQTRILVPSSIDPYTGDWDSFTLLGPVIVGLTKHILGNSVPWLTFDRYPKPILSQCMGRNVVGLLPIPHTHTPVGRSHSDYSMWPRPLEAPTTLKP

SEQ ID NO: 979488 - protein, 216 aa, Homo sapiens
MLFYVTAFDRDRAIAKITSYQPRNSTSLILKIAESHLDWARKKRTVNREELLKQAESVMQDLRQLTGHCTKSSMNNELLVQVSGLHWRLMRLYLRNYRELTWVLGAGEASNSSAIHKGANEGTKYYSKPPGPVMRFPWVGQQQPSSYRTAFKMKFRFKRKFNGKAIMDLRLVDLPLGITLVEMRCYAQKLHLASHELVDIRPVVARSVITYETWQT

SEQ ID NO: 979489 - protein, 33 aa, Homo sapiens
MPCQVQGQGGDLGFRGYLKPPFLDCPNEDVGAD

SEQ ID NO: 979490 - protein, 99 aa, Homo sapiens
MLTCLQPGGERKVKACCCPAGGSKNGPSCWESGCFVLGLNPQGQGPGPSEHKGPSSVYVGIGDVLRVGMSCDVIQSSREVGAKLDPYVVTVRYTGYESK

SEQ ID NO: 979491 - protein, 235 aa, Homo sapiens
GSRDVETRGPGRRAVRGRRWGCTVGGGSCVPSPRRKLAEARYKERGTVLAEDQLAQHVHSECGTCSRDPNWEEFGDADTPSSEDPEAVHEFRVQIPRDMCARQLAVDPAWLSGRKALWSEHAGRGGLLLTNQVSEDSSIVCREQLRAIVNVRCDDFGVNYIKQVLTGTGAKFGQDVRSKMTLVRAIKKLLALGTGFGIIPVGGHLPHSVVFQLSSIWIHTGVLQTGERRMVRDCQ

SEQ ID NO: 979492 - protein, 113 aa, Homo sapiens
EVHPVVNHPRSYSSVQATPSIQLVAIANLCRCRGAQSGPGLRFRCCVCALCARSGFVASYRVEELASGVFAGSWVGVSTWPHRVGTRVAVAGTIPGHGRLCTSLRLLALWARS

SEQ ID NO: 979493 - protein, 31 aa, Homo sapiens
MARAKADPGQDSCKRVGTRGPSVDGILQDST

SEQ ID NO: 979494 - protein, 128 aa, Homo sapiens
MSMRATSYSVPIKQVPSQRTGTPLCGQRKSLSFRDLAAQDIDHALVPQQVRCFGRRKILGEAKIPAAGVVLWKLSLPSNRGLTTVKFLLPPKRETTSTLGAHQDKPARHWHDHVWNRGFPGTSVTSSH

SEQ ID NO: 979495 - protein, 143 aa, Homo sapiens
SVRLCVVEHYIDVCAACDREWPSRSVSTFEARAVSSGCCDTINVSVLAYRLVFLGGVSKLVLLWMCVCVSLARTADAVVSGHTTRECWRSAQSTKHGEVDAWPGQRVVGSHRQSCVACRHLPLSFLSSPGQRALLLGEAARIL

SEQ ID NO: 979496 - protein, 114 aa, Homo sapiens
EWEGGLRQGGGIFMDLHAAYKARGSKRMVKLFDSLLLSGSMTPVCYKTVKLCIHCYFDCVSTGVCSLLPHHRSLFPWNFGSSFPMFPQIWIWCAIGIIYSREIKWEFCVEEELQ

SEQ ID NO: 979497 - protein, 270 aa, Homo sapiens
MIQESRYTGVTPQAKAGNNKLESRSSIEMGTMASQKPLTLSGFRLCEPHVNSPTWQMLIWAQLQVRKLDSIWLLWPVVLNTHARNGDSQWRTRVEAVGAPGVTGLITSGVMDTEPRRDSEAEFYEEERHGPSQESARMTCVRVDTLKALHMRSLSPIFELAGPDSRDNAGRITWSASGVRGTETDDAKDPAGTPSWFNVPHARDRMSSRTEGWSISCGSQASDHREIEKRMNGLQRRNLMQVGKSPRPVPRVRSPEWPRRTNHAGAGVTC

SEQ ID NO: 979498 - protein, 146 aa, Homo sapiens
MAWANGLARPVAVHVALCCWMLLNPAACSSHVLSAVAADALPGTAAVAAGWRVVWLWALGLLHKSRGRRGLGRAQFRAKFDRRVLLVTMLGSRGPPAAVMVGSLNCIVAVSQNMGIGNERGTCPGTVRNEFTIFPEELTTDSSVEG

SEQ ID NO: 979499 - protein, 173 aa, Homo sapiens
MRTCNIRRGCSKEIYLNRLIGGVSQYIPKINSLIICVANDNAAVVSTAHEVTQEDENKGAPQEVANLIFHMRLRKIWCGIAMAHLRARKWFLAKCLCDRKDLEAPRAIHWPPCKNFTWDTSKFVCVWPHVEKSITVERINIEARWWGLWGEGGILSLDNRRQWITWKEFLKAK

SEQ ID NO: 979500 - protein, 61 aa, Homo sapiens
MSAPTGRYLSHFERFSKGQVFWRRPIDAGSPEHLGLKKSQDLQIAGNCAKPNRFSTVTMDR

SEQ ID NO: 979501 - protein, 166 aa, Homo sapiens
ADSTLSQLSDSGSDSKRGISGVDAGEAVVLSVPRPRKAARSSTKSRRAEELPRETRGPQMGPSITRLDLRVEPTVHSCVRCERRSAGQHHVAVADRGVARISMRASPCPRIVDYSERRLRLTTVRQLKVGHVILEVNGADSFVGYRSDRGGRPSDYRRVPSMTNGP

SEQ ID NO: 979502 - protein, 141 aa, Homo sapiens
SGRSSSKSSHCDSPPRSQTPQDTNRASETDTHSMEKKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 979503 - protein, 200 aa, Homo sapiens
EAARARTVGCCWAARGREGAGLRSPPSPSPFSLAPAGPRAGAGHWGHRGRVGRGPVWAREGLEDGLGRTREGGTRKGAGKGPLVWEHTTAGRRRRRLNRENALAQGTQERLARLGRSPPQKGLTGHNRLGERNPRPKCSPWNALEPGDRKCTQGGLDPMTGDHGTQQEHTQQSKSCTESGENIHRGIGRRRSNKRLRDPV

SEQ ID NO: 979504 - protein, 248 aa, Homo sapiens
MRVWDDHSESSQPRPGDLEELACLVLTPEAVVSLQLRMQVRQNGLWLLGLDGMTRKPTGFSQIEAIEEGLLMEIAWVRKGVCNTARCSSMKGPGMGRPGRQPAGQHVVGHLKAVAVGAIEKQYSAGSALDDGGISAGRPEDAARYACALLSSHGLAMMLAVSLEARNLDGRLSGGDRPGCAVSFASQGHWAIAWSAPHERRPWDVEVRFGEGKRLSTKEGGCRLRKKSDIQEQVLWNPDALVGKKGVR

SEQ ID NO: 979505 - protein, 177 aa, Homo sapiens
RLQSGADPGVVRVSGNLDKRFSGWYDADLETRWVHEEARGGVQALGDAGYEFDYPCFTLSASRMKRSRDAVLGLRARIAELQSVVCAAEVCEGRGVASKWSRARIGGVYTRISDKEHEAAVLETVADVAHGVTYHRRRRPYDVPTNLAEWEAHDTLPFYTSNIRIGGPRRSSARCSQ

SEQ ID NO: 979506 - protein, 304 aa, Homo sapiens
GGFPAPAVSRPFAGHQKFLCASTGEHGRAHGPGGRECGAGDSLLFALFLAVSPRLRWKELQGSRDARIPRVCLSRGAKLSPIIAWHGLLRRTVRQDRATNAEPFDTENVCVYQAKRLQGEQMRVHDLASKMRPEPDACKLHWYLRDHCNLATHGEGQPRHAEQPAYEPGSCARGWSRTPTTKGTTPITMRNLTLLDSGLYCCLVVGDQAPAIGAQGPWCHGAGGADRPKMHHPTVWCTHPPPRRVKTSRLPAWLRVPGIGKNPLASPHPGPESTRQGTELQTAGPGTWGTMARHFQGMKTRLKP

SEQ ID NO: 979507 - protein, 311 aa, Homo sapiens
FLAPSELPPPSPRSSSPGPGFPWPLRPPSLCDLYEEEEEEDVKMGSEDVVEEENPGGPPGLFRQLHNFELGGDYVRSNNTIPVKQDRLEEPYEENQRALTKHNPLALVLPYRDNPPLANQLSCNDCWIIQASPATDGCTLQSIQYCHRRRCDIQLSAECWHRRDNGIWDYQEKPPSREHIKIMPQPKLGHDQFCLYAKTTLWSYTILDDMPSENGDDPDNETAWVAGYTTSDKKPLVLFCRERTLGGTPLFDMEARVSVDQCMSYHTYMVLGKTWKSSETKPHRGGLRPNVGHTTGWGGLRTPVHEESRRP

SEQ ID NO: 979508 - protein, 175 aa, Homo sapiens
MVSSTVGAPAEIACQLYYSSINPFPVPSCSPVRRGYSVIPALTCDGNAKAWEGQDGEDQGPYRGGEVTLDEGATLDLTVRISPSFYEKHCVRPEHASELEATLTVLTPGYVPCNVEMLQACSLIRVPWDTPDVSPRAPVSRGYAAQLDLPHSSPSGWFPEHLPRHKVVRLPSTNE

SEQ ID NO: 979509 - protein, 309 aa, Homo sapiens
DKGTGGVEGGAEGAGPGAGSERAPGARVRPGGRPDRLDTRGRRPGMGGTTSARANLLWVPHRGVPIPSLTICSTRQGRQCKRLQHNGRRHVVPKLAPSKGHKKAAKGDTRKTCGLEGTPGGRRYQGGEAPEGFSGHTCEGPRSNTNKGVGKCPPCEKEGPKLPVRNVTQRGRGKQRGRATNGFKRGARERVADKRRVGITREAAQEQRFTEGGYPPPPGLTKAQGGVGPGAQESGGETVGETSSVGANHRGTRRESKGPLKEVRTGGSPRERPQLTGLADACRADTTKKRAEAPGNPGSAGVRPPCRGV

SEQ ID NO: 979510 - protein, 144 aa, Homo sapiens
SEPCGEICELRLTCGTMISSGGTPGASASSAPPAHEVGHDVVWYRWLLLTVWGAGGAVVLRLSHSGPLRTAVMHSILLNIAGRLCGLIDGWLFPVGRVMRMTRDHACWDKQPIVLCIQGCACYGTHLARGQKMGGCDSSVVPGS

SEQ ID NO: 979511 - protein, 228 aa, Homo sapiens
MALEGKPKELADCAGANMLGPTGSPMIVFKDYFTPRGPGVGARRSPTAKEATHGRLKEVGINLAHVRPGTVGGTFVGQRGHSPKELQGGTFVDSRQKWPFPFPRARRNDKALSTRRCGGSQQKPPSTAKGFGQSLPLDRTVGKHWGTRRTLLASGQDKVGTWAILTALVVLNGRHTGQNPSSGPLTFPAGIFTQVPINVEDQSILSQVGKIIPVEPSMGQIHRTSENT

SEQ ID NO: 979512 - protein, 150 aa, Homo sapiens
AVAAAAGRVRDKMKLIILEHYSQASEWAVTYIRNRIIQVKPRPEKYFTLGLPTGVPHVVGYKKLDVNTIRMGTLSFKYVKTFNLDEYVGLPRDHRESYHFLHVENTSFKHIDYPPRKNPNSDGNAGRPTGRRVMPCEEKIKVQGGIELFV

SEQ ID NO: 979513 - protein, 191 aa, Homo sapiens
VQVFAPANALPARSEAAAVQPVIGISQRVRMNSKEKKDLWNSGLRCLGITMMVIIIVHSELGIILGYSYKRGWKDLQNETSDDQKVCEREMQRITLPLSAFINPTCEICGGRRLSWSTHSQIPVDPQEGTTPLMGQDRDSWGPEPSSQVGRSRHAEHWCRSRPPSYQLGGTYHFVLLVKTGIHSPAFCGES

SEQ ID NO: 979514 - protein, 315 aa, Homo sapiens
DGRMDILVSECSARCCSSSAASSSRVTEREDPNKPMGVIHYQTQRSLGSVAPQQFVRGTAGRPTPIIKMLKTRPERGWSSMPWLIPQQFPGKGRRTEQKHLKFFLNVAGKLDPCWTQHLGGTDKRRSVHPQNFVGGHVLTKGRGRTRYSIAKIIIEQKYLLCGAAWWRARSKREVFIRQQTFCGRGADAEGAKYEVKKWNKVGEEKGVSNPKEKEAPGETTSNAGADGIILTPQERNRRGRTTTRRVGATTTEKRYSEGPNRRGPNTSGGSRADTSIKITPGHSVKDTETLKQTKAEHERIDKSSRTTQNATNTS

SEQ ID NO: 979515 - protein, 71 aa, Homo sapiens
MSATSPGLQRTRVLVRGQAAAQGSALKVLRTWANGPVGVKRSPMLWGLNIQGEHAQYNRYAPKVPPAIGGP

SEQ ID NO: 979516 - protein, 253 aa, Homo sapiens
LSARGKTEVGSVFLAARAQEREASIMETTGCGKRIFRIHDEEEEPQAPQESTPAPPKTDIKGSYVSIHSSGFREFLLKPDAPAAPSLDSWIESILLRSQHECIPQAIQGHGQSDAKANVPGMAQDRGTTVHDTPNNRKIEQLSKRNRVNRDHMDQCANTKAGWDLPELRQRQIMERLFPQSNNCRRPIQRWFLVIHNRSDTSTQHQSKDGTTVEKDSTVSPNVGETENTTEPGHTWHARCEHSRTSLKQCENK

SEQ ID NO: 979517 - protein, 272 aa, Homo sapiens
MSVDMLIEHFVVKAQHHVCHAAYQTIESGDYAGDNYVHRRGCKKKQRVDNRVPTDMNVGGILAEEENIDCLTVSYVFILYYTHDHDVDLSAQSTGENKIVRIEKETAEEDYQHERPKCIQKQSRRCDNLEHKLNDLLKEKQSVEKKVQLSLNTKVAKLTNELKEEQEMNKCLRANQVLLQNKLKEDGEGAEGEPVTKEDLRSPRSQEQLRDVMYYLENTGEDQHLPGEEPEEIQEGQIHIGRARLKPGSSGARGNCPQEGPQRGAVTQAKIL

SEQ ID NO: 979518 - protein, 111 aa, Homo sapiens
PHDSIISTWSLPGHMGIMGTTSQDEIWVETSQTISVPLTGCVTLLRCAGAWPEGFGLRAHVLHGAHGGGPPGSDLPEAMSESPSRDVVGIRNRDSLEVAVKTFPPERTRGK

SEQ ID NO: 979519 - protein, 447 aa, Homo sapiens
LCYRDEEFCACQKIDSLSFTASMKHEPTKPPMRKLQYVFNAQRISTIRWPSLTLCDDVCPVDMRAWDWRLILLQESSDQGGRARGVEAREVECRSCSVVEPVASEETTNRMEIVYVVATVVEEVTRSEDTPTESTHPRVNSFMGAKILYDRRRLGYFYDRYWTLGALMGPIYPFSLEAQIRRPVRPIRLDQKERGRGDNPIILELVYRNKWQSCGVGKGTGDKGERRDVGEGPSGSSYRLSGWAPSNVEVRTHTDTIFGGASVLLRTLENRRENRTALSVFAPVGGPRIYGKCGRKAMNFRASECGNGVCAHNERRQLCGPGTARGNTFFRKRNVCHALSGTESAVLVDGRRPLFEPLWFEKPLEELVPLDDKGESDVNSDIQEALPFCSLGFNRKSREQRKAHIFEQGGYHLSHCIEGVKTNSNRLLPSGKKKRTRQVPCAKIGAP

SEQ ID NO: 979520 - protein, 152 aa, Homo sapiens
MLSGGSTNLKPNKLYAGAILDVPWMKTWGTVPSSPSFLFTDVDKAKPVSERHENSSMSVVPDPVLTAYVDTTMGTLAGQNMSILHIANHRPVSARLPRSDNRLDTHITSCLNICPNPFSKPLSTCKLFTSTKTIHYRIACLPSNQSYHLEAY

SEQ ID NO: 979521 - protein, 103 aa, Homo sapiens
MVFADTNKETQTGSSDYKSHYGGDTNVQRKFSIEADIGAHRVSVIARAVCTQSSQEIPPCVQQEDDTRVLDPRKCACLDLILWLLCAATDLEYDFIKGAIDGN

SEQ ID NO: 979522 - protein, 238 aa, Homo sapiens
ALVVHENVISCPHLGASCMEVQRRVWGGNAVQYVYMVEVKILCIEVFVDSPYGPFALVSYHFPDIQSPWMVASAEESSEELDMMRSLGMGPPEGNHPRWIHDGGRIPGPDADTLPKDLEIVVVLGPERKALHGKSGMVELVRNSVKLVCGRRLPSSCDRDFSYSLLQCMGESSGCRGSASMTVGHVGQPFSPGLWAFGPEGTYPLVLAGGPMVLFQDQRCLSAGGVPVVLIRDYVLEP

SEQ ID NO: 979523 - protein, 142 aa, Homo sapiens
MLSDIAHRIVAPGNGALLSCGLRPSVRHCQCGLRSIGIQKITDDNRRLLHGRLLAEQLDQTSRETPAFESGVILLLMRITLTRNGVLMGVAYPPQVSQIPRGVCRWASRSDARRVDPHLVRAQNGLSITHPRVRNAARSGST

SEQ ID NO: 979524 - protein, 138 aa, Homo sapiens
MWLRPCAGLGPSERRGFEGHEFEDNLVHMVETDTTHESTKFCGAPVDPGKGSHNHCRWGAGGPSTGLVAHGPQGRFHRNCGHMATVPVGFLTRNKKRPGGKRAAFVKPITEGEARGQQKGGSYTGASQEGGKSMYAPT

SEQ ID NO: 979525 - protein, 313 aa, Homo sapiens
MDLTAGRFLVKCSVWLRAKKLSCLRQADSTFDPEYPGPPRTTLSIQVLTAQQLPKLNAEKPHSIVEPPGGGIEIHGRARETVSRQETDYVLNNRLQPPLGGTTLKFQLRAPELATWIRFVVEDYDATSPNDFVGQVTLLLACYTQGYRHIHLLSKDGASLSPTTLFIQIRSSAPEGPRSIALGSEKCSPDPLQSLSSSGAGGGSNRPPRPPHWATQTDFDQAGWTQPVVTEETARSPPGGTEGVGQVTLQDDPNPGARKRADPWSEPTRTLDYRQQAVPAGNREQEPGRKPLARAHLPKRKTRRPEAKNKMTR

SEQ ID NO: 979526 - protein, 317 aa, Homo sapiens
MTLNQTPKRDGSPDKTLRPLATYGQRYTQTKPRTRTHTPRHQRRRAPHNACPCYSLHICTTTNGTLCAIPQPWRITPQYKTPSRHRHDQTRGRQHLRGLDTITHPPVSSTRQAGNAIPSPSRHEGPPMLNIHGGDARNKLDTRRNDKSLRRDTHSAAGGTKLSNAETTTTGRILGNTPHGHRTHKGEGQQKGKCTTQQRDVKPTRRLTTTGSHHINSGHHGAATTRWRRGVYHTEGKYGRQILVEPQAGRIANYNEEYDDSTQLDRYTKRDDRSLHVNTSWYRSDIVVILFSLLPFFIVNGDEHRKLTPVHMPHPVA

SEQ ID NO: 979527 - protein, 322 aa, Homo sapiens
QRGTLPSHFLVAAVFSLSCSEPPELSFVLECSVWVPRVPESVTVVVDAFYVEDGRSACGLTQSLYEVICYRSHDSLLEELESCGGVFIVDIIKVPSPWNRRCASSLEGYFFKAPAAGAHGIKDEWSLIYEPATVKENWIDPRDEVPAGAPTMRIPRSSHSCWRQSGRYNREMAGGAAAEGKRRGPALRHAQVLALERVQVPPGSLKDQSLDVHHSQAIRKVLQAIAVSTNCSLSTDGVEGPIPSRTAQVCLRPNQYGPKQRSKQNKFRGKQENTVSVTQESKSGSVKYLRKTPDWRNTVVKQLLSARKEGSTTYDCHSITHT

SEQ ID NO: 979528 - protein, 389 aa, Homo sapiens
NTGETPSRASRVQAVSRKILNSCPRDLPSYGSQNAGITRGEPTVAQTITCAYPISLTSSTQHPRENMANITPQHNPNYPPNWHLAPMDTQFTSQRADIPGQRVHQKRSPGAAVHYRFLVNNPQYINPLPCTLQATTILSLSTQTRTFIYAVPRCTTKQLCADPPCGLPNHIQQLRTDANTPEGTCNHAYRWVLCDCTALGYTPGYIPMEYGPKEKTLLVAPTGLTGVYLDKGHGHVSFFNALSPIFFKRLRINCQGATSPIIPHMRWLTGMIENWWSTTYIFRGGHPLPQTCKPQLLGRHSTLYLRSQFQTPCFTNRTNTHTTHTKQARDAPAPPTTISSHNPSRQPDAHNEKAAGQHARPKGPPRKTSGAVLPTNTPGEQQACTTPAD

SEQ ID NO: 979529 - protein, 87 aa, Homo sapiens
RTGGVVIIPGFGLSCVISHGSMEIRDVPPLSLAVILVRACTVLLRLSHRDLFHTHARPTVPYCKYPAVGSGTISSKATKPRSTCELS

SEQ ID NO: 979530 - protein, 68 aa, Homo sapiens
KRDDEGNVIVDKRRNKTHTECLRVRLRPTTFRSRPVAKCGYPAKAQETSLTLDVPPVKKTKYHRNWSP

SEQ ID NO: 979531 - protein, 96 aa, Homo sapiens
GRGRREQEFLHMAPGEVIITVRLIRSFEHRNFKPVVYHGGTLDKTVQGIYRILKQDIPLGPNLPRTIQNIINMMHYRLFIRHIIHRHDAALCGVAR

SEQ ID NO: 979532 - protein, 169 aa, Homo sapiens
MCRQSHIGQTGFGTTENPQDYRVCRSQGVWISCLIGVGPRGPVLCGPGVAHLLSVPLYTSVSVESAQVRVPMLGVPSHNRVGWLPVCKSRRGISLDLFPGPASGLLCHETVCCGVCVHWTPHGHFSGVEGLAPPSSDPFPPRLGAPNEPPLVACFTFVIKYGIRQNESI

SEQ ID NO: 979533 - protein, 68 aa, Homo sapiens
ASSEPGAMSPPVFLYGKVPGHAHRRLLGQSHARSADPSEAWDTAEVDLGRLIRRFRCHYSTFVVCRAK

SEQ ID NO: 979534 - protein, 445 aa, Homo sapiens
FNLVALLRARRVTMQLYCGANLGKFWPGISSLLCRCLVQHLARGWIRDIWPRICAGHVDFRYSYAEGISGFPETWALKLALPFQTDYPEGHLLQWHKHMDKFTLSSIKRSKTILDKQRLKENKKRRNNDEKQNKVNSRQSNDKTEKHHNKKLRGRELRRDGNYKNRENTKGTHAEKETNERKKEGRRRRERGGGCRQHHETSSGGEDKARAPRNKTKGAERERGGEKEEKREEERERGEGGEMGGWGGAGKEEGGRVGVEDAWRCGEEREEEGWDGAGKSQRRTRPERQHKHAKRKKEKKQNRRRKRNTRQKRRQGRTKTDHASEAQTDKKKKTARQEAEREQREQSKRGAEREGEEEGEGRKEGREVREETKRENGRKRRSRYVQRKRARSVNTRSIEREREERAGTGKGIEREDRKEEEKGEKEVYKKRRKETTDVSRRRRRG

SEQ ID NO: 979535 - protein, 113 aa, Homo sapiens
MSIGDKLWIGLGREDAKKKSPMLVPTPRFVIRKVFPNGAMSESLGLGRPCKALLTHPCLGNNTITEIIIKEISQGQLYDNEKVYKYTNKPQLRYMKYNTGDEDRTQKYYISID

SEQ ID NO: 979536 - protein, 309 aa, Homo sapiens
MPMFIVNTNVPGGSVRRGGPLRRLNPSSWRQATAEKPPPVTIRGETVGPRDPSSMGLRGSYKARAGAQLREDLGTEEFGTKIRGDGEENRVHLRGKWFACVETLWFGPTAPVEQFKARSGGSHLSNVLTRRWTARPIGAGWHPVSRLVAKEHQEGNPNGMVSGWASHQWKTRTDTMGYSRDGQDHNPFGVAADTHRGEQAYNSTDSEERNNVVWEGTAHEDNDIKNTTLVWGRVRHVRYMQPVTAVCNDRNEGHDIGGVPPPNKHAEARVFRPPQWPRGTRGYTRASEYCRQRVKSKKQQQQNSSTKDS

SEQ ID NO: 979537 - protein, 221 aa, Homo sapiens
SDSTAKLKRILPCHAYVNQGREPGDRFSGWQKLIMQSDPAAAADHPGPLFRNSQLGQFHFTNKRLRTSSHIGARAGYRWAYGFVGCHGMFPLIESPPVSVRDAHAPGISSYISKIFMGLIPYYQSGFFSAIPVGLSPPAKQAVVDLVGVNSVPSPDLSNKPSILGDGSGVMEWSRKRKVLRTNSTVQEVLPSHVYLNQVIDPDDRACGPRKLYMQLIPQQL

SEQ ID NO: 979538 - protein, 201 aa, Homo sapiens
AGGENALGEPLVRSARRSSDPPRNGCTGCERLARAWARHLRERLALAACAPLAHRVDLASHWTSWMMLSCPCRVNPSLHGSPSVHVHPGCGCRTPRTHRARWHLATGVLPLDLGLVCVWLRWRKLSLSWGHGVNPYIPACAEPPEPPVPTVTTRLGLPDAQRGCRGHRVRCEHGGTFVTPRCLLFVEEEQRINVLDLSDEK

SEQ ID NO: 979539 - protein, 344 aa, Homo sapiens
QTLTFSASVQAPWRPPGSPRGGTLENDRADAESGDAHRTLNGGKVPPDTEGVCGSPYGLISDFAGEEQLDPKLMAVGGADLAKNVTTIGAYHWGRSKPVALYQQDCGSHVGCDRGGTQEDKRHGSSGGTYRWRALWAQTTVPPRAPGSEGHSGGKSAVPFGGTKGIRRESADSVGIPQWPKGCVIRPTDQRVSLGKKYSGDSDVADKGSRLRHMTACGGVMTYRDRRDYTPIERQGSNTRSVRGNGQHVQRLRWEETEHRIIMKGLEGQPEDVDSRLSGGSRGGATESRNGHTRQMGTQSTFATGYTKQKATNRRTARHKDPGIHRLQAPKVTRLEGVRTEHST

SEQ ID NO: 979540 - protein, 434 aa, Homo sapiens
MAMVGKDIRLHAAAARSSSSPMYLLAGSNRQGDRSLSKCQVALVGTYCPRSHGAGTGESRWSYDHQSWHLRSRISFVGQRWARYQGSVESPDPSFGVQPYPAEGHGLSREMCEPSCSAKSTQRRITQSGDHATGWRRASEVVAWRTRVQPKGPSGVALARNGVDAHRDISARHDARLEAAANDEWSYGPVNAPDRCSMCRLSVTMVAHTLTNERRGRVKPWRDSWWSGNIRIPGMSYLFKHIHWGNPLYCDRLERDPPNSVGMGSPLGGKATGCWNNLVGEEKRRGVATSHMGQRESTGEGKTQSRLPVVKRGDFNWRRPRARMKPLNIEAGQAAWRPVKQAKVPWDEIRQPAGRGSNGMPRAQVNNQGGEKSTKKPLRHRARSSTQGQKVKQTWEPSKSSRKDNELGTHTGTKSFTNRGEVEDNEITTSTRSR

SEQ ID NO: 979541 - protein, 328 aa, Homo sapiens
MGTIDNKNSPKNTNTVTSAARGAQQRMVQATHRSTQQQRVKTQEQNTIRDPSDNTQRACGHHNNTTQKTKNRAKREKKPTGRYQRQTNNHHTTLEEKREETQTRGENNNDNQGERTQKQRTKKTQEKKRHRPPVGTTKQQNKTKKKKKRKKRDKEKRTHTETKKNKPNHNKQKTNKQKKQTVHKKEEKKKAKEKKKKKERNKQKKKRKETKKNKRTKNNQKRKRNKKQQGEKSKKKKDEETGERRNREGRNRKQKANAKGEGARRDETGERAASKEKDKKEKDKQDRTEKATKRAQTERKPKRGTSGGQRRGERKEKKGEEEKAANRN

SEQ ID NO: 979542 - protein, 138 aa, Homo sapiens
MVVKSEDEEDVMPTHVTWREAAWVLNTLRVAEPYLVPAWRTVRTLHKYCNPYTLGDDKPENHHKNMNVCSQLLHHKPSYETYNVTLLERFRVRGRGIAVSNEEVDGRLHIIGGHYNRSGSHPKILRMRNQRARLGHYQ

SEQ ID NO: 979543 - protein, 286 aa, Homo sapiens
QFWSAAKTKGFEVYLAEMSADNQTCGKRNIHGRKLKEINKMADHWETAPRHMMRLDIVLVLQGCLLIDTTVEDWTRLLMQILERTTTTTDHTTTMQTEEESELGYIPKSKWEMDTSEAKLDKLDGLRTGTKRKRDWEAIASRMEDFFSFPDDYDTRASEPGKNEGQMGRPGGRRQDADRQTGIGFVGRTALMGRTITSLTRGSTWLKKALNRTKFFLTLRFGTEHYSSQEWYAQTGPESKPRGHSWFCPCVPDSQPVVRTTRQRIKKVPGSPRYHIVCPAKKYLTA

SEQ ID NO: 979544 - protein, 543 aa, Homo sapiens
LPVRLQPPCTGIWGDPPPAPPDLLALRPSRRCRCGVLCTAFDPRLHPLGVTGMCGEVDCPAGTSYHLDRGVSRYYHSMRSWDSPSISPWERVSAINTTDSSGSYPRAQSMGTRGTELKQGTRTRNHMSRHKSNEQGGRQTGMPVQSVSNRDVGLSGVGLIHMRCSHDGDASYRQRRHRKLLYMPLDNRQVAEYHRRKRQELARQFSFASQAHCSRVPNNLGDSLHFRPQLEQAKRAWGRKGKGTKLKSPRVPPIFLSIPTFDNKWGPIPGSNGLSKSNTSLYQDGQVRDNKGSDATSISEGKAVVVNPIGARTEPKQDNLFFALPGCGQKCPVLDEIVVELATYGHMASIGCPGGPRVDRLEPSRNNTLFDPVGEVTFTITRHPGCLGDNHINCSQAGGGNTMESHWQRQPEKELAPELHSQGPHSTKSRHRKRGAQRITRERCVGTTKGVRATDHKDGRRERRKSPNDPTEEKDIEPTTILTRRNEDGERRPRVSPRRPVRNQVMCRNGTMTNQQAEDRQPAHTATGGDDNKRGLTRQPHEE

SEQ ID NO: 979545 - protein, 270 aa, Homo sapiens
CRNPNAGGSPAPVRRSAGGSGTVHVKLEKKDKERDTREGDECPSPGAQASKKRHCRCAALRPSVAALVSPPCNLLFVERLARVLWSHGAFLVRSIIPGLLRLVLSPVLPASVGLGSPCLSSSCQRPPEGITLHPPRRRRFAQDREERSFEWPLWLPARPVRLGDHRLSLCPVLAQRGRPSAHPFAGIFVRRARPSLRGAARGLLVGLQHRQAPQLSLGTVTTPRAALCMFGPSCLRPRAHVARLRLLVPRTLPLTRGIDDCSPQPGLPAP

SEQ ID NO: 979546 - protein, 646 aa, Homo sapiens
RGSVGRNLKDSRKWVKMVSTDTRWLPWRPKYCHQMDVYILGDFNLPRAHVLYTGTDTHWMKAGEPLEIMIQIHQVEPGLTTDFNVHGGSMEQIQGRTHGNQLKITHLQITTVSKDKTPTLKGDLKCSIHTMTVHTNQTLVTTKQAYPTRLQLWIDHTQDMVRTDYTVTRTNQYSDEKRTFDLRRNLPRHSHSGELFGSAIDIWYRKLWFEDPVGQTCTNDNQTLATELYTGGLTWPQETAAQHTHITGDRNIRRQPEADDNSRFTNTSLRKLLRNNAGVCRNSRYINKHVRKTNTVQPGTRNQRPRGTKNRRCTQMLHICCSLAHNDSLSIYSYDDNALENSRRRREEHKIRRNDTKRNNDRRDRSQTDDRHSKAESASGSRQESSARAQEILREKKRGRQQEQDRSRGERRAVSERADGERDGEQEGRSARKSRRDDRDGSRADEQRALGGTRTSGEEEEKQERTSETPSDERDEGKHEEREKKQQTEKRRRQTKKKRTTSGETEDSAQENEHRTQPRANAKQERQGRQRATKKEQREGGRKKHRRDRQRATTRRQQKEEEEKTEKQKNKTREEKEEQREQERKKKSKTKRKKARKGTERHEKQEREKRGEKKEGRKKKEEDKRGDNTAERQRRRKTKHRKDAKE

SEQ ID NO: 979547 - protein, 140 aa, Homo sapiens
MDRRDVPSLGRAFSSELATLVGVLKPRRTLWRARMLISPRQDTLPTRGPREPCVWGDSCCPVCVGVSPPFTPVSRQGTCCALAPASERGLAPPGGSTPHGGPGIHEEPVLLRSCYGQNGLANRLPFRFHCCEKNYSRRAI

SEQ ID NO: 979548 - protein, 364 aa, Homo sapiens
MGSTRMILKPKVQTLCVKRSPVPEHSMVHHRPVTQPVCDKRRLVTKRANRVYRSLSASLLPRLRITANSTPTSQKKHETKDRHQQTHSREQRRGEEKEKEKREDRTKKTQETKRDSRKKERTERREERRRRKDKREETQREEEERTREEERDSTSKQRQEERQEKKEKEKKDKETRKTKETEHTTRKKRGKPRSTRKGEKKSKQSDRQKMQKQETKMRNKRKKQNRRNRRKRKREKRAEADEGGKETTRRTGKKDERQRQERGARQRPKAETQARRKERTRERKRQRKKHRTNTNRTERESEASTRDKTEETKGNSNTQEQETRETEEQQEDRKHTNTHATRQQQQKTTTKEKHDTEQTSTRKR

SEQ ID NO: 979549 - protein, 238 aa, Homo sapiens
MSECVPTTDYTMLFSDTMTDEVIDLASVSLRNSVSGYLETGNTYVAPFSDETESFTPRIRPNVKETGKATRGTFVDDDLQLTMWVLFTQTKTCRPTAMHTPPGCLTGAAALVLTLHWSTLLTDAPGWQALRRLLRMNRLTSSLATDVAARGLDIEGVKTRYLNFTMPNTIKHYVHRVGEQHVLAGLGAQLSLRWENDEPDSMLQKRDCTQLPRPPVTRQILPHDVILKFRRQIDKWDA

SEQ ID NO: 979550 - protein, 810 aa, Homo sapiens
SPPHRLHCTHVSFSVPTRPFPTLSSSPRPEEPLLSERCISGARGRARPLDSDRLRESEKRPRPGRAHTSGVATGREVDSLAAAAARRGPDTHRYARYPQAPVHQWRAWILAKVGSRQQGGGTNVLTMGQYALVAQTQQQALVHLVTPSSGTTLPNNLYTFHRFCSSRTRTSLNLSKRHFSEWQIWTLNYTLVIGIPTNGIPTAINKQQDTRMTTISVEGEHGTHGQNSLAPGTMDPRDTTTHGTVPNGLTWDYRVRTSQIHWATHLGQQASRLDRPWFTSRHATHRRHITQPWVGLNDGNNGRNGLMYTDMGGRNSHYGTKATRLAKQSVIPDHGRDMMGCILVSSACVILFSLYIEQPKYQDTLHVAEQKTAEHTQYQQTKYAHRQKRLNEQAGARHKRATTLTEKQPKERELTEMNTETEKEEQLMREEQTSKRRSKGEQRKRMTSGKERQASENDDSRESDEDRISRTKEGQRRNDTDDTSHQQKREHKQSEEHERQKHDEQQIEQSEDRPADESNTGQHKRMKVATEQPREYTMSRNDRHTHTHRSRKTQRKDTDDRGDTTTRAKRAESESRQQDATARDKNATRRLSVERQTESRQQGQGARQRAKQQQNDETRQRKDKQQMTQQSVNRQHDYGHEAGEIREEESRGTVGEYGAIDSARSDATRSEHQRRRERADRDEVHDEYQAQSKARTDRGDRRTRDSERMTTQRTTTPCTARLSAVKASYAMRAERTTIETETRRSETHERSDEGERTEVSDDEQEGRAHEMEQRRERVTSTSDECSSNGEAEYVRPGVERYTERSKHAES

SEQ ID NO: 979551 - protein, 415 aa, Homo sapiens
MCSHSMYTRALILLHLHTIRVRPKCNTQDELSWRHPASSPHPVSYKQSVARVRDGYSTRALPYLSIFIPLSRGAHSRGAQPPCARAPLRPDPLSTPAPFSVSPHRAICRSDTTPQRRQHVTPRPSNLSPATRAKKADNPKERVGTSLLNTDPLPNHHMWASLPEGKPPLSSPPLGPVPLTRASPPRTFHGRPLLLPRPSSTPRDRGAHSTFFLPLLSPPAHNGAPPIARDTINLPWPPPRTKDSPGKQPQAGRRCPTHKQGGAMGPPRKYPNKAPGAMSTTRTDPLHNHEPKLQTHSNPTESAAGPFNPPPLTVDPNYETPPPPALLTTPSPAHQHSRPPPAPHRRGRPPPRTNPPPDGHTAPPARPTPPTHGGRTTRPAHKRHKQQNKTQVTYRHHKNTHAEKHLNNHNHTAHA

SEQ ID NO: 979552 - protein, 204 aa, Homo sapiens
MPTPPTRPTPKTKSTTTNKNKENRPKNTQKDQNTKRKNKNTQRTGGAGGRLQPRGEGNKKARTPQRERGKEGATERAGGKREEKRKAAEATRTGGAPREHRESGARRQAPDTRTRERKTDTTQQTQQDKQTQKAARSGTRTRHTRDSAKDDKTEHTSQQTPDARQPRSTRAETTDASKHEATPSEEQPKEREDTRQTRQTAEHK

SEQ ID NO: 979553 - protein, 360 aa, Homo sapiens
MTIPTKLTITTHMSVVCRMSILHIYYLYLGKRRYNIDSIEIHDQLYTPSATIRTQRHSKGKEQQARSRDTKTEAGGQTEDRHTTEGRRKNEDHNETAKTERQENNTTKHKTDADKNEKKSRKHTEQHRQHNSTHNTDETEEHKQNGDKQERKNRRRTEHEAENRHKEQKRTDQEKPSRKETSRLEKTRSMKNDRTQSTRDKKRRHRTTYTKITNNTERHSTNINTKNRNERSGRTDSINDKRENTEQKQSKTNDERRRTARQEEERGRQRRRTREQTAHTERETEANRDAPRRKQQAKRRTTGKQNGGERKKQKARRREKQKNKAGEETARGSTQAPTRTETEADKEHTRHRERATTKEQ

SEQ ID NO: 979554 - protein, 227 aa, Homo sapiens
EPLWLRPVARCPRDPQGRRGFEGTSSKANLVHCGVPQTTQRNKLITTKIVGGAAHGATKKKAVLKQQWWWGAGGGDPTDKSGEGPVCHNTGVFPTRGKPCVAQTNNGLGHLSTHNYKKTAPGGATPETFSGDKTTKKEEHTEEDHKPRGVVNQTPGGCTPRRGRPEEHKNIRRPRAVVVSIQRNKQEERTAQKTRARQQKSKKIRGKKRRRERKEERGEEEGRVKME

SEQ ID NO: 979555 - protein, 79 aa, Homo sapiens
MPAYSCAVRALWVVLGLTEWPGEPKVEMSPWFTGGPVMPGWGLRDLLAQEAWGGPPVSVGRMCPVRFPGHGGPGNLLPV

SEQ ID NO: 979556 - protein, 561 aa, Homo sapiens
IQAVLSKVQLFFSMHRPLMHMKNSCTWQRRHGELARGTTTLRWDFNTTHRPTLRQEWTPQTGQRRQYRGQMAQTPADSLPRTKLLARQTHAPRPIVDKWPGKTRSWPAPGQQHPQITDFVRSKRTFHTTTSGTRDSSYSQIKHTLASHFLARTHATSYFYSGWAKPMWPIKNITFIHDGAISHLIKLGTAFINNHRSTERALTTQAKTPTTHTVHKAQLIAPKKHHRAPHNTTTPYEPSTAQYNISPIGQPQAGWAQTRRGSTSKRTAQHRDEQTNELRAHTLAGRHTRRGEKQIQTTNMTPQEHAEKRDPIARNRTIEPKVSSNTSQNIDVRDTTKRTGKNTQEHTNREHDSQYTLTRHSQHNIERLIDERKSHPETDTRNYSYRQVGAISSATPPFLNQTEENTDNRPHINHKRGIVEHSTPTNKRWTDETYRHTRPATELRDYNVRSSAYSMTCHAHHADHAQHKISTTENIDALPMVQRQNATIHADRRRANRRRSHTSHHVKTASSTNQMQTASRVNNVQPNIETPTTTTQRQSRRQTARSRQETTSRTRHKPRRC

SEQ ID NO: 979557 - protein, 101 aa, Homo sapiens
GGASSWAPAACILLALSGNGAAPAPGAWPEVAVDAVRHSMGGRDACLRKLSRQSESCRVLTLGSQIVGAHGRLLSGSQVQRVAVSRARMWHVECVEVTEYH

SEQ ID NO: 979558 - protein, 186 aa, Homo sapiens
LNSGCKPWIYMLCTVHLFHELTVQTLPVLLRQTTWKGRRLGETSASKKSKIVLLCPESIAVPAIGSCSPGLVLRALDPTEPGPRVCSLRLQAAAWRYSGVVLLVLMRGMFRVSGTYHVCIPPLLGVASVPVAMWPPSAWTDLMVGLKILESIIGLGFRTGYVRTLPRVSTCVPCGMESGLCFLLDL

SEQ ID NO: 979559 - protein, 71 aa, Homo sapiens
GEDGQKERDFHEAAAGWGAPRSGLCLGEKKARPNAGQGLPVRTREWKGARRRLSPPVKKRLPSLPVQIRSL

SEQ ID NO: 979560 - protein, 81 aa, Homo sapiens
GAQEALGGNAASETSSGTGSAAGPYAAPFPSPEGYHWDPELGIQFPTKGLSPFLKAAGEDLDVYILILVVDVRRTLGHRLE

SEQ ID NO: 979561 - protein, 121 aa, Homo sapiens
MSDLPADEPCHRFPSEMPRQGACWGRNRTSFLRYCWRLPANCQFAVSVTQLKKVFVFRKYREALLLCFLSLFVEAFLSRSGFWGGPPHPKSPPLCRPLGALIWAGENSSIVLEDSSELIGQ

SEQ ID NO: 979562 - protein, 122 aa, Homo sapiens
GDNRAGCPRLRRRYSVTPSLSALRFPAWCPQDVRSHGECTDDAYEALSPSSLRLAYGPSLCRLYPSITVTPDDRAKLESLYTSLENLVRSVPRGRAQVVRKKSNSTKTCLSYSIKWDQNLRS

SEQ ID NO: 979563 - protein, 268 aa, Homo sapiens
MPVSVWFLFSSLRVRFLVFPCFLLFGLLFLVFWRSGFLAGRFVLACASWLLGTLSMSPAGPEPATREGSKARRGIERSAAWAGTSGDPAHPQQPLATGAKPLIARSRQGHRQLPSECGAHQAHAHPELQLARKRPAQPRFPLRLSLHTSLQAEGAGSRPWPAQKGAPTVQRWAEGLLKCQPKWEPRQRRRRERARAARTASTHVTSHQHFEEAEAEWINEVRRSRPSWLTRRNPVSTQNTTKRKFERGPPSARSPSKSGGLTQEKRRD

SEQ ID NO: 979564 - protein, 337 aa, Homo sapiens
GYCIRCVCVWFIHCVKFFPPLYSTLLKNSYCRERHVFLYEIIFSGLSTITTQSDLRHILWCWYTASSRSGTGAGLLLEVPGSVTSDPKCSLGRGKAWYQTKLETLQDPGWEAMGNDLRHTRNEISEMNRAIQRLQAGDSTHIQEPACQGVEAAIAEAEERGEPGVSRNARAKQEELEAALTAGHSRIRQRQLREYQELIERDSLAQDIEIATYRKLAWRVEGEPVGWRWEMGHREYLHADVNSTGGSSSGGGIGLTLGGTMGSNALRFLHAVTGPGLHEGLIPSGTASDQSQECPRMIPPPNISTLSTSTTPQSQVRISNPLSQCRRFPDQVNHVGK

SEQ ID NO: 979565 - protein, 325 aa, Homo sapiens
GPFEFLHGERLATPPNPSRARPGCQYSPQNAQGSYPETLPETFFGTCGLVDPQAIWELVKMSSRAHKLHVLIKEMQVHGQEIESSQKMELEKTCCQYSGCVHSHDRPDPWLLEKEHDPRVITVSSGGMLVQKLNTNDLQSERTPFDGTTGLCYKTRGSKWFSTDRVGPRAPGHPMIRHQASVAGPTPHGVRQAIHGVSTPGSRDRPRSEAQGVATTMLWLALTSARTNPQASPAASLSVIQASEASFYTLASRYSVLLTAPKRTNSLTIVEPAGSDISNRPTQTQCEYQNCLSRYQKVTVYGNQMNKKTPLQLPLEDVVPTVSAS

SEQ ID NO: 979566 - protein, 127 aa, Homo sapiens
LLSVVLFDGLMCVFGVRCFGLRLSQSMHSTRHINNSRIDIIECDRIESFAADQVSLSRDVGVGLRSDAAVWRRCAREGRAVNGQLRNLWCASVVLWMLWVEASTCSAAVACVACWASSGGGLYFYSV

SEQ ID NO: 979567 - protein, 480 aa, Homo sapiens
VLPCLLCFVFLSPFPACLLVSFRVWASFSFFFRFFSVVFFVFCSAVVAVLLLFLCFSSSGFLLSVSPFFFCVRSFLLRALSSRGFFVFPFSPLVSPVAVFSRAFPLSLFPVSLSFLCPALFCLCSSSVLPLPPSRPARSSRQSRLPLFPFFCRVCVIILFSPVSCSLLFSSFLFVSCFFVLSLFLVSLLSSLFVFCFSCVCFCVSVRDLRTQEDQRRRRTGIMNSRLCHPSALVPQFCHVGPTHNLYGVPSYFPRWGAHKIVCEAIECVSAFQQGGLIYVAMQVPRSQPDASAVQVKPDHDSEAMIRLQAARQRQCSESSDNLVQSSTRRLQPLKSRQNETLGGEREDGWRHCSDHRSHRNNMLRKERELEEARKKPAQIRQQQYKFLPSDGFEMSTYRSLLLFKCRPGPETVRANYQSLLEHVRGPTMRQPQHFPKVHAKPQGLATAPVPQYIPMSLPNPKCRVMPIGPPKCHAPPSEY

SEQ ID NO: 979568 - protein, 145 aa, Homo sapiens
MPINERWCTVVIRVLSVLQHKLHRHASWRYFGYYLVQSQCVCGICAASCPVVMKTCAELSRRVYQNTPFQGMYDSVVPVLSSLSAGLEASLDSSAVGPSLAAALPVVSTVPEFSHGSWQVKRSFLSWFRLHLQQGKCPSCDHIIH

SEQ ID NO: 979569 - protein, 269 aa, Homo sapiens
YPSRLCLVPRLLASSPRRCSAAALLRFCPPVFFSSFPAPPPCFALSPVCSPLCPLFSLTRRLTSSLPFPHSFLCRRVLICSLVMARVSSRVSRCSGVSCLRLAFCSSVAGAFLLPALLRLVGRVSSVVSVFAVLCLVGVRFPLLRFLLRFFLSVPSGLPVSGFSLLSSPFRSLLPSSRVARVLALVCVSTPVSRSSLLPSLFVFPPPSLSVLCSSSLSAVVGVCSCALLMSLLFCFSVVFVLVQVRSLELIIFLVCVLCSLGACCMLTR

SEQ ID NO: 979570 - protein, 231 aa, Homo sapiens
TFSIFRHPTSCVPPPLRVSSSIVYVVVCPLSSLLPVLRISLSICSIVSCCLLFLISFLFASSPPIFSPSSSFPCLSPLFPLPLFVSCCCALCVRFCLFWSLLLWVLCCAAACSSFRVFARPFRSGCVSLVLRVRCFSRTVCCCICARLLCLDCPASGLLLLRGAVFLLVFVSVLLVCVMSLLIVVALYTIYLDDYDNISSKRSYNAYGVCMSEAFPASGVLKNLCLKNGFS

SEQ ID NO: 979571 - protein, 132 aa, Homo sapiens
MWLCLLVRVVYDLMVLSYFVALAWMALFASCSGCSFLSLSALLLVSLWPVSGHGVVVCVFTLLLGCCMLLAVVFYWLSDWWFGVCCTVCRVSPVPLFVSTVVSGHCVFVRVFSSVVLLDCYCHVISFSYWYL

SEQ ID NO: 979572 - protein, 148 aa, Homo sapiens
CAYGASLLRSFALGCALLRSFGCAVTLAFYGSFCGYRLGVVPVSCLLDGVHTCAISLCSVCVNIVFAGLHQLSTQCGTVPVVGLLGANKWCSSHGSAHPGGLRVYLAPLVACPLVVCLASSLACSWPCSRRCNPRSSWPHPFFTDFLS

SEQ ID NO: 979573 - protein, 83 aa, Homo sapiens
ALTTHSVNPEVPHGRFCCFAAGKGGATEQLIHMPRIGVFFQTSGGWTMNVVNWFLLITPELNFYVNKENQQFQQKIITNNKKM

SEQ ID NO: 979574 - protein, 484 aa, Homo sapiens
MAFIINTASQPRGTSFTTCPIPSWIPHIAGACTQPPTGAKWQSHGAATLAPWWANCGLHTPHCIRRRNSLGGPTQALKAINENEHDRLCLGTYGATLFGIAQRGRLVVHIQDVNTDLGYFIHYHFMNNRLSPITLHSVFGAPQLHNLQLVVGNMRFNTDMWDKDICGPTVYEGTITFGGLYPFYPCGPQVTLLALRRPTWEFDNRQSMLRTYTLRQPTHASYTYTTPPKRSVTFSPRQGNQGRHQCMNTIFLTTLHCVYSYPPIKARSDTQLANSGTVLSNTVVVPTTRYYTSTKDSIVQPSIWHTDYTCTLHTEQTQYHQRGRAERHMSERGNQSPAWVKCQEPAHMLPRHIFVDTLLGTSQRGPNEGTPSIKTTQLNGKYHMDNERDRDQARMVKNQWSKTKCRCRPTTVYKAPPQSATNLRVDHTTHQQRLHKHSAHTHIPPTAAQQTHDTQQDSTTHIEQNNQQRQLTHHHPAAAHQSNT

SEQ ID NO: 979575 - protein, 132 aa, Homo sapiens
MGTGVFTYMAFVLVEPTGAGPFGFTPQDTHHQGANAKNTHQHTNFVCRRRGHTKKLNTSVEPAQYVRNVAWSSTQPGDCWVIHPKKPGHVGQHEWAHGSKARLTPTRGKEQRRRETTTENDHITDETETTQN

SEQ ID NO: 979576 - protein, 164 aa, Homo sapiens
GWGPEAGRPPDSSSAVRARLVSPARQSQDPAAAFSLHLSLPPAPGRGLRLVWRLGGASGGHWGRASGGRFRAGAGLEGAEGKPVWKPRGAQSGPQHTLRGKTPRHKRDDRRGGGVTRREVGNRRGRRLVRTELHIRGDNRWSLTPQGGNTRASWEVGAPSKNYR

SEQ ID NO: 979577 - protein, 58 aa, Homo sapiens
MQNDKQIFVNEKAKDPMRPHPCSWARDGARKKRIGSRKHDTEPAHTMGTTNKGTGGHT

SEQ ID NO: 979578 - protein, 117 aa, Homo sapiens
ALTLRLAAGVLRRVVGPSVALSGRPYHFASGSSARGVVGYGQPRGCKGRHGSQMRRVPLVLVLPEANLLEREDPLRKTPSGGQYLLVVGPGLAGITTLDLGNFPQGNTHRSKQFGAL

SEQ ID NO: 979579 - protein, 500 aa, Homo sapiens
QTLTFSCLVSSAMVPSRTVFVWGKLEDDRADSTTSGGSSLEHSDYAAKVPADHRGWSGAPPLWAYIDIRPRAHTLSFPKGIAGDIGRSTRATHEVTLHWGAFIPGVSLRPLGHLDHTRTVVDPHLMGWTTLGRTIPRTDDKGQIGPHGETAPRTDRPGMGGHRTGWATQRCSLAPRPRTTPERTNIRARWQWAGQRTAISTSNSVSKPLGRPPQLENRARAHAHTTPTPSGPTLRKLTRGVNTARGHAHGPRQPLGTNMCSPCVAEPMWAKWGKRSGHTTPKSRAPRKRNPTNEQPPPASNCPSKPPTGVTSTHGGHPDSQPGTPHTSGRPWHRVSHNPEKERRAKNKQRNDGHRTPYEWNAGNPTRAPDTGAHHTNGQDQMGATPIVTTPARPKQDTRDKQPKRHTSNDAEHHTTGATTGGNKSLHRRSNSTHKAGDQRSLPKGGVHAGKTQLTTVSSFTTLYPRRETGKTDETKRQTARTPRRQQTHKPRRGRKRRTQ

SEQ ID NO: 979580 - protein, 83 aa, Homo sapiens
MAHNDKAELSVRQTKSNQPLRNKHEERNNQQKKKKTAGQTQTQTLETHNESTELPHTNTVSLIQTPATKERSRQQKQPPRLPE

SEQ ID NO: 979581 - protein, 186 aa, Homo sapiens
GGLSAEAARGWKRILGAAKSLAPVGVRMLRPTSQYVLVDNHNAESKEGLSCSGCCSSWLVFCHSGHSLQCYNGPNPIGCCKTAVNWFIWIWMAWSHYQSWCYNVVFTLCWHSCEHCNFQRRSTTRLRGKMELTYYCCKKGPVYTLTNSLKMVGHPYQRNQFFWLVTPFLGSKLGAFIPKSTPGELL

SEQ ID NO: 979582 - protein, 30 aa, Homo sapiens
MCNDKKMFWGIANMLEEYKGEKGDKANINV

SEQ ID NO: 979583 - protein, 52 aa, Homo sapiens
MLYCTSDSCCCRKRDTVFRVRWKQSLDAGANKLGGSASSRKGIQVLHQWKSP

SEQ ID NO: 979584 - protein, 303 aa, Homo sapiens
GLRSSRLGARPSDSQPARWRRGSAVRPSPSPPTRSPGRVTACGPRTQRRGTGGRAEPRRQGRPRGRPRGKKLLDDLGVTTASSETAAPESRAEGRHPGGRPFRGPQRESGQWAGHRKNQHRGSSGRPTLGRGKAYLVGPTGISGWAPNSVGRLDSQRDPWGTHSAHMQHDWRVKASGTSGDMDGVRITEPAIVRHLGMNSGLPPGEPCEGANPRKCAATREHAEGTRAVDRKLGMLDTHKVHGHRVKGAQKGPRTGTREEVATRAGGAQVEHHRVQPAGNREGLREGTRGGPRTRGKRWPHGY

SEQ ID NO: 979585 - protein, 107 aa, Homo sapiens
GAPFSAATGRPRPPPQPWRHVRGLLATCWRLCQCRVHLLPPLWHIIALDELKTDYKNPIDQCNTLNPLVLPEYLIHASSVSCFLCAAEWLTTGSQYAPLCISYWEVL

SEQ ID NO: 979586 - protein, 84 aa, Homo sapiens
SVIRGAILVVENDKGIDMVDHKYGRSRGSSKGVVMHMGDLLGDVLVCVCDSTCSHLVESSHNIHVDCNDSTPFLFALIAIVPKM

SEQ ID NO: 979587 - protein, 312 aa, Homo sapiens
ALHPGVVSKSESPKEPEELRKLFIGGLRLETPDESLEDPFLSTWGTLTDCVRSERLQNTKRSSGLVVFVTYATVEEVVAAYVVLGQRRWMETVVEATVELSPEKILKDQVPIVLENLLLVVWHYRTDIERTSLGDYFGTSSGTTCGACNHELTEAVALKRGFAVCNLDDHDSVISIVIQKSHDCEWATELVAVSIALGDSKRMAYVLSSHGQRRTTVVLGDRWCVVVAVWFRVVTCRLQFRWRDTCPRLWLPIGAHPSAVRRSGGRGVCLGAWAQRAHFGGVGAPVSGYPPLPFGPRGLERLPSGPSSPPVV

SEQ ID NO: 979588 - protein, 181 aa, Homo sapiens
AVMNWDAGAEPRDHLPLHRLETIGDLSWPQGEALPKGVDMRQDELDRLVHLAQWREPGILLPLGPSMALRSSSSSESCVLVVGCQRVCGGDEKSSFICNTLQACVQNKAWAYDQFFPISHVRLWVPAAHPSFHPQSLLVALHRWLTSKHIRRRKCYRFEGHGGPPYTWRMVKRHKVHNLRD

SEQ ID NO: 979589 - protein, 105 aa, Homo sapiens
MWGPKGTHGNGDKGQINKVRETYTHAATTLITKRTRPHHANGHNPTQWATMGDKTQKHKEDVPTKTGTHKTKQRPPPAHEHNNPTGGRRKRHAPDTQRAGRKHTT

SEQ ID NO: 979590 - protein, 325 aa, Homo sapiens
EREDREKHRPEEEGRSAPEKIIQSLKLCPGGSTGQPDSPPGCPVWLEAVIVILPLRACLGGVADVLDALFFEKPVCSKMPRGFLCTFTPHTRPKRGPIETKTCMSSTTNSRLFGCPNSMTRSSWIISCGASLEPPLVWIAPVGKSPGCFICVALKDSTGPLVVPVGNFPKRPPFALWNLESSHGPCVLPWKTRGVLCRMHVANARILVVLLVLKGVVCLWWNSGSACSMEKRLCVLDRLDTLSKSYLVPGLTVHIVEVVWPTCRWVMPGLQRASMGRGEAVSLRDLVFHYGAGSLGGRGGLGRRRAGTARAWGPGGRRVFVPQMA

SEQ ID NO: 979591 - protein, 104 aa, Homo sapiens
GRAGMTGVRVEGSVGLRNSNGVQNNACTDGGSIIWLTERIVHVTEVDDVKNGACSEAFRASKINRIGQVGLRLWRGITDVRYKLRHDQVTTGKQLSGECDSMMR

SEQ ID NO: 979592 - protein, 148 aa, Homo sapiens
MECNPCVTMHCLNCARELYTCLTNCWLKQICPTVNWGYHKLEGVAYSSKERKTPLGGNFKQWVLEASSGEHDLEGNLWDGPYNLDVRKWKRGSTIFDEHLGRISLNMFYITVVKRLRLRFVKAGRNCHAFEELVFVGNPLDRETFCEK

SEQ ID NO: 979593 - protein, 155 aa, Homo sapiens
MRKKRREQKGREKKRQKRHEGPRDREELKKTRYETYGRRHRKGEKKEQQKEMQRRAEEQKQERKREERRRETQKRRRQDSTERDKEREKKERGKREKQKKIEEKTKRTEKKGEEQGAEDGQQERGQKKRTDRKRREEKKRRHRTKKASKRRSKRK

SEQ ID NO: 979594 - protein, 107 aa, Homo sapiens
MVGQKVVPKEKTGGLQHELVWGFPPTIKKKPRGRKTKQGGFLGAQTHPAERGAFLTRKRTKTGGDLQNTREGVSPNRRKALAKINQKYRRPARWWVIISSTQSRNSY

SEQ ID NO: 979595 - protein, 123 aa, Homo sapiens
LLASSALEYPDRRHAGGGLQAGMVPVLQRVEGVSNRVVRVLGCNPGSHDLFQGDRSNYIVGTGPRSNPSLTLEEPAIPEYISVFKAGSLTEFNTAIQEIGSDSTGTEIHSGGIRRYLCKSINK

SEQ ID NO: 979596 - protein, 146 aa, Homo sapiens
MGFDHRTVSYHGRRLDATPGDVRVIGASCASGSVAATGCTSVPERRSEDVVLVPRSRRGGPCELRLCLIHSNSPCPIRTQGECACMCVGPDGSPALAMLGRSPGQDDAHFFSDRGQALAKNPENGLTSAGTEFARCENGEDYRLEP

SEQ ID NO: 979597 - protein, 264 aa, Homo sapiens
EAERGLEAREGSERFRVQRTGDHVRGSSCSQTPSRAIPATLSGGARDGCSPARDYSNDPRGQRSSEPPPGGTQDHSYDRKFLMECRELTYVNQKDPPRGSAHHSGGHQPFPVNEPPLKASKEQPVANRPRKISGASAVKKSTQLAMEHFNTHQPSVVEGTYPRGALRGPFLEKEVPPARPYESDQYLGQAVDVGQDTPSLSPSIKGTCPLFFVNTQQIPLWASTDEGSCTPGSDPAGQPEPGQDGQTTFFECQSQPCVGAHHLR

SEQ ID NO: 979598 - protein, 135 aa, Homo sapiens
AKSIMSETRKHVIISSHAHRIVNHNSMYLLCALLVRSLSIVLTHTEYTMDLEMHRVAVLEPSPMIGCSEVQVVSGSIKQGVAMARLDVKITRRSLRSAPQVRPISRGLSPPQSNVGSLPGHLANHTGSYFLNILR

SEQ ID NO: 979599 - protein, 175 aa, Homo sapiens
ESIPQTSFLLQWRSRTGPVSTAGDPKQAREAEARATVAEDIVLSLWRPLAHASPESHLHLYRASCIKSPGCIHIKLKISLYILVTGISSFQCHYRESASTMSGLTENEKVLVGQSLLAPKISRMEVPVNWVLGRSKVSNEPRQGGIMVVTNSKLLGHPKRMNPRYKRPPLETTIP

SEQ ID NO: 979600 - protein, 89 aa, Homo sapiens
DRSPGLRRPGTDAQCQTLALTVLKSRSPSPRSLPPALSCPPPQPACLDHSELVPTQDGSQGPEGELNRLFQGIILFSGNSVGFIYGVRG

SEQ ID NO: 979601 - protein, 327 aa, Homo sapiens
MRDTGTHTHDNLDQRQSVLSQGTIDKGIARHSRDGQLTASTVTPIPLDFLDIGDSTHLYRSAIKLQDNRQAHNILGQTTEGQLKKRRTNPANRTNSNHGNTHITHDYTTNDATRENDSPHSETREHPPKRNRTTKPHMISTRRNECQTSTPNRVEQTAYGEHTTKRTTTLTRGNNLVTEPRPRTTYRSERDERKITGDPTTEEQETANPRLNEKRTTRQTSRVITTTRGRHYNTESKETHSTHSRHNTADNPSKKKMSHHALERKANRDEHKKELQRKYNYNEAKDTPDETNHNPSNHTGIISQNTTTGYTINIKTRHYHDCYARPT

SEQ ID NO: 979602 - protein, 252 aa, Homo sapiens
MAMIPLLTCKNDWITTLHETGLASSYFEPKSVLNEYLYAHRGTCVNLVKWKILIGAINSPTREATDVIQENHLHSIDSIRIALNSGSLGATANCAYIPLNIFLVAQGALRVTVPHVLAHQNYGETQVRKPHSAHTLTTETGIYALIAIRNYRRMRPHCALNSFKLATWNSFRSQLIVRVWIQPFWGYHEEASTRMYIARHRSRIGQDLRFQGRTRRSISLQHFPVVHGSPTRLKTYIDNEDYWQPRPLALNP

SEQ ID NO: 979603 - protein, 178 aa, Homo sapiens
MCRSGLGRSGIGNAIIFSTGIGVTRKALALSSVYKLLEYGSSTISIVICLHHNIAVCRTVNCLNSPKRRMREHLSYETCAEVSFTVTEDTSARTNHRKSRLALIVPIFACLRSLFGPTYLADTVKVAQQCPRVQRWFGKGPPRLAQLFTWPFEKTGYAWYEEYLVTGNPYPTKLWSHL

SEQ ID NO: 979604 - protein, 135 aa, Homo sapiens
RQWWSWQQNAQPLVAGLDKGKLDQEAAIRDLPLPEKLGSSCRRAPTLCSWPWAKGTQRLAWPVPCGNARSFLIPTMGVHALLFILAQSTLYKTLVPGCHTSSSPSLVYFLVPFLISWGRGGGGAQAKKRFTSVLG

SEQ ID NO: 979605 - protein, 83 aa, Homo sapiens
ANFRRPSGSSGLSIPVRTRGQCGCWFAISGAFPEDGYGVCGGMKDGSMPCLKAVVDLSGTLSPLKMQLCQAHGKLLKGSRVVL

SEQ ID NO: 979606 - protein, 174 aa, Homo sapiens
MRVARKDRGVAAGWLAVCAGRRRPGRPDKGPGGKVGKKPGLGRSRPEGSINDPGKRPEGGASPKEKLLCGGHTFCVNNLRGPREEKGRDKKQACGRADIQMKGTTSDVGTPRMGITPPRWQGDTPTSTRAHYQIVSEEDICAVLPKKSQKPTCLVWHTFVSQHRVAATTVHLWR

SEQ ID NO: 979607 - protein, 283 aa, Homo sapiens
GGDELGRRREPRTIPPGRHETIGDLLGASGWRSQGVIEEDDLDVFVHLLSGVNRASIRAMAELWLSAIFIFQTSWCWWWLQRVCGVMKTIFPFILQHTPAGCNQGCAYDQFLSHISMLRLWSLQLILVSTPALFGGQCTLLTSTHKRRKMLRLRAWGPLTLWDGDEAQVTSGTCGGPSSIRGGCPAVVAAATCLSYLLNTGYAVVLVDKGALPLPKKGNGWSANRKRFTLIEQPWIGQPKCGGGTTGRPRPGANTPKRSTGHIKKKPGEAKMRRGTRKHQARL

SEQ ID NO: 979608 - protein, 84 aa, Homo sapiens
TASVGATTVAVACAILDGMEESGSGTAGRHVVVTGEYTCTKGENAILAEATSFSKRDDLGPNVALCNQEAQTGFSISRQDLGSI

SEQ ID NO: 979609 - protein, 214 aa, Homo sapiens
RKYRPIRAWTISSRVPIALPGRIQGHFQMEQPRSEQLFYYQTNYLVVAAMMISIVGFLSPFNMILGGIVVVAGVTGLCGQPKIKTSFAGGRSATPDVVMVVMWASYFLISMFGGVMVFVLGITFPLLWMFIHASLRLRNLKNKWRIQLPRNQVEEDTDGHWSWDALEQPAHKASPDHLTYYFSKVKGINIIYLKLGLQQKLKLQFAFVKTYFPG

SEQ ID NO: 979610 - protein, 265 aa, Homo sapiens
LCPLQARARVSPPWFAESAGAGVGAMGGEGWGHAALGQASELVGTPPCYLAEAGGAATAAGRQISGRGRTKSRGAPRFSFGLSAQVAADSGPFGPLGNHLVWPGGPEPFPGGAHRQGPLWLVGPPPTPRLLFIIRDGRADQGPYNFGPPCAFLRGDIVPGRLVGDTRRRGTLSLSVGAPAPFWVGPKKPLRGTVSGNRRHLLSPREARAQGTDPSFIIKALERHIKGEPWNSRATPKGGGPPRPMWERSGAPDPDPGKCFGTGQF

SEQ ID NO: 979611 - protein, 117 aa, Homo sapiens
SDRRRGGAVPCGLEESCKMSLYPSLEDWKVRPTYFRLTLLFLQTLPIQQFCQKLLSYPSRWKSLSQMYPELSQYMGLSLQCKKKYVQMCAVVSGAPLQGLGSKTFQYKLYGAPVTGT

SEQ ID NO: 979612 - protein, 204 aa, Homo sapiens
FRILKPPERTSESVPRDESPTLSPAVFPKCRFLTSCRWKADVKGSGSYESRLQCSYEEQQITNNQRIKAAVPSIKFCCGPMEKSVVLNEPPRRPDGAAHADKYSLEPVAVELKSLLGKGCPVCEGLCRPRSGESCANPAVGLYILWRTSVSCGGQTGRAQDASGTRLKPSSQIEAFRASLQARDVYVMMLCTAHRATVHGRSHL

SEQ ID NO: 979613 - protein, 287 aa, Homo sapiens
EDADPPWREEGASAVIASGPPVRALGSTEQAGDPVYACDYETLTRPFSERPAAGPGLARVRRKKPLFAGCFGARLPTLAAWARLFNRRQIPCWWTARKAAVAEVGAFHPRGAGAPELTGGGKNFFGRQRGRPGGIPVTFPKGQDFEEPEGAGKSNTFRCTQDWGGWSPRTRRERGLTPVFQPGREKNRLASEAVHGFFLRRHVFCQETTRQENKQIVLPRSVPEENFEHHVGGGGPQVKGTGHDGSEDTCTRGVVFPKKRGKGVDIQGRHPGHGRSTPAVDQGIKGE

SEQ ID NO: 979614 - protein, 163 aa, Homo sapiens
MQPEEQLDTTPAEHGAIGGMRCGKHGIAQHNGGPWAVSTGAYNLPGTLRGTHPTKGRRPRLGSRVTSLPQGKPNMAGIAPGEPGWTQAPRWRAWIAERSEHAACGPKPRELDPWLPPSGDPSGGERYTPPTRRPTTKSPKGSERNSPGDRRNWLREQRAERPS

SEQ ID NO: 979615 - protein, 106 aa, Homo sapiens
MQAWPNATGQGMQRSLLPKVLARRIKRLGFGPILEHLGESQSALGRTQYMHGRGVTYNTTYKGQTTRAKEESHGRQIRQHPRDKGDKSLPHNSGTHTLRPHTAVTS

SEQ ID NO: 979616 - protein, 193 aa, Homo sapiens
TCSQNSQTLSKNVSQAIHKYNAYSNKPASVIAKYLHKIKQWQLQAKANWPGSQVTKHISCTHSIACSYFSQLGQHSRKLGTHSHSSQACNHASSSNHSLPCTRVYVAFGPICMKKEKIYVDIERKFKTPRQGLQQIGFPMPKYTRVHHEPGTLEVTILGTLHTGDWFTEPNYLYSLTTSLHDYSEHTTDRLPI

SEQ ID NO: 979617 - protein, 102 aa, Homo sapiens
MARLETPKAQDVPEKLGMVEVQRLCGWSEPRILWGSLPGHLQSGSAVWVLLGGVPSRWGLSGKWLFSPCAGYASRCFAFWGSLGHRFVYGGAPWNAGGGPEP

SEQ ID NO: 979618 - protein, 70 aa, Homo sapiens
DGSGAARRRQDGAVGSSRGSVGPGRGSGAPVPGCVGGRSPGLVDPFRAGGFVARVGAFPGGRERLVVAPG

SEQ ID NO: 979619 - protein, 94 aa, Homo sapiens
ESRAFARLAAVLGSLFSPDDRRCVLKAAPNSSLRRICSLKDFRCAAIFSGQRSFRASYLIGTRVHSVVFVMALIMVNKLGRIWAMMDSASGRGS

SEQ ID NO: 979620 - protein, 90 aa, Homo sapiens
PYMYSLACDTHVIDIVVQGSGLRSRLHSPPAMYTSRRGALKSVRTQKDIGFYQPDVIFSVTESCLPVFGLFLQILTYINLGEAIYLDPEG

SEQ ID NO: 979621 - protein, 76 aa, Homo sapiens
MPGGRHPEVRVSEIPSSLEPRSAVVRSNRYGQVTIRVKGRIRPVGTTHEKVGPGGRGRVQSAKKGPMSGRRRRARQ

SEQ ID NO: 979622 - protein, 364 aa, Homo sapiens
MKREHERREKKRETNQAKREDRNIRTEENKNEDKQNKPADSETQQARKPKIEQKERQGNKNRGEKGREKTKTEKKKRRKRNGRRDKEETKKEGERRKEQKREERKKNDEEAEAKEKRRRAKERDREKKGRKTEDTERKKTEERRERRKGKRGRTERRKEGEEERRGKKRKGKREGEGEGRKGKPGGQKGKGGKGGRKASEAKRREEDGNRGGTRARARKQMQGRGEREKKRSRRGRARRTDEKKDKEHATERAKKGKLGRNRRRIAARASERQEERRAGKRKTKRTRQEQREGRRRDKGRDEAGRAENTRNDRRRQKQRGGNTERTTQHQTTTVHTRSTQERERAAAPEPETGAPTDGAHADET

SEQ ID NO: 979623 - protein, 463 aa, Homo sapiens
MSTRSITCEVRGLQKATVPRHNGEQCVHGIVVADPAVIEGPDDNRMGNPFQTTANRRHCEVEAQKYVPHFKMRRVIRGEDTIRVTSKRRSSGSLLHVYAGPQPRVHDISSSLSFSFPSIVLSSSTRGKTNKPKTDQGRYDQLSRNKRHEALASVESGESKAALQQTEPTQHTAQQTQHQRDDHNELVDCSHQDYTEHTHNDRDKTGERTSKQEKEEESRRRRPEKETQLERERREREGRRHEKREEERTGEGKQQGRARGEKDETRRRETAEAKGGERETKTEGEDGEEERARTGERERPEREKETRTGRRYDTREREVGRGRKKRQEEKMVKEAKDVEEDEEKRVGERGRMGRGEEEMGERRSGGGEEEDRRENREERRARETDETTEKTQRTREHGDREKEAEKRGGESEEEDERDRRKREREREKERRKGRSEKRRTDEEERSGEGYKGEDKHGQSEGRR

SEQ ID NO: 979624 - protein, 728 aa, Homo sapiens
AYQVFYPVNRMLCQSTSLCVLRTAARVPRQSQMPLPGGTQAKQESTGEMEQERKEVDAEAREEWETQQRLTRRHMRRTRPNAPRQKMEDPGTTPYHGADKAHQGDTNRHEENTWHKREERNTQYTHYTQCTHSWKPGNHKRIGEEPDHETAQPADNTPLRTHSNKKGKQPTAVTSGRIGRGIPAQGLERLLPRNSGKVGVKITTFAQKQELNINVVDTQTISADSINYPHNEQCRQQWMHSVITYKNTSQKEQGIDYHGGTNRQQRLSSASTYIAIVRLAEPATVGAIHISVLMSNTDQSLQTWRPYLTSGGRSFIRQFQQCNVCPSIQCILLTKGKPKERATSPHSMVLADPITCAHTRIIIVTDTTLYMVAYALTEAQRVHTLVFSSYPLTYHSVFTHDNPEQNSTIRKSTYKQTNKTHNNQNHKQDNTQPDLNKHQYNTTIQNKQNNRTNNMNTTKEIHKHEHSTTERNQKRQEEKRHESTHTTEKQDGERERRRRRHERARRERKKEGDENERKREKSTQTNHRRTKKNKKQENSEEQERHDAKQRTTTSRTRQQKTKRRDKRDQREARTETAADKKEQSSKEKDRETGERTAQDDTPHERSHEDSKQASTGDARRRNQEAHEAEAKRQSADTRTNKPGRRRQEDGRQRQEQHASECRGQENEHADAQQKSSRKSKESATAPNDEDEQQSHTGPKTRSTEHRTKRRGARTDPHTNSGTHTSRST

SEQ ID NO: 979625 - protein, 178 aa, Homo sapiens
MAQIQLDLPRSRAQFCDRHLALPAYLKCVCDRRADYYYVDNGYDSQSVISGNLLYGITQRIGRTSPRTGMYYMKTPFMFCMHSSLHVVGRAATTIATRCVAPHGDTTAFRATQTRHHSVSTRLVRHDSQQSYHSANCLGHTTELVRHRSFGPTPGLAQQHWLSNGKRHYFYRIPPLTR

SEQ ID NO: 979626 - protein, 189 aa, Homo sapiens
DIFPDLFKRGGERLQYVFGYKLVELEPKSNTYIPQSTLTEEPVEEDAEDEAVTKARLLRDEASLNRIGLEGPQSVYGQGAKHPYCNGKVGKPMLDLSPGRDRLIRGSADSATEGSSLSVPEDPEEESITGGTFGGDKSFHLGKSPGAGLPPKYREHSRSELNGNFARSGGPRAETTKPGEKRKPKGIGT

SEQ ID NO: 979627 - protein, 96 aa, Homo sapiens
MVTGNIDVTGVASGQAFGSVNLANWCVLGDKPTSSFLSGAHSLLKNHYLVTLWPHKSFARVTGVRVAPNYSGGVDPPHCRVTSAPQYCGGTIDEGR

SEQ ID NO: 979628 - protein, 97 aa, Homo sapiens
FRGHIRTHTVGKRLFLALSCQQSICNDRVKSDGLILQTHSDVREHYQCKELSPKPSPECLSCTKHGGIWAAVYHTCSDAIECLTRNRYALLRLRKPN

SEQ ID NO: 979629 - protein, 171 aa, Homo sapiens
MAACIAAGHWAAMGLGRSFQAARTLSPRRLYLPAGVHRGACPGSKSTGPSRARVRPNPARRKTGHPWTSTAPWNPGNARSLEVLKFISSKGERTRILLKFSQYDTAHRICLEQGEKYSNISRSSMLWKFFCRVLTNRLDLLCPVEKIKPVFLGILHSGDQERRTVGLLSIL

SEQ ID NO: 979630 - protein, 743 aa, Homo sapiens
MTARDARRAAQSSTRGPAGTERTTRRARARARQRTARADERTTGGRRRQREKMRRDDKRKKREKTRRRREEEKKREGEGGEKRRKGEREQEAKQGSREEKRSERRGKRNEYERRAEYERPESRAESKRRDRNRKEEEENRSQKAEAEAAHSRGVINERIETHHRKVEQRMREAKKRKRGEESAKRRDGANGQRSAETHRGGRGKKVERGERVGTEREEEERETGAEKKQQVSKRGERQNGRVSDDARRSGEREAAAAGTRRRSDGLAQAEGRETRGRESEEARKRGGKARDRRAVSRERGGGSEQAGGRPDEAEGGEEEGERVRGRSTQRRRRQGRDRRRSKHVDKYRKEAGGEYDGTTYSKMERASAERKAWHVKRKEREGGGGERASRERRAAALKRGRQKTRGGRVGRRGGGSERDENAERRERREQRAKRAEQKAADREVCRTRASRRSERSERRRTGSRMNAPSVTPRQTCSVHAMKARAATEWQIRMRDRSTGEDEWKGGRAARAARRARYPLEHDRVRAVNGAGGDERWTRERGGAKTWADVREEAKRMKRTQSASKFRVSASRGARGSRSAAARGGVRVDERIGEARDARGCQRGAEAASETSRSIDELHRQREYAEAAVRVRLVTLQEIDREGLKKRESVVRAERARQTELCDELHSMHAAEGRQQMRVEGRGLMRRLAVARDREASTYRCDRDRHDATSETERQSECSGDESEQTSDEESRDGVAAPRQRSVQ

SEQ ID NO: 979631 - protein, 114 aa, Homo sapiens
MGGPARASGSERYSLKWWRNVHPTESSLAIGDEGLPFISCFILLFFEKFNESLRLTPTEEVRHWEPPPSAMVPAKGTTMTVCNVACSEDEVSQMGLGEESGPYQVISLISTCIT

SEQ ID NO: 979632 - protein, 209 aa, Homo sapiens
MGYTDKETWGTNTNNVRIAHRATPEDKKTQRRTDVHTGEPPQVGSEDTPAEWKPEGEPGKTHRENKRRDAGAPSVSPALEKRRDRHPVTPGPDKLGERYIKSTDGSKKSQSLTRKGVLPSNTVSTEGMSPNNADTKEELNNYTPVTKNTGGATGMHNTDTAGDTGPWKRRSDLEDKCGRETALFSPRDVKTVLTRGGEERHNALVPRSA

SEQ ID NO: 979633 - protein, 483 aa, Homo sapiens
MNVGYKNNFLVVFDLTVNLEIAIIKRLTIINTTQVWLIRFGTGSTKLWDNQVRTSSAQQQQVNCILDTLIDNGPNGSLKNSHLLLHITTHSAQFSPKSMGKANFSRHTGTTHYDASTHNAHSSHFSATIGASTKALNNSVTPHKEQQTSLSNHKAYRDIIDSGTMLLCRYGYHMSWVAATYRSPLTHQRCRFHTHTVFITHINKSHVWAGGTQHFISPSTPHCAGGAHPEQQAGRHNHNFSKRAPNTTWDDTHSSTTRDQHRAFKNSTSGAQESKDNLLQWSAKRDRISECVNNINLDTTTLQQTTVRYTPQRGTRAENYTMAARCDRTYLASSLDRGTLTTPTSDYLLPLRVTALLSSLLLLCNNFHKPPTAQADSTDPAPPRDEANEQGREREVGDRRYEQGSTPAQTRGKQSTESTNTQRENSDKRSRTRREEGSENEKSKAAVRADTREAKRSRKRRRNNDTTTGQHPRPNTPAQTQRE

SEQ ID NO: 979634 - protein, 191 aa, Homo sapiens
GYCEYGGVKGEARHASAGGLWAHRYKRNLPVEGLSGYSMLGPEGLNPDLTGTWSIMKWNRETQAPYKSRTSRLAIGLFATVRGRNRPEDLARCFGKKPGGREGINRLKWTVAPDVQGVGGALCVPTKSGRGVAPPLGFRGGSLRGWCTRKRRSPLVASPRVGLWVQLWALWPFACQSVIHVPLPRIANGLM

SEQ ID NO: 979635 - protein, 220 aa, Homo sapiens
MGQCGSLCGVVLGPRGRGAPGARAPGSGCCRGPVKSPERDTLRGEGGLWVAERFGPFPGGRKWLVRLAQDVGNIGAQTRGGCEELGPGWLIGFRLVDVAVDFEWFDPPQGYRVALNGWPPSFRVDPTPEDNRGGGSPGRKYNAGCALVAQAGCDLVTIPGKRWGGVCNPGRHGSHQERWDWERGGRVQEKGPTEDSMRANLHAGGDSLVRIFPKDLYPKE

SEQ ID NO: 979636 - protein, 30 aa, Homo sapiens
MRGSTTPQLERPSELLNVRNTMREHTRGYR

SEQ ID NO: 979637 - protein, 141 aa, Homo sapiens
MVSVRKGLRNLEVSLSLRIWAHQGKPLAEKCAPLVLTICHRGFVSQEGWDSKVLSARNVVKNKLCVTQEEVTQERLTSPLCEGLKKARQSNLKKELCQGIKYGAHKVRDNSQNILRLKLVNSARCDRSLLDPSKKELGVRE

SEQ ID NO: 979638 - protein, 117 aa, Homo sapiens
MPIGRNMGVTPGKGSQKTPAGPHVRFIPGGFTLTLPFSNDNKSFSERGLRNAVVFAHLLHPGGTGDGGAILQVRPILNAVLCQENWIRKTLGVGYKPDGIRGHQHGEKSPALQLDPT

SEQ ID NO: 979639 - protein, 139 aa, Homo sapiens
MVIRLCAYGDPGGMSTLVVARPNRKRLGGNRIVLNQYREMELWRLMEGQSSLDSESIAELRYKNKALAMHCQRGFAGLCSNWVRLGGGMEIDLKFEIKIWIGEILDCYRSNIPKFLIEANIASPIPVVARNPVPFRLEP

SEQ ID NO: 979640 - protein, 105 aa, Homo sapiens
MPRGSAAGLPAAAAGLEGGTKRALGAGTSARLLAGKPGGISAPKMGEPADRRAKQDELGMGEHGQWHRRMERKHSGQGGKLRSHTNSVGMTRQRTTPGRTPKHCW

SEQ ID NO: 979641 - protein, 188 aa, Homo sapiens
MVEFDSVQSAQRAKASLNGADIYSWLFAALKIEYAKPYSFDCVHRMIRILWDYTNPKSQWTKGDPGSKPPRKCQRKGPLLPWEESPRAGIWEGPQTVWVTTKPFTNDEGLRGPPHKIQYRKGDEAMLVHPVGGVQPVRGAQCRLKGHARLWGNPRTHISAHKPGDMSTPVGQALWKWSNGIQINSKGL

SEQ ID NO: 979642 - protein, 306 aa, Homo sapiens
SRESATVGCCWARGAGGAAGTRVPACPVSPACLKPLACCTPGWSGGNWAATRVALGPREHLLVRPGEGLRDRLGEKPPGGDPENGRGKPSWCGIKENAGSGAGNQRGGSLARRAWGGRMGWERDPLKVGSAQRRLGKKRARKVCWASLKRVEPGAAVPHRWLATSGGRPRGRAPQRRAESQSVERARKGGRRKVTTRQAPRATTIHQAGQVPRSGDTTMLRCGPTAWQRGTDENGQARRNEERTFPVNTSGGRESPAARDVQRRGDRRYQKRHIGGGGQKRPERGGTTTERAREQRRGDAPSRGRL

SEQ ID NO: 979643 - protein, 292 aa, Homo sapiens
LSRAAPVERSGAEIAPSSPPAGSALSGPLPLLALARRDLAAMQPPGLRPPMQSRAVPGDDGRLGETSRKVALPKGGRQRGVAGARGKGGPGGFPGPLSKNLGARAGGSPIGGAQRNGPAKDPGETFELAFRADRPEICRKPKHKGATKFGHMTAGRCGRGRRHPTPKNARDHDVGPQERIPLRRGRPAYRRGRLSHTNGVHTGGVCTPQHRGKQYTDRGVWEEQSSPPPAGAPPRRWPRHVWENPGPDRTPGDYYDSRCPGLRNHNFTKRPARTRESPVNRPGNPIRGPSPR

SEQ ID NO: 979644 - protein, 103 aa, Homo sapiens
MRTGPEGTTKFRTLFPSQDKKLGEWCVPVKKQGPWTGGHKRFSKKGPRFPPRSWCADHNFLRQFGVGWTWVNANRFAPVVRNPQSGCSGRKKLRKREIFNPGK

SEQ ID NO: 979645 - protein, 237 aa, Homo sapiens
MRAATPMEDSMDMDIVPPEAPEHIFSDCELKADKLIITLRLDNDENEHQLVLRTVSLGAVQRMRGTCGSLRHMTLTKAGPIKVALATFENVCTANGYPSAGGLGNNTTSGLKVEVWFRASAYEVDSTLVAVEEDAEQKIDEEEDVKLLKYIWKKRSAPWEGGSKGSTEKKYNFVLMKMMTDDDEEDDDEDDDDDDFDDEEVEEKGAVKKFKKKSSKNGKVNSEWKVKPFNQIKENLE

SEQ ID NO: 979646 - protein, 119 aa, Homo sapiens
MANPTVFFDIAVDGSSLVGVSFELSVDTVPLKTAEHFLCSEHLVETRIGYKGSCLAQQLIPGLMCQGGDFTALICALVHMSIYAENFDDENFNPKDIGFLAIVSSGNMWTKKGGSEFII

SEQ ID NO: 979647 - protein, 297 aa, Homo sapiens
LRRAERCLLHFALQLLQCQPDRSVPKRFRSSGAVGGPPQGNHQIPLFPRPPMETTDKTCPASNVYPPINMLDLVDKTVGQDDISNQRDWAFPGGSEHLAVRHPNQSCASGRGTIFSKPSRVPFIKLTRHHLVTNVSPWGTLGEEPQNLPQVAWSSYGRPGLFPQRHHTLPPRGINHLLGTPRHFGNLEGPRIGSKGFGQRGHLVNTLPFLQPKTTRENETLVVKSPRSFLYKEGQCINPAVVTVTFRFVVDLQIHMGQTGHGNNEGAGYAGTKMTFDQCQIKSDRDNLAGRYRTGDS

SEQ ID NO: 979648 - protein, 262 aa, Homo sapiens
MCGADGRRGIVGSRSTPRPTDPETDSVCLPGTQYVAFASLDSSAQEWGSGVALVGSSRRPKCMQSLRGDVVRQQTVFVHVQSRTGPNKRNAMKQGLRGERWIEGLKQDFEETLTVGRVSDLWWHGTPMFTAGYRTFDLDHGPSGAIRAGPRREIDCGPESRVGTSVSNRSNRIPRETFHLSSMRCPKGPVIGAVLWGLHLGRRWWTVGHRPVIRVLCPGMLCFQGEVRVDRGLGCRCRNTGGLAEAIGKQGRGKRAWVHGRK

SEQ ID NO: 979649 - protein, 78 aa, Homo sapiens
MISLESLLESAFIQRSPHLNFDTDSEKAVSDSCKKPYSAVPPFVQVSFDLWASDSETWCQRSLVRGEGLHTPGRSHPG

SEQ ID NO: 979650 - protein, 68 aa, Homo sapiens
VRRRPYWRLALVAARRDNIVFPICPGCRHPRRARMSGCVNSQFEDDPFFSESILALSRKYAEDDKKFC

SEQ ID NO: 979651 - protein, 152 aa, Homo sapiens
MWEDSGLADDGDDDPVPLPNVIAALLKKWSSVVHPPKDDPPPPEDDENKEKRTDEYPLLWDQDFLKFDQGTTFCELIPGCKLLRHQEVWLMVLQDLLQYDQGENTPEEIRKTFNIKNDLPEEEEAMYAKETSVVAEQLQCVPEHCTLFAVQY

SEQ ID NO: 979652 - protein, 75 aa, Homo sapiens
WSKVCRVAWCDFDKIKAAGKWTVRFREMEGFGLIDDAWEKTSAYEDVSNTTEWSFLNPEQDNGGTQESVKEHDMT

SEQ ID NO: 979653 - protein, 191 aa, Homo sapiens
TRRLGGPMGIPRRLSLRKGGPGALGPSRRGRARGPDSEEAEFVVEPCPGTKTPSRTAALRQGLRAPGGRPGHSGAPFVAPRVPRGGHTRWRGIRPPSGVARLAPVLGAATLTLFPQRVVVFFSERPFWHLPSLFSRKPLGWLRGPYLPLVLPRHVKPAGQTVFHGKRDQVVAGEDFLSKPQDLCQLSLECS

SEQ ID NO: 979654 - protein, 263 aa, Homo sapiens
GPPRLSAMWLQTGRGSRPCIKALNHSALLTAAVKAEMSLWRLPWDLLSLVQGSGQVSGRGVLGAIMDRVPPVKPGSRHGPGSGHGTNSCPGPLRALDRFLPLTCSVRDQFPLVYFLPSDGVPGCGRGPFGAAKVRNGPRAGPVPSALLGLGVLGLQGPWDLVSQISLWGCPQADWTSLECGAGATMRKVVSGLPEAQDQAQCPQETTWLTDFPGLSVCPFREQAGPPPGPLEICQRVLDTHGLVMGGPVCYNPGLTPRGIATV

SEQ ID NO: 979655 - protein, 132 aa, Homo sapiens
MDYPLFWAVYSWQMKASTVLPCRSAGTVFYKSIFSPKAHRRQNKRNPPLVVGACAPKEAQHPLWCAGPSRDVTGTLAVPRDLARKAWPPKQRRARAREPTGEVLAPRRITPRQRAAGERREKNTEQQEAETL

SEQ ID NO: 979656 - protein, 150 aa, Homo sapiens
MVQLLYTYEYEICLGEGSAYNSVLWDISPMMGVLDGSKMEVQDCALTLPEKMSSQQTIERRSPSKLDVAQFLLVLHARAGNRMERNRFTESKCENLQIPGAALDKYAKKSVKVIVWVIQPIPMPDCSKSAPSIPKENFSVLDLVGDPQPS

SEQ ID NO: 979657 - protein, 270 aa, Homo sapiens
ASWDDACGTEDEIYEVSVLMTCMYQRAPLSPVDVSQFSGSVQDPGLHVWGRERKFEIGCLWSLDGPLSSRLLQGDVLLYCCSTLEEVSHLHLWIGQQSSRDEQGACAVLVVHLNTLLEERPVQHLGGCMGNESDPLHELTFPGGLQVTRKVVWKSRISPKTSNREPPVAIKENSTKVTRGKKNHSGATEGHLTLGTASNHGGLFHSVTLGQEHLRPGCVWNGPNILGTDTGGGNWPGPSGNSERKGQAHVGIVTAWGGPCGMTTSGPSLG

SEQ ID NO: 979658 - protein, 256 aa, Homo sapiens
DNTANTRPRRQGLWDRRRQLPRAQTKHGRRDATMEKLRAQCLSRVPSGIQALPGFSANYDGDGSRSLTLMSSGRSAQNSGCADQAEAEGCVQEVGPQWQRDAELWRSPCGRWGPPCPRPGGVIAAGFVPADPQWGRRRAGWTTSRGVYRWLCPPQVCRMWDVTRDLKVGGAVSLTTFDFLLEEDGARVTTGRNFRGLTYPGVSASMNPGCGVVPMIDHVPGSCEQSGQPCACAVSPPWGSLLLALLSVGTPQLGRG

SEQ ID NO: 979659 - protein, 176 aa, Homo sapiens
ELGACPRGAPSRGRPSSRTTLSVAERRKSSQAEARGGELLRNGVARQRGQPFRMPDELCGGNGAAVTIEGGGRCAVSGRRSGSCGAGAGAVRGRRSHASSTGGGHATKLLERVASSGDRLVEGLPVNDGDTVVGIEGVEARRQKKTCCDTLSRLTHAVIHSAYSRVCPVGDQHSGK

SEQ ID NO: 979660 - protein, 132 aa, Homo sapiens
MGPSIKGAITLFTTGVYLAGRTLVTFRVYFQENALGVKGLTLIGFSRNGPWRVNRFSRGRGPTVGAGKRHSVLPSHQEFGCTACDSLEDVFSTRDFLKKIDLAELVYNTGTQEVKEKRVEDVPMEFPLHKVR

SEQ ID NO: 979661 - protein, 93 aa, Homo sapiens
NCAMPYCIQVMKGVLDEGGETQMLQKSLRKEEEPSYRDTTAWSYGQPKMDADREDPGVAVSSSQAALVGMVIPSPPVMDGHSLAWGTACEMKR

SEQ ID NO: 979662 - protein, 102 aa, Homo sapiens
MLFQLQDGCHIPTAGRGSWGAGHTVSTRLNESATGNPPPPGGGPGRACQCHWQHSTGPPRHFQIGSPLLGGSRPILLCLLGQTRGGHTWAHHEAPLAFGRLS

SEQ ID NO: 979663 - protein, 105 aa, Homo sapiens
MRGRGEYSRHSIKTTPAGENTRGMLKQTHQQRSLRRANRGGPTSQAEECHKRRRDNYRRIESPEAGGDKTSSQIETEKEREKKATSNNRRKSNRHTQSRQDSKKR

SEQ ID NO: 979664 - protein, 74 aa, Homo sapiens
SPVSPRRQQAAGGVNAEGAEEPGAEVQELRKTVFDTRWVITQRPQNLKLNAYGDPPRKFPSEDRCEATPAKRVG

SEQ ID NO: 979665 - protein, 137 aa, Homo sapiens
LSPGVLVEVTSSLNPAWKSLTHRGDAQEDRATWKSKYLPSDHPIIWMILRKCVIRGSRQLWAPIASMQCMIPVVSRSASEGTVVLSGQVTTSDAHRAIRRARVGKRKPSLLEETGAHRLSQGEMLGFVVRPREVTLT

SEQ ID NO: 979666 - protein, 111 aa, Homo sapiens
MRVKAAVDQNMSCPCRVKASMGAFLPNQDANNRALAKQTRKNELSSPKKPSAVYHQYGGQLDAGEQRLNDMEGLPGQPVDLLWTHYLCISSIRWDHLPPLRVPKDLEPVLQ

SEQ ID NO: 979667 - protein, 106 aa, Homo sapiens
MMGIICGSTLFIGREEGKPRVVERKFYKTRGSGGQIPVGTGNGRVGLTELFFTKDGLYLDKKGYTPFVKITISLNLCQRRGQKGWTIMDVIRPVKELLTLSVVTET

SEQ ID NO: 979668 - protein, 103 aa, Homo sapiens
REEKEKRKKKERNEKRENTKRDNHQTKTTKERKQARTAAERTERKLGAKNGTQKTDKSKGEKKSKTGTRTRQREGEESSENREQDSRNKRRKETERKAQERRK

SEQ ID NO: 979669 - protein, 186 aa, Homo sapiens
MWSQATSQQPCPRDLQWYDLVTTYSCVGVSSEGKVEIMANDQGNRTTPSYVAFTDTERLIGDAAKESKLQMNPTNTVFRMPNVCCGRRLDDAVVQSDMKHVALYGGEDAGRPKVQRKNTRGETKSFYPEEVSPDGSDQQMKEIAKLPLGKTVPMLWSQVPAYFNDSQRQATKDAELNGWSQCTYRY

SEQ ID NO: 979670 - protein, 241 aa, Homo sapiens
TSADRALGAGLYGAPARVVFWLLLLLTVPARGSSCALYFSAVQRYPGQRRSKGHHIIVKHSFNPRHRILWTGKGQACENCFTWPFRGTPNFAWPVNSLHSSAAVGGPLHPSALGPLRPKKKPCMAGGALSPSHRLNPEPSEAVQRGASCCARPGDTPSKRCIRVCRVGDNGRAILEMGSGQGSPTIMPNDYVFRLNGRCDQEASERDVGHQDFLLWFTVNPDEELPSFSKWNVGSPPGKGT

SEQ ID NO: 979671 - protein, 145 aa, Homo sapiens
EKVAQTVCPESRGAEEEAIAWPRSLDLVLARERKQRQQRTVLLMDKQNSQMNASHPETNLPVVYPPQYPPTGIPRDLQDIRGLPWGPRSCYPPPTARHSGPCPSCFPVPNQPVYNQPVYNQPVVELQGSPWYASAKASIKLSTWD

SEQ ID NO: 979672 - protein, 39 aa, Homo sapiens
ATNISLYIQNITCGFEAALILALVDVVDYFCMSPSMDEG

SEQ ID NO: 979673 - protein, 183 aa, Homo sapiens
MVPPCRHHPWGLNYPKIGKIDGRLSRSKIVSPVGHENQRMPIGPQLTGEVSLFASLDGKKKEKLISIALATTLGQTISSMHQFCWRRRPSHVTGSAFPWRLRDAPGLTGPALTLYLAPRQCPYNYKAGVSTVLLPSKASLFPRARASPCESAEFPFVSWGVCTIARILSVTRQVSRADLYTLC

SEQ ID NO: 979674 - protein, 84 aa, Homo sapiens
STEGSCGRYTSDRVDDQYPQEPKVRKAKTHLITCRLGHVDSGKSTKYGHLIYKCGGSTKEHGEIEKEAAEMGKGPSRYAVRSLD

SEQ ID NO: 979675 - protein, 301 aa, Homo sapiens
REAVDISECGFVFFKPGNMCSVQAVKDKYISRVVPIKYQDYLKKKNKKGQKNTQEPKKNWCGRARGPRKASQNTMVGARGPPRSRQPAGTGGAPRRTGTKQRARDLTTIIKSRRKPPQYRENKIQQSYYREHTKGDTNQEEEATDESHDNKKLGPQTVGIPHNTTPHTTRQTEATSNKEQSRKKNKEATKSKEKTQGQNRISETRKEDSSASRNRRVQEKNANEKQDSKQSREQRKNEDKANERSADENKREATGREPRKEVVRDRRYHSSKRRGDNEKRHREQKQEDEERRAQRANRTHR

SEQ ID NO: 979676 - protein, 334 aa, Homo sapiens
TRALAGAPNPAMERRRCAPVFGAVGWCSCPAPLLFLLFGHLRPRESRLLPALPPLGCLLGRDPANACGCCPNVAPAERAKPVRGIGRTPAGGYLAPGIGSGGRARKKAARGKKPGADKPAGTGDVSRACTSCCKKKAGNPRCWRQDEGDPTFNPRRWFAQVVAQTDKNQKGAEEAAGKEGPINHMCPARGNLRSKGLPNKVDAPKRTFGKLATGCPGVLDPGGLEIPNTVFNREPGQQGPLLGPQEGNPACDRTPCQQTGWPESKHRGAEPPKKQTGLSAAQTRRQRPQIGGPSNRTGGAHTILGRQQTSGTVHHHSCDTTRIEDNKHERGHKR

SEQ ID NO: 979677 - protein, 100 aa, Homo sapiens
MAREIKKENVHNRAKHIVESKTDDNHTRTTEEQDQGTSIPHPLTSLANKQAQRLQWLTNERNMTTTSVHPYHTQKETHKVTQETQGSNREQETRTKNQAR

SEQ ID NO: 979678 - protein, 87 aa, Homo sapiens
MVQQSEAEQLMPDPETYTTHISTRILALTHLQHQPKATDGQGKMAPNRRTISHTEPPWIRPQHQHSDRIGTPGQRQRHDTTQNYKGR

SEQ ID NO: 979679 - protein, 79 aa, Homo sapiens
GPSDGHETRTSFQEQREEDRSIQQDCSKPTLEHCCYHAQEKGTQGDARGDKAQVHRMSHRGDQLGVSVKTSSSKTRAQA

SEQ ID NO: 979680 - protein, 481 aa, Homo sapiens
SDQTVSLSYRGVIDITMCQEAPSSPVIVYHQIYFNIGEHSGCSKIYTQVFSEFTVYKRYPCKPSIDPHPVAQSVPLVHNRGYTLELTVGNPPEVPQSAVHGDPIVGPQQKNATETTTSHPLHTRDSRLQTTTEHAEKKSMPGARCDSATHTEPTPVGATEQLVHNQPTGPPWRPPVLVPKNMWRPRNTTQISPHKYADTPRLTTPPRPNHHTAATYTTRGTIQQEADTQPPKGADRPNRRGGNDAAAPSALPSARWALVGPRGDTKNRHKLKHLCYNSEQILPRNNRNPKRHNTLPATAVNISVLRQHRDPRDGQAQIAQLNNHNHGRTTYSRDQTHTNQQDYHEQTNHSLWETSHSSTRMVDHHRSGQTNKHKTQRQVRPGATPPRATEDNQREPLLATPECGGSTHTRLRGSISTQEPLKPHPASPDGAPLRDTQGGNAQRTRTGKQPPQWQRPQQPATLVAVDWPANTTAEENHTTHH

SEQ ID NO: 979681 - protein, 488 aa, Homo sapiens
MQIESWMHDPWLASWLTTGHLWPRQTGKDGDPGARSSWQGTADEQPADKDSDQTKAFEHSSTDPPGRYQEYSYTKPEQHKPRHGISAAGTHRRHNTELGRNTTILAGDRDSTRDNSATHPRGGTREPEQAEQDTTHNPTPEGERQHRENNEAHNESHKQATSRTGSESSQERKTTQGQNAPRRDNRPTGSTLRDQLLNREAATLNTRQQKETQPPRRGGKPTPKRLGRHESTAGTKAATTQRDHHTGSTPQGKQQRQTHDRTRENTTNRHRREINPRSDNTLHKAEYQPRDQTTPLLCGSQESNLSTPHREQVTQATNTRATMRTSYTERTPTTSRNEDKTTNTYEQRQVNTLERPSNSIDEQRGTPKLNVAQQHSEENGHTAADNTNTEHTEPNNRTEARATNHTTTSLIDNTGCHDHRKTTAEIPQEWTTHHGRDHDHKPTREAKGAKKYGYSNTPRAHTARGTRQPMSNKSQDARNNHRTDSNQQ

SEQ ID NO: 979682 - protein, 175 aa, Homo sapiens
NETRTGPTDSNLDMSGSVLFTPETGVMLLTPVESSLYWALINLLSERIRYTYEELFPSVTCGDDNAREPENAVDKLFSSEKHGVLLAWLFDLNRQSTIELESYRLLRVRRSFSIRRAQKKTSGAHCQEFRRRVMTCALVHNVFRRSLVQRSVNSILCPTRLPGCLQPCHASNTVP

SEQ ID NO: 979683 - protein, 319 aa, Homo sapiens
GAGGGTLGKMAASRVGTYRNAGNSRNQKCTGLRGKPGPGSVKSTRDGEYQSHYVKMGHYTSRGNTTSIPWQMASFSTTAKSGDEEPSAMHARLTTQTQPHKGQQATRITATRRVSKPENDGRHTSRSNRTKQRGKQGCIILPHGQEHKSTVMPQYRHQCHGNRAVMVAPTWTVGKTQGEPTGKNRFTPTGFDEELAERWGYHMAVQDLSQVLYPTNTGGGNMANCNPRAECHVARQGKELPRHVLDSPQRIPRARIQSDRWRNVELMGHPTQNSYIGRLHHRRVETTNTGGTERQRHTDRESRSEDVVPTRTPAKRTDR

SEQ ID NO: 979684 - protein, 298 aa, Homo sapiens
VEAEWLPTSRRHSKPPILLGQEMDAAVGERDVPLTLKQRQPTKNDVQSERSGPPAATRAGWGSWHSPGLGQVGEGTPRAHFLPSLPAVEFQTCPYPHPEPPKPVVLSQKNCYSPSTKFPSFPSLSLQIRGSTNANPKNKVQNTAQLPSRKVLVSGVKGCLPPSIFAPRHLSRLVINRTAGLNKPPGMIGKGGPSPCEEGELFSSPVTKPRCAGFYPGQMAVLTANPVKQVSRRLKRWYNQVHLKRPAKRKGENRSTKVGQRKSSRYAMAENYVTPTGANPGGPLSPSTFHIYTRKNEK

SEQ ID NO: 979685 - protein, 108 aa, Homo sapiens
MVRRSMDQDETLLRLDESPHSNRWLLLSCDDEIFAHVNVATMWMGFDSLMRLARHPGMNGIRTQLSDRKSCPQHGVGPHQIKIIALDSGICGKLTVGMNKNIDRLDMG

SEQ ID NO: 979686 - protein, 142 aa, Homo sapiens
MAGWDPVHCILKTGGPSMALICCQYMRGSGPLCSPAPPHFHFGQTNLHPLNFSAKFPAWQGPMHFEGDDGILVCFESKRQFAYSCAAMQELRGKVTPEGRQPSVVAVGVQLCLIPDISGPQAQVTLWLFPNLWGNPCTQELN

SEQ ID NO: 979687 - protein, 262 aa, Homo sapiens
MASEELQKDLEEVQGVLEKGYYGKGVRDALTAEKSKIETDTQDQDAQKLTEDSRNFLIYENPAACGVLPGTTGLYGETSVTYGWDQSDNVCENLHYLTEVLKFPPEKCAGAFHGGRSLILLVKNSKWEELLHDCDNLLKPISVEGSHNTVRTDDRAYIVAERTSGNPKVDYLTQLKGLQEQRGASYEWTGSQGGWSMSNGTFAHATRLEAALQSRGATEAARGRMRHSVADRGGHTGTGSAVKETETSRRPGGKVTAGAREG

SEQ ID NO: 979688 - protein, 302 aa, Homo sapiens
EGFLIRCLLIFFSCWLLCTNVPFAHPLCMLSASPAMCNCDWSKRKSPVFSRITQILVALYLSLPLHTASVFLSAEVQPVLSGKERATRERKVIVSVRVAINDTLLVLCAVSLSICLLEEISKMSLGNIYLEGPRALRVSRDCHRCPRDTALHLSGLLPPVIRSFLGTRASMPLIMTAPHVSDPGDCRISWEMLDSIIGRRVLVWDVVTFPLSGKIGPTLKSYRHYQPVNGSALVGRFLFERRDVKSYDLPEDAQDTEVVANLSWGTNAFTVSEFVVNTWSMLCGTHTRGGVQRVAGHITHAP

SEQ ID NO: 979689 - protein, 227 aa, Homo sapiens
GRSRRRRAEVKLLLMGAGESGKSTIVKQMTIIHEDGYSEEECRQIPERWSTARTIQSIMGHGRKPMGKPCRSTWPSPYTERTGRTGPAIRTHGHCNRPEGSKGTCNTLDAPCHGRSQSRRGLIGDLTQMGGGNEHMALKGPDSHRGSTPKLNRRQSGLKYLERTQGGSTRAPSSVQKRPTQNREQNWSKRENRPVERPTEDNRGRTTSHPYQENPNSNNGKAGNGDW

SEQ ID NO: 979690 - protein, 74 aa, Homo sapiens
SFLHHRYVAEACKRGERAAIAVSLEIVGMNTCLDARAIKRGAEWMRGDLDIFADGVLRANYWNLINQVVQVWQR

SEQ ID NO: 979691 - protein, 134 aa, Homo sapiens
GELMSISVHAQQLKVSQSLFGISNSPEMTDCDSGYITGCSGLLKYVLQIAASWIRSRQNVQSATRRLRASGPERPGQEICQIMLWPHCDVFVSGRQCRTTIENSVDGPGVQRDDIIQLGERHCNLYCAIGMVFS

SEQ ID NO: 979692 - protein, 241 aa, Homo sapiens
ALNQRLVKPGKSALYGCFNEVMMTFYDSDDQLRAESASGTQVSAHGSTLLLPWPVEAISYILSKKRMGAARDSIPEDTVTFRQIHRVNVPELTLMPPSSPKWTRPGAAFLKRIPGWLDLAIFFLVGRKLMDEKASRDMEAQPAGSRPRWHPGVCYLAFLSARGPPSSPREAMGKPAEAWSWAGSGPDVPTTRDFGPGTTFSKGPWRFKEGLGLKEMCWVCCQPGSAQPKGFCPHAGAQRLC

SEQ ID NO: 979693 - protein, 139 aa, Homo sapiens
MTPGDLPGDDLRGRGILARLRMPCSRGEPSPCLTKLWVTCDGRPTKDGWGPQYPGPDKWKKSLNPVMAGVTRWRPFWKTREKRHCYTRHPPYIGVQWVQGHNFTSSKGGSSLRTGDVLGLVQQYPPQGEEEAGGGATDI

SEQ ID NO: 979694 - protein, 100 aa, Homo sapiens
GVEVSGLYRLAVRPGVGLQVLLCCSLPCKGVELLLSSARAYRGGHLTIRLALGGCTKSGRSTACVVAHNKCPREWAGFVEQLGPMIHGPNSHGEKTRWPS

SEQ ID NO: 979695 - protein, 94 aa, Homo sapiens
ISALARCSACKCLAESCEGPKGCCSSFDLDRVGQVCLREYHLVDCHVLFALNVVPSVSPEGTEIIFNAVVVQKSKDPVKPGGHVTYQIRQEHTD

SEQ ID NO: 979696 - protein, 116 aa, Homo sapiens
MPKATKRTDNTILQQETFKHIGWAYLRAIVAPVRCDVHFQTPGGEAIESHDVWHALHLAAFRNGHPLVISQCLDVRQENENPCPLLRHKHRFDSPGALVRKSALTRGSGESLQRAK

SEQ ID NO: 979697 - protein, 78 aa, Homo sapiens
ILMRPPDEQRLCKDDQLYGLMARPSGRVWFTSQTEGTGPLSTEMGAAVPGKYDTCVSALCVRRPFFPPPRQEACPDGD

SEQ ID NO: 979698 - protein, 141 aa, Homo sapiens
MPCKRTNIRVLHGASRERVKGDLKHILDAHNGPYAIDAAPSSSNVFHSRIYETEQWDYQNPLRVLTVKFKLVMHVGTCTRCESRPDTRGDAMLFTSDASVFTANVSLMMSQMSRHAQSSCPIDSTQRYVLPTCLSGTLVRR

SEQ ID NO: 979699 - protein, 112 aa, Homo sapiens
MGYKGPCFTELFQVYVQGGDFTRNKWHGGKSIYGEKFEDEEFILKHTGPGIFVHGKCGPNKMVPSFSSALARLRWLDGKHVGVALLKEGMIIVEAMERLWVQEWKDQKKITL

SEQ ID NO: 979700 - protein, 123 aa, Homo sapiens
YSLGPKPSPALLPENLEANHLLEQRTKSFNWKTERCRGRSCILNHMVSSRQNSFGSPDATPGEKRNAVVNFLGSTEGHYCGPREVSIACELSCASSLAIMADGGSNNVVCLSHSGSSHAGGSS

SEQ ID NO: 979701 - protein, 86 aa, Homo sapiens
ETRRDGPAEDTGRVVGTPPPAAAWWAALPCGSKGWGQIRSAFRLWAQKEQNEITTQSNHNYGTSIGHPSEIMQEGNQGISEKCGTQ

SEQ ID NO: 979702 - protein, 290 aa, Homo sapiens
SPVRASNDDKEKKEQWSCQKWAAANVQPIRMHYLVPERAHRTQAYYRNSLIRNKLAGRRQLRGHYSEAERLRLPYVLSPSVYCEATLTVAEAVQNSTAKRTLRDIRISMKAPARDPDKTTASHDYPHDVLHTTGNTNGRADVHPTITSPTPTARNAKQTPHNTPHTATTLTSLGDTPEVTLPPAPAPTPAHIPEQQHTNEQDTRVTLAWTSPPHIGPMAAHGINTGIPGSKEQVLPARFAYSHLLTHNIYTLVNAHKYSHISPVIPPAVCRTLLRTYTGAIHNKGSTVGR

SEQ ID NO: 979703 - protein, 195 aa, Homo sapiens
FSMDRALNCVDDTVCAMPYWQTRTFESPVATEPVCQETVEQDEPQCATSQQSFHTERPSLLETHQVSTTQDTKKPRRILALRSLQNSTEFIKGRNQLQLLDNRDTITTGMKQQLTTDLAIEVTCAQSTRFHSNSGPVQHIHIDLSHRPPVTASINIHKIALYLHHVFTAHVHPETTIKVIHRCKTCYRTECRTPP

SEQ ID NO: 979704 - protein, 189 aa, Homo sapiens
MTDSLAADPCWYYEREYLHYVARNDRLDCMVWLNCGLIRTAHDTRVDVLQHNVLTDFTAEPRAHVNYSPREHRPENRKLSTLRGPPRVGKQYDEPRMNDVGYTDRGTIYEVRQNWTSSTGCYEDELHSQMKGRADGAHQATPCPTARTRCNPRKTGTTDGHQTRYNQDRTYGRDKNTDISKTQPRRARK

SEQ ID NO: 979705 - protein, 179 aa, Homo sapiens
MANLTSEGGHQLTIDAREKPFPTVGDHDTVPGIRWARTGPFYLTQGVRENSFPNGKEPCEGVYQLLMFSCSLRTHANEQRKQRLARLATKNPLVDTTLVPFPQACKTPYSSFLSTTRRLSRPYLIVPLPITPPLYTVPMETVQLRVRLLYEHSGLVTRSPVRAKICHDGLQISTTVLLP

SEQ ID NO: 979706 - protein, 70 aa, Homo sapiens
DVPGAPVLASAVLAWRLFLARLGNSCRLFRRRCRVSHTEGGTRFARRLTQRKITNEQFTPGVVYVRQPYA

SEQ ID NO: 979707 - protein, 243 aa, Homo sapiens
ERGEPDADHVPLLGLLRLQLRAARSREHATPGRRRSPQAAPRASVLLLWLAVARAVERPLIPRGEQKGAPPGQEGAVGWAPGIMGLCCLTRGAQRDFPCFGNGDSPWAPMWHSRVTTLGHPQVSRELGLHNARTHAAALVLQEATRLVKGSSLETPQINSKGVTLACSLWPLLRIGILGTHVAQVVHFNHKYGVQIGASTTLLLQGGLPSGSTDRRHCLARHALGDFHNQGAVDVQDLLPVKL

SEQ ID NO: 979708 - protein, 127 aa, Homo sapiens
MKKPEFHLLCTPVAERVILSTSNDPFLSLMWPSIGMSPGLLSLGPLRESKPLLHADQAVKDSPPTTSLIKSGGDTGGLWKALYPVNGTARLGGTDRARQEDGGSPTYPFHPSWLVTVHHDLWHILEP

SEQ ID NO: 979709 - protein, 295 aa, Homo sapiens
GCGPGAVWVRLVASGCHSLGLYSVASRLAKGRTCRGLSGILRTLFSKPPTSPALGKNGHGTLTKEFDDEQSAYRQLHEHHTRTKTCINTWSCLTQNFPQREHFKNHFLPIIHQKSASACNSQPPPPKAKRTTDWYTIRWTNESFWQSVGIQHGLRLVPQRSLLARYISNSPAENWATLLVVTSLLKNSYESTPTVGVHREYRPNMRSCLTARHNTASFLQQALCSQRNLRQPQHHNTFRAAQHAPGPLGQPAVIPGCLLLEAPGRLHSAHARHASKPYRTNPAAFGARCIPHSQP

SEQ ID NO: 979710 - protein, 109 aa, Homo sapiens
MTSGVKTSLGENPVSPLKEYNNNLQGFAPTNNHKRKFVVYKYIKKKDPGLHPIVWCPGLEFYTRCTMCGIPAPYLKASPKKVLGDIHQGGVEAPPNGHWTLQSPRGPGA

SEQ ID NO: 979711 - protein, 313 aa, Homo sapiens
GFPGLLPVNRMLCQSPPLRPRRAGSSQSRASRSAQPAGSRRLPGQCVCAVGAGARTGTARWEETIALAAMGARGLSFTAVRQPGAGVGVPCPTGELPFLSPGGCWAPEIPAAGEHLASNNGDELPFKRCTNVRKRSRVGNVGTPPDGLQIFPEAYVWIYTSGKQFIRRCTPPLRERDIPVELGLMVHRASLQALTGGKVSLLLPGTTLSVTIFHITCGNLPGRKYTLAMGTKPFFRVWGGPTDSRGTDRLPAGFSVDTLSPTIRSAFSLPRGRALKKQLIFWPPPKHLGWRPGHIDMVLLARSGSISGSHPPI

SEQ ID NO: 979712 - protein, 106 aa, Homo sapiens
MVTDQTHEARSWAEQHKPNGTPMGKWAKTRRCNEQRGINMAHEDNTKPQTDTNYTRIPIGSHLPWNDAKRYHTPARPEHYRETGIPNHTGHQTALVTNTIHKATYW

SEQ ID NO: 979713 - protein, 90 aa, Homo sapiens
FWDAPHPCSSLYGCSTCVRIVGYKCEAIRGDWLPAEPHRGVSPLELPLRFEVRHTASLLLDACLAEDKDLLCRKLIDCGAALENTCALIL

SEQ ID NO: 979714 - protein, 93 aa, Homo sapiens
GKATANYAVNRYHEKYYYRLYTIIAHLHNALCNLLNIHMPRRHIIVVISIFVRKTDSFYSLLLGLYHLLRLDGNSYTNDTAFEYLQGDTNNFP

SEQ ID NO: 979715 - protein, 73 aa, Homo sapiens
PVQPGTAMINGDPNLQQTTGKPRLSKFYQPYSEDTQQRNHQGDFPIVVIYSSSMKHVGQFPKTQAGIIQLGGI

SEQ ID NO: 979716 - protein, 122 aa, Homo sapiens
MQKPSLETKIWRSGEGKVRRLPKVIGTVWYGLTYAGDCPAPALCRVNRMNLALGFRVTALSDVGPVGNLGQYRSMSNGTLGSEKYGENNVGVPEKRENLARGIKWAEHIPCESTESCPLFSL

SEQ ID NO: 979717 - protein, 67 aa, Homo sapiens
DLDLNLAPERESSRYVSPRFQNDYFLTYPFKNLPTASDMGPQIFHRDLSAVPPSYELPQSVRDQNEE

SEQ ID NO: 979718 - protein, 297 aa, Homo sapiens
GQRAGRASREGASGGAACSLSLRRPATSARARGGLRSDRAADWPACRTKRARRCEGAEGEAPSPRRQNMGGNRGTRLGLTSGAAGFGPKQGGSRYVKKLVGPPGYLEGAGVTQDLLDVNPFLLPNLKDSERFLLFLVGPYNSNLCFEGAPRAESFPVERGPLRQGIWSKKHLSGFDWETTEKRAPWGRRGKTGYPADEGIGQRRRLEQPCLGQVICSRVARCFGTKVPRESENRVQVISPVMSSQGCFPLKKERVITTGYFNKKVGSGGSTAHTGCGSEASESFLKGPFGLSKSGCT

SEQ ID NO: 979719 - protein, 152 aa, Homo sapiens
MVLIMAPGNNMAGLEQRSILILRILDGEPWSSSFVGALSMGLRYGTSGSAEAGSHVLQHDPSRNAVSMRQRSTVRCWKCIPAGSIALSLTDLVVGTLEGLSCLGERVGTVFFRLCPFDPEIRAQGVPVETPTVWDLALGKWSHEEGVFSPAI

SEQ ID NO: 979720 - protein, 193 aa, Homo sapiens
MQTSVSKRRVSHSGLSRYWSSCRNVGIHSAGRFVARAFERLHDRPASAPQMLVRDDMGAAMQALHAGLKGPRRKFTISLEEPPLSNSQSGGYQTHLAALHHSLSAQRLRINGINSTGGGCDAQMNIRGLLILEASRDMRSDVLSECYPVTIRAERVYRRKGLGVGRRVPTGLGTAHYGGFNLAPRDIAGIRAS

SEQ ID NO: 979721 - protein, 214 aa, Homo sapiens
AAEFLSAASWRLRTLRILPLARGAAGQSWKRPAGASRESKGPDGMGSPVLKPPGDYLPQALEGQRLKKQLQSRVPDALLAGELFLRHDTDLGESNSLMMCDRRKPAQNQSQRKKTPESLILLHETSFHKPQRCRVTWPPSKAPIGARHGAEENPHAGKSLGLALPRRNAHDDDRPDGTPKGRRHPTWPPTHAPGGRNKTNGTRTPHRRTKRDTK

SEQ ID NO: 979722 - protein, 274 aa, Homo sapiens
SLLNNAIKGGVEDEVSLSAYITIALLEIPLTVTHPVVRKGAVIAWSQPGRQSTRRGTSGSHVYTKALLAYAFAHGQVHQDERGHGSISSHLNEEAVKIDNAVHVGSALMKPRAPSAAYLRNPRTPSAEVEMDILVLRRLSHGLPDHKLGGPDLCNRHREVITKHQNAQGGFSSIQCTVGGSPCSVPVWGSTFSRTVTLPGASRLRACPVLPVGEDRCSAQSWQLLGTPPETSGFPHLGFPGAAGPAWGTHLFCAFRFLHSGGYFFLPCGSPLRA

SEQ ID NO: 979723 - protein, 121 aa, Homo sapiens
MLGTSLPVSDGDKAPASTKTCSVRTREEAPRGAGGPGGARGILAGGGTLQSALRRAVTASGGTIKTEIREGLLKPEKSDTGKMHVPEKLRVSKTARNVQGPPAPIAHSKEQTQKNKIAKKR

SEQ ID NO: 979724 - protein, 566 aa, Homo sapiens
MVPFIARLSQGQDAQFAVPVSPTEGLTLVRAPKDPFSLRHPFPPDLCGPRASTLTRAATTGATEAHPGNSPSQRFPLATKCPGPWITLRVAPHVCRTPARRLAEGVAAHHLRTEFAPNCCPGREFGPPGRDPSVDVGTATLAPVALARIAEETNVTVAERPSKKPCSKCALPNNLLPRVKKHRALRPPRHERTDIGHRDAPYGCGPRQDRVGRRTYRNRMIVLPSEHINTRAGKEHVCIQRTRHHKPAIVGISHPARECLVRSATNHAHGLLRFVGGARRRDGRGERWREGEEAAARVEQEKEEGGWGGSGRGAVRRGGGPVGRRQERASREGRHGRRQEAPGEGVTESRETSHSEANATRKKKHDTAVAGRMRRRGGRSRAGEQRSRSGDSRDPTTAPTGNNAATVRTQRPESRVEAAIGGRPCDEVRRAVRLTRVVAADAAEDSDTRSRPIRELGAENETRLGGHHERREAEDDADRGCRDAIGAASATESASPDGRLRARREQAELSRERMTTGESDGSDGDRESGLRRGDELRAERACDRRMRHESCQVPESTEGQMRGVGG

SEQ ID NO: 979725 - protein, 126 aa, Homo sapiens
MARIGYTAICRGWDDRLLATVGLHLALEMPTEWVFWAKRRFYRTPGNFQVGTSMTVENRSTPQSRKASLSLGQRSVKHSKFSYCLVVGKLKTYMRNCVLLAIRDFVLRGCQRSGFPGRVLVVTARH

SEQ ID NO: 979726 - protein, 102 aa, Homo sapiens
KGRSLMGPRLRRRRVLGSAPTQELCQPEPHRRSPWFLAASRGSLQMHQERGEAEADTARGEKRSRNCQHKRTTTGHHGFGPGDTLPNLRVYVPISQVHCLSA

SEQ ID NO: 979727 - protein, 279 aa, Homo sapiens
EGTWIAVRRLRLEGTGGEMSRVPAFLSAARWRNTSEVQPPHPASRDGLAKFSSGPEEGVMQPCQRVPGDQAQGLTLGVNARYSAAEDALTTVVTFYEDPGDQPRSSLPTRYCGYSCEPRMHPCLGVMDGNVIMQRETVAVLPCATKGKMNWLVVSIKVSCQGGVWCLNLEEIKGEGDLFGFLVDLAGIPMAIYQGSGMFSAPLWALHDFTGLWLYQFPSWEREEYSPPAIWPTWYAATKVGNKASGAGAAHTTQDYTTPKDNLFMLVVRPGAVLCRLGL

SEQ ID NO: 979728 - protein, 283 aa, Homo sapiens
QTVRRTQAVIEDAVVPQAVSTLSSTVSHDSQSVTGHCIVQSGKDEIRTQVDYWEECVRKEERFTSTRSSSYGRKRRKKFKHLKFKSQAIEIREWAVFHLNSCAQIVKILNIPMLRVNGADEDTISGFCEDYTLWMSLLCTGDDLKCLRLRGGMLCPCERLIMDFETNRLTVLNLIFDGNSNNYYESDLLGGGKIEEGKTARAFTSIGDSLVNTQNLRHTLELLTPNSINKELKRLKNPELTPVESTTAFGRLIAVWSHCFTQVFFFAPTKSASVLFDNATTLD

SEQ ID NO: 979729 - protein, 129 aa, Homo sapiens
MSGGCGATSAGQPSPLEGKFEPRGAGGWPTPCAGKPKSGEAGCAKRFVCVAPDARWRQRWCETTLCNKGTVGRSQKQEARRDNPRAATSDKGWVGEQNPSVMRTASTITRRRHSSTHTQREGGQRHKEH

SEQ ID NO: 979730 - protein, 51 aa, Homo sapiens
MSCGPRAQSVGTGHSVDQRTRPAQWGVPPKNPGDGVRHQGQGNVTGQAYPG

SEQ ID NO: 979731 - protein, 173 aa, Homo sapiens
MTEGRQMKLLQGRTHNVLTRHIDEKRTQERRIKLTNRRPKASDQNEEVTFKQLKRRVENSVSGDQHNLEGRSFKKDDQRGGWINKTLKPPVTGTGQEPGVNLKGPKLKGILTNSAQEDNIWTRINCGEVARNKPIGGDKYETFGKGGPLWKRQTVRGQAKHQLMETHQGNLHN

SEQ ID NO: 979732 - protein, 298 aa, Homo sapiens
DAFQLVCKPQASPDRWNFLRTVRLRCVHVCLHLDGIASPSRGRHSEGARAGWLIPCRPSPVTQPHKAQSPAQGNQGVSSSSSFQSSSPSRAQPQFGLTSISPLLNPCPHSNSSPSLNLKGTSGIVLNADVIFYNLYISQEISSPKNSDVTLKIKYVIMGVKGGGGKALKGRPCKVVQAPGVTIDGGPGSRRRTLKTIKAIDKPENNKQNHSNNKLCGAPAAQQKYQAIVGRDRWSEWARLAQEPARQVVFPKKRGPLDTPWVGHGFTGRRDPRGERRTETQTQKQRHTNTHRTHDGRR

SEQ ID NO: 979733 - protein, 439 aa, Homo sapiens
MAFRSLSDVLHTTGSCRVSEDVTVLEKAPCCTAGDVPRELPGKMLRKPVGSRCQILASVSGFLTEVCPLSGPFLPSSLHRRPSVSRAAVRVPIRACGCVFHSVPNPSALLVAPSGKALGFLADARFFPENASPVHFPSGTGPIRFIRKHQGLSGLGQLQEREPVTFRKTGEGHLADPGNNPRDFWQIGYNVAGAVGVTSRGPHGKALLEGGQKPGSQGRECGTHEGGNPGAQGRYGEGLIEPQGVAMEFMSIVLLASVIFCIFFIYPSSTASEESQKSEKRKRIDTSRTDRVGRGGRGGERKGEQGDGREGEEEERTERRKKQQRREEEEKGRKTGSDRERSQQGRRRRRKDRGKEGKRTGKAETDRKGRKQRKAKKKEAARGERQEEKTGEQQHRAGKTTREEQKKDRRETEERQGQKERQKAEPERRTERHREAGRW

SEQ ID NO: 979734 - protein, 119 aa, Homo sapiens
MTNQGRGEAKKNPGELYEACSTQKVVAPQLVCPTVGELKGNTLGPGQAVKATTKRSMGKPQIYRGAGANTNTTWTSQLTGPEKHERTRGNHNCLRKEQKLTGGDRRAPNNHRAHKQQNA

SEQ ID NO: 979735 - protein, 287 aa, Homo sapiens
QSRLSGRLDSCARWGSCSSPRCPRAGHLVGATRTRSSTCGPPAVLGVYGRLCANPRGELGRGVAPEGWGQDSPGLLHLVPTTLANGGLERLDLEHLPPDVEGRAKIIFWRGPDYDKAMRERTITFSCQGTLDQGWTERLPDIGKRRWPNKGVALLTACGGTPCVLHTGAQASVNGGKIFLVFRKDNSPRLDGGTAIWYKRLANKGSLGSGRGRLGLENGLEFHPGPGGPPGLTDECAWNLENLLKNWAMRQEHGGSNRVRAKCLLPPRVAICLWGHAHKCESSEELQ

SEQ ID NO: 979736 - protein, 91 aa, Homo sapiens
VIYNLPTEKSSGSDGFTTEFYQTYKEKLVPFLLKPFQKIEEDGLFPSSFYEASIILILKTVRDIRTKENFRPISLMNADAKIIKIHGNQIQ

SEQ ID NO: 979737 - protein, 343 aa, Homo sapiens
CPLSTALGHSPIPHPIEPLTQNLCDQGPFPTHSYTLFWTRRANKIPTTYHECYTTGWGPELVHGHCAMALLYAAWLPRRTPQSKGAYQGPATERWEPTPELTHGRSTRGDYNWYQLAKEHKKDTSRNTGTVTEADAGNSINPVTPPRAGKDKGLHKGQLRDIARSLDSQAQLTQPQEHYRRDKGVTGYGAGTDYGRRAAAVRHEPNGQLQWTSPGMNYKGKTDTMTNRREELPNPTLEKKKAKKARGKHKRHNTSAHTSTHNTRLSYTTTHNTQTKKPTIPPNINYRYKRILHTLSYYSLSLFLLTKHKQPTHPTHHLTITTTHTHTHLTYEHNHITHHIHTN

SEQ ID NO: 979738 - protein, 164 aa, Homo sapiens
MPGQAEGNEAPGGRLWGSLKEEGPAEGGKAHTDWTVYPRVRQPRGEIHPLLGGDPKSREAGGGWGHGINQRARRSETNHAAGKRGDTKRESTSGSDVGHAVGGKGRIWQRGAQDPEFSIGGETRGDTTHDSNQETMLETTATARRNSTSPERGRNNGLERDSQQ

SEQ ID NO: 979739 - protein, 181 aa, Homo sapiens
MRQRFKPCTVALANQAKIPEVPGVICGMHHPGFWQSKAFRELVVLCQGANEQGLSCSEGSGFNYKELRSRSRAPAGPPPPCVAGSKREGGGIPWSIIKGPRRCRWARRVGEDQEPGLGVKLVGCHGWPLGMSHRTGGLVTVGGGQKGLKPRLPPRVATRQTRRREQRKTLKKGEQNVARGQ

SEQ ID NO: 979740 - protein, 142 aa, Homo sapiens
MVRTSRTQSLASAEVSLDAKIQHFDLGRKKAKVDEFPLVATWCQMNMSSVLCSPGGLPELCANKVHGTKVGGKDGFHIGCGLHPFHVIRITKMCVLCWADRLKQACEGGLWKAPGNVPGVHMAKVIMSIRTKLQNKEPCDEA

SEQ ID NO: 979741 - protein, 132 aa, Homo sapiens
MYHRYWEEYSKGADYPGLLIKVSQHPVYYQETKLTEADPSVMAMVVYDLNEPTYGHIRRRYALAYVADMLVEPFQAILIRMLLRRTSKMIVVEKPKPESNPVGYKLLVYMWNQYKTKIPLNSLSGTFWSLPC

SEQ ID NO: 979742 - protein, 41 aa, Homo sapiens
MDTRDIELCVHYTRGNKKVVQLLWITVGQFSMNTVTYFFPG

SEQ ID NO: 979743 - protein, 131 aa, Homo sapiens
MCVGAIGTIIMPELLGTLTKGLCQGVKGTSPRETGSSACWEFETRNRPYKLTRCGSPVDTVGLDTRRKGFITKVTNEGFSQQRFLFMLLTEREMAARKRGKFPPKLTRVVKQAGEENISPDIFTTVWGLAH

SEQ ID NO: 979744 - protein, 168 aa, Homo sapiens
MKTRASEVVRDEVDIRVKIQLGPHPKRAIVEKSCTTLAILTFYFQFIWAKHQNLGGRMFTGAGQGSASVGGTKLQVFTTEGLIIEQSRKTGSSSETQGLCGNNLTTGVLARRVWLEGSTWPQRRSGSFVGLSIVNHLKPVCTQEAIMCTCDKSSSDQCYFPPGLLPNN

SEQ ID NO: 979745 - protein, 185 aa, Homo sapiens
MSKTTTFKGVTPNSRNSSRSLRPPGVASTFSIRFDEPKEQTVSEGTKVASKYLLGPPEEHSRLLCGQMSRPGAKVSVGAVTDLEFTLTADERTSSEGKLGRFLRSERQHWCYFHEQLWTQDLPGSLGQIGQEKPVPCCGLCTVGLPRPHVASRRIPVGGVQGLDLELTSSIALTAGVLCCSSMAW

SEQ ID NO: 979746 - protein, 72 aa, Homo sapiens
GKRRQRGKMAAAVHSGVTVEQLPQVSSCPKKDIITFLQEHGSDSFLCRTINYEEHIQIVAKKVNQGPLWLQL

SEQ ID NO: 979747 - protein, 103 aa, Homo sapiens
QPQQCGEAWGLPWSLSPPIGKGKESRTKAPYVSNPQLSIRDQDPGAKLQWFSDCGCSSSSKLIPVLTGGHLKLEAPGVKFERKEGYSNISYMGCYSSGNLFLD

SEQ ID NO: 979748 - protein, 111 aa, Homo sapiens
MSKSPVSHRGSKVIIRGHSLTVFLGRFPRTSDAIANYLCPKRRGRNGICSPPERYSTRGENDVNYLSVAGGRMQGGKRGQEELCIAVKYSVKVGSQLTVRNAGGITGWPMR

SEQ ID NO: 979749 - protein, 111 aa, Homo sapiens
NNDLFSMCLRTVFLLTLAKQFTSSLDSYSVPDVLPPHNAWSSQRHLSSEPLSRKTTLPLYTKSPYEFILNYNSSRADRTNHIGISFFEYQHFIAHALAYDHPDEANQAENA

SEQ ID NO: 979750 - protein, 309 aa, Homo sapiens
ASFSGWNHGMGVEEKKKEAFLLCQGNPLMKKLKEFRRAEWIKLLRRRFAHKMLRKGKERMLIYEKAKHYHKEYMAGCTELKIRMAQDAHEQAGDFYVPVEPKLAFVITELRMGIIGVSPKVRKVLQLLRVRQIFNGPFVTGSNQGLQINYAEGLWQPYMHGGIPNLNVSEDETISTSVVMGKINKKAELALTDKRFGLLDLLVNTGIICLEDSIHEIYTVVKRSQSIYLLRALNVFHRGNEKRHIVTCALALETDHSLETVPHAFIPAVNGSLIEKQNTGAEITGALNKLAVMSPRLNRMREHQKRSHK

SEQ ID NO: 979751 - protein, 272 aa, Homo sapiens
MGFRKPSVLVELIKLKLYQHQLCKVMDESKIWLFKEMDEEHYEEEGEPVGEEDVGVFLGFEVKDGPGGKEGNWVEWMFKNGHMICGFLSSDKKGDCPDHIMADSDFRGICMSLAKMNRSVVFFQGKFENALCNTGCSAYDSYPICSVQACKVKLWKNSLGYFGPIRMQIVELYPYFCVSEFRLKLNMEYGDNRSYAGDNRIPCLVKKPEVTRRGCLTASNHADKAGEEPETRELTTVSQRVGNKNRDTKRGNNRMTQHTKETDQTESLSDTL

SEQ ID NO: 979752 - protein, 124 aa, Homo sapiens
KQAPATCPSDPDNPALIAEAEDGGTNRKRVKMLSCRDQVSVARCRPVQYGTVRDTAPAEKNSLEVDAIQDPLQKYHYLPDVDGRTLCDLVFDLSAWIVLRNALFCYNGRIYDSQWSEEVQACLE

SEQ ID NO: 979753 - protein, 169 aa, Homo sapiens
MGVRDDVKSMHPLYPASGGPDKPIVYEGFRDNGLLGCTVPLEGSLFLDRRTVAQWRVCALILGIRDLTREIYLYDCWLAQSYVGRRRMLLLVRPACWGQAPRLPDRLDGAGTGSFPVSTRDGLAKTMGVVDLPRVTSGSSASVPRGLPGFSHRGPLAPSPPRCSGPILF

SEQ ID NO: 979754 - protein, 35 aa, Homo sapiens
MPGNLYVANQKAGVSLGTPYFGEGPPTEGRTRASG

SEQ ID NO: 979755 - protein, 130 aa, Homo sapiens
MILVRMLLLLTHRCTVSPMKQVGREGRRATVMDFLQLVYRGNKRSAMVRTAHEWVKLHRRIEIILNKSRKRYESLCGINMDVLADLRSRMAAKKIRRPISQSGKDRVRMPTTDFEKSLTRKRLRCGEGSM

SEQ ID NO: 979756 - protein, 197 aa, Homo sapiens
MRIHTHTHTHTHTHTHTQSVCILYIQEYSDSAPRCSKHFFVTHQLVTCMLKRGLVRHVENTLSILSTRCEIAAHTCNVYSSAIIYPNIQKKKKKILENFFASPRLLPQTRVLLLGGVLVRGVVCAARPRVGGRRENPTIFYYYKEPLLCGACYYCWLLLLLVLTPGGHTTAALLFESLIYAGNRHQTYVAEEREPRC

SEQ ID NO: 979757 - protein, 98 aa, Homo sapiens
MKVVYSVIARWILTEVKAGSTESLKLYGEQTSYFELEDLSEYFLIQEFKSNHVYLELVRQKKIPSVDGPSNPLWFHNRRKKPHKVLASKRVDKKPSVQ

SEQ ID NO: 979758 - protein, 107 aa, Homo sapiens
AFRRCSQARQPCLIPLMIYESEAAYDPYDCIPERPMICSTGDPKAGAVLSEAVSMRQTNLIRVIPEVTRTTFIQYCPSKLVSDLIDQKVYELQASRVSSDVIDHEGV

SEQ ID NO: 979759 - protein, 107 aa, Homo sapiens
MAIRVSVVDGVDRRCAASTCEGDESEVTQMHFAVVTRGPSNELITTTPSDYTVGPTVGWTTKSLGCRMESSLEVPAVLLITELTCWTYCQSSHNELMTLGCVTLLMN

SEQ ID NO: 979760 - protein, 168 aa, Homo sapiens
MWRSIHWMGHFLRSPVSRVAGHFKVSSYHAPQGLDFFTVGQKVPTLAGASRDKWASSSGAGGSPSGLGETLGAPSCRERADAKLQLKTATIGLSLVQSGGGEQDRWTLSTAMVGIDASSGWGAQRTATGPGKEAPGKQAKEGWQTRGEVDWRSGPYKMDRWVRTRKGQ

SEQ ID NO: 979761 - protein, 87 aa, Homo sapiens
RPKIAHAYSSISHYSPRINGHSHPESPRSLHPGQSWLIIAHGVTSSLLFCLVKSRKYEGTATSRIMILSRRTFKVLLHNLSSFVMTS

SEQ ID NO: 979762 - protein, 73 aa, Homo sapiens
KREIRIPTDRSGILLSMGLMRAGDDLVNLKPNIWTLQAQGDRLSSLLQTSLLRIVLGAGSMLAAVEERRLVDG

SEQ ID NO: 979763 - protein, 131 aa, Homo sapiens
MHYFPIILRRSILSSKDALISPRGYSWMTYNVPQHSLATKICVELHRACRASLCSEAPFSASGYNLSSTIQHEETAIVVDEHQCQDVACSSAESQSHLKDVYHYHVVGKLLRAYYHKELESSRAFAIRKAV

SEQ ID NO: 979764 - protein, 42 aa, Homo sapiens
MLGKRLEGGTDQMLSKEFHKAAQVKKDAGPAEIRQGPGGGKG

SEQ ID NO: 979765 - protein, 96 aa, Homo sapiens
VFSYSFLNGPSNSAKKWKLFHLISAIDEGKVLTVACAFLRVILPQKYRWSVLVEEKSTGQEQGMVATLKTRDDLTTLIIMEVQRQDGGLYTREFRE

SEQ ID NO: 979766 - protein, 68 aa, Homo sapiens
DCVVDRAGCKAYICRAVFPGSLGLYLVALLVAPGPSLQSRLTVGCDEHERTKKDQEGSRKRKRDKFPT

SEQ ID NO: 979767 - protein, 65 aa, Homo sapiens
MGMKALYGVESNPHYRVILWELERRLPTISWVTLGTHRCHLSAPYTVQFCVFRFPQGSRITLEPS

SEQ ID NO: 979768 - protein, 150 aa, Homo sapiens
MRSPLTAVPEFNQETRKLRQFQTWDAYTRGACLVLSVALDPRTSGWKAEEVKEDIARVLSDACKDEAAYVLRRSRRLPLKSYPAVSRVLRIDSFTKECDEKTDISATLKAPRDEDMAVIQTNPRKDAVLRYSDHGSVRATLSTQSGRVTV

SEQ ID NO: 979769 - protein, 220 aa, Homo sapiens
MCPRSLILLVMRQRTSALTLTTERLLHRWCIGGRLPTLSDAAPQHHALPPDAIISPLPPDLARCTRPPTSYALHWQHLLNSLALHRQLLLTLQASPKSSLGEFTTHDCLITQPPPRSPSPRHLKHVSGGYPTLFLVPKRLGLPPPNITLHPIQTLHLSDPPPTPDTPSHNTRCTVAATSTTRQQATPTPTTHPHHTPTNAPCAILALPFHCATITTHPPN

SEQ ID NO: 979770 - protein, 311 aa, Homo sapiens
MSLLECKILARCGGHACDPAVLGEAGRGESYLSPGGKKVVGSLGLHTDLFLRDYRETLSQYGHRKNEGSLPLHVAQEDLAKSSGEKIFNPCPETLLMRARHGWNAILEMNRITPRDTGQTKTHQHDGDRQRDEDILKAPVYAHAKIHKRNGHCETTQPQRASITPMQSGQGTSHKKASRGYEQACQKKWSTGKNQKGAKRRDGRHANCKRGGGGHVGTLKTECGTPQITTYSSTTNWDGQTSGEGSGRGHKRTRPLHADTSSKRKRSGTTSKRPHTKPTENKQPPQRHNTTQRKHDHTHLTNSQTKNKAEY

SEQ ID NO: 979771 - protein, 87 aa, Homo sapiens
KAPVDDAQEMLTLRIATMPKDTLTVNVEAVRPRCPRFRKVKPSRTHNNMYAWGQEVSGRTYSYMQLMSVLQVFMGSLEDSYAVSSAA

SEQ ID NO: 979772 - protein, 282 aa, Homo sapiens
HIPSPESSSSNCDSSTLKKYDLTAREPETHAITLLLLDETENTARLSKPSHGSERPIAQSIVWLVMDLGRSTVHVSPDTSCGSTYLPSRVTRECLEHLYTDAVQKKDLTYYSLCRRFPDIVLGGTYMVTRNCYARSGVTGVWQVTCVRMDRRDHDTLYCILKKHEISMKTISYAEKRLIQDIAVCIEGNPLLNDSVHDANVLSILPVKYAINQLRIPNRLISKVVEPVGLAIRADHGTYGAPRLGVETPQNVLYPLNHATTSRRNLASYRTKGWTMLDGSST

SEQ ID NO: 979773 - protein, 129 aa, Homo sapiens
LNLFLSMTIFVSLLIPTCNPSEPTQSISSCRAVTSGGCPSPCVTPRVCLCHCLSMLNWKLASVNPCPVSFSTELKGMDTLILPGTLPTVGCGLIFFSLERLFQVSPGPSLGFLTQIGPHIFSTGNGCNS

SEQ ID NO: 979774 - protein, 77 aa, Homo sapiens
EKEEEEGEEKEIEEESHELAVVYRNVQRPESVSDHMYLDGSYGYGDQEMNVVNKRPMCTTYAPWFDDMGEWICVWEI

SEQ ID NO: 979775 - protein, 177 aa, Homo sapiens
DVEGSTSPQIGDKVEFSISDKQRPGQQVATLCADLLGRNSNSKRRLGYVATLKEILDCIETANHDKENLFSTYSEFSGDVDSLELGDMVEYSWSKGKGNKVSAEKVNINTTEVNGITGGSVIPPFISGTNVSSTPEECRSNYRLSNQGNDGDVEEGDMKGEVYALGHRWDGNKVGLL

SEQ ID NO: 979776 - protein, 297 aa, Homo sapiens
MESHIELAPPAVISGHNPAEDKRRAPSPAADTRRTITITLASSALFACRMQAEQPAPDDQTYETTNQSHTQNTTHHTHAKATDTTGTSTTQQTTQTNRRPQHTTTARHKRRRRGRGEETKGGESEGRSADGEDNAATQKRGEESSTEGRQKEKIAKTGEKRAPDSQDSQERRRRQRQAQAERAHSTRKQRRTRRSNAEAENRRGQRNEHKGRRDREETERPEERHTRGGARHKTDHRSKKRQRTAKAQQSAGRERAERRKKRQRTAEHSGADTREEEQSRRHNRRKTPEQTEYRRAR

SEQ ID NO: 979777 - protein, 291 aa, Homo sapiens
MGPLPEARPTGRGRLHTHTTAHQHHNDTTPHTPQNRTHTTTQPKAAWEGRESGRQRRGKGGGRGRKQERGEQQEEKRTRAQERAKRARGARGGRGKEERARTQAQGGERDEAREHDRKGRSAEQRTRRGEGEGGGEEQEKGSAERGRGDKSRREQAGGRMRAGGRGKRGEEGRGGRHGPAGGRGGETGRRESGAADERGDRSETGEGRKEGERGRKEEKEEREKSIQRREREEQRRRRGTGEGHAKRERGRTKKRADKQERRGREETRRAEGAQKSAQQDRSDARHQQRPR

SEQ ID NO: 979778 - protein, 134 aa, Homo sapiens
LLTGLQSTIFLQSLKDGLNHHHVEQKNKEQDKKRPQLCNIQCVCYVDQSQIQEFREAFNTDDQNRDGFIDKEDCMIMLASWGKNPTDEYLDAMMNEAPGAINFTMCLSMFGEKLNGREILRDVYQNMALCCVLM

SEQ ID NO: 979779 - protein, 66 aa, Homo sapiens
MGQTGSDDLGAAYSPGATRPTDASQRHGGRSRSHYECRGYFPHCDRAPAGDKQQGRTAWTITAGAL

SEQ ID NO: 979780 - protein, 295 aa, Homo sapiens
VPEVLPPKEVVPEKKSTGASWPEKPEAPPPKVPEAPKEVFLRRKGQCLLLKSLKCHPEKSQRCQRKVVPEKKVSEAIPPKTEESSRCSAESVCTEGKLVPEKKVPVPHCKESQKLELLEVLRIARECGLLETEIVQCLIVKGRKCQPLVCPRGAEGRGVPEKRVRMGYSPERKVPPVKDVKGCHSMGRGPRSQTRTGCLRHIGRKHSTSLKVASVLPKLKVRRNKERGQGTWKKLQTALSQVPSTYKGVLNKSPWTYRARALEDRAPTVRRATGPNRHGITAKASKRPKRDEPGN

SEQ ID NO: 979781 - protein, 100 aa, Homo sapiens
MIEPELSQQAHPDRPDYDLGRITNTDPNGANTGKATRNAKLHTSDHSMYTLKTEPNRQHTRGIRTEERNQHNHQTKTIKRQHKGKEHDQTHPQTNSEKNK

SEQ ID NO: 979782 - protein, 101 aa, Homo sapiens
GLEDSSSSTLGVANLEVETQSLISPALSDCSVSRSSEYVKEVLSDNEVHIGAVIDYERLELKSARYFERVTYELRQVFRCVQCSLMTGTDGWTVMRLVGVV

SEQ ID NO: 979783 - protein, 206 aa, Homo sapiens
RSSSMADRSIRTVWSRPGTMAGVSWLIALSRKRDNCCEQEERKSFVVDSDPTVIHNIAKDYEATIELERRKQRYIKFVYMLRPYMMGSNSLALEVSCQHICLRPPPSNAYESLKHPHLRIHCLRWSKLMYLDDLGICLAVMLLSLYSACSSEVPLGWPVCIRNVSIHMVVGGALEDQKDTSRARLDDFCFRNSLRSLTGHQGIRAF

SEQ ID NO: 979784 - protein, 519 aa, Homo sapiens
IQRRSSPCLQSAEEGVQVAVDTAACVAQYLTVSNADLAGLVLKRTRCTLVAGLVMNAHWLDNCETRTLDDNGHVHYDLTMTPLPKTVRRPSPTLPNRTMAATTHEQDGRREPCDTNTMKITWHHHTTSATTPRHPHIDHTRMIPNTWEGHHTFQKHVSYQGSITQEYHNAHGSLSHTHKCGNPNTRSVQHYVGHHYDSYHSITMDKGYSLLLQLKPTRQAVTNTHKEQGKDILTQTQLSRNAYTQGNNTIRARPLCGIKGRPHRHNKDSTEKLKQAQSMEMEQQTPTNNNSTLNKHDSNKTTSSRPTELRCEEQHQKSDAPHTESTQRQSKTNSKDKVEAEAHSRGSSKTRGQPNAQHVGSPQSDEETHKLTDDRGESDRNTVARRTPPNTHKNQARQRRRTRRRDLTTQHKLRRKTADIESRRPTHTKDTTTEAVAQHYYTQRRRCGAKHVTRLEASRQTKATSNKSDRQTVSRAEAHKHETPERSKATPENQAADNAAHASQPNREATTAQTAQPQT

SEQ ID NO: 979785 - protein, 110 aa, Homo sapiens
MALNTDSGFGNTRHHWALMTLWSWNEAAGQAVGITEGIFQKAKVLRSSWPSSTEGDTSVRAHGATRATKGVLNRDCPLKHRSDQGKYADNWAANTRLCIPGLRDTPQVVG

SEQ ID NO: 979786 - protein, 169 aa, Homo sapiens
MGIQSPVGSYCGHILLKSGLTQYVEAQIDEAVWQTTPSREQFRAQATRESVTALNTLGGNTTKRRTKQQHDERGRTNSSGSQTTTGASRRQHPQTENTPTTTILWVYPTATDNIKNEQSADESNRHERETETNADVYTKPYKPTQYTSDSTVHRHTNQRRKTERTQHKD

SEQ ID NO: 979787 - protein, 103 aa, Homo sapiens
LFFFWKQGLALSPRLECSVAICWFAATSVSRVRVILCASVSRVAGIIGTRHHAGLILVFWVEMGCFTMLGRAGVELLTSGDPPTSASRSAGDWQAWATVPSHM

SEQ ID NO: 979788 - protein, 56 aa, Homo sapiens
MGTKWMMSYNENVWIHGPNFHSRANFTAPAGNSSQIIHIQLTNGGPYHKRIGGLKS

SEQ ID NO: 979789 - protein, 126 aa, Homo sapiens
MLLGIPFAMSLCRPDGVLVVWPLSYLAHCVHPIVYVMLQSACVQLLVALMGQGCPGGWGEGPSNCEEMPPDVLGESRATGKAWVVPTGGTCVGHQGVPRGYQGGGASTVLSPCKTGRLAEQLSCPF

SEQ ID NO: 979790 - protein, 152 aa, Homo sapiens
MIVIGDSAMRNPGILPHTESTTCMIFVAKPLHQEMINSIFLYLEPSDYHRNRCNGQDARDKEGHTRLNRRGSSLFDSLWNMRLHSFHDYNIQKESDLMLMVLLYETCYCRTLSDVMQPAMGPEHYIMGTMVDPMSFYLDNVVTVYRLPRALT

SEQ ID NO: 979791 - protein, 201 aa, Homo sapiens
MYALLLNWLNAGVNLLPVRLECTYVSKTVPQPGPLSSRIRLYDFNIKGPFAVLNCARSTGYLSQGPGVRHDKKDRQSRLIFVLMRKTTFSTQEACSDTSITTLNTTRRVCTHLLRKVLSLRLGSVTRVSSRATSEFHARTLGQPGRKLRMRSQERLGSENCPIRGRRERTVKEGTDRRNGSSQEMTGRWAPGDWFTGRAKW

SEQ ID NO: 979792 - protein, 161 aa, Homo sapiens
MPRTGKSVKEKMCYTEFRLPTLLSLGASYLPETKPSTTRQGQCKFLKARTMRQPHVMPCHHMAEVSCQEIPLRKVSYEMSRIKSVSTQKSQTWSLEPVPDTFRSESDLEMSLVQSNMLWRGSRERHLWIEWMYKRNEVVRNVLDYDIHLSWFLTKYTIDST

SEQ ID NO: 979793 - protein, 214 aa, Homo sapiens
GGQRHLQDTDQSPLQSQPMSRTPYISFTQVAQFRFIPSTSERSGQCMIYTHVVMGVVIRAGVVYEKSDKIIPLASGVQRGLGAPSRNLIAQKAPQLGSQTSRAVASLWGLVQSVGYDHEMFQTFTKETKAYRGAPKSPNVFPSTHFLSPSGKTHVLRTGVGPGLGPVECMGYFGTGGMSSAGYNRENKLLWGYLYARERAVIIAEIPPQIAIPS

SEQ ID NO: 979794 - protein, 72 aa, Homo sapiens
MLGISMPFGKLAMGSSGMAHRVGSELTSESHWRCSDPWPGRALGENLGFVFPIFLGGGGYAPCCQLLARSPC

SEQ ID NO: 979795 - protein, 302 aa, Homo sapiens
MSGWRGEGPDGVYGENTCAEGVVSHRRNSGLLKEVAVGFFSQINKNAPGGNSGSGCVKQHSRRVDVTEGLLTGGLLSNSEEASPERRGREIIINIKRARGHGGREQEPHQTEETTEHNKGTQAGTRRKGTKEKAQTTEDMKAAGDKPRTNNNTPIRQQTTTKHLARRQSNKQTAQTARRTQQPAASTTASHTRDEEKCTRHNTEEQTHKNVARRKDREQRQAHNRQTRISANEHRQKSPTSEHKEKETSNGDSSTEHNQPDRGTHSSKTHAKTKQQTRHRTTERCGSSQTNTKQEDSTKTEE

SEQ ID NO: 979796 - protein, 214 aa, Homo sapiens
MLFLLKFLRREGWFLRGAESIIQCADIQVGLQHKLKYMRVENFDIFLGSLATFFLTLLSHFGAPPILQKLEVYGHEMVGTERNLWTNCLCFQKPDVCPPIAKICLSAGPVCCGHGFLHQILGLLLLSCDVEGTPAGCISSQSESSVGGKSWTTWFWVGGPCALALVLHYQIPVYIICLAGTPVNSAESGYTAGGRHSSKLRCREDRGRKGPPKG

SEQ ID NO: 979797 - protein, 307 aa, Homo sapiens
SGDSGPRWQHVRKALPRRLVGLGPSGMSDLIYGDLTIVRVNIVVMFVVPEDVIVTHIGKTNSRYVLQVKIKLIDMLSEGRTLCYKKPTDLCLLSGFPRVGDHTEVLKGIQKFPGINYPVRDPKFDRASRLAVADGAKEVVRFYGSCSEMIDLRRTSMFHRRRVCQRLDAILKGAQSGQYFCAGVQSAGDLGWRYEGKISPRNVAEVTRSAKQGLYRNPGDTMAGAPQGAEELCLVRRRMARWPGHCMGAGNLDKLGGESGAVDTGTRRTTPGERGQPERQGTDRTGDNHHKICKSAREHEHGREPRN

SEQ ID NO: 979798 - protein, 155 aa, Homo sapiens
MPSAGVKSIELSRHTPTEENEMICCSVLSPRIRSSLVSGVGGSDLDIVLAKLDQLDTRILHVAEYGVAHFQYVLSIGAGWAIIGGFNSLDFPYAQATALEQTYAKIHFSMHMHRCNLTFFTKNLLVSIRNGPRLTLDSRCVQRMKIYYLWGHSSL

SEQ ID NO: 979799 - protein, 134 aa, Homo sapiens
MVLSPLASAASFRGQGEDPVLGKLETVVVTEEEALAEDLPLVSRSNILPPGGIMDELCLVSETDWLPNLPGLGSLVNLGVNAQSLCDCWIIVVRMRSHVAGAPPDIVLSKQGGLSETMVPLWTSGSEVPASGET

SEQ ID NO: 979800 - protein, 132 aa, Homo sapiens
MSAATEANAYFISSSKAHVIAHLGYHAPDEADQRRNALNAGDDTSYSSTLVGLAFPYCIALIYSHDTLGVTETFYYSFSLPKNYQSPEPAINMTSLHNSFYSKDTSLGTPVIDSLKPMCEPIAGSKYLAEYS

SEQ ID NO: 979801 - protein, 105 aa, Homo sapiens
MVSANILYQHYKIRMDNFKLCLDCISLAWIKSYCNGQFQCISLQAQVMVKYVRLLNNNGTYIILQGYSLSLELTSLNLYICKICILMLDLAIYRRSSSNCEKFLS

SEQ ID NO: 979802 - protein, 212 aa, Homo sapiens
MMTGDDDPSSVVRKCECENILKKVIQWCNQQKDEPSSSLKMMRNNGKCEVDDSPCGGAKKFLKVDQGTLFEAHCWLQSYFRHRRLLDVTVQTVADYDQGEKAPGEIRKELLYQNVCTGQEGSRYGNEKPVGCKQMKCWGGMGNWKDVQIHWAADYTMDIDDGHNGGSQVGEIARRGWGHPPRQFQKKTCSGAKTAQERDPLEQRLRQRTRVT

SEQ ID NO: 979803 - protein, 47 aa, Homo sapiens
MAVLWGQVGGCPGTRVSLSRKYAADTRRTDDRVVVAPSGWAGVTEGL

SEQ ID NO: 979804 - protein, 239 aa, Homo sapiens
TTQGKRQQEPSSTEEGDMAKEWGYACHKVLTTGMNFPKCQGGKPVRPFELHTKDIRHDPFSAQTMVCVFMMGALQKPIPALTGKHRAELYLNDYLYGYLTVLDEGRFLLPGPLPTSPDFILSTWGLFRNDSIGLLDATPVSLESQYWHAGRFTILSQLGTHERLPPLEKNAPAKQAAAWDSPGDWHSFLEQQGHLQTWGEFHDLSLESHRTHIIKPTGPRTAPYNTFAPIRLFTALPRK

SEQ ID NO: 979805 - protein, 173 aa, Homo sapiens
MVAGVGRAIFGGPSKRTVVCRDWRRPGTRNVNYWTENTPQGAMNRTRSDLPPEKVERWSQSQIGRIRAGDQTHVCLKPQCSAPQMLSKRARGRARTKENLQFIVHKRTGPPHLASAVNSACAHHPDGKQLFLVPLHTHTTNPVWHTITIRTKRDSPAQLFLYVFDSPALYLHH

SEQ ID NO: 979806 - protein, 181 aa, Homo sapiens
MQTDPPAGVSASPVADNVMTWNAVIIGPADTPFEDGTFRLVMNFEEQYPNKPPGVTFISQMSTLMYTELVSCVSTFAEPVGVPHMTVGSIFTSIPKSTELSPKIDSPGNVESNLYKDNRENISNVSCTRHKPGTLTRPRRGGLLMATGHDGQGGAGNNGDWSGSRDGKRRMVSKETSGPRA

SEQ ID NO: 979807 - protein, 278 aa, Homo sapiens
MASMEPSWLVPFGTSGRVNHTFPPIFTLGLIFPLGAAPFMESIVGVFPRRAWGFFLQHKSALFPPSLNRRTGVLPLSLPTGEPNTLHTRVVILINTTILIYHLILPTKGRPTCGEGRLQGAIVLHTHLVEPPPSGRPPTQGFLTPPTSACHIHLQPNNYVYLPNSRGARTTPCGKDNLKPYPLRQQICGSVYTQQHSLLSLSDTAPPKLYTTRRFDPQAAWRLRAPPNIWGCQSDQQPQKLWAGATPFSRHPPAPNSQPLPIAHFQKPPPNQPKSAGT

SEQ ID NO: 979808 - protein, 155 aa, Homo sapiens
MRRLHDVLSYSVLLLYGDGSPYSASALIIKKVTYHDPCIESVHIGRSGKELILPKQESIGLCGLQDCAPEDRLSRSARKDIQPASVDPMDLMKDSKIFAHAGSCKTNRVLDQVGPPSLGPSGGCTIPSTMSDHQIQEYRLRHGPFHLVPPQYGIC

SEQ ID NO: 979809 - protein, 119 aa, Homo sapiens
MPRLEYSDDYSDTYELKSGSTYLRIKALVCLTYAGIGCSLISMNSFPDYELFILASMNLDMFFKMGGQEVICHSLRAESLTRYGLGRTGVFPIRKEIKARGEGQPKVREAFNVREGVHE

SEQ ID NO: 979810 - protein, 286 aa, Homo sapiens
DSVPHCITGTPTMVETIKDPSPHQLSWLDHCHVSQVIFTSVGKFYYPWRGRHNVIIASPQHFIPTCEKRWDWHLLEVGVERQRPVGVFTRFTVEYTLPIDLTQSNSAKTARIVPVHWLTSLPKVVTEVLTSSADVDARHGVDTGGSKDMPYHNSVPENEEDTSLVSKPLREAGGRAWSSTMQGGVKTIHQGADGHRCIRPPRKARASHFRGWNSKRQARREPEETLQAALLTAVARYTDRNRRAMGGHSWVTWRDHPQESSHTPDARIPRATLATWSPAMSSARFR

SEQ ID NO: 979811 - protein, 179 aa, Homo sapiens
THSGTGAALNSLFRLPCCVQPSRSIMSFSADQMLNSRRHFSCVTEQVIPSITLSQVGDVLRALGHQSPIQMHEVEEQFWETPASEELNAKKMSLKISAYDASQFPTNKDQATYEDFVEGLRVFDKKDNGTVVGAELRMLLATLGEQMKRGRSGSPAWHGQEDSKWLHQLRSFVKHIMSI

SEQ ID NO: 979812 - protein, 73 aa, Homo sapiens
MYLTSLSLSMNCLCRLVRMIVPLLRAKTEQKNMGPPKLTSVGGQTKAAQQGAGAQTGGDTRVLTVPPRANPTI

SEQ ID NO: 979813 - protein, 434 aa, Homo sapiens
MPCQHVLWNNVSAAGGRLLLSSDGRLNGTVRSNAIGDRNVREAMDQFTTHGRRIKFRLVMPGLGRVPHRQRCSRLTVTSESNMCAWGHELYTTAFGEVNTTELYMTDGIGFTEEIPVALRKELQGCDPKKLSLVSISSKRDIEFVMSAYCNKNEVHRGNDEQEAIVAHGSLLELLTVTVCIFNWTQHHCSSLWIVNRYPQGHAKLHMAVKGTRKTQKFVWNTSAHLEVPIMQACGRRMKFHSTTNLFPPCCCTLPSYMDKVLNTVLTLVVATQSGHMRSNSIKLGFIHHPETPVTTSQKRGAIHLDILERCRGMPKHGGKPGLIGAMRRKTSQLGGMGQTPEHGLVPCTAITKHGTGSHTSELGQQRAQKRKETADYIKGDQQHARERDKASGTAQHIEGQQSDTKDKTRGKRAAHERNTTRRTNASASTDTTA

SEQ ID NO: 979814 - protein, 169 aa, Homo sapiens
MNDIAHHIYYGGEYPEYVTDILRTQQQHNTLTPTTCTTDLEYDQFSTEDVHVVNLITHQGTLALTLGYPPPAKIITSHPIRWLLIKHQQTATHVGEVRPHRHPVAADGRATGPAGKQLALSTSTESRGRTSGFQHGRINTPAAHASTTGDTASQSRSDHRNSARPRTRK

SEQ ID NO: 979815 - protein, 70 aa, Homo sapiens
HLTGVREIRDRIRRIQLETPHSSRFHRPPADNQSRLSENGISCLRRLIDTNKKRREKSYPRHIVTKSVVP

SEQ ID NO: 979816 - protein, 76 aa, Homo sapiens
YKTRYFNVCLTDVHMKEVIQQFIDVLSVARSRKVSGVYLRGECKTMDEEDERFVDTHQLCMSEMPRCCTCCVLGEH

SEQ ID NO: 979817 - protein, 70 aa, Homo sapiens
YIGFIPEICILATDPEFGVLGADTAVVDICDEWTMSPAEQLTDSVVRESHALSLFVYRLSGSNRRRGWNM

SEQ ID NO: 979818 - protein, 209 aa, Homo sapiens
MVCFRLFPVPGSGLVLVCLDPGSCAVLCMELNLKIQKNATCLYVKTWQMVLTVRYENYKMKNFKSCNHFSTTDTVTYEWKHVVGMIENGSQEIVQCSSRPGFSWIGEFYRRQPVYLIQGQRLICAYNTGDSTTFPDAEDKGILTVMNLLCHQNSIDMTLLDAIVYQLRNRLMLSSTTGMFLYHAFCPRMDGRPNEFLCGLRRNFQGGPT

SEQ ID NO: 979819 - protein, 98 aa, Homo sapiens
DSGSIFKTLGLWINPTDHSSSKNHLDRFFRRNSFSFITRGPFWKNIRDGLTSSRDARAKKNYCVRLAVTGGTQGRSKHGYHVTWYRMVRTVTKTTEGK

SEQ ID NO: 979820 - protein, 147 aa, Homo sapiens
IARSQKPEVSDVMHSVIAIYLKRSFIGYVIVVSSKIKVLRSHSSYTLESSLAAPYSGAKRIHEVQMNSRGEYIRSAIRPNTGAWTSVYTYARLDLGQIHNKKSYGKLPASYSLIRKPCGSNTKDARIGNGPSHLPNFLDTLDSPLHT

SEQ ID NO: 979821 - protein, 185 aa, Homo sapiens
ILESFSKTSEELKESCVFLWICFGLGKRKILCFIGVCVEGGSGSLRCTAECNVEVALQDQGGEGGRALEKIRLWRHFGKRDDVRVNGMMIWQQMVGGFRKIAPRCKLLVNQPLICWCIGGRWGGGIRGEEKSTHGRRCTLALWFKSSVANGSGLVERKREIDVERIGLRGPYCGGSIVVFKRTGI

SEQ ID NO: 979822 - protein, 284 aa, Homo sapiens
EPQIKKEAKPAISEKVQIHKQDIVKPEKTVSHGKPEEKVLKQVKAVTIEKTAKPKPTKKLNIEKENLHLEKQTNQNNPKGTSEVTESGTKKTEISEKEQYKKKQTGSILEKKKSQQEKNSLQLHNVTKAEKPARVSQDVEDVPASKKAKEGTEDVSPTKQKSPISFFQCVYCGWVQWYGFQFPFTPEKPGESSGQANSPGQKHQDRNTHVMTLQCFEDLTKGPFVPRVQAIEFAPESSANLSGGLEERAKVVAHTVKGQPKQEGAAGTGGEITPKGHLGRGHKG

SEQ ID NO: 979823 - protein, 109 aa, Homo sapiens
MVWSAAHTLVFEPPFWLRRCFSALEYRDGVVSVSAWDRCLPYGNSNPLTLVMCAELTMASHAATDLHCDQAWPLVVVVTGVCPWRECLDMKCMSAKCSMCTLSDYVTFV

SEQ ID NO: 979824 - protein, 136 aa, Homo sapiens
HDGEEVSDRVLFDTSDDEELREERDMHSIIVLVGNDEPRSSLEEQVMNDIGDLLQEVTVTMKMMITPRQADRLSMLSQEIQTLKRSSTGSYEERVKRLSGPELNEILEEIETAIKEYSEELVQQLALRDELELKRK

SEQ ID NO: 979825 - protein, 219 aa, Homo sapiens
DSGSIFKTLGCGSTQPPLLFQESFDRFFGRNSFSFEPTAFNEEQRVGCNRNRGEESWWLRMRCPRHRGTGMWSLEPGDRQCKPKSKKEIEALLALRIEFVLREECRMNSGRDFSCLMRTGDCPRLHLIARSVMVLSRLWARNRRPSAEVTERFWGKPGRMKSCIAKKMEFEQFLAMMRSISNEEGPGTYEELCEGLSVLDKEGLDIMGVNSAVSSHLVE

SEQ ID NO: 979826 - protein, 136 aa, Homo sapiens
GAIVCALGECRFDKIKVRIMDSEVQQMVGSLDGLMMLGERDKGSLHEGCPNTTEECLPELREERRVDLRDNRSKKGNEVDRLSLQYLDDNVSHRIVNCRSGPCLWLDFLKVQQMSAWCRLQCCQSFKNAFRVDTIR

SEQ ID NO: 979827 - protein, 125 aa, Homo sapiens
MSQHTFFDPPEEEPRFYNNSYSDLGHPEVLYLILPGFGIISDKVEGYYSRKKRNIDRYIGMVVELMISVGFRRGYRVSTTIYLREEIDVDSRGYVNFRDHNQSLIPSGVEEYLVDSMKIHGSNMK

SEQ ID NO: 979828 - protein, 180 aa, Homo sapiens
SKISIKKRARHHEIRIQKTASSSKVMKDANNLASEVENTEADLKKLHEKPVTDPEGVSDHELIVALNDYRPKPFAECAYQLRRKKYEKSKGQYHTHTLIDLELVFSYKEATGFTEYSEYHKSTSMHKSDTEEYTPHVWTFETPNVHQLTDRVCYARMQEWDRIYLERVMEAVQFLGQQTG

SEQ ID NO: 979829 - protein, 66 aa, Homo sapiens
FGSRSNPSVALAVASTIFENVIIEQGSECKILFTWRKQDAKAYDFCFTFRLRKNSCTRDWNHRNSF

SEQ ID NO: 979830 - protein, 62 aa, Homo sapiens
MTGESDSSSGRITEAGRFAMAPENLQHDDIPGGAFTGMHLGVKLVFTRTRRHDHEEVDAAAN

SEQ ID NO: 979831 - protein, 117 aa, Homo sapiens
FFFNLIYRRTEEGTEEKNGKTSRNKEKKEKRRKTTKLRRRTPKKERKDKEKREKERRRKKQKAKREKKKKQKEGKDEQETLNSKRQSLVNLSSLHNIGTEIPTLRLKCLNTQHIALI

SEQ ID NO: 979832 - protein, 71 aa, Homo sapiens
KLRTPVPVSFGTSPAAGSIITSPSSVTIITSPSSLFPSSPLPPPCFHHHLSLLPASFITSPSIISIITSPS

SEQ ID NO: 979833 - protein, 103 aa, Homo sapiens
VDVVSTKGGVGKTTIEANLGAFCADAGLRVLMIDLDPAQPSLSSYYQLVDEAQGGIYDLLAFNITESAKIISSTTIPNLSLVISNDINNQLNSLILQAPDGRL

SEQ ID NO: 979834 - protein, 85 aa, Homo sapiens
MRHEIRADTLPFGLEAFREAFAPIAEEFSMTWHITDTEQKKRVVLMASRESHCLADLLHRWHSDELDCEIACVISNHDDLRSMVE

SEQ ID NO: 979835 - protein, 107 aa, Homo sapiens
MGFHHVSRATLELLGSDRSTCLGFPKCRDYSHEPLCPTFSSFLTGLSCCWSLSLAILHLAVGVSSPKHRSPNTYSDKVQTSYQNMLQTLTPTICLMSDSLIDCPFYQ

SEQ ID NO: 979836 - protein, 31 aa, Homo sapiens
QVIACPQACGKQALLPPFGHESRTPAAPLSR

SEQ ID NO: 979837 - protein, 77 aa, Homo sapiens
AAGAVVLRDIDDGAREVLVVHRPSYDDLSLPKGKLEPGEDLPTTAVREVAEETGINIRLTMPLQPIVDAAANLVVVG

SEQ ID NO: 979838 - protein, 72 aa, Homo sapiens
ASVSARIQAFAEQAQFQLVETFAERLAQVLMSEFQIPWLHLKLTKPGAVPAAKGVGVEIERGCRYLRFTLVL

SEQ ID NO: 979839 - protein, 53 aa, Homo sapiens
MINYRATDLHIACRSGPAGNLIQINLDLAAQAMISGRYHRRCHRPRGRLPCLT

SEQ ID NO: 979840 - protein, 70 aa, Homo sapiens
MSTAAMSPPDEEQTVLHPPVQLRISGMTCAACATTIEKRLSRIDGVHASVNFASERATVTGMGVKDAIAA

SEQ ID NO: 979841 - protein, 80 aa, Homo sapiens
DFISRYETVSTSAGDRYDSLLSRSGLWAADAASWNSNLPLPDNLFKMTQQNTAFHSIGQFHVADYVNFFFEQKQVFICKQ

SEQ ID NO: 979842 - protein, 122 aa, Homo sapiens
LTGSMTLEEWKLRKSRDVRVNCSPGHRWRPEPSSLQGSGKGGLSSVLVLPSSGGWVPMAPGFVLLPRGLFSSRPPVTSRQGKSLCDYRVKVEGPCLRGFIPSGFRGVRQYTGTWCLDGQSHS

SEQ ID NO: 979843 - protein, 105 aa, Homo sapiens
PRGTKTGAQSWTVQTLADNLAGGTMRQAVRAALLAALLLLVQLCPGSSQRSPEAAGVQDPSLSCSPLVCYQLCWGPCAPLFSVVVLLVSRGARPIGTRYGRRAAA

SEQ ID NO: 979844 - protein, 85 aa, Homo sapiens
GFGDLFGNLYGASGARRTASRSPRRGADVEGETTISFDDAVSGTTVTMDMVISGTLPGMSGDWSSGWYRSASVDAAANLVVVGGR

SEQ ID NO: 979845 - protein, 143 aa, Homo sapiens
ATCRRVATEPTGDHTMSVLLGSGHGPGVSPEDAGTRVRGHQISQQPLRLEDSEGRYHDRQENDPCPTATHSQASSGGAVCVCHGDVDAPVPQGQSVYVTGMSVCTCYEDVGRVYGDMVACVSWGCVLGTRVHMCHGDVDAAAN

SEQ ID NO: 979846 - protein, 147 aa, Homo sapiens
KNKHTKGDAPKRTKKMKKTSHQTKRQETGKNDPESWSDPDKRKGARSRETVTGAEPQKDPQNRRKVKHALPPGRQEATFRFEPFRAQGAPPRGRTAQPRVLNPPVAPEVTKPTVTNPRAKKALTKAGARDATHHFQKPLQLNLATLS

SEQ ID NO: 979847 - protein, 119 aa, Homo sapiens
IRGRVDTALSGFVAVAAVAFFAMWSVLSNLLCAILIFTVGPFRLGDVVELVDTVDKPGVKGRVVAINLLYTTLIEVEEAGTGSVMVQVPNSLFFQRSVRLLARQRHTALTFGERSTRPR

SEQ ID NO: 979848 - protein, 131 aa, Homo sapiens
ALSLLRSLPRRARSGFGPESSERPQPPGAVPCAQPRGAWRVTLVQQAAAGPKGAPERAAELGVNFGRSRQASARGTNTHRYKASCKSFKYNSLLLKHQRIHKANKPYACHECDQRCHGWPASSQHHRIQTG

SEQ ID NO: 979849 - protein, 163 aa, Homo sapiens
ICRKLKLDPFLTPYTKINSRWIKKRGGGGQFQDGRIGTAPVYSSQCKLCRRQVISAFPTEVPGSSHWGLLDSGCSPPSVSRSRARHHLTWEAQGVREFPFLAKGSCDRWHLENRVTPTLILRFSKGLSKGHINRLYPVHDSEGTMSMEPRSLLRSQTALSNMS

SEQ ID NO: 979850 - protein, 76 aa, Homo sapiens
AASEVLVDSAEEGSLAAAAELAAHPPQQRLRKKQKLHLMRNEARKLNHQEVVEEDKRLKLPANWEATQSSFGVGTK

SEQ ID NO: 979851 - protein, 104 aa, Homo sapiens
GRFSSGGDPGQRDPGSEFFFRLHPDEVEALLRGWGQPRGQAHRAPPPHGKGQCHCLLFHLFLGGWSRLHPQKQWLGLKGRSLLLPFSFLQKQTEKKIKALYPKK

SEQ ID NO: 979852 - protein, 76 aa, Homo sapiens
VRGAQTMPPASPGLRVGWRIPESLRSPAEDMRLHNLLKMSFPNNVGPILLRVNSLSHERSDKIQGQRLIFFQNCLL

SEQ ID NO: 979853 - protein, 72 aa, Homo sapiens
TFSLIVPTTIPITRSSAFLNPNSLLIITIGTQLAQQLLRRHTLYLKAFWDSIFEPKLCPRETVTSCLSRRGR

SEQ ID NO: 979854 - protein, 73 aa, Homo sapiens
RDGESEETSEKNIQYAERRNRCEEKVKGIGKRGRNCECKMKKNEMNGKKTDKMVEEGKLRRQVSSLKGEGKEN

SEQ ID NO: 979855 - protein, 115 aa, Homo sapiens
MRGRVDPKTVKILEDNLTSTIQDIGTGKDFMMKMPKAIATKRKLTNEIMIKLKRFCTAKETINRVNRHPTEWEKIFANYASDKGLISSIKGIKQIYKKKTTPFKKWAKDAEQCRR

SEQ ID NO: 979856 - protein, 55 aa, Homo sapiens
DYKSDPITYLFKNPKYGPDAVVHAYNPSTLGGRGGRIYLSSGVRNQPDQHGETPS

SEQ ID NO: 979857 - protein, 68 aa, Homo sapiens
MGAIKHTKHSGFRQSLLDAPKEVMSEFLLRRGFEAVMVDALRVDHRDNMSYHSAFAGSVQPLCRRGRE

SEQ ID NO: 979858 - protein, 100 aa, Homo sapiens
TKFAAASTAQCENTFDALGRIRTQRDATGHLTRFTYLPGGVTVADDGQGHHSNTWISDARGRTVGIIDADGQRTSIRYDRYGNLVGATDRAGKVDAAANL

SEQ ID NO: 979859 - protein, 96 aa, Homo sapiens
SNCSRICSSCSPTCSSCFRICSSCFRICSSCFSICSSCSPICSSCFRICSSCSPICSSCSPICSSCFRICSSCFRICSSCSPICSSVDAAANLVVV

SEQ ID NO: 979860 - protein, 106 aa, Homo sapiens
IRGRVDLVMNCIGMHLSWGLDTVLVFWGEGGREDECRGHAKLVHNTGGGTETLIEEVGSSGNELSLFVNLRDISEGEGNVNSNNMFSFCHFLKGAGTASVSVDAAA

SEQ ID NO: 979861 - protein, 67 aa, Homo sapiens
VDYRQKLTLGVRGPELALGQVIAHMLSAIPTGGRLSLTCQQGHGTQEASVKAAAQDQWKLLDLAQSR

SEQ ID NO: 979862 - protein, 136 aa, Homo sapiens
AGLPPLDFFARGSTNVIFNSFVFVYVRRHMENHVCHPLAHSSLRYTRRGTLHPTHVPESSMCYRPNVRKVTPGSYGFHHFVNNTFYHTFTHNLGPQEIFGGIPVLWRSSTPQNGDICAPAGLPPIFLRSSRRGREF

SEQ ID NO: 979863 - protein, 162 aa, Homo sapiens
PKYLGTVFPSEVDTKLTITAAFGPHVIMRTVLGVHLKRSGNMNPFCTLESPVQPCMELGKAGPELSRETWWRRPRPALSLPGPGQVCVCPSSTLGGLQAAAEGIPWYLFHFSVHPYPPGLVEPMVILGFHIHEKRRFFFVFMLKLTPILLSHKINLMPSGKT

SEQ ID NO: 979864 - protein, 83 aa, Homo sapiens
AKAEAPAWMGSFPSSPAFGPGSRFGARDQPAWTVTSPLEPGLGDRQYLPPRRAPWAVPPCAWAGPAALEGALIFFNKSLCFAL

SEQ ID NO: 979865 - protein, 39 aa, Homo sapiens
PPQPLPPHRRGHVVWCVGRGEEEEGVKPREETGERHHTH

SEQ ID NO: 979866 - protein, 103 aa, Homo sapiens
GEQAEQGTSLKGPQVQGLEHQALVEFQEDIIQSLVKNSENTGKGLPDDRDLREQGGRTACHFGHAQKGQLHLQVGQLGQQLLLLLPAKISSLDLGQCCTSRDD

SEQ ID NO: 979867 - protein, 324 aa, Homo sapiens
PEPGARGPGVVTLLARRGGVRRPLGGRFPPTPAPGTRPAGPSPRPFQSERDALQFLLSLQLYIARCDCAPRWADQLTEEQIAEFKEAFSLFDQDGDGTITNKGTWNCHEVTESEPNRSCHCRIMITDVDADGHGTIDFREFLTMMARRMTRYRIVKKNIREAFRVYEQEDVKGYISAREISQYMTNQEKQLTDEDVDKMIRDADIDRHRKNKNEKSTRLNERQKRTHITSTVSVPRSTTAAQSTLRNFTMGRTQHRHKDHLYTVTISQRYVNITSVNTPLKLVGAALRQHDRTETDTSKPRPSVNVGHSPQAAVKRIQNAVTST

SEQ ID NO: 979868 - protein, 70 aa, Homo sapiens
MEYSLKGWIQHNKDENNKRKEGKAYQGIRNMSGKPEAQEERISTGDTQKEPTAETTASSDPGERQQAGTH

SEQ ID NO: 979869 - protein, 469 aa, Homo sapiens
MAECPTLVEADHLTTRDRHVGLVRMFDVYRTEKQPRHGCPITIEYKGYGYMLQGALAVEEDVVLGQAYETPTPDRPQSLLTYHVCSSTLMENNDPTDYQLFWRISDTTVNDLTADGQDNDYIETCMPTTDLSDHMGTNHDLPISDQPQGALGRPNETHAINHNMGTVLDEYVNGNNPYRAINNMPMDGPYTLQNHTDQGQSWELETMGTKKKKKGTAANKTESETLATADLDKGRSSNINATRTKQTRNATTHDHRESKYTQTSQQRQKTQGCPTGVKYPVYTSDKSINDCALIAAITTNTVMYDTDASIRSTVNLADVTVVLIVPNLIMTAEHSRKNTLSAVNIVRRDNLQSILVHLLEYDSGGSRLQVMTQTVKESTSEKQDWYRDHSMDNIPQSSDHETVRARSTNGPWYCATKRRRNNGTRASTADHPAAGRQQQPQSQAESPRKTLACQTSEAHTTPAKKRATT

SEQ ID NO: 979870 - protein, 307 aa, Homo sapiens
SSSNGSDGCCAVRGRGLCCVVAVSDHVNATRLLCSGSVRRMSTVWLLVLHPVERLVWCLLEMRDACAEDGTDIFQVRLTWCPKSSPWISQWTIQSIKLANRTTPRFLRWCHMGRTTSPQQNSRCPQSSIPLSPFDSPDRSHGIVDTPSLHCTTSIRDTTKTVSTGRSLQNETTGVKLLHLLITTLPAMEDTTSESVLKTTPRDYLRKMCLESRHAPNVIAYPANEFPLDPLHHHVNTPHNASYLPSTSATPLKNMAKPMHALSRDTSSVIHRTHRKSEKKMKDDVDAGSLSTHNYMHRKPHPLKGLT

SEQ ID NO: 979871 - protein, 279 aa, Homo sapiens
LKAQLGKEKTHINIVVIGHVDSGQVHHYWPSDYKCGGIAQKQPLKTFEKAAAEHGTMGSFKYAWDLGETDKLSVNVVSPLISPCGNKRHSKYYADYHRSPRHTRALYQKHDNREPSQGLTVLAPDSRQLECRVNLEDWISPKKMRARHPEHAWTSLCNTKNEMRKQTNLYEELTKKNYQPETHTYKHDRTLRGKRKTGKKATHITAQQGIESTETDQTKTETPHSPLDQEKRKTNTRTSADHKSTTTSTEEPKREKTTRTHTADRKQQNRPTGDRTDSQ

SEQ ID NO: 979872 - protein, 591 aa, Homo sapiens
DEDAYKKQFSTIHTSNSVTPDMHGRQHVIKQQLHSCIIRSRHPSLMHTSTARRHSTVTNSKQVRTSPLNIVTYASSTAGIAVSYQHSTAHSFLQQHQGRGLACSSYNPRQYFIMIYIQNYSDYTNTLIDTRPTTKRTTEQDNNTQHTQTREHTQTSRAREREDQHEETQDETHGATTKERTTHRPRTTHSENDQTTIQKRRKPTKSRGTTKQKKANRRNNTPHEYQQQTTPQTTDIPSTSTTNNHTRIITEKRDNDNKKEKTHVMRQRATKNRRKSKIDRKQNQDMAQTRTTKHRKREQTTEKDTSQKRRRRSRTKTQTNAEQPNTHNERVIKEHKNRRQRRSPTPATAKRRSARAQTKKLTGQKDNRGHGDTRRLRENRHRHEQTLMRTRHRRNRKEETEQEERITDQQQHNSTNHHTDDKERRGHDTIREEQQRQQATERAIDTEKGADTTQTTDEKRGDSAARDKAKAEQTKEPGKQDTKTDQQDRTRDKGSRAERSTARHTHSDHVKEAEEEAHEGERDETHRQCSEEHAEKQREMHKRKERAHNTTRERSERKRPKGTIGRADERRSAGDQREGDNADSTAGRARV

SEQ ID NO: 979873 - protein, 114 aa, Homo sapiens
MCVPEHGPTAKVTIIHMGRVVMLARKAERGSMGTARTVHILLVCMRGPPRTLPRAVYSRVELNRDCFPPPFSVLSCRFCCEPQEVVAAQSLRGAHVFLTVTTLTNARARTYPMH

SEQ ID NO: 979874 - protein, 279 aa, Homo sapiens
TARDVSLCCCVCVWFPCGVCANGVIDDTCLDACSCVLLDLCVLMCLQQLLMLRVAGLTRCCAALPHAVDVCDAAVLPLLCCHSVLADVMPALLRSVPKAFVCERLWLMCCTPHCDDLTVCCQPDGICDIDVPVRTLKVCRWFWACALCVSLCQRGWLALLVLVVGAFDGAAELLVVLSDPLIAWGTIQGHLWLAPDGGLDTKWSYKSLRPGYMDDRTAQGTMPGGRTQFGFRFLSLWPLEGLGGTYFSPRRQSAFYRDGTINSIERYTTLCSTTEICNW

SEQ ID NO: 979875 - protein, 412 aa, Homo sapiens
MAWSRSYEQRGSGLNREWGDKGGVAIGLWVEAKKDGAIYGADERKKIYEEYIRLIYAIVNNKGREKCLSKSKQAKPEGNSFPKRRTQQLEKRSVHELRDRCDESGGPGGEPEAWVLERNTGGVTPLGGAPNNRTKTIAMQRNLDGTLTQPFGAEQREQQHRNIDRKEQVRAPRTERQLNLAHEPGGRLNKARGAPEDTMGGNRSAQTQRGNPSKDWRNKTEQHKTGRRETYTTVRKAHEQRTHRTAEASEETIRGNEHRNSRPHTGTEQGRTQAGEARRGRLRQEGKHRTNKRDREGRTEGNAERKHGGEEQDTVADTVQQKQRETEDEKEEKQRRETRDGARAQNTTNGAEALKKDTEERNKDIENKERRKSKEKNTTNNRNKTQEDKHKKKQKRERLKTRTKRKQRREDE

SEQ ID NO: 979876 - protein, 121 aa, Homo sapiens
LHLMEKIYDGFMTFLNYLSAYGHSLAFYGGTSLFVEYISDGRMDRQKQLSKLGHNSQKPHFHGSSLQGVDIVATLLSKSPDSPQCEGKLYRVAQRPAKSRVLCKRTSQLRITTVATLSSAH

SEQ ID NO: 979877 - protein, 278 aa, Homo sapiens
TTEELLGSICPVALVIVEARELPIAGDAEGRFWGGCWRLQLPPFRTKVPLTLQSTHPRVPPRLGGTVGIRRFSVAKERVSLYSRALAGSMAPGTRTLGGGRMSVGQDRSSSCRRKGRGTDSEGANSLPTGLAETPNPAVTAEGPRCMAAPWMPHGGSGDKENVIRSLARVAANQRTVGVTQCQAGLMVRQRLTQEVGHILGVTSEMWRAGRQVGFRAFVDLLGSAMVVKHRGSPDHPGSSGLTARSPDGGAQPEAQRNCPRLRKPKFFWLGGAGEHDA

SEQ ID NO: 979878 - protein, 161 aa, Homo sapiens
MVDGSSPTDIRGILRETVEEVTLSHTESVAIGLLVIQGLLISTQTIVVTLVHTGIVARNRTNEDHAPIALSRWIVAKVNCTTGGGDESCVPVRGSSSAVELVEIPKTYRSVWDEGLSPAILDQRDCDLFGKTRDSQMGERERGIGMQSKRYRGRPELSGSS

SEQ ID NO: 979879 - protein, 136 aa, Homo sapiens
MGMGTATSLEWSASRDAMSMTHGTLHEDGGTRALCIAQWVEVPVHTQGHTPKNTNRVRNEQRRWRAPGAVDRPEYPTNTTKVTDHQTKLEDDPRRQRDVQCNNTTVAAKSRVGPPNEPKVDDGSQRRCKCTQAAAT

SEQ ID NO: 979880 - protein, 150 aa, Homo sapiens
FCAMGGVGNVGGVRWSGVVNVACPCTVGGPVGGLILGCGRGPPLQHCVSTGASLCEEASCVTAVACERPSREFSLSPLTAPENTADISQKRVESVPTLWALSVMLWVLPLSLCGTRGGVVSEEVPRECDDNPSHRLIRRESLCGGGRRKV

SEQ ID NO: 979881 - protein, 126 aa, Homo sapiens
MRPACVAKDPRKTRLPGRYTSRQTRSGPSDTRTQCARMEPRRTSEYEYVGIEAEYRDGRDPSHDRARVESEREVVHVESYGDGSRGTHNQVTVTPVCSRRGHLIRGNLDVILREGERRGIKALLNR

SEQ ID NO: 979882 - protein, 310 aa, Homo sapiens
AGAPTPSPLPSCGALHDEGLSSFVTCQSEDPHGGPPSCPLDNINAPTRPCPSHHASLGTGALGGGCPSAAPGATCTARQDQDTFTVYITARWQNMPVAGRHMEPLEEDGQPPGAKAGGTRITTNVLNCPPHSGQNTLAEKTIEVTKSACPRHGPLHLGAWRDQTLQEAKSYRDLKMKDSRKSRQLKDVNDAGWATLDHKVPRSRAVEDGPQLWKPTEPTISNLNAHTMSQWELNPLWSGSTKQFYNTYRGLNQSFTNYPFHKERVTKRCHKAQWDKVKFITLVKRRKMEIAQKWVKNNWCDVKKGYIIKA

SEQ ID NO: 979883 - protein, 307 aa, Homo sapiens
MVEAVCRYPGTVLLPLLLRGDSSRACRNYYLSLDDCESAILSRRLSPEETRDATEKWFCARSRSSLQDQMPAMRLEALWTKHPVHCWRHGITEIFAYLAILLMSTHVRMNPPAISHPGVSHGCQNGRGPLMSRRDKRALRSRTAATGPESPVVASHHAAGHRAATKASHAGRDHPAARRRLSLRPPASPRPVLLWSPALRTYGVAPGGATAWNAIITQLLNQVEKHRAPHPAIKEKSQGSPTARHEEHVVWIKCLCAGETAGGVLGVLVPGPSVFRLKSPAEIGEGSPGGFRPPDNVCGPTKRWSHK

SEQ ID NO: 979884 - protein, 195 aa, Homo sapiens
MRGGERERPLSMSGKRVARDEHADTRARGAERETHKVKRRGTNIQQEREEREEERESVGAAEKRGGGREGGPSQKERPCGAREREESRHQREESNREQHRGGERAQDDAIPSDGELVRAPGLCRQKGGPHKRKINEGEDDTEGEVKHNRKTGTLAANEGMRVQTKRAACKAGANIQGTQTEREESNPQRERERAK

SEQ ID NO: 979885 - protein, 125 aa, Homo sapiens
WQLLPVTLWPEVELLVTVLELLEVADALPVLLMLPGAMLRCAACDAVLLLTVLCCAVLCCAASDAIPDVGVLKSPVHAYGHAPGAKKMCDAAPQVAVPVKAPPERSTCTADGQLGEHSEKGKGCP

SEQ ID NO: 979886 - protein, 226 aa, Homo sapiens
MPHCYDEVCDGKLQVNGWVHTLQMVSSLQLGPWSLEVASILQVYSCRPPWNSDTRLQLPSAIYEDCIQSLSVKSGRGAQVQALLVRTVPGYRLWRSHRYSEREVIGRKGLVSMDIVTVLYAEGRLHRVSCDACEDDRLAPRTLDLGCWAVRALRPGAMGPTLGMLGPQFCPVAVSQAGSPVARRAPGKPPGQTKAPLADGEDWAGGTAWGGRSLEGSQRVRRVTPG

SEQ ID NO: 979887 - protein, 217 aa, Homo sapiens
NRKRTKKITVRDAETKPDPQCTHESGKGQYPVIAKLPCAGLLGHRSIPYRALASSSGFHPISDDSTLSSAQLYRPSLCAPQGLRTVAHHCLAAFPGASLYSSHWPRSVGCGAFRFQNSPWLIIQSVPSYPPGLHMCWWKEGMMHGAADLELGLPVWPTCLSVHRPVMPVRKCVRQLAVMQGANVRRKSAEGELHSWVVQMVATPSGEEPKATLCAGK

SEQ ID NO: 979888 - protein, 259 aa, Homo sapiens
QAAGKMGDFQNVSGALPKAADHLSKQEEGSVRGRKRGKEKASRRLLQETLRLVGFKNTQREAIVEGHLTCDRENVPLSAWSKWCSILEGAESLFVAGGVHQELKVVQKRTQCGHSARENLFVRLTFAQSSHTRFSREEAPKETTCVLWYHLCFRVASRGEASPKKLRVLTPMRFHECGRPKCGREALVRRPRHEVGDIYKRVPLKSGSHPRGAVSRDHPKKKTSSPDRKGFSVRGGVGPAIFCGPPGFPPPKKMLGQHT

SEQ ID NO: 979889 - protein, 119 aa, Homo sapiens
MSALYATLVDLSRRTGMIWAKGGFFSISKGASYTKCYVGPVSNNFSVNFYGTSVIRESPGYGFWVQVELEPVYSEKDSNHQIESKSFEKKDHFVKASKDVTEFNKKAEYSIARLFARTG

SEQ ID NO: 979890 - protein, 318 aa, Homo sapiens
ERLDVFAWVPAAAATSSDLSASIAASLMLLTVLARVLGAAFQPHTPRCCSSTSRKGSSLRHRSASGAAQCSSGTAGAAGASLGGAAPDEADRTPLTRLACASARHRPPVSHPGRPWLIVSLAAVGSRRQRLSFPQPALRDRLAPEPVGEALLEFPLFSPFPHLFLSLPVPEPNRCRASVIAGPWCVGVHSEKDLDFGPLLEPGVPESAGVCAPLSVPSGVPPRVGIGHRRSFFVAALAENYLRMEHPFGEVSPLSGPIVLYPVLGAQELFTVFMTVVDLCSLFLGGSRLGPKKTFSVGGSGCLAVVVFTYWAHFRACS

SEQ ID NO: 979891 - protein, 235 aa, Homo sapiens
MVSLVGAPYPTCRSGQPSLCQAQSIRVPGAVFLSSPPEVVFSRVPQRGEVRHSRRSFFVCVGTPLLEVGRTRPTFQGGYWGALFPHHGSRGAWGRSLTGGRAAQVPPLVVVPREGLVSPGGLFLYEGPGRRAFGCSGAPNCDVLGEPPSHRGADHPRSSSLVLSYGNCGGLVPHGVFALGGDAWLLCCYMFPRIRKIVNRPRSLSLLWPTDERDADTLCVWCPPRQYVVVSAVVA

SEQ ID NO: 979892 - protein, 71 aa, Homo sapiens
MREHEVPVHLLITRRNDEQRTLDAKTEGNNCPSSAPLREKPHPNAPSQPYQALGQHPLQFPLGGPHAAPSC

SEQ ID NO: 979893 - protein, 173 aa, Homo sapiens
MPKSSRRLVETNNVPNTYVTEWHVVSRRLVTRMKETSCAWRSFLPGIAYQTEEYPGISVITFICPRRLCLSSYAVLRPETVHASAVNGSGGCRDLTDSLTTRGRLVQKIPSRTECCVDLVARTEDLDVWGCLSKPNSSLEADLVVDVVSHLSKIGEDSFALNKLTANKKGADR

SEQ ID NO: 979894 - protein, 181 aa, Homo sapiens
MTAAITCLLALTATIFQCGCTAAWMACQEVARPAVGVRGRDIVVLGVEKKSVAKLQDDQQLLERSCALDDNVCMASCSALTRRIRKARSVNMCAQVLDVARCHLADCGRTLVTVEYITLLHRQSEAAVIRRAIGLQADLASLALIVGIDFDGTPRLYQTEPSGTYHAWIANDIGLGAKSVQ

SEQ ID NO: 979895 - protein, 137 aa, Homo sapiens
CHELDVLVPGTGGACGPIGSALHLSGSEMLLALARVPCGSGWHAAGVTGCGLQLCHLLSCCCCLLLLLATGLALGLGCLPQPVTQCVLLPPCALAYVCRACWWPALLGCLASWGQAPQGQLGLQCPMLELGSTDNDL

SEQ ID NO: 979896 - protein, 140 aa, Homo sapiens
VQEPQDRSESPLLLLRSRAELSRSNGLSHQVSPGCWSEPIEHGRDLEVSGELKHPSIITQQGIPEVPEKSLADSKKQELLHRVDEWSTWRKRDLGIINHSNTVIALSSHEPVTTGRDKSTDQTMEQIDFPMQEQEMLIPP

SEQ ID NO: 979897 - protein, 261 aa, Homo sapiens
MSNNTVGAGHQDPGESHDVWIWTSAAASTSPPSSADVAQQRNCEDMIQMFQKKLGPIHGCGLEAWSCKADRLTDGHLPVLESDVVPLTSPDGDEDGEHRPQESTRQMQRMLKQLREYDYEDECDRLTWEETEENLLFEEDNSGYAMAKMQRPMGEQQVKIAMEKGDYKDNEKSHDQKPRRRRYQEMTIEQIELEIGQCKERNDTEMQEYMDDVKMKLMALDSARLAELADKIISQICKTEQYAMTAMTDPKKEQTTTDKQA

SEQ ID NO: 979898 - protein, 290 aa, Homo sapiens
MAPSRNGMVLNAPLPQWTWQLAAVAHCGSTMPGPVRILHDCNVALCNANGCCLQSAPVPLLIWSPSPVPSLLLHCPHWILSTHTDSVLLPVPAGVIRPWDGKLMWIEPGRLHNERVGPVTHSGSFLLDPWTEGCETNVSNWMIHLTCAHTVARASLTLEYTGYQDLNPSLRPSELPIVDTPRKVADQFLGLTDIDNLGPTPWLTLDPVVIALSRERVSLKHRETQLDVHHLKERTNEFQKWPIDYVLAYWALLPNAPDFSRAITVPKEMHANGKARQEPRDCFENYAHTH

SEQ ID NO: 979899 - protein, 77 aa, Homo sapiens
VVVLVCLSHPDAILVGAKCHRLLVAGKTEQMTLRGTLKEPQWLGNPDRYYPAVPGQDPLRLSEIKTIILMEHLSTVE

SEQ ID NO: 979900 - protein, 551 aa, Homo sapiens
MATVRSNAAMGLSGAYTHERSKPPDGDWKARIDTTLSPTVKKSFRGAMIGRVMSSHLDERRYYQRTAHTIRMDTLTVQGRGRGREGDDEIRRNDQFQLCSREVVLNVACGIPGGEIYSDEIELPGNHLTRGNMSLKALYVGTSTGAVSWSKIASAELQYTKTREARLRGHGEICNTAHLFHPRGNPVLIGNTFVVSCVGGRSGLGSLESCSTTFAETYLWGEFHKRQSTFGTRHTEEHLDSQKEVPHSQKGFHVCARDAMKHRDVPNRVEQCGAYMGRAPQKREEGYPSAWHHEGRIPRGDEKRGADNLSGARERTTGIDNKRARDPTVLVRQVVRAWIRNDGPRGVKPLGGKAQSEELSGGSKNSATGQSNWISGNGSHRNCGGTPKRGESTQQGPYTNEGELTHTNKETMMWRHHNSKKGKAEAHHEPQSKPTAGQAALQPNSDEAPGNTGGATAQSPGNTKEETMTNRKRDNTPRCRQHGANHNQPSNSANNHQHAQIITHSSGPPVYHPHINETRHERRASLDNAAPTKTTNTPILTKNTTHTTDEE

SEQ ID NO: 979901 - protein, 275 aa, Homo sapiens
GLGGPASPPVPPALPNAAVSILEEPQNRTSAYSLEHADLGAGYYRKYFYGKEHQNFFGMDESLWPWWHVSLRREEKEGSGGGTLHSYRVIVLDHAAPDTPWYHLGGRAAAGPHGVCPQGNFWSTVAPQTEPQLPAPGLSFTQGTTGRCSHWMSKLLSFQRKVGILYCLGGQGSEEEMYNNQEAGPAFMQFLTLLGECGAGSKRFERFTGAKVGHHNRDSTETPHSPLQPHTRTTEDHVPRCPTMLALKHLKKTSQEGPSAKGHQWGTGNWGPYRV

SEQ ID NO: 979902 - protein, 555 aa, Homo sapiens
GALSPVLGPLSVPVGAGVLCALPPPRGCPACPVNVLMPLAACGACDLGLCGACAVLCVWMLAAVSVHQSPMVCPGNALVCCRPPVHYVSTLQSMQVFDVCLCVWADAPGQLPVHATLPDLNLCKSTTAVSQALFAACPACVSSIVALGLMVHGGQCAFGCYRLLLLRFVPGLWARHFTADHTQVPFLEVWTPGEETLSEHGCGPNWMCMDICSQPYLFGAERPLGDHRQSGCQTRQMALGIVVWCPRGPWWLDCGRGCPKLCPFDCTGSLVCVMHVEQPPKDPPWRLLTAKTIFLFGPPVYGALKRLESRRWGLPAQGFPLVGLHEIPTKGVGFIRYSLGALTLVTEGVTGHRLNQSVDHGHRWFRPKWHATEQWQFVGLARFGTEVPHVVRPFGFGELAPRPDTLEKFGQGSIFGDLSWRPRCYLFPFLDHWDESPKPLRFGPIWAQMVALTPRVLYSIKGTIGSPLWRHVETKEPHDPLCGYGMREDEPTGYARSAEDCVSLMEMRKHGSTDTRKRALPYVITLRSKRNVWLVRLRLTLKEVTCSACHVGMHA

SEQ ID NO: 979903 - protein, 244 aa, Homo sapiens
CGNLSAVTGDQMTLVAIAVHLDFSCAIRQFHVSGAGSRCWTGSHQRKIGSSCCTVGSADRLTVLYQVRLPVTFDLPMRPVIGEVTYGVSQIDPRSFNGSISPQIPQHSPDCDISQEDLIVLLLTDVLSTEQLLITIHRTIARYRLQPGTFARSPIRTVVCRLIGRRINLIERDTASMSIPSLKLTLHDNPATLTDELLRSGKALVLTRKLGCDLERFRNRLVTTANEGASDGHLEGTVRSATSL

SEQ ID NO: 979904 - protein, 140 aa, Homo sapiens
MHTHALAGLTLPVRTCAPQVSTYKPKLLRQMWDSLRSLPGLAPFETCDPSFVHHSARCPLFSFGGHLWDRFRLVVANSQFEQQVNTFSKLSRLRFDTGCLNSLVNHFLRPKRNPLGEHDPNLAKCGLWYLRRGESPTPIV

SEQ ID NO: 979905 - protein, 340 aa, Homo sapiens
GHASSPAPVVQKHPAMWHSINSNSSMHSMHASMAAWRMAAWQPNLGTQHSTAQHSTAQQAQQQAPNISSNTSTAPLQIYQSCSTLSSFTVLVIFPNSAPKHIAHNHRTTRHHTQHVACTRSIACGPSTLTTDATAHTRHTAIFRHSKGPQWAKPAIFGHMQYDTAGTALAQTQTDQFCHAQGIEAPYHPLFNIRQALGASRKRLPMTGKLGTTQLTNSKRHQSLGDNTQRCRGTSQPGYSHTPTTWVYTPSSYTRQSEFGGHLAPTWPRAGTVGDTIMNAHYTMEATRFAHRFQTHITLMGMRHWTRQLYSYVIRPKKGVPGGYGTYDHTLHRINYQPKR

SEQ ID NO: 979906 - protein, 241 aa, Homo sapiens
MPRMAVMAPRTLLLLLLWGPGPDQTWAGSHSMRYFTTSCVPGPAGGAPLHRRGLRGRHACTCGLTATPRARGMEPLGTVDRAGGAGVLGPADTECEGPVTDLNRANLGDPARLLQPERGRILTTIQMMSGCDVGSGTGCFLRGYLAGRLLTGRGLHRLERGLRSWTAVDMAVRSPRQVGGWPCGEQLRDYLEGHVLWSGPRYLGERGRRRCKATGQHPRRVLTHQRLTLDTMRATLRVLGA

SEQ ID NO: 979907 - protein, 61 aa, Homo sapiens
MAGDGATQQNTNATEAHKQHPNDRHTTTKDGKPTHTAGPEAANENNTTTKHKHTPPKNHKN

SEQ ID NO: 979908 - protein, 118 aa, Homo sapiens
VVIRGAAAARGVSARVFQIRGAAGRSLYLGEKQIQKYTRLTIPKISVIDTWCHMNQTYRTYTSVHEKVDSELACGRRWGLKHVDMLDVWTDAGSGYENVEESMEQHRLFRSIMAFKGT

SEQ ID NO: 979909 - protein, 120 aa, Homo sapiens
GILGTLDKRAKRGQRKPYHKKRKYELGLPSANTKIGPPPHPPQSVWREVHEYVPEVGTWGNIFLPLWGASRQVVVYTSVKNNELIQMLSYNCDLITSWFVPMTLVKEIGDRLLQIPGNHR

SEQ ID NO: 979910 - protein, 145 aa, Homo sapiens
GTCETVSEESNVLCSSPQHTVYMRRGFPEAGEDIDQGEVSALSEQLKACGLRYCAEKYEWDVAEARKIWCFGPEDRPNILTDITKGVQYLNEIKGQCGGRIPVVATKELAHCVRENMRGVRFDVHDVTLHADAIHLWSGGQIIPT

SEQ ID NO: 979911 - protein, 345 aa, Homo sapiens
SLSPSEQVNSEHKGASAKTGGSYQDQCTMTDRMRSGVTGVAMSVGPRSVDRIAELDMAEAERQLVRARHLGLSVVATCEQLLMLYIKHSIEHEVTQEFSSEKHDVLTDRKAALECQGPEGQSAMGLIGAAPGRSRKLMSRTVGTHEAARGGHKQRLLVCPPDSGDGHYYSAAECLGKTREVKQSYERNRREDKGQDKASTADEHTDTIQKEGTKSRKPQQSKKNKNLTPVAASGTGARDTRRAKEKGKDTEKTHATASRDIEQTKEQQHVRETKNTTRQQKHEHKAHKATGTKTEPNPQSGTEKRPDDERQGTAETQEKERPRHHHKLNRNEPPIKRENHNNREQ

SEQ ID NO: 979912 - protein, 141 aa, Homo sapiens
QVIGAKLLKKEINFETRRNEVTGFGQTAKLNNDDTNADSPTTATDTHTRQQERLTDDTTRREELDTTTLVDRHDDDLNENNRHDTKRRRLNSYDNDDTHRTHDDDTLTVTRHTRDKGNCGTLPYNNHVGRNTLSERSWNCD

SEQ ID NO: 979913 - protein, 333 aa, Homo sapiens
EKGSEEDDDDELKTMLTSEAPNALTIYVTVTHACADERQCSTPCAAMAIISGPMNSVYQAIDIDSNMHVGLCMPHCRHMVHEAMRRQTTVTLTVTECDSHTTADNMSLTDTPGRTHEPNRTDGATGIDHQSVTTLDARDPDGETADGNQEITKADAFPSPGGLHTTKEAPRYQLNHLNSLSFADPMRKAAISYITRQAHEPPSCRNHNSGHNANRPKNPVGTEQAGNLPPKHARTAGQETGEWSPKAQRPTNHQRHKTTIPLNPGTSRKHPQPPQTPQQTQQNKQKEPKQNTTHTKPRQTKDKITTPRQKRSNEHNQTKTNKTTRKKGHRKTN

SEQ ID NO: 979914 - protein, 72 aa, Homo sapiens
RGGHLFWPCLSLGHLECVIQSVKLLKSQESSGSLQKEDLIIMSLSSKLEYPNVIRFVLVINSSHKNPSVFEL

SEQ ID NO: 979915 - protein, 124 aa, Homo sapiens
MAIPNAYRTKNSRLYTSYAKAPNVVAPTGYYNPSRDAIKLFTKEPLKPGTITITLYIDRPDLSSQRRSSTMNPPPQPEAPVVNLNLGLLFIALATVYPSRVLKSSDQGEHQRSNYALTRRTCEQ

SEQ ID NO: 979916 - protein, 145 aa, Homo sapiens
MDRTWRRPFTTYPMLALQVVHIIVDVGATAVQDGRSSHVASWMHERSVSGGTHCTWEADAMLKEWPLPTQRLERFSGSISLVCTAWELRLPVPALRLLGMGEPPDVGGPRTGGAGTIPDGGHGLASSLAGKPPVWLPPRDGVQHL

SEQ ID NO: 979917 - protein, 146 aa, Homo sapiens
MARNQSETARKSYRWWKLRPGRNSLATKGDQEKRSLYRRGEEASSATKALGPWRFERFVGYQKSTEHDSSWKLSFQRLVREIAAGFHKPPEVSERSHRCAARRLAKRTWVGLFEDTNLCAIHAIDESPSCPKTSSWLAGYGERELK

SEQ ID NO: 979918 - protein, 199 aa, Homo sapiens
MRTEHKSANCVVPGYLDLGWLLLLLRDMGRVTPSQVVGRGLWVKVCRKGPLVVAPMIPMRCHALAVTRNISIFPAFLEALYGKPTRGVICPGPCTHLGGGITKYQGVLRESRETGYLPRANKWGETPAHKPCPREKTRLQGLNAGGDKAVWNGPGQVVLTQFLPRGIAAPKGAKSKPYDDHRPHADTPTTGTLTHGTLD

SEQ ID NO: 979919 - protein, 305 aa, Homo sapiens
VSAALRCGRRAMVVWIEPGPAGAPSREVRGSERRAEATGLGLADWGVGRGVQETMSRTRWRVACVLVARPGSAFASFCLLGYMAPLSTSTPGSSTAAGATCKVCLCSLALQVLWGALTPRVGLLPLEPVYWLVDNVIRGLEWLYVVLVICADGLHCSYRLPVCPASHPPNYSVPRSAGISSISHWNLILDCLPLLPGITTPLVPTPSGRNDIGHRLPSVRGAFTPSQPEHDNDASGTAMEVGNLFREAYAGIGKLKQSDRTNYGVPPNFTINHHHFPFGKVPQKFVTWAWPLGFLVHRLGSTPRE

SEQ ID NO: 979920 - protein, 158 aa, Homo sapiens
PSESRPDYSTPYGHTPRWAQGTLPVVPSFQQSETQQYTTLSYSCGRLLHPQPEHAATGGVWVHVRSRGLAAHTLYQHPTYTTYMINHPHHTPTDQHNKTTQRRTAHIQPPHRITRTQQAQAATHSAALHTGATRARQTSHSNQPPPKNNEPQPHHEYP

SEQ ID NO: 979921 - protein, 317 aa, Homo sapiens
EQVNSVADQLTGLKKASHARSDSRSISDSENLDVVMACTSTERKCLGMLAGMAMQQGSLHASGCEEDGGSTVKCPTLQGLHHLPSMANDCDMPGREGKTWYLDDDPSAASRGLGHVELVVRLERCTRTRERMCLLLRWNDGAEVIRRCSEEGTMADPGILTVLYSKLHRRLLGMGGLNEGRSSRGHTHFPAGEYTGEAVDAGMLQPRDDWADAMNLRSQLALRTSSGCGDLARYVVPRRMARKGAGDGSDRRGRWQSGWGLSAKTCRISLFSLKLRWLDRQTQKLPFQTRRSFQHVWGLWKFAFGAPARPNPSFTRV

SEQ ID NO: 979922 - protein, 140 aa, Homo sapiens
MYPFLQLAGGLDCYYYSWLWQRAMNPGDDREKKLADLVARRRVKSQREEFALKVKRRETTCLIEASRALVGQASDTYILSSVRGVPGMLATTLLVQAWCKSSNSRWEGDECVGSTQRNSHLQPEVTWDHAGSIHTGLMTI

SEQ ID NO: 979923 - protein, 108 aa, Homo sapiens
IRWGEGRSPMNYTCAFRETKMIHGQNYNVAILILSREPVLGHHLRSNIVCSASLRDHRDRWYKMASGAHAVPSASAHTSTRLSYTALRVDVTEMACESRHTRAWRDVC

SEQ ID NO: 979924 - protein, 232 aa, Homo sapiens
AEPGTSGRVGENKRLTKGGRKGARDGTRGLIQFSYEHDWYDCRNAAVSMWQVYMNHTWKMTARHPWTHTVTRIACFLNVSRRVGGGVEDEILDLHLAWNAVKLAFKHKSYYACMDESMYRGKNCLTNFHGMDLTRDNNRVPCVKRQGRQGLEAHVDVKTTDGYLLRAVLVLVLLKKAQQSDTEGPLMLSTKQVRQIRKKMLDIMTREVQTNDLKEVVNKLIPDSIGRDIDKG

SEQ ID NO: 979925 - protein, 149 aa, Homo sapiens
MSKRHEKGGWNREKHSGGDPHGKPYGGTPSGGGNTAQEAPTTDAKKGYYVSGEGDKLRRPFNTGGEQANGGDIHTKEEETFVKNEGRAPEKKGGGGGSHPKATAPKRVILREDGYPKEGAPVVFRTTGDTKGRHTFSVDHTHEKRGGRQ

SEQ ID NO: 979926 - protein, 157 aa, Homo sapiens
ETRSHSVTQGGCSDEFTVHCSLNRGSSDPLTSASQVFVPPRHKKLCPANFWYLVFLVETGFRQCWARRVSNTVGSTLIRRASASQSAGITGCEPPVLNQVYIFKLVKLGIDGIIYSKCNQCAIFFKGKLKHLLKKKKEKPLEGHLYCWGARRTKEGN

SEQ ID NO: 979927 - protein, 426 aa, Homo sapiens
MHMVLDGHCRDYYMSVIVVRGTHEGPLSQLQSGCIRDCCRERKGLDPVTRGQTPKGLERLVREYELHGMPRSAYAYVGSARLSKLRKTIWALDTRVSYVLRINMVTYSLTPSGEALVVQVCGLRETGRGVYDTVPRCKKGRGKVGEKRHMEGRLRKKEREEANAGATRSARQWPMARLKPFVRPLELALESRRCGRRSPTRKGLSTLEPRGISAHGNGGRHPGGEGQVHGGGPPLTRKTGRNNRGSSKNEFTAPRSQGANNTLGTHVREMPPWVQARIIYILTKHPKWENKAPCVPLEDLMNNPSHEKKFPRGANLRQEENSANKRKNSVRRSKCKQHLSPPGTTQTNGGRTKYSAAWDRHDTREKSYSSTTGACTKKTNKAGGDKNACCRHNATKVSNEQKSRTYRKNKLPRYEIRKPPLYHLTV

SEQ ID NO: 979928 - protein, 269 aa, Homo sapiens
MVGPSNITGGHRNVLPVVHEATPNRGCCELYEGALGAHSSFEREPGERDEKTVSILRGTWALTHGSDYVANRKDGRCGMCNKLVALLATLEEPRRAWRLPHGPSTQITLGDRLKERVGYQRMDACNTTGPWRAGQSILTQGPERSALRRWSRTRKTSIREGVRGPRTIILLRPDRPRGCSPGTNNDERRASGAPLATRKATRDPTAGGPHSNAPRAEKRDLTQEDGSQENERRTPKKGTREPPEEREEGGHTGEEQRAYSASSTQRGRT

SEQ ID NO: 979929 - protein, 337 aa, Homo sapiens
EATEGLGVVSESFTLVPRLECNGAILVSSRPSGSQVYKWWSHLRSPRDSWDYKDDAAWEELHREGASYSYHEKEEGLERVFWAYGTQDHSDMSRGCPWKDFRLLCALPLHALPTDPVVDPRWCTCMSGEAILLSCILQQEEGDSAGEMKAYGEAVGAPGGEEQKELQRAVSQDHVRGFLDEGVGYRETGPQAFHSKGLSGTSPDDVQAVPVWVLQVKDWTNVLPRFWIPSLTPEDKGQQAGEASRTVDCPCRRALRMWTDAVDLTRYQLVDGWVITGARLRVCGPELRRTLGGVGLGWYLDVERRGLGLWNHEKSRDGRPQKEREGGNRDNTRGPIC

SEQ ID NO: 979930 - protein, 143 aa, Homo sapiens
AKADRKSAPSYRGGLKKPHRYSPKTVGAFPSRFVVVRKFVVEAAQSVKLLFPVVLVRDIAQGILKKPDPEVSSSCSDTDPVLLARRRQSNAGTLDVDRRCRIYQKLVCSNPNALSRSPINARNGTNPMLVLSRRYYAREKRSC

SEQ ID NO: 979931 - protein, 109 aa, Homo sapiens
MRTGRHVCGVLCSPAEPESRKWKHVEPCRRSVRAAGKKTRSGRDDVITSLASGKHTSSVISSCAPSKSEGNNLILARSHELERAAGAFALGVIKPARGICLAPEEQKSP

SEQ ID NO: 979932 - protein, 103 aa, Homo sapiens
CSRRRRPVSSRVLLPDARLSHCLRGSGRLAPHTNQRRYLEFLQHGQDKTRTKCKQSELRSTRTLDELSEECQKKGGNTCCVNRTQDTSKNARSRTYIRGSKSE

SEQ ID NO: 979933 - protein, 157 aa, Homo sapiens
HLTSVSSQVDYCFSRVPLTKRSSCVRMIFVLAYFERDRSMSDSERQMMLLCCTALQDERCCTATSSGSYVVAGMAVRGSPQPLHSFVLGGRGSIGPDRFYRLRRQFPQPLLARTRSQVMPKLDASAEEQRPLGVRLLSGPPDLDYCQDHASEMFRNR

SEQ ID NO: 979934 - protein, 194 aa, Homo sapiens
MGLIRCDLKCEGHFDWRRYRLTSLAISRRVASFLMSDTSRGWQREKCEIRKLLKTIAVADIALGIGDDSFISGLCSRCCIRKWVKTLINTGWYNLGKVADDKTGDGEIMNGPGGMRTRRTDSPGGGASRRVAFTPGVRQLCANEGENIVRWSLSVAHGGTIEQGRCKATLDVEKYQRREYRKQSEKNTPEKRAE

SEQ ID NO: 979935 - protein, 305 aa, Homo sapiens
SSSAAPPSRCSGRVSPAPCLVGLYLDVARPEPPDPGWSRCQSAEVSWCLPAGAEGGVGRVMSHCGGHRTPWLESWNERLRTSVQKLGFWCEYQTLTTETGVTPSQSFEADRQDIIVRFTVLGMVAIRSPSSEALTMAYDAKQWILRLRKYPEYGDNGHQYIKPGKGMWIKYHGKPTNISYSLRLRVALEEHPVLLTEAPLNPKGNREKMTQIMLRPSTPRHVRGHPGVLSSTPLGRTLALYVASGDGVTHTVPIYEGTPSPGQSCVWSLVSGLNDTLKIFNERGTGSPTEASGTRGDSRKVCRAG

SEQ ID NO: 979936 - protein, 194 aa, Homo sapiens
KSCERRAGAGERKRGAGPGPGDGSPAPGPVCVLVLLGPRVLSAPRVSVSNDYLYFQVLQVLGTFRYIFKAKTCQGNLGVGIFHTKGMTQGFHLCSPPFETFTKRPCGGNLQTKRVLFTSKGPKIGLWLQARGGGLASLSSPKNSGVCPQGSHGGRAAGWIQFFVDKPQGLDHLDQASLTGGGLIQGQVTPRRHE

SEQ ID NO: 979937 - protein, 112 aa, Homo sapiens
MGLTPSVRKMVVSVTQAGLQGRNLDPCWLLTSGDSGSSPDSSLRRVAVEMYRGRMSSLPRLVWLYVWVRCRDIPRMLGPLCWFAVQTSLESHGDSVQARGQSRSRWVHSQGT

SEQ ID NO: 979938 - protein, 332 aa, Homo sapiens
EGAARVAAALDDGSALGVRADAGGAGRCSRGLARSPCGFGECVPQNAGKVVGFRGPGEAREGAGWAARRWANRGELGSEGAAGRFGVWGGVHGGFGGPGGANPGAGRRRPGARRGRGVGAAKKVGLGVQELVGSPQEVLERLGGDPPRGSSRAVGPRGERGPRAHQGGSPGGKRTGPLGKGEGGDRELSSGGSGGRAICRRGPPLFVLCGEEGSPGILGGREENKEGFLGGGGKTKRRLTHTTSARRIERQTKRDLCVRGGAQLVPRQREKKFFFEKTHLRRGGAQDGAPPMRVLMTSRRWCHTRRGAPEENKHPVDNGRRGVGVFLSQQFT

SEQ ID NO: 979939 - protein, 70 aa, Homo sapiens
PNTCVNCLAMETRCRVVVWCRTCELIVVWVTVLQRGVCISLGVADFDFGEALCDDVEGVKRSNSEYSWFL

SEQ ID NO: 979940 - protein, 327 aa, Homo sapiens
MTVLGGAVSRAFSVRMPLPVELTDLLDRVRAEFPQLVVKGEGGSRLLFRVRLSMIIYAVTSMSQWDRRSRAVLLIDSHPSGGDASVEGPEGEGAESNSNHCVRYCHETINLQENKFHKKKPTRSTSKRITLEHQLNKGHLEGTETRTQSKTLFMTGACRNKSSTSFANFQKTTSSLWLKTIDPDGIGCSMEPNRDGWCDPYMILKGWLPTGTLVTTCALFVSITCLINLVLVVIQTNQDFKDNGHCVILTLNIGGVLAAGMSTKHLLSLVTLQVLPWEKLSSLSTQRSGLKKPVGHPKPTRPWGNTLFVKHTHVRPRAENTTGAFPF

SEQ ID NO: 979941 - protein, 279 aa, Homo sapiens
GPGGGPSSSSIGSASKSDESSTEETDKSRERSQCGVKAVNKASEYQYLKGIQAMEDSGSNKSTKRVKENEKENRERERKRETKRRIQLLTPEARYLVKDGKEKPKVKSGKNDDKARETRERTPKSDKETESSSMKEEKAKDERIGDQCPQSMNQNQFKKGKREGAIREEQRYSTGDENRGRPVQEEEKGTPVLRSLKSTVRRSDYSRAERTKTRKVVFTVSMTFSPVRRLFDLGLRKVNNVFSYLSEMGGMAEIGVWENQNRNNDAEKAGVPHRVAGSN

SEQ ID NO: 979942 - protein, 121 aa, Homo sapiens
MVDVVARRASDQVGASMYVTDEDLPMGKGPIDGISMDPEVQWPIWQETVSRVASSVPSYVLRMLWGYVEEVLPGQQDLSEDGYGIENSYVPTEDKSGKIRSKLSDVISPNFGTETLGILRD

SEQ ID NO: 979943 - protein, 228 aa, Homo sapiens
LLAEELRDLSKLEMRDDLEDCLVAVRVGLVQRTAIAVGSAVDSPVFQTFAHRFNRGNGPHRENWSLDQHKHMGVLRDAGTRSHRGSPDARRDCVGDQRNGFLLTNGSIVIEAPSSVSALLGLGLPGVVPCLKSISSADWEIFIRRTARAPQSAWSLRALGRCFVIWPYCSMGGVPLEYTLAMAGSLRVLRRFGPLGWRLRHDFQPYLTHVALMEDGGAARCGKFVDAL

SEQ ID NO: 979944 - protein, 108 aa, Homo sapiens
MALLVKSTLWGEIVTDDNFILEHTGPGYLCTWLMLDPCTNGSQVHLHCKTEWSHGKHVCVCKVKDGMNMWRPCTRLWAPRNAKTSKTIIIADWGQFNNLHCVFYLNSR

SEQ ID NO: 979945 - protein, 110 aa, Homo sapiens
MSMDHNLYWIARLCRMLNPSTPFEVTVPQSEVKGKGSSYSVLSLLVQGISQRRDSRSGSRAGTGFLNFETAQGGPTHCGPWDGLRALYEHLSGAKEITTLDRGGGPLDRK

SEQ ID NO: 979946 - protein, 142 aa, Homo sapiens
MWEAADLANEREKHKSSGDFMGAEQKEHTVGSCIGDHKIKSHFRNGGSNDHEHITEELESQYQQQYATRNIHQERYRGTFVDLASVTVRRPLIAEGLIVLEPAGMHDQMMITLILKGPKMIPDRRFRGPEPRTTLVKELPRL

SEQ ID NO: 979947 - protein, 149 aa, Homo sapiens
VIWRRFAFFVLQKGRKLKLSGPRWQEGKAQGTGGLWVKAEANMGFGATLAVCPDHLCAVCRQYHHLLHLLLLVPLQDVPPTTSGCQHHSSTTVVHAPYPRAPSVPPATLDQATMGYHSMPSHARDASRTLPNAVPPLTQSSRMGPNGRT

SEQ ID NO: 979948 - protein, 108 aa, Homo sapiens
MMPSIRPGGVQPRCLEQAGPRVDLYEGTCGSQQYKAVRDGHLCVKVNMMISFRVYRTEQAHDVARQIEKFHSQHNASYSSQMEALECYHGKLSEVVLKLRTLVVYLGK

SEQ ID NO: 979949 - protein, 148 aa, Homo sapiens
MKRRATAEADLRASRHLDPVGVARAAEGSCGRPGWWGLRCAAQPAGSVAPGGPLSRCAPGLWLEQPASNWRPVGQPGERPPGGGAWTLPKHLGGTLTKNRGEAICASEVWSPFEVARWIGSRDSHKRRAKSQWLRREEWLRDRHKAPR

SEQ ID NO: 979950 - protein, 312 aa, Homo sapiens
MTPTTKTHYYPTKHTQKQKHDTPPKPVNKTRYTSLYPTISTSTHLTNILTLHPLTTNTTNDNNSTRTKTIPHKTTLTLTIPKPHLEHLRIHTHTTPQTHSHHKQPPTLITQILRPLKYKTKQHDYINTSENNHTSTNNPKAIMHNSLQLEWNRPSYTAYTAQSTVYQLASSQHTIITSIDQPTETETRGKMRTDTEDRKERRQGGRSREEDRGTKRENARSTAHEHTELKATQKRGREKGEARRRNQGANTRTERATRRGDNKQKETEPGEAIKWTEKTGNSDRKRRSMQTERSRDERLRSRSRRAARLRDE

SEQ ID NO: 979951 - protein, 168 aa, Homo sapiens
MHQWCMGNILSDKSRIREILRFSSEQYQNSNPSEDCVMTRKMNTWRKKTEESVRRGNANENMIIMLHAVVCITRGRTHDFRCAEHQSYSTPHRGHNWSEPVADWGSSRMLHIRLRRGKRTRNDPPKCKSGEENGVTPQKREPSASHADTGFGKKGTGNNPPRGHHNND

SEQ ID NO: 979952 - protein, 119 aa, Homo sapiens
SPSGERELSGCVVAVVGKPVSLQAMEVSQAMEAERSQIVRNSPGRLLYHVVRTKYGEWKRMNNAEGHRETDTMRVSWDRGPAEAVGYQDMINEVDCVNGKGLQVEIRNEICVSNDGRRS

SEQ ID NO: 979953 - protein, 43 aa, Homo sapiens
MYTTEESVTSTAASSSPPEEETPFYTNTYSDCSVTLKSYSYPT

SEQ ID NO: 979954 - protein, 210 aa, Homo sapiens
MSCHRYPEENDNSLEERKSMTHGSKVLLYSYTVLEFLIQMKPDCTRVLARLLLNEPMRGRVPSHTWRPMEVMLTASDLVSHKILSVYLHALKMICFTHDIIPRKSHDDHKFGGAPLAPGKKLWQHLAGGRGHRKARNKGKQGVQEGPRAKHGMAIPQKTRRSTALKHQEARKGITAIAHHARSRSMYNRNQLRTQRRRTRTSPRRNTAQS

SEQ ID NO: 979955 - protein, 89 aa, Homo sapiens
DAAEGGGLALAIVREQQLLSLLMLDVYLLGEGLNKEDVTEHVKIDSELCWLPSSEQSAVCAYPGLLTADSGDLAAVQRQDVEQLKLIAR

SEQ ID NO: 979956 - protein, 147 aa, Homo sapiens
MGEKKRPPKGGGPKRLPRTPLDGCPGWPHQAPTGARDNPSGGETLAKQEQRRATNQDGGGPPRRNITPRGVKHRPGRRPTPTAAEQERRRRRSLTPTNNHTGKTPPNEHTNKPHKQPHKTTAAHRVNNQPSGAHTQQDTDPRTHEPN

SEQ ID NO: 979957 - protein, 269 aa, Homo sapiens
MSVGGERRPRRVVKGNGLTQWSPEENRGPRRRAGAFSHNIKKGAGGQPREGFVKQLPKRRSEEDIKGSLINRGGPRGSAAYSNMSPRRAWEQATRQQKQQTRQAVASTQKESIAEPKKQVERKQWEATETSAQMTRSSQRQGEARQHTQENDATRADERRQDKKMNTERRGNLKNHDRTPHDKTNRDKAERTHKNNERKQEKEKRQERNGHTKQTSGEATEKRTGTKRRRQETAREAQNREKTKRKNIREQETTAKKGDKEREKRSNAR

SEQ ID NO: 979958 - protein, 305 aa, Homo sapiens
SPKQIKHNNMQHSTPATSTTHVAQLQSTMTCAMHSWSNHCNITGHQHPSTHSSCTHSHQAHQQHTKLSPSTSSCGMLSSKAQCSKHQHTFNQQLHMPHHRPKSVAHSIFNRFTPTIHHTSTHQQQNRKKQKTPKQLKPAITTANIKHLAASKIQGSTKQHNKNTFFPQHILNKYSRQAVGIYADNNTFNPDWLNISTSITSKAPQQQPSNPKQQFQHHIDHTGGDFIQPKLNPPTRQYFTTATANSRKTLIYYKQPYFWQQLQIQEKTLRTKTDDIPTFPGTTITSPVPKGDEKPRGKDPMGTPV

SEQ ID NO: 979959 - protein, 157 aa, Homo sapiens
MTKNNHGHMSLGLRQLDIVSDPFGLVYCASSLPMSDSVKSREMDVVRFTSHRSQNNCLGPTAVHGVSNPSLLGPSGTADWYRALETLSECVPPDSGRLVTRRTRTCVDRLFDEQPHPANAGFFFSLSPLLSPTSITHPTRSHNGTHKGTNRNATRKR

SEQ ID NO: 979960 - protein, 440 aa, Homo sapiens
GFFARTKPVGLLSQAAPPHHRLLSARRVWLLRGRRFANFEGQYQPCGTHPFPRLLLGRLMGHCSSPNPRGRLPQGAPQMLCRRLRESLAPEFATEECEVGLPLQLDSSGGPSAWSKDINAYNGEEPTSKSLPLSHACDDRNRELGILWGMLGSSRERMDRACLVTARVGCEKGRDKKLELVYRSSQDKQLEGTWMRNSRGNSSVQEENKGWPPLRGAGEGGWRSTIPLMKPSVRKGFNASLGEKLLNPPYSQRRTSSTVSHKTRADGRFLFCPSSYHYPSSHCTCAEKTRGEEEGQGRPRKAAEGGRRRREGGRRGAGRRNKAGGSGTMRRGSEARRERREGGEERERREGQGERGRRGERGGAEEREARKARRGKKKQNKERERRQGREQSAKTPSRAKGERKRKSRRRRETTERSGRSDRKKGRNEKEGAEKKQKERR

SEQ ID NO: 979961 - protein, 231 aa, Homo sapiens
MKIVIRCTRVYVARTGGLNNGVPRSVHMGRKQISCLCCIALETVWVGRIVSFSVCHTNDDAWVSIWETLLLMGCYYNPRALFFLVYSTLVLGLIAPYFSRTRKYFEAVDGHRGLADEGSHGAVTLPFESVPQIKPAWCLQHPVPSSGQPDITWGDTRGIIKSWAPPFTLRANEDPIILIEQTHSLWRPTAHPHVNHSHQTRQRLNTRRTLVFSTLLRVIIYLLFIYHPHTN

SEQ ID NO: 979962 - protein, 327 aa, Homo sapiens
NSTGSRLDYRRYADTLFDILVAGTMLAPARNAASDDAGLRPYDDSNQLCVISTQVSDHEIIRDYVAGSPHSNSLRRYHAIRSNGSLQDDTEEKLAPLPVKPCSEADARCTFGECLSGILRGAMRTRALAQAILTSLFQRQVSLKKASAASYAVRLPQKRGWVDEWMPKLALNSSFDAHRHSVDDEAAGTLCRVKPDRRVDHSAEYFTDARSLSELSESSDSCSPWRRQDELENWVQAPSVPRNARQEGWVCAHKNEGIVFRTDGWLLGHDMRPWGATRAIFAHGRVPRKMTWGVSREETPQGGMYTFTTKWLKSRDNKHTHNNWNTH

SEQ ID NO: 979963 - protein, 109 aa, Homo sapiens
SEWREASWKWLWWSRLGIPVSAWRMADSSASEEHDVQNSKEKLVHYLHHKIVVDGILITDEGASGWNCKCMISLRAAIPTSRAKVAALMICMKLDAELVSAHCCISLNF

SEQ ID NO: 979964 - protein, 142 aa, Homo sapiens
MIEQRIIMIGQGRRERGDMQAGEGQRANRREGREVKAAAKQTERAPARERRATSRRSKTRRVQAPDCTGDSAEQAKRQHDRTASSKRQNRRRTPHAESDEHPEERSKRHKQENTTRKAKKEQREGDAEKTAETTERTHDATR

SEQ ID NO: 979965 - protein, 246 aa, Homo sapiens
MLLYRDSGERCYKSMMTSEVSLDYTEKDVCQVSILEDSNLVGGEIGIDRYVYGDILWCTVFVRYKAILCQEFPREGYDPGNIGRLFFSIRITNDVMLRSLLLISPETDIVARDHGRAFQSFALRSADITGSGVVEMVATRLVAVWAGPWFPGIYLGCSVDLRMFRSLLRKGDLRLCAFVFPRLPRFFLLFLRHRVQAHTSADGAAGRTHTASGEVCAQVELTHESAVQLQNGRAGPLPVDRTYNKH

SEQ ID NO: 979966 - protein, 101 aa, Homo sapiens
SADGTLGCGEVCCVSFCVTRVPVSLLANVARVTLVCHLLSRYGGRYGGRQPSVYCVCNLGHWRWSRGELDSGFQVIHVSFIEAVWIATKSSRICLCVIRRS

SEQ ID NO: 979967 - protein, 180 aa, Homo sapiens
MWFVLLALVVGYAVQPLTGACLRRCIIALQVCDSTWPHTTNSVHLQYNWDNLLKWDVLVTQTVRLMRICLDRHSWSWKKVTRFDVYVNWETWNTFLKWTGIYQTADNTWEPEDKLYDCPELIEAFLNSQTSWQNENRWYNHAQLFILTVNLMTANQTERTRDELVAKPKREFAPGVSGTS

SEQ ID NO: 979968 - protein, 103 aa, Homo sapiens
MQPTQYAKNQFHAADLHDYTGNNPEWTYEDKRVRAKATDGSTPLIRRVDLVDIVPTRQVIGYGNELVLPNDGNYYTLLHSQGLRHLEGMDGPPSSEAQRMWAP

SEQ ID NO: 979969 - protein, 77 aa, Homo sapiens
LFAQVGSVVFGQLMQQFVTLARTSCSAGGSQGASQRLALPLLQPAWQGWPTDRCALCIGGQAAGAGTPRLQVLGIAH

SEQ ID NO: 979970 - protein, 36 aa, Homo sapiens
NTANNFATGSSPKLKHPATPAAAHSSNQLKQQHHHV

SEQ ID NO: 979971 - protein, 226 aa, Homo sapiens
MLKLDLALYWGSVNQNVDGLGTGTNFTLVPKTPAKACPVTPWLDCFALMTRTHRCVLYLTVQIGPGMRERVVFPAYEGAWIDGQRLTALLSHSWGPCTDQQASPLERETCLGRSPSGRYQCLVAYGTQRFLVPNKWIPDKETKHDNIHRPITAISSAAALCASPEKNYIQKTYRFCVAVCPKSECVSDQLCQTNRYSLVSSLRSREKKCRITPIISEGVVETEADV

SEQ ID NO: 979972 - protein, 316 aa, Homo sapiens
GTRAGRRLRSVEGSASGVPGTFLLRGCTLREFGLTQTPWLQKSYRRIVEECEQVLLGKNGYVGNEYGDASYMLRNAKIERDRLRTKDAWRRIMEEMQNLLIGEKDQLDVDWSPVKGVLYGEPSGGVYGVGLKTRQVVRNPTLPGLEYINVPTCELCRCMPQRRSWERLECHESITGYRGVDDCERSLGNRSLCAGSSTQVQDCYKAQYCVTAAGNCPVGSLTQVAPEWGDKSRPLDMNIVLLTLGHARELDDGVLYDLNAGGTGGRQDGTDKEERKRPRVQRQGDHRTDTHQRRHTGRRRTEERRELETTTKRQTE

SEQ ID NO: 979973 - protein, 407 aa, Homo sapiens
MRCVSKDICEPAEYTTHDAKLNLPELTTQFTGPTTVTHLTHLHTGGKTCPTDTTCGDFDSTLLTPSDYDCTWCRNDWTTLRWTTPDTTYCGPGGYLPNGTPYVPPHCLRTTLEPGVYTYTGAGYTTEDTTQWITLRPLRGTDNNTLGLVKHYGIIVTTLYNYLTTLKEEHLQPHRYTTFTTHLAFLQHWFHGTYSAPTSGLFRIPRYMYLHDCTFITWDWTTRHCHKGGRNLAITHRGHTGTPSTATRADTKTTTPYTQHNRTTPTPPNAHSDANDKRESATTITRLRTPQNPPTEGHGPPRTHKTRNQKETLWHNATSARSTHPTYKQPTRHKQRSREKQKHREQEQEHKGHTTQRNHRPHAYIPAAGAQTNHQEDRNEHPIQDRTRAHTQTTRDRTTTHHGKTKN

SEQ ID NO: 979974 - protein, 328 aa, Homo sapiens
GCAVWGSEAWRGCCHQVDQLSHRLAASLVCFSIMESYPTMIPQACMFANRAAHRHSHHTAWPVLCHTFTQFHSSQHNHQAHWHIQSIPCAAASHFLTIASAMLHIAMLAHSHSSVGLVCILWVQLSKAAIVMHLDHKGTQHNSNTSNINVDTAECNACNTPNNGLHTFWPSSLVEPLSNCQAQVPYCIHCDILYPTNADGHSTFNSPSLPAETIDMQGLLSLAFRWPNVVTTIAFQHTTWPDIGGASISHMATGLKRWSIGFQVGSQFGQYPYTLCLTWLVTHIIPVVQNDSQGIWAKQPLGSYARINTGNTATYNIEHPVSINLNPN

SEQ ID NO: 979975 - protein, 302 aa, Homo sapiens
MDTLSGSLIDYIVPRALGVRTKTGGLILYVDCGLKGVQIPEAKFWTVGRTKPILADTIGVAVYEPELGCIKARVNTETFINRERRHFNQELMVAEESPYDAGLRLNVCDKRDFVNQRTLLSESTTVLNESQNSIAPISRTEQFIHTPMTKLPTSDPRHIRMTCRPYRITDLQNTHSEGKSDTTTQRSNKPWATTGHTQQKLKHKKQRQGNKPRHTAAACHTHDSVTNSTCNTPRRHRDDRLTRPRANANGNNGHDKKHHPRERTRQATRTQHNQARTQSLAIASRTTKGDQQSATTPPTSTA

SEQ ID NO: 979976 - protein, 487 aa, Homo sapiens
PCPVKHPRAGNVSSLLIHHPLSLALNMAAALKQTAVPGTYSKQLVACSKPPRKVLWFIPPSDQLTTTVSSQSQRHGLTHIHPPAARATPHNALPPQHPQQLRTTPANVGRNLPPPPLAHPYHAPPLHHPRRNSRIPLTRRARAQPRRPSSRNTAKRSTPRHCFPFGQQPMNSTTTDVQLTRQHIRNPFPSTFNSSTGTYTVASLGLANALWAYFTYANVATTSVPPFNAWLAPDAPKPLGPLGSTPTRHLPHSSPPHSYAASSHTSHRHCFPTPPRLRLRLDTHPLSEAPTFLGYTSTLHTLSVACYTPSYSPYLTLYSLHRYLNLGHALSASLGGAISPLSNPNPLLTACAPYRLFQLGSLTQLHTASALSAPAAPGPPIHRSTQPRLTAQSNTPASQPPRPPHTGPETPGLAPYAHIEPASGDPPGHTPRHRLPAPPPHQQVPQKPTPPYATPAPPLRPSPRNPSPTPPRHRKNTHMAPPVRRPA

SEQ ID NO: 979977 - protein, 111 aa, Homo sapiens
MLTILRGQAISVVPPSAFRITIFSGGGQYVGRGLILHKFKHKVSRWNTFSSAMCVALLTIGDSLSNCGPGLADTGDTRTYLSLRGWVATSQSDTSKCFHNFKTSVRNTGGA

SEQ ID NO: 979978 - protein, 84 aa, Homo sapiens
EEERRMFNSAVVTMPVVRNIFLAVGVIRIQSEDKGQENLRLNSIGVGWIDVCCLRLATFWYIHAMGSRVAIKNSLFVNRNIPIG

SEQ ID NO: 979979 - protein, 186 aa, Homo sapiens
SRGVGYWSYGEEVYIDNCGDEIDGPKIEETPCIGCKEKMVRIYGGVGEVTEIPHNKSVTTGMALTPRQYKRNSKDIHMNTHVTIHSIPTNSRPSKIGEHSKKRERDSERKPKAQGQRDSHPRGPNTTHAAREHIPTPPTKPTAASPTPTHPQPGTRTHHINTRVTRTAEPQHTPRTKHPHTPRTPK

SEQ ID NO: 979980 - protein, 96 aa, Homo sapiens
RQWYQRIVSNYGRVDVRRSLTIPLRYQYKTIGDILLSICSSSVNDAWMMSSATSILRDFPIYPSTQAGAQVRHSLHYGNRPTCNSEYSFTAHSAVE

SEQ ID NO: 979981 - protein, 103 aa, Homo sapiens
MTLIQTAFIWKLVNNADGEHCGNRDESVKVMKSCDSVINLSKERDLPEFWQDAAVIQTSEDSDKKSCSSCPYGYRGCKSEKFIAQIGNLIKRECFQVKALTWY

SEQ ID NO: 979982 - protein, 102 aa, Homo sapiens
ESYRSGWHTGVGILSVWDDSGMLLFRYGLLGVPNRYSRSTSISIVGRLCGPPTVACPSGPPKDGKGCTEQVTSHMLCSESPHEDLERRGTWKYAMFDVAIGC

SEQ ID NO: 979983 - protein, 78 aa, Homo sapiens
PDMINEVDADGTGRIDSSEFLTVMGIDNGEDTDSEKEIREAFRVLDKDGKWHILVLEESFAMCMTEYLGEKLDQMKRC

SEQ ID NO: 979984 - protein, 176 aa, Homo sapiens
METSKWDSRQFWPLQLEVTLSSEGRSAVVWYSHRGQPRTGVDETYSWNQLLHGLGTSSRLSHFPFAKSPRPEANSSRGEWRSQVAQACRWVKGCGEWVRNQQVQKKATVSKGTHQRAEQENGVETTFLKAIIVNKSREAWTIYHLFEGPVELMNFSWKGCANPLGVTVRYTIRTQL

SEQ ID NO: 979985 - protein, 89 aa, Homo sapiens
SEGKISNVAGEVPGDGEVVRSWRAQWRGSRGGEFEEPRNVRRRKIAGGRSSGQGIVLDAPAAGRVAASTSAAHLPPGFLESLKEDDVGF

SEQ ID NO: 979986 - protein, 105 aa, Homo sapiens
MARGPKKHLKRVELQSIGCWIKLTGVFAPRRIHGSPQLLRECLPLIIFLRNRLKYALQEIDSKEDLHAAVHVKIDGKVRTDITYPGGFMDAISIDKTGENVPSDL

SEQ ID NO: 979987 - protein, 64 aa, Homo sapiens
MEFIPMKWHPNLSVWGDTFRPGIDGTTFTSGSPPHFGEQLATPAGATTHTRPSLPIEQTPPGAM

SEQ ID NO: 979988 - protein, 186 aa, Homo sapiens
MILCPKRGYEEQRKSNDEWAVSHSLGWATGPSNDGARYQSMRGGRVRLKYSKCDGMRWCDRSWMDDGAGWLRRIRVNPEGILRDEFEKQIKRDIAGKTSRVVVKACAVRDPDILSCESSLLRLCDIASESQSTRVQGQPWHNGVGGVGKSKKSRAQRQTGYLTGGGKKTQAEDKEENLETLRGRKT

SEQ ID NO: 979989 - protein, 66 aa, Homo sapiens
SIGINPECPLRPGGSVAFSVLCTGLTMDHPRRTFNSPKTGQTIVIYYLVESVHTEIVENNIVGNSI

SEQ ID NO: 979990 - protein, 90 aa, Homo sapiens
LSVFGSEEAKVQLPSVVPNPGSSDYLGVLHHADVMFDPYTEIYSRIPEVLQEVKWCHFCPGPQDRAPGVCLQERNVGDDIAKATGDLEGA

SEQ ID NO: 979991 - protein, 121 aa, Homo sapiens
LLDQLKCGFVTMICAVLNGRCQILVMLWKELKEQLGEDIDSMSEGNGLFSRGKLGVAGCTYRISNRRYRRNGMIHDAGSSLWAQMQAETGRTTGRIWTASGDSGKAVEASGDEAGRKQLRF

SEQ ID NO: 979992 - protein, 190 aa, Homo sapiens
MASLVSTLTSSTWRDSVWRKPCCMDYIVATCCAFENSCLDAQQLTSPPENTGPEGLCLNACSKVVDSSSGADHHQIAWNAITPGTFTNPRIQAILFSVSHVLRCGYSAPGLSSSLSTWASYVEAYAYRMCAVVNTDFPSCANVDFAFPMQATRELTQWVDVVDAGREVLRWRGISRNSLRGLPVLVLLEI

SEQ ID NO: 979993 - protein, 116 aa, Homo sapiens
MKSLILLAILAALGAVVTGVLMKSHESMESSVNIGTRRIIETGVNAEWRSRYPARAEMDEPKVQERIRERSKPVHESLDREACDDVRTFAERIRQWFMDTMLPYNRYVQEAPRGLT

SEQ ID NO: 979994 - protein, 201 aa, Homo sapiens
MAVCALYSVPHSPTRSVSRRAHALPRPAEMLRCTQSLSPDETGVQGTGSSLSLGPYAKDVKVGCRCPSLNAIQGETFLAECCGRVHSGAMMGRTVIIEQSLGKSQSIQIDGVTVANSQVDETDKKENMGAKLVQDVANNRNEEAGDGTTSATVLARSIGKEGFEKIRKGANPVEIRRGVMLAVMVYIVDLDKESKLVSNLK

SEQ ID NO: 979995 - protein, 68 aa, Homo sapiens
MNKLGRARRKQHTIDPLTTLWALYHTQISDTNHPPSIHYTHTARTNHHIQHRTHPYLVSSPYQYTRAY

SEQ ID NO: 979996 - protein, 182 aa, Homo sapiens
SAPAPVAGRPRLPRDLRWGVPGVFTPETLNAVWVLRLQTLLDAGHDFHICNHNSSQTAAMDLSPADGRMLARTGGLDAKPANFHVCKCRWANGKGGVFSPTFLAHVARVNYNFLSSSRELLRGSRGQFSLRSFSSAFCGRGGAVFPIKIKRAPVAGFRGYKGRNKAIPVVEVADNVTQSCVT

SEQ ID NO: 979997 - protein, 158 aa, Homo sapiens
EPVVTGGVLCVCVRCCACVVVFSCGRLGDIPPAGVVDACDHQWSDMLRSQMQVQKIGAAWQGGEWMHEITWNVRLRLLVSMAVATRVLLEWGRRVRCRRREGLTGGPLDHRRGGARTVYSLESAEVGITEEELAGGNVVGLGNHGVRGILRDYLLCYL

SEQ ID NO: 979998 - protein, 164 aa, Homo sapiens
MLSVALLENGLPGAVRLAPTMERDSPWPLQKLERRIHSPCSVRSFRIAMHVGDVTGNQFTPRLTSTEFRERLRSIVTGDLSKSFRIDRSPMKARVCCPLMLCDEEIGATRAVTGLRVLARQYLVLNGEGYDSWVYAIVLSVLYHGSCPRSPECGHMLEHHWTVD

SEQ ID NO: 979999 - protein, 39 aa, Homo sapiens
MGHHLLREHRESLYLIHSKNASSGYLGSLDERTGHRRST

SEQ ID NO: 980000 - protein, 113 aa, Homo sapiens
MAAVIRGAVVVDSSVELGGSVNISESSGFFHLGNYEECRKDVRRRYDSRTTYIFSRRSAYTELNMPVEAIADMQARVWELLSKVMVLWLCSSRRRNIHKASFDECLLLSGINI

SEQ ID NO: 980001 - protein, 242 aa, Homo sapiens
RGAGEKTDDNGASGPRPVTRRRRPVVGVDELCDVEERLLRSCRLPRHVHRTEAQLGDSYLRPTETRRMVKMVDVFLYRDVAGAEEKCGVVLDDIKPSSDPELQGVRMLVRELSSAHLEKIRNGSMHWCVRSCASRMEYGRMGDRCDVSKHSTYSCLMDRTAIYLHDQNPDADLSVRCTMGVTTPVKLHHDHGQLRILALRAWKLIGSSPGKELQENAGPATRMSSLSQFVTAWGQSWARVVE

SEQ ID NO: 980002 - protein, 67 aa, Homo sapiens
DPDGDKYHTSIDHLTSGNTSISLRPHYGLPKLCLEGMKVIRRLHSISSRSMNAMEERMPSCSPMMVA

SEQ ID NO: 980003 - protein, 272 aa, Homo sapiens
MSNITHVHMAPMSPPLRPQQCTPLTGVGAILQGPALNDSSSVLRLGELTEITDATQVILYSIRPNLYAGWLPSDCRCIGASRCRGNDISKGDQLTSDLARFRRNARDSGPNGFPLGGFEHYTNHQLVMSHVDSAWFKASCILVDQALSSWWRIDAESAQMKEEEDVNTLKYIWKDGLAPGRWSQGFLENKGKLGVDEDGDEDDEDGSCLPTDDAQNRRSRFLHNTAACEIQLVVPPVRGTVMGKFTYWARPGDIFSQDSSTRYGDKPPFTVP

SEQ ID NO: 980004 - protein, 69 aa, Homo sapiens
NCCYGTSMWRSGNAFALSVSREDAFEGGVPLSTQTMVLPVDRGDAQALVQSGKVSRKQYRCYRGRFASV

SEQ ID NO: 980005 - protein, 103 aa, Homo sapiens
SPAMAFTSASFCYMLASVLTDACIILRHLSHYTHFDLTLGRTDLQRILYDQGGIRLNPLVSPQRWSHLTLDYLVGSDNVFDASDDVEHYYLSVLQILASILCV

SEQ ID NO: 980006 - protein, 72 aa, Homo sapiens
DVMELEPCCEEGFSAVPVLTWTVIFPIDPDQILSGILIKRRPGSYSQAERTWWNAEDLISDLTYSSMLVVLV

SEQ ID NO: 980007 - protein, 574 aa, Homo sapiens
EWQSGFSGVPVSLPTPSGWVAKTREPAATERRRTPVKGAETSGAAPRGVQEERKGYRQGSMHDASMQVLRDKRQIIVPYHLTVMTKLEAPTGDSRTQIRWEDKTGQPRYKLTAPMDALITASSDKGGPPPAVRPTPLKQGRDTNYSDRRLPQSRDSDQWKDCKHTAKREEKQKHQGETKQMTRPHDETRITLDKRAHTRMAILRNPMGLLGLWYTGATQHTIAAGVTQIPEGTGPVPSRAHAQAPRRPHSAHSDPRSEATNTTEIDHGPPGTRYLRNTKNATTTQGRISAHQKKATNHWHNTDTPTYTIPTKSHRRSTSTSQHKAEQDPTVKATTRDISTTNVTVSSTDREANRKTKKPKDEQEKTAPYRYTGDSGNPTTSQGNDDNTLRSRYDEQHNLEQEYTATHAAARHDHANADTVGKDMEAQSVQREATMTAGTYDEHPDVTQILNDTTTTHHQHKRTKNKQNNPKSNETLTDEPKQSTIDNRDTIAGDGDTQEARKHKEQPQRAINEQQRNKIKQRYTSRRHRGGTRRSTNKQRRTRPTSYKGTDTKQQRRSTNETADRRYTDRSRQQ

SEQ ID NO: 980008 - protein, 189 aa, Homo sapiens
MQPNTYSLRNYTTNSGPTPNRQVAENNTARQPTPSINKAIRAKRTRPAHHQPQTKTDRGHPSTSHKHDQQLHNGNTPQTQAHPRNQNTNDPTHHPCTQNYFTKNKSKRTPTPKEPQQTAKTGTKKGRKHTTYRRHNRHPTPEAPNKQTKRTTHHDRDKQQQDTRRQTTETTTAPQQPHHAKQHANPLTQ

SEQ ID NO: 980009 - protein, 84 aa, Homo sapiens
MTRRVLRCPKWDSSISFPFMTGTVAQRGSSSSNLRPCGFRKAQKEGIVWRLFPESPVPVREKADKKAVAPRGGEGRTPGVPQRQ

SEQ ID NO: 980010 - protein, 83 aa, Homo sapiens
INPLAQAVIYSTILRAHSSQTLKLALMLYLSRPRNKHAVLRCPVRKPKREVQPHRTLQKACSILGGYFRARKASLQATKCLLI

SEQ ID NO: 980011 - protein, 162 aa, Homo sapiens
MDKNTPVRDTVVLQAYKSGSILWGHPVTSQLRLDPVRKMDCCLEISRIEYKRIPFETTCVRHLWICRKSDAGSTVMGNGSELHGCNAARSSCARVFVRLGDPLLSFAPLLETRQLGGSSDSTWGRHGPVGSKPLGGGWDGELLGGTVFRPQRCCALPLLTRV

SEQ ID NO: 980012 - protein, 399 aa, Homo sapiens
MQSDTTKISADLTVTSSSHTPHIITARENSGPTHTEDQLHHNHQLTIPHSHATTQRHGHTPPTIHNINHSMANQQTRTHHTKQLRTLIADTISPSLHNYTTVTTEQPANDRRLTQQTYRPPSHHRRRGTSRMSTDGRRTTNRRQQSSNEPPRQTTTHNNQNNTSATTTQQLRSTNDTQETREDKPRITQQENETHNNKATTHDTKLSNNTPCTVPDITQKEDYPLNTAEQPLRAYNSRPTTQRSTISANRKNTAQQDTSTAQKHTYGSQHEYSTHTVRSKQKHRATKERAEHTQANNTTGKQNRAKQRKPQAHTQSTKQRKNELRTHTQHTTTADRARQDNATQAYAPHTIRTQNRSAKYNSSAAQHNQLATRDRHDTNTATQKTKMKRNTRETTTHYR

SEQ ID NO: 980013 - protein, 78 aa, Homo sapiens
PNLSPRFLIVQPMSTTSPYADTHGIAMGVLRIYPYYSQISVMLLNMPVTDNSNSEFPIEKGVDKLRNTHKRILVGTHI

SEQ ID NO: 980014 - protein, 146 aa, Homo sapiens
MTQITRGSNRGTAGGKKTMDAQGEQGLDTRRIELSECERRRMHSENQIATQGETEKAREQSEPNGARYTEATQDDPTATRIDGQHDEHTGEQKSTPETTNATQVRRTTRDKEHEDTQQNQQTDAIYTQHTQPRKKSNTDTTDNHQH

SEQ ID NO: 980015 - protein, 83 aa, Homo sapiens
TVIRPPRRGVGGLRGTFFFFRLTAGQLRSLSTPARRRLMRDFKRLQEDPPVGVSGRTIWKTTSMQGNAVILGPEGTPLEDGYF

SEQ ID NO: 980016 - protein, 69 aa, Homo sapiens
HVLTGVTQRVCQEWCLAEYLQRHYFPDDTIYDSLCRALVSSPCFAGMAMYTRSLLHLPWGVPPIASADA

SEQ ID NO: 980017 - protein, 222 aa, Homo sapiens
DDVGDRSGFVTRDVFVCASDLHNTTTLNTTAVTAVTNTARTTFLLLTRCSTCATTRLHNGGRHMPHMTLRHNILHRIIYIEDGTTRSSAPCDTHYNSLPTTNKGTHLGQRHTPDGVIRRIPKQVHPLAHNTIIFSRALPHERHDTPPDPIPTPSTLTHKRLHKLTLIPLAPHGPLLSTNHKTETTVLIALSSLVSPNPLLPSDILHYDTRAQLHDIQWHTWT

SEQ ID NO: 980018 - protein, 113 aa, Homo sapiens
INCLDRSILYHNVWAHVIRSVPKANGGERACPERLNVTIADESALAENACKFDLSAPRRPVFTSEYLATTGLARAVDKMPTVYHFTTQVEDEYILRKSCILSRTVAGRNHVSQ

SEQ ID NO: 980019 - protein, 428 aa, Homo sapiens
SSPGRPRGSDIVFNTLTWHIPDAPTDDAQGRQGELDSPHYFLLLIQLSDDYSDMYHCREQTMWSIQADAADHACTYQREGCGADDGKNNMMQQETITTGHTETTHTQTQEATGRPHTPEGHRATYAVHHTDRTSTRTLPPTTDERDTKTSANNMTDTETREEQQETKRDTTTGRHKTKTQTDQQRTPNKRHIPDTHKTGKYTSTTQPQEKKAPKRTNNSEPPPTQHSSQTAHQRPGKNTTTKRPTTAKPHEHPNGHNKIIQQISQRADETIQKQRNETRTQHKKQQKRKEKPHTENQRKTREQDKRAQQQTNPKKRQKKATQQKIDQKTQKQPQSGETTTETRHNNKTYHNQKPKRTDTREETQEKEKDTQPTPNNTNNVTNSTKQVTNKQTSNKNAEEQNHRHTSRSTRQTKTRPTTLSNTTNDQTD

SEQ ID NO: 980020 - protein, 263 aa, Homo sapiens
MSKVGCNSLVPLIRDLCEWLHEGSAVSILSNRGEIEPAREEAGMDDSHEEEDRYGALTWINATTVILTRSPNSGAEYTYPNNLHEENFGLGLSIVSGAPNCEQYMLRLHQVKGELLYVKLICNNCETKGNEVGLGIREQCVCVESYIKDRVRDVDVEIRTCQWGRRINGRFVNDEGVRDLSADGVLQVGSYVGAHSSLSRARDIGYFTGASPWRCLQESVRNHRDGRKRAASNWAAAEINRGGARKSTRDRSGVQRGGNRQAA

SEQ ID NO: 980021 - protein, 89 aa, Homo sapiens
YMTWGRPVSERECRCASDYKRIIYGGDVDEEARTIYHEGFPVRTPLIREALVDHSICEPYVSMVSIAGGSDEVMPAEDTSYTCRQLITR

SEQ ID NO: 980022 - protein, 121 aa, Homo sapiens
GLLTDSVGATNAVVRRRHLDGRKSPVLGQLETVVVNEITVTKGKLFANVSFSQLEDGLNVLLEQMPRTGFLSSQDLALSSLKGLSNPKSLYRLRGSIRLRMSLQCGCMKPSRCNALEQCGP

SEQ ID NO: 980023 - protein, 72 aa, Homo sapiens
GESRHVLIVLLRGTETAQRAVSMGRMKPVGTPFRSGLGDKRQRVFLATADGEIPKRPASRSPSALRVRLRER

SEQ ID NO: 980024 - protein, 366 aa, Homo sapiens
VFPFGVPLKILDVAMGRRHARCYRYCKNKTRYPKISLHAEVTLTANDYALFGHCGTETTANTWTDDIPLIVSHHGCQTDILTQMVLYTPWNELARHKDATNTGTNEITTQLVETHSTRSIPLNPGECVNTQAPIYPPVNHGHSKPQHDRSHDRHGSLTQRVHNTQGQCRHEMAPTATPDPTKGTTLTEPTRNTHKRSPNSKQPPGPTSTDNTQAVGSKPKRDEHQVGHRDRGPQMDAPGEPQRDNHKVVPHGGHSDPDTDTPTHNTTQQANRREGTNQHQTRDINQAMDNSTHQHRTTHTIEIWATVKQQTRGLNTTTHTRGHSTARAKQVNTNTTPNVNKRGDHRPRGTTPSIGAREQNKSKTTK

SEQ ID NO: 980025 - protein, 269 aa, Homo sapiens
VEQEILVTGIKVVDLASSLMSKGGKIGLPGGGWMYGNDCTDHGVNQQCLQLRHQWMVYSVYAWGDQCDDGPVKCKWVYHHDILSMNAGGGSHRYTDATHLQGKSSGILCSTLVIDAISVYVIVDSRVLRSCNSCAVLVVEILHERKQGQRLVLAIVIVETMLIGCPTQGWYQKLSCRYWCRIPFCLLELYRTNHVAVTWRTIAWSRNLHNLAKKGIYHLLYRVSYRLADDFDWPCPVVTYRFAHWAWYDCTLFGLHLVELGHLCQVVDL

SEQ ID NO: 980026 - protein, 286 aa, Homo sapiens
PLIFAESPLADWDPVHVLLTNWRAFKALIDCSDTVGASGPRALRHHTHIPLWAKPNRHPVNFSATFPAGKDPSILRVMMDSVCQRANANAYSCAAMQELRGNVTPAGSQPTGGATGLSICMIPIIDAPQTVPGMNPTLGIMHTTRPLRHAQEDSAAHILGAAGMPTLTRPGGTSTGGEPTPTSDTEGTDNHTERHGTLEGGPNKRQEHTNAYKAATGPIRKYHTRLGRHPHALNAGPAHGAARGAQDHMQSHNEVPTRKPYTSAQQTHPNSATPTERTGRQGQHAK

SEQ ID NO: 980027 - protein, 266 aa, Homo sapiens
VRAERGGRSVSARGQARQECGTAARPCGSRPGGWAGVPEQPPGLTSPVSLSPSLVAPPDRHHGAGMSRNGWRIPRALSWGATDADGGLRGAWTPVLRRDRNRVTWALLTSPGSRGHPTPRERSFSRPSLLGWLPDAGKASLMCKGVLSESMDELSSTGLLGAAAPEYGAGNFFSHGITVVTLRVGIHLHVRSWIGPWGLCPTQYKGRYWTTRTLFGKVRGPFLYNPVGNTRGPYFRRGSRHVGRNHPDGGTPGAQSAEVDIARVTL

SEQ ID NO: 980028 - protein, 77 aa, Homo sapiens
EMRSRNGDCRTGKPPLLLIPRTSEKEKRESSQEVAEAQNTILSRSAYRNKMGDVCFFSNLINAISLADANPCGLDSP

SEQ ID NO: 980029 - protein, 128 aa, Homo sapiens
MSGRYQDGLLAGRQQLRRRFLLLPDAEAQLDREGDAGPETSTAVEKQEKPLPRLNIHSGFWIVASMVVTYYVDFFKTLKENFHTSSWFLCGSALCLSVYQLHFTCIVYLEWYCGIGEYDVKYPSLDTH

SEQ ID NO: 980030 - protein, 155 aa, Homo sapiens
MATEDGYICFALPGKRTKKELGLSRLKSDLSGLPWDDRENCGGLCDRLRGFEYVIAFMRLEQLPVKRGLGSLTRIFSHLMIIWLHKPESVRLLDLFDRRSSRRMYRDWSGEGLISGTSLGDFRKLGWVPLAGGKQAEDGSVRDMNLVTKKRGNPY

SEQ ID NO: 980031 - protein, 194 aa, Homo sapiens
MTGEVGSEVHLEINDPNVISQEEADSPSDSGQGSYEDNGPLSEGDSDEEIFVSKKLKNRKVLQDSDSETEDTNASPEKTTYVQCRRRSNNREFICGGKYLPIIRRILPKVWQTVMTVPMATVWYQDNSLKRSETCLELSLQSGNSTDFTTDRKSSQKAHPVNHEGNLQDNAGSTHPQRRLGTRGDNTPYLHNSH

SEQ ID NO: 980032 - protein, 134 aa, Homo sapiens
MDAQTPSSKAGQEDTLRHVPPDTCDGCGAHRTGDSRLRLDGAAITVLCLGGQRQEGSWSKGPKFPTLKIAHSLPRQESGVQELGSPRQGGATGGGDREDSSKRWPGEGLPHRRVAQVTHQRRPDPDKPLQAAPR

SEQ ID NO: 980033 - protein, 50 aa, Homo sapiens
MQTGFIREESSLVLGVCTAVIFLRSIISADPTDVNLPNSDTVPSTGRQTT

SEQ ID NO: 980034 - protein, 258 aa, Homo sapiens
MPVELVLVLRIPDVSRCLLLHLAVCLTRSEYDRGVNTFCSRRKIDVMVEYAIEAIKLGVYRRIGIQDIRGCVPSMWQKRITSPLMETEQYLRNSSQRWMLTYGVCHEWATCSMSNDFILISAQSGDHLIATGSRYNETMTVDELGPKSVSQSGFAVGDQDAGSRVHCLLSFGDSTDYWEESMRTGAPAGSYGPIVRPCTGDARAVGRSRGEPRGSCTSFPSAMTRTKAQCSSSSPTVMGAPAAHVGSSCVGEFLSTGT

SEQ ID NO: 980035 - protein, 156 aa, Homo sapiens
MAVMSLWRTGFGYCGGCSVWPAPWQSRRSWGAFLTRGFSEGCWGNSIILQASLIRTTVGRPMRKRIFIGIEILSRISSAQAVPYEQVIDEFYIVIDRGLPRRNLSITHGDMYSVLVKARTSQKFQKAMSQNHCGDMHNASHIMMDCPVDFVLIVLK

SEQ ID NO: 980036 - protein, 115 aa, Homo sapiens
LAEPAPDETHAADLVFSARSVSRGRPETFFCSLCKYGQLLEEKNSLSPVAGSKVAQSVPSNRITCTFGMSGTSMVDGDVHSQTFWRKSASASMSLCSLVAIGCPGTRITASHIRQ

SEQ ID NO: 980037 - protein, 216 aa, Homo sapiens
MPVMLRYMGRWSSSGYRCVGRDMLWSTSIRGTASVSKGYDPTVENTYSEIVTLGERLTLHHSIMVEHSRGRTEYSMLPYVIHHLGSMVMCLCMLSASLHSFQRRLRVCTKKLHEGHGKTRVAVGASWGTRADLSPERGTGQVEGNEAWKQSWGAALDGGPLLEENSELTQGSSQSHQGEWPVEKSMGRGGGTLCEPGVGKRGLAGGRSRGEPPPRG

SEQ ID NO: 980038 - protein, 88 aa, Homo sapiens
IVVRNAVGRQNTRCRGNSSPKSQNGKGEDSYHTLCVDEEHSQYECKSTRRIWVNLDRINWGGIGLKNHGINLMKDGCLDDGAKGVTSR

SEQ ID NO: 980039 - protein, 113 aa, Homo sapiens
SPKKPLRHNKPAQQGSDTKIPLFPRLAMTTQDRLARVNVYSSIIMLTLGQLRARDICQQRIWFRRGVNTGMCTHTKRLASGCANFSNVPVASKYRITVVKLRGMLGDHNTTVV

SEQ ID NO: 980040 - protein, 75 aa, Homo sapiens
EAVSRAVTLGDTEALTSLSLRDCGAVTARIQTRGPRLGNGNRGFIMLIARFPHIVRSVHHSHHGNPYGIWQYCMT

SEQ ID NO: 980041 - protein, 86 aa, Homo sapiens
GEGLVCLVRELRGPAIVCKVVLVTNMSRGSSAGFDRQITMLSPEGRLYQSRISLYKAINQGGLTSVAVRRERTVQDLSHQKKVPDE

SEQ ID NO: 980042 - protein, 83 aa, Homo sapiens
QVPGHVAGDLAILRRFLSGAAASLSRPVPGASRACAESPSDRLPGIEHFSRRELLVTLSHAGGQSVIRDWLKDLGTNALLAPG

SEQ ID NO: 980043 - protein, 106 aa, Homo sapiens
DEADGLLSQGYSDFINRMHNQIPQVTSDGKRLQVIVALSTFALLMRCRRKLSEKISAFSLQWVDLKGEDVCSEILYNHVVVPVNPKIDRPLGKAWKEATLDMMMYM

SEQ ID NO: 980044 - protein, 514 aa, Homo sapiens
MSYVASKIFNEELMVRKPTKNDLYPKIQSLKSLHMIYMRALQIVYGIRLEHFYMMPVNSEVMIHSLMDGFLPFSNLRVLIWTHFAYLRVNDFETADDAMSKSKKDKSGFKWHYQLYSLPEKDGRKPIWHFLLAINSSVRSTWHQFNSRHQEANALGATDTVPWKRKVKPSHVCRRTHTSSVSHTNGGEVHKNSYHTARRHCLFTHKPLNHTFFLFSVFYFFCISTLPDHHYHPTPPPPPPLLIPSPHPLTSLPTPTPSHPHHHPPSPTTERGNLDAHNKHTQTDQPAGTPRNAGEQEDHTKRRTHSKQRQAEASTDEVATMQDERDKSEQEQRDRPSREPQQDKRGASEKARRHAARMNRAHTTSERERHNKRPRPHREEEETAGTTRTQRNGTKERSSGRDSAGEDGRAQGKWTQRSMTNGRPASTKDTERPTDEGTKEETHTSAKQADARSVGLQTCAAGVHGGTEADASKTDVKEEDQRHAEAEQHTEHEYRTDKQHDRARSQQHTIDQPT

SEQ ID NO: 980045 - protein, 69 aa, Homo sapiens
MRRDEQAREGERKNRAPTEGDNKRREKKRRGKDNSTRTRQKRRAKRQEHSKNSETAARSNAHPQHEHSH

SEQ ID NO: 980046 - protein, 75 aa, Homo sapiens
GCERCLALNGEILQVNHYCHQTIPVSSLSFITGGMITCNHQSICEEWLLRGPIRHPVGIVGFGRIKVEVWISINL

SEQ ID NO: 980047 - protein, 126 aa, Homo sapiens
MQVSMLARHDTQPSSKTNSREHFVKTCESTGKEKQLQTDSRQTGPQVWQQTREETSNNQTHAYQSSRRDPPTPRVPKPSGGPNTRRSRRNTRVHDREDTSKKQPGKSHTEQTDTHSTRDSTPPPST

SEQ ID NO: 980048 - protein, 154 aa, Homo sapiens
MSSREVAACNHGTLGAIGNLRVVDQIQKKASGHQIGGHPGVRGSTGLPTLLNRIEWNVREECRGTHRRKTGAGDSTQRYRRSATRRLAVETTRNQPGDGPGYEAHGKKAPTHGSAALERHNPRGEQTEHPSKNRAAHNWTHHATTATRDNTHPT

SEQ ID NO: 980049 - protein, 104 aa, Homo sapiens
GRRVVCSVRWAPGPRAGSVPFPPRHEVDVKEDHSLEHRCVVRKIRAKYPDRVPVIVDKVSGSQYFDIDKRKYLVPSDITVAQFSVASSGRRIQLPSERRSSCCG

SEQ ID NO: 980050 - protein, 128 aa, Homo sapiens
MLTRTPLLVSYKRLVHIIPPASGGNFSGEHISPRRTNHEDQPQLTRGRRRGDKSLLEEGDANSTHHLRGDTLTTGGDEETRSFSPLYIVAPRGATLPIREHCAQVKWRTQLQRPTGWGAPSSGVQICR

SEQ ID NO: 980051 - protein, 111 aa, Homo sapiens
MTRLGLIRKQRSHFCTMEVYIAKFVMCHQESDIDSTDQGRRRRSPERNFQVLMSDYTRLAEIGIVVRCLARKGSSLLVTIPLEEYRFTEMTDRLLLVDQGNVRSLMWLHAI

SEQ ID NO: 980052 - protein, 359 aa, Homo sapiens
MVTRVCFEDGMAETGSAILREVNNMISEINPRYRCVAGGHYVGAWGTARIRRTMNLFDKYLSSCQGIHSVLIGVMVAVRPLVTSLDSTVIHYSCGHICTVGSHPCDISGGLCSTTDEMCIELMTSRWYDNRHSTVSKIAWHYRRSCYRLTSVDATLPSDIEPTGTYSEWSSVYSLDRVSNMASIRLLTCSHSIELSSKRMVEVIMYVELASQTVGAVFRAMHLSIRCLIHIPVYSMSWPYSVDLGGALPNGRFRGWAIVDWCARAVDLSRGSPRADRLSRQVWYPGWGHACRALTGGCATRLAPHHWCAAQPRVSLNRAGGGTPLVGRAARRSTQAGEAPQDDGHLTGGVNTPSDLSGS

SEQ ID NO: 980053 - protein, 76 aa, Homo sapiens
QKIRKRNSENSRREAEIALLYSGLGNRVRLRLQKKKKGVFKPLKLCRLLKLLMEIPKRCVRVSRVIFQTNQRQGEI

SEQ ID NO: 980054 - protein, 204 aa, Homo sapiens
EGLYGSYARIQNAYISPCQEEERHLSLRCATEPSCCRHATAARPLVIRDRRNLCRIPVVSAFVPEVVPECRDAHGLTVGRVDQVRVVGFLRYVATCLSDDMSSVFLWNALEAVRVCCLVRIPGLAVVSQRWLPLSGGAVATPSHVYPHSLLDVVLCPGSVKGTERGHAECALDNRPRATCGLGSHRAKLSCTIRTRVNNRGACD

SEQ ID NO: 980055 - protein, 69 aa, Homo sapiens
AALRNVASLMRTGAEKRCASNVCMVGHSERQVRSQIGIVMGSTGCMTVKDTDATWKRYIGEMRSRTIDK

SEQ ID NO: 980056 - protein, 227 aa, Homo sapiens
TLQACPVSCPRVKIRIAFRFLMKTWSMLMHGVGHDDHVISAELIWLHLPVARTHSVRVLARIALVSVNELLTTRTTLSELERVPKETPIIPLWVNLGRRQRIPFACTRREEHWRDQGKWVLRTRKVLGVLHFCALFKFRRIVGLARHSDKVCARSQGSPRNLLRRGTFNARDTCEASSPGVSRIISHCPYPTKSQHLAYGTFARRLRFYKAVSLAFVVTHMIHHTDS

SEQ ID NO: 980057 - protein, 116 aa, Homo sapiens
PSLRPSSCCCCSPTASVPSGLQSASGAVAADPLRTLTSIPLLPPPVLDHGRTPRHQYLAADACTMLVIPSPTHSWLGPVVNRLALRRIILFTSIIRDLELIFVRCSRIEPAIVQNT

SEQ ID NO: 980058 - protein, 61 aa, Homo sapiens
MRHCATTGRGFTAGAARVNTQNRGVSLPRRGKKAPFGKQYARGTQGVPPLTSLSAGENYNP

SEQ ID NO: 980059 - protein, 490 aa, Homo sapiens
RRHTGGLRRLSCFSGWHFPRAPARQRCWHSCSAYPWLWRTALLPTTYSSTSRHAHTPCVPPAALPLRAPNTPCPQNTRLHTPSKASFTRTRCARARHPAPHARTRSLRPLCYTSALVQHNPTSHHILLCACLAPACTSHAPRPRTALSAPLLLPPHASTSLPTTAPLLALSHMCPHSLTHGRADTPAAPLPLHQPPPFTRLQPTAPCPPSSSTSKQLWGPQWLTVPSPLLIRNHFSPLPPSPRRIAQPLSHLPLNTLPTPPTPTGFYPNGNQLAPRWHRRTLISWLQTFQTHAPPPTSQPTPRPLYTTHSRLPPGNLPACPSRTHNPHSLHPTHLRPPNPGPLPPLRTCAPPRTLSPLLAGPPLLASPPLGPAPLAPARPFQFIPPFGAFHLTSPKRANAALRTLGSHTSHSHSHSGSSAPPTAQRGLSTPPPAPPSAPRPAHTKPRQHPAANTAPTPHISPHTHRRLTRATRTHPSRTPLLTLTLRRPP

SEQ ID NO: 980060 - protein, 93 aa, Homo sapiens
MGIRQPTKRGGTYETILVPSPSWLGYRTTRFPTARNDTNWGVAQVKNESLTGRGSNYPLLGADREPTHINRRGGGHSTRKNIRTGTPTRATRP

SEQ ID NO: 980061 - protein, 120 aa, Homo sapiens
MTRIGVPPLWRSIPSSSLTLSSVRIRSILGPAGPRIDQNLGTSHQVLKHLEPHLNKIWKLCPNSFWSYHSQSPWNIWVQASLIDFLPRVSSSSVEQVKTDTAPESPLGSPLDHHGMPSFE

SEQ ID NO: 980062 - protein, 75 aa, Homo sapiens
ENRVEAAAAGGGPRLVVRLWTPSPLQCRVEAGVCVPERMGWAGLTTQVTSIDCQSIGRNEPLDGADAWTVSHRRR

SEQ ID NO: 980063 - protein, 75 aa, Homo sapiens
VRCLAMPGVSCGGRRRVEGLRCFYWALEYLKRFKGPIAKKKEKSTSQYAADDVAARGSMFASHRIVSWGSFYTSM

SEQ ID NO: 980064 - protein, 113 aa, Homo sapiens
MVISDLELLAQRIEEPVVEKTAGREKLGGTEEVSRAEGRITPRVDVLLSTTVTWYVPPCPEEVQGDFALNVVVVSGDVITGERDHVYNERDLDLMNGVAKVNTLFTRSMHYDS

SEQ ID NO: 980065 - protein, 119 aa, Homo sapiens
MCGSDRPYIDRSGVLCSPCITSYRPMDLLTVENLQFAIHRQAHCEWVNVWCRTTIVGTLHVMKRVNLALVMEDVIERDYEGRIWEYQVSCKKYGCVIMSSMVDGSGPVGYEEWLLDDGM

SEQ ID NO: 980066 - protein, 240 aa, Homo sapiens
ERRRRSHRLATLPMTDDSVEQVSSPSPTTDGEQYLHQVLKISKNLQYQRCRCGRTVCPLEKLGPGLPLDLSQWCQKLHATGEPQIPSSPVMNVPRQKKRIHRCVSKILLPKANELMEEELQQEQDCIEKTGISKSVDGRRKARQQLGYEKGRGIRKRRGEETTTDHYRAMTEEEEKGEIQKVVRQHDYSDYEDRSPRSFAERCSSPRKIESAGEFSWVHESMFTEKTTTYQYPGHSIPLI

SEQ ID NO: 980067 - protein, 399 aa, Homo sapiens
MTSRAPRGHSHAAQPTRKRNTLRGALGPGSTTWAQTPLWTHGTPLIHENRPLDGPTATNGPALGARSAPHHTLYAAHRDDAPGHPTTPISRRWGAQHLPDKHASDTGRSTTTPMPCERRTNLPAHTAHEDDRPNGRMASCHGNTLQLVAQGGTRLSHCRHQDELLPQSRCGHLLPSSDSYQPTLVYTLCNPVPPPSYVSDTNGLGDQLAAYTPAHSRHVSLLQCVPPYHSLGESHLSVSRHAHASKTAPGTRLLALTLGRHKGAPSRMVPSSPRITFPYHARPYRQPATINPCNTPLWANAPHDPTDTPHDAKGTQPNAPDSQWQTAEVHSAPISPLTTATGQPTSAEYALTWTPASSPHPQHADRRLPLKRETNATRSSHCSRRQRTGTRRTALTRTA

SEQ ID NO: 980068 - protein, 116 aa, Homo sapiens
VEPAQLYIKTEAIVKFKIQSTGIWGMGLQLQKVNLNQIPLGRDMQSPGDENSDGDPITQQEVREKNEAASKKSSARKEMWWVLVMTHVELKCILEWKKHAIVQTSGIRGTGIQWCM

SEQ ID NO: 980069 - protein, 103 aa, Homo sapiens
MPEEYVARGGSNGCECGSSAIVMTTSRDARPILSQLSDGAPHGDERNSSVETTHRSNSDRCDGGPPPSSGNANVGIKSPQFLINGDPNRMTGEQCHGACYMHQ

SEQ ID NO: 980070 - protein, 122 aa, Homo sapiens
LLLALSCVMAGSIRGWDLQISDSRTGKVYPACAVSARRECRRSAVMSCRYAGQVARYTGVDPRGGRSVSGLTSSITEHDERCSLASLERSPSICDPLYQLYFGTKERLYEKDRSVADQISSA

SEQ ID NO: 980071 - protein, 252 aa, Homo sapiens
MDIAEWMSYNGSTVSCSSDVYVIEFGVVTMTVIGHTTGEPTNLIELRRAARRDVQARLQLLIFGYAEGDEQVVSGQARDEYTTPTNLQGHHPESSALHNKRCPAIQSASVPQRVSAAHRKRTRARLRGTELWMKNPSRALTANDSEGTWLHNKPPALRGPTTHHAPLAIATRSCHKTHATPKKKQHQQVGDAVESTRKRHTPTKCLQPVPNTRSRHTPRQAQPPHTPTGGRQAMPPTTCPPDQNREPPATQI

SEQ ID NO: 980072 - protein, 162 aa, Homo sapiens
MNVYSSVDGHRRQLGSSTGGPDGVPGRKLLTICIFADPRVNWVPRVMARYCCPIRRCCWGTVKQCLMVVPRVAPGGPNRLGDDNIADWMYDELLEKTYWGVYCRDSDVVGQGSLLDDKVDGSYLVRCRSFTPDAVVSNLGLILKRLVGRSLGHKGLGLAVHG

SEQ ID NO: 980073 - protein, 66 aa, Homo sapiens
QVNLMSSPMAGTGLGGWRCCGGCDCRSYVIQRLVNAPGVRDSGVQSVWLDGRKASQSNRAIARELP

SEQ ID NO: 980074 - protein, 67 aa, Homo sapiens
EHLIAYKKFPMRVQCVICCGQIQMTVGGYVKCISSIGVELCVTAYWVEKYMLRENILNQLRIVSTSR

SEQ ID NO: 980075 - protein, 148 aa, Homo sapiens
MGPPDKCLEIYVLTGILIELVEVEMLTPCDLHFLYKKYRKRNLQFRIAGADGPWFVIQGNLVVRCSYWNIALQVVLFARCWQNYLRKNRRSVKSSRRTIDEGMVVIAGHGVAVDKYGAVIVLIAKKHTRIRISRTPGGTFNLGKDGLL

SEQ ID NO: 980076 - protein, 221 aa, Homo sapiens
GAAENGCYYEGYVGDVKRYAMSDFRSVVVRDGACIRTATTRDKEARRHEEEGEEGRGHMREKSKGRNEAASIEKEQKREKQEKNRNKKRRKQKKESTRGKKETQTQREENKEQTKKHRAQQKERLMRTRQGRTEQSEARHNRAEKGTKRQKKEAKTQTRQKREEKKGHRKRGRRRQSCEEEEKKTNTSKKKKATHESPNIIQGTQREKTEHNKSQRAKEQK

SEQ ID NO: 980077 - protein, 68 aa, Homo sapiens
EPVVSALPGELVDKCIGSRIHIVMKSDKEMVVLFLRIDDLVKYGIWKDVTGGLKIMIREGTWDLLTFR

SEQ ID NO: 980078 - protein, 306 aa, Homo sapiens
LPVCTRRGVVYAEVTETLRLCARDDRCQTEHHAVARILTSGSLGKVERRMRCEIDSDYVRWSDDSCEVNGDSSAQDTCASQCRGVMRGIKLRIGEGAIVVASSKSDDELRGVENGGKLMTVRIVNVCLRRSRKLCSQGEDASEGPSVERHSSIAVRGEDIQFVIVARRDCVERQACGDLVSPGARVKPRANWLLCTGAPLAALRNIRALLMLEGVHHDAKGRRLYAWRTVTCVCDSQTLFPVVAINCGLVVPNNNGEDKTLARDKQKQLGGPKTTNAKRASGPNNGRERRVYKQSSEKRTHPRIRP

SEQ ID NO: 980079 - protein, 106 aa, Homo sapiens
VVSMEVMSGCGGFRLVRWQLCAGSVPYGARARIEGFHHVVDFRRLLLLFDPVETMGNNDYVSSDLLAFYDRRLLTLLRLLRIAIDGIPVSSLHRLVVICIRLVELN

SEQ ID NO: 980080 - protein, 77 aa, Homo sapiens
SSSPDMVCTYAGFCYMLALSAHCRAHLSVGHLASITRLVSSELIDVMYYMNPYRTRCNYAVNPLDSPRGTSSTAVSV

SEQ ID NO: 980081 - protein, 196 aa, Homo sapiens
MESPGRLSKAVAWRKKLEEVRELQSGAPPDANVAITLSGDDVSMTCITSKEELNCQEEEDPMNKLEGQEDRVLPHLVGEHWITRCPLRGYAGAQCRMSWRAAGLFTGEKEQAAGELRAGVGHAETRRGVCAGEAVDGANRAGLRGATVNLVSRPGFHLVRTGNTGKFGGHSAYGRQPAHRWCNPARATRGGPHLGP

SEQ ID NO: 980082 - protein, 72 aa, Homo sapiens
VCPWFQPVMYSYPSLAVHTSIKRQSNGSSRHVVIDIVAVSAVSKVTRCIAISEFTRLLDTKIKLIPLQVPTK

SEQ ID NO: 980083 - protein, 242 aa, Homo sapiens
CLPAGVCQVLRGKLRRTGSSGEAPQTVYTSAASQWELCCALWRLHGMMRPYTCTTCAEVSSVDVTNDWKNVSYELLNDLMIHTEVSYKGTGRGGDSVVYGKSVEGGPVISDYEIHGGWEIVFVEGQIAEVKSNRCVARIFVEPSTFSKRLRGYQTASWASVSGLGMVNRVGKANKMRKSRLGQVKTIERHSFGGEGDPTGEVHTGKRLGGQVVMHDAVGAAGRGGEHPPRAGLGTHRARREA

SEQ ID NO: 980084 - protein, 208 aa, Homo sapiens
MRIEKCNYLFARAHLILAHRMMFVRQRLLRVFRFCKIVNVIKNLKRSAVLANVMVDQSIPGKELVEERYSGVIHLRFGEDVEMNLSNTSESYGIEISDAMKRVEEIEQKRQARFIMNRSTNKYIELQTNGQDFSQRRQAKQSNLMRAPLAGEGNTVGERQMVAAVTRGCGRGRCSLEICVAISLHVHVKMPLDTVVTAKLCMFYVRSL

SEQ ID NO: 980085 - protein, 31 aa, Homo sapiens
MLMWVGLRKGREWVWEVVEGGRCEDDVVGDV

SEQ ID NO: 980086 - protein, 61 aa, Homo sapiens
MSSGRKSMREQNSGNSESPSSEPNEKKLISFPDSEVVQVSDGSEVITLSDEDSIHRCSRQN

SEQ ID NO: 980087 - protein, 57 aa, Homo sapiens
MGYPVEDGRYTFPVGIRRLTHQQYFHFRYHGIGCPPGPILSGLAHPGRNFTACRAWA

SEQ ID NO: 980088 - protein, 140 aa, Homo sapiens
MQRGRSTETLLPRIIDELIAFHDHAPHNHVPYLLPSPVCPFSYTLTTEVTNTSISEAQEIEGRLNYPARHHPSPHRAPIPTHLYITDEVTIPPLPSNQFGHQWYCTYEYNDYGDLIFKLLHTSPIIPRTRRPAILDVTIE

SEQ ID NO: 980089 - protein, 148 aa, Homo sapiens
MLCAVVKLIGANKEFITYRGGITDVKVMTSGYTLENGCSLGLVQQDELHDVEGRRQVNYEGESKLDVNVATLVDECLYSQRFPLEGFEITPPGVLNGLTCGFTGLRAILSGQHVSTLLGGRCFESERMTDGLDGCEPLYVYLVSGLPL

SEQ ID NO: 980090 - protein, 72 aa, Homo sapiens
LTMERDRQQMRDMALRFQTCYMHRNRRKHLGNGSYDSEEINQDIKMSRNFCSLNDGHIPLEDVQEVGDYYKL

SEQ ID NO: 980091 - protein, 108 aa, Homo sapiens
MGVSRAPIRVWCRQGVTCCALSLGLILRSQLLMPQVAGPENPNLGRAPYLYPLGGSPCPQCLGTLTSALKMGFVFYVFFEGVQDIQYKSLMVQCDQSRPRSHPKCAGQ

SEQ ID NO: 980092 - protein, 31 aa, Homo sapiens
MWPTHILEQPQHNQTTIIWTAKNIDHKHLTS

SEQ ID NO: 980093 - protein, 221 aa, Homo sapiens
MPAGSCYCPGNAVIQPEWADAKDKTHGGGDDSFNAFCRWDGGVAGNVPGLCCRVGDPTVIDEKFALDIRTGSIVTSLMRAHHTARRDACNNYALRATYTIGTDDQLTLLLDRIRHDWLTSVPGSLGHSCGSNSLVVVVESVFMGFGLHLLQWKPSLSVSYEQVDSELEVPPFDPVTQGFHTAGSGIPTCLFFSNAKERREAIGCGLMVNREARWTRRKTTN

SEQ ID NO: 980094 - protein, 91 aa, Homo sapiens
TRVGGREEVKLSEAPPAGPPGKGISSIEQKTVILRKEVVGDEWTYLGECGVLVDMRITICDRRVLSEWFGSNCLDSKCIVSRSSSKVVSIL

SEQ ID NO: 980095 - protein, 113 aa, Homo sapiens
MRIEIGVICVRGHLSCDTAMMFVRDDAEVSMICKSTCLKHFTKRAQSSRKLVDHEHSGKQLGKELYEWIIHLDICQKVEMNLSNTSESYGNKTMDADEEQLKMSIRGAKAKIE

SEQ ID NO: 980096 - protein, 127 aa, Homo sapiens
RPWNPKSLMKSALVTYRQLFHPESVCITGMDDAANNLCPVGRYTTSVWQIMALVLVRNSQGGLKRCTGVFRGLLGFSHSFGWGNWGLGSPITCSWNVSRIVFWAKKIRAGVRPVVTVATTQVSHESC

SEQ ID NO: 980097 - protein, 72 aa, Homo sapiens
PPPAPGKHVRTTLQAARMGKEKRERRTITAARKGRRRPSRNGNEEEGDQYGTMDDRGHTSVYEVDLMEYHAK

SEQ ID NO: 980098 - protein, 118 aa, Homo sapiens
MTGNKLHHGADKVVHHQWLAQSRYHTVHSLCLLGLSIFCASFVHLFTTAGYEGSEMSCAMVLIHCKAPSWSYLDPRRGPISCSENRGVLAYDLGWAAVMRSAWGKAWFLSLAGGCLRT

SEQ ID NO: 980099 - protein, 220 aa, Homo sapiens
ERSFRDCPHDSPVVDPLICNSSRPFMDWKALLSSLNDFASLSLLELGQCVDYVVERQMAHTTYCKYNSSVTNDCELRKDGGGAARRRQTSFSPSIRHIFRPMRAHKLEQHGRTRLVIRARVRTESVSTLLIRPMSAAPQGVKNWLAKGLGACTSRPIHPSKAPNYPNRGKPPSRIQRELHPRPGQSHVCRERTGRCSVTSLSGRTGTEEQHGYLDCTQNA

SEQ ID NO: 980100 - protein, 133 aa, Homo sapiens
PDTVVHMTSFSVFWKLLSPGDSSDSLLSLNRIRSDRCQPLNSSTHEARPGILVRGSSGHDCLCILLLSCVVSILCLVDCLLTLVVIPAVSSGAARQRFVSIASSPSGGRPQYLACAAHWSSGVSPLSSCALPL

SEQ ID NO: 980101 - protein, 72 aa, Homo sapiens
GVNARTLMRRVLVWQTLWSLVTIAIMYHNSSREAGDWDLRPARQQLALTAGCKPQPSGFRCKSRGQGEGASE

SEQ ID NO: 980102 - protein, 155 aa, Homo sapiens
MVWRCSTYSCVTDVRPFWLHRLHLSCVGLARGCSVFLLLGLLPAAYLNPLRRVMRRTSAVHCVILISFTGHCGPFVTQGVLLPYCFMAGCHRKKSCPRSAGFLWRLVKLYPFCLELLSHSQLLTDGGPSVLVVCASVLWKGSGPLFELSINLCKQ

SEQ ID NO: 980103 - protein, 111 aa, Homo sapiens
MSSFERRPLPSGTMGSRLIGGRYVLTFKVTWISFKWSTIRFLIDLLHDVLNDFFGKGQLCNNYNLSYTFRVVANVEHQAGSLLVTAAVFIIGKAVNKKNNWGLRKNLNWGG

SEQ ID NO: 980104 - protein, 144 aa, Homo sapiens
DQIRTIERNQEMPHKGAYVIWYGQILKDVRYLGLSGPRSVAGVVYIRKQDGHRSDVCCTITTDLKKLIVQRHHQTSAQKAIKFMFDEKLVTGMVCSYITSVSLWNIWLRLMVLQEMYTTREPKGYSRAAPDSRTVDSSQNDERQ

SEQ ID NO: 980105 - protein, 72 aa, Homo sapiens
EEDNRSETASSGYASGQQVTDEPPLEEHVQGNNESLQLVNHEANSVAVDVMPHVDNPTFEGRRNSYIKRLLS

SEQ ID NO: 980106 - protein, 178 aa, Homo sapiens
MNETEHWVKVSTNIHTPQIPFMWSIFAVSAHPGMGKKWDAMTEDQGGGSTLGIPGIHIGLEHELCTIMSTPRETTTTATAQAGKSGGRPSVHEDNTRQRKKEDIIKRTKNQDLCEDGHNNSDNMKNKDLTINKTNDTTGRGEQLQHPHKIDGLRTYTRGGANKTLVTGKRDKHTSRQN

SEQ ID NO: 980107 - protein, 79 aa, Homo sapiens
SALVPLADPLLYDVVTALIIQVLSARSGCVPIQTCTPSCYISCPVHNSEMEVVRSDSPNWRAARIVGTFDRKLTEYDKS

SEQ ID NO: 980108 - protein, 301 aa, Homo sapiens
VFPFVCATEDPGVCHGPPPVPVVTGIVRIKPYPKSRFCRGVPDAKIRISYDLGRKNGKTWIEFPGLCVTWCHVVNMSMLSSETSLEAARICANKYMVLQFVAKMASHIRGGINPIPCHPYQQDGCTCAWVLDRPPNRAMDGALAKPQGTVVHVVHIGHVIMSIRTKLQNKEHVIEALRMGYVQVLLADKIIHVSKKVGFTERSSADRSLKNVGRKRESIQMFGVSGGSPVWCLLASGGRGHDGSMCCALKSHKSVLCKRARRKFGGRPKIEQLGPEGKGRPDGRGPQTGNQPVGKNTARGL

SEQ ID NO: 980109 - protein, 114 aa, Homo sapiens
MKKRGGAGTTASSVEDKLPRIGRSGEGQFGGTLYQEGRSGRPIYYKLSPPRRGGNGLILSASRTFRNVNDTTIAKKEGKQMNARKMKTDQGKARYRWSDWYKSQTYDEGLYNNE

SEQ ID NO: 980110 - protein, 109 aa, Homo sapiens
TPLAALKRHLCVGPSSASVARRSRLCRAPPSDRRGLPAKRNDRPGCPLNSSVIFLIPCIGIAGWCSSYCLGARTRSARHAPVTSNIDWLLVGYWNGCVFGKYGPSLGLT

SEQ ID NO: 980111 - protein, 115 aa, Homo sapiens
MISALVVMGWQLRLNSESKNYRERNISHTTATSYIYHSIPSRHPDIQIHTQHTPTPYIPTSLIFKHIHTTTTSLIYLPSHPILLQPHPTITTTDTIHSNRAIFLSVPPQLAHPHY

SEQ ID NO: 980112 - protein, 81 aa, Homo sapiens
ISPLMAVCNVVYGSSVSSRSIRDDIARSGIKGLSEGYKFARVAMSLYVPKMNYRHFTMVRIRALAFMRGPSKYFLHRQSQN

SEQ ID NO: 980113 - protein, 135 aa, Homo sapiens
MEFQHRRSEPWAVLGQALGPQECKKLMNVCRIFYDMKVRKMLHTRRNQKRTKAVIFWSQLQTNKCIIVEDRQRDLGGKDVGVTITDPFKHSVLDCFLTTIVRYACMMQALKQKNPENDELLLLVGTKLAPLQHYT

SEQ ID NO: 980114 - protein, 215 aa, Homo sapiens
MLSWSRGPDGSCVPRALLPPPCPPSRGSSSPVTLAQAAAPRACPSSSAIGRVENAYIDNLMADGTCQGRGHRGPTHRTLSPSRSWSRQIPGEKTLQFNNSRPRLRAELSLGMTNRPVFQRLIITVDIVACPPYGRCPEHNVIHGGLPWDHQHGLHDTCGGNFKTIGDTYQYNPSEKCNPRVDRLPTSTFSQVANLCIQPQVLCTDVTAIARVAFR

SEQ ID NO: 980115 - protein, 349 aa, Homo sapiens
MALAGTPGRTERRSVRLLSDQEEHKQLVLDRGPAVIQSRSILVITSTLVGARHLVTLMQYPCTNRNCNELIVMRHFFGRTYGQHVRRGIFGTGPIVPSMCISSLQHVLGSLLNSHEEGYRSPFRKIPRHAACLLVRRAKVVTNELNVGVPCLQVRYQYVYCARKITHSKQSAVARSTPLLGWVRYAPFGEMLDRRTASSCSFSFDIIYRRTGNAMTLEPEEGSLSRSIGGREMLRSIGEATSHQNGRYLTRTASVDLGRNARYRTDSVLEEVAPGTFVLCRICLEKPSEPGKLRWGLTLVKVSNLVPDSDKLAQVEGKARVTTMAKARQHNGAGYREKQRREVDTRRGQ

SEQ ID NO: 980116 - protein, 142 aa, Homo sapiens
MGPLAVLLPSHVVDVRRVVLHAGAVAHLPAHLLWRRRGTLDSIEMTGKTDVAQYSYSIECDIPLQVRRCTSRRVATIQRIFFLRSIVVFVQRDVALARVSNMPRLVGNIDMWPVALGGGITWRKVAPGSLWIAYNHHGCCIF

SEQ ID NO: 980117 - protein, 313 aa, Homo sapiens
AQGAGLERVLEWQEKRIPYSDSTAMLKGTLRCQCLRVTPWSAELCDAIQCAVSTLFMQLIPQELVLYALGPACSGTPLGCALVSTFHQQSSADSLQEGFLLAFMGHRAFCGWLLCCSPRFIPLVGVGSAALASLCSSRDSTDPCVGLHLPVRSRYADFPPGAIRAGPPTLAYRQGSGTLVVVNFMARCAGSVMEKVVLALYLVVMGCARSPGPVPVRSVPNRWLGVSHVCCHQGEEPEVRHLAATEAVHVASFRGELVDYLVLGSWSLRWSGHFPGPGALKACRLALVPRHLLGFPQARAFRGGVCTAPGALG

SEQ ID NO: 980118 - protein, 250 aa, Homo sapiens
MASDVRFCLLGITVCHTQLMRGLILECPDDTSCCPGAKYSKIVCRDPHVVIPLEPISGRRVFLRKSSYRNAELLGNETHVNFKLRRPMSLGIGPRNAMGSVDAMDADADWVTYVASVGVLHVFCGRTLTDCADTDDSRPVLVVAPFVLQSDDLVPIFPRTLAERSFAPVVPLCRRIWPAEEIVWNWPCGHYLRSSLPGHAYLMVGETSHTLQQAEWGIALPMSGMKPKDGSGRNKCRADQVFTTTAGSDG

SEQ ID NO: 980119 - protein, 75 aa, Homo sapiens
MSADCCKCSGPCGATNIRRVQTGVPVPGKIGITPQGLVDAGGERVFQGPTRHRCLLERCRSITHGGGTGTGRERR

SEQ ID NO: 980120 - protein, 82 aa, Homo sapiens
KVGAYMTTLVYKPDTVAFVPISGWNGDNMLEPSANMPRLQMTIGMSPVMGLVLAMWKHQLVEALELAIRTSNSFQLDKPFGA

SEQ ID NO: 980121 - protein, 103 aa, Homo sapiens
MCAMMQQEESIKEKSRRGNVIVIKWRKNKVEFVVVQKAKRDLGLEMLDVTPIMRESLFQKTNLSGGNLTYLLTIHELCQCMLQVTLIVKDLIVQTIIMYNPIW

SEQ ID NO: 980122 - protein, 103 aa, Homo sapiens
MLPTGRRHNSQHVRLNQTTVVITAKLTNMGRTVEIIRGSHILVHFGPPKGSLSLRILLFEQNNFWEVGLGGVRGALLVLKFNTETAGQNEVPNQGQNAAFYNS

SEQ ID NO: 980123 - protein, 287 aa, Homo sapiens
AVAGFVVARVRDTMTARHPCDPTYSLGERVLRIMYFRNRDQASLTQGHENYFHPLGIPHLGSNATLAVYKNADWNTIYAYGDLSFYNMWVNLSRPLGMNSVGAFPAWNHPGGVTTSVRCGTNLLTKATCAAVSDPRKINHQFLAIAVNGSADAYMRSNCALPVGEKTSCLGCLVGSSYCVEAFGPCMDTIGLRTSQDFQIMVSQDPVLEDAGMAYQSWRKARFFCWRTSAMVAVMGMTVWGGPVLGVEEEMILITGGRGMYGQAMRGCTQFDRGPQGIRTVVCLGFP

SEQ ID NO: 980124 - protein, 58 aa, Homo sapiens
MGTGLDYLPYCFAKQGALTQTWGAAGQKTFNLVGGRPMMEPRRAQGRASGGSPKAGPV

SEQ ID NO: 980125 - protein, 95 aa, Homo sapiens
GGFTWNISSSPHNDFAKMENTRPPQLTDGDRFGESRAKAGTDGNTRRRRARILSPELSTIGNKSIQVRMKPRLVKKAKQNIPFQETGKHLPQRLD

SEQ ID NO: 980126 - protein, 96 aa, Homo sapiens
LYHALGRAAPDASMTLGVAVGLGLVLVLTQVLAHSFDQYRNTDPAEKRRPLLHARMRMMSTRADCLDGDRSTGGRATVDMDLTAPIGICMEYLPII

SEQ ID NO: 980127 - protein, 303 aa, Homo sapiens
GFTRNSSSVSPHGYVRAHPQRPIIIRHHEHERIRSAGSVQWGGPPPSSTAQLPKSPYAKLPSSPTSGLPPKASPFKVQTSLLGGIFSFLNQTKVVLKRWTHNERRGFSAPSRQDPRTCANFPTWNQSTQGGTSAWQSDYPGMNVSLLLWNDNGFDDWSSPRQTADSGNRTRNLVPSPRRDPLHSEAFLSGITQHVHILQHNKFTDLAYWNRPTHRTAGVVTLPLPGMGAHLIWIAEPTPRRPHTTRKRTLGYKRKATRPYQPRVLAHPVAAGDLQANSRNVGSALNTGPRRGKADVGRKPART

SEQ ID NO: 980128 - protein, 137 aa, Homo sapiens
ALSSERASVGSQYVLSSPLFLFRTWCGVKQTAVPGIYRSSGGCSSPQKRCLVLPALPVIRDQFHRGELNNKICRREPRLRAPTPKWQKGMENSLGCPLKIPDKQRIRFLKRQERSGLGKAQEKSMSFATDHTNDEKE

SEQ ID NO: 980129 - protein, 245 aa, Homo sapiens
MTNKKRENLGCRSRRSMGKSEKLSQCRRDLGAVTLRDSKYAGELMPKSAKEIPLTRREKKIYLSLKKKASKIGRKEREGWLRVRRTGLTFCVRLCGRIFNPSLTGSYMAYDQCEGLGKYFPRSSKKGFPTFCGPFDSGTHTAKLHVRKPVKKGTKGGAGAWVPPLLTLVFRTQWVYHGGGPKGLGRSPFGPAWQDGVQGVSQDEAIVSLVTSPFRALGNGGDNCMRNPPKVRVGTQIPPGTDSIQ

SEQ ID NO: 980130 - protein, 102 aa, Homo sapiens
MSSVCNTTCLWIELYTMRSYLFTTHQLVMVTWGTRPDFCPFPRPPPVPTANSTRYNQITVLIPSSEAVGKSLPLMAGQFIWRNGPGLCVCRLKFPCFINSWN

SEQ ID NO: 980131 - protein, 133 aa, Homo sapiens
EQQRRKRSDTWLGPKLDSEPFAPFSARRRPWKTDYHRVLVRECALRLLGSPVSFPVEHRPDSVPVLMNRPRAESVKEEAQVILHPRKTRIAEYRTERCMSMIHMDVMWADGRVDDELGGRRRELIGTPRENSD

SEQ ID NO: 980132 - protein, 183 aa, Homo sapiens
MKEGERLDVFDIIDKADRDWYDHKVRLIVREMSFLMNVGLGCSWQDNVAGHMWELWSDLVGQQTPKTRTQIAYFQELIPGPHAEQQDKPCDAPAPPKAHANHAEQAAQSHQLKGNPSSHRNRLTQGGACQQKNPGERDEPTQTGSDSTHGPDDNTHGEPYGHDRGQTTRSSNDSHNKTQPSPP

SEQ ID NO: 980133 - protein, 100 aa, Homo sapiens
MRVHCWPCFSYCSDQQSQNGRRSRVSLVAWRLEWVGMRRVLCECPLTGGEHLVGDVGTQVPPLPCCSLSPSLAWISPRGCGSICRFRPELSGFRVYGLAS

SEQ ID NO: 980134 - protein, 185 aa, Homo sapiens
MLTQTNKNHAQGCYNTLPDCNPTTPSHTQRTVDSKPSYSPGCTALSTSCIQPSRQHLHEHKALRDIPPLIASCQDPKGHLRYPIAAYAQLAWTHDPLDYTQHRWPLTTARDNPPLPTSSTQPWIKHQRRPGTPPLTLTLHNVTTPISLPPQRHPPPGPAPHNTPLTRPPQPPSPPPPQPPTQPTR

SEQ ID NO: 980135 - protein, 117 aa, Homo sapiens
MWGTGLVAVVALWQCVRLVSCGPLSGYATRDRCDHILQSVKCDPSGLDDGSTCKAECSLQLCNYTIGLAHGISLRTRKYTLLTHTRVTCGIATFSREKARVLQREGSLNSLILGMRH

SEQ ID NO: 980136 - protein, 45 aa, Homo sapiens
MPKNNRGPRKRRHRRRRKRHRANKQEEKREKKTHTRGDWKGERKQ

SEQ ID NO: 980137 - protein, 131 aa, Homo sapiens
YNIHSHRTNHIIISSSKTHLSPPWISSPDVGNSQNACNAGDILPILHPSRLPSPYSSALIYHSAITLGSTKLFYYCTLNVCRKNLVKLLSQAKLNMTSFIDNSFYSEKIPSLRSSTYDSLKPMSKPPSLGR

SEQ ID NO: 980138 - protein, 239 aa, Homo sapiens
MFRKRCHSGTRSSGGVPGIGVSGQTAANPIVVVVMYRFTIIYYYYPTTHIPTSTHTDTYANHNGLRSGGTRRYEGRGTGGRVPGRGRRSRRRGGGRGGPQPTRDKDGGRATRGRRGGGGGQEEREDAGGNARPRTRARTRAREGARGREGEAGERRQRKQGREASESGRSREDRRIRRSEDRGRRPRKTQARARNRRQDDSREERGERAVRERGAREQATQRGRSRAQTNSRHNRATKR

SEQ ID NO: 980139 - protein, 297 aa, Homo sapiens
LITAKIQRIIRDYYEHLYAKKIGKPEEMDKFLDTYNLPRLNHEEIQNMNRPVTSNEIEAVIKSLTAKKTLESDGFTAEFYQTFKEELIPILTQTILKNRGEEDYFQIHSMRPVYQNQIPKPDKDTKERRNRTKDRRKEQTRKKDRKEQTERQRERERQTDRKDRKKRTETTERGPTDNILMILMPLKIPPKTIRAITTSVQCRIQITKNQYFFCHRPLQEVYNSSGHYNTRINHQAGDPRNITGRRRHPGRGSGDNISTPHSRKNDAIIIYSSESKHHRLCSITALANTTPDKGRHR

SEQ ID NO: 980140 - protein, 142 aa, Homo sapiens
EAQTRGREDGGHGVRKTVEPSGVLQEIFVRRELAVLDGMRIGDTSEPPTVNESVQLVPQHGLCCYVKCAEILHVDLWDDYYAEVLQTTNQTDVPLIEGSIVVSVSVESTLPLMFIEIPVWISGEKRPKVASRIHCMMSLKIH

SEQ ID NO: 980141 - protein, 121 aa, Homo sapiens
CALETLSGLYTSSVGAGGQICGNGSRDGAVKESGRLAGSVSFRAEPLPAHGPNRRWEMPVPVMWRCCEGGAMGTEVKPGRSVCSNGVEEWVCCYGVSWVPSPAGCANDSTVPGAYRGTFEA

SEQ ID NO: 980142 - protein, 136 aa, Homo sapiens
MAVVLCRSLSVWQQCGRGPSLCMLVSSVTRPGVEDHELADLQVTCVDWVPACWRGRNETSLAERYEAEEQQVSKKRPHLAEGEEDEMCHERKGGVAVSGEDTVVLRNDGMLECSVALGDAAIEPLEDGDPEDDRTA

SEQ ID NO: 980143 - protein, 108 aa, Homo sapiens
MAAFGHICGVEAVAWMHTLSHGFPRWLPDHAIKGLGRAVRNALFLVGPDTRFKNVVSRKWHLRGIVNRRVPTMFPMSKFGVLIDRQLEPIGKGAKCRLTIKEMKRANF

SEQ ID NO: 980144 - protein, 312 aa, Homo sapiens
MACRSRRRVSTPMNMLNCDDRRITGERDQKSSRPEPYETVMQTTLGGIWIYEAEVGFHSCGMDDESLTHTDNTPHICIIGACLFNCLLLLLEGCSAVIGLSGPLAGITHAVGKQSRCKPGLVSAVLRTFQTLLAGEQAVCMCPQSQEDWRESAARFIDLCNAWLIGLFYELRSEEGVAYEIGSATTGSHLRVNHALAFLRKAHGASWGWALWFGPPIRVVRSQRGPMGLQATCGELLLATTPEWGGLQSTPAQFRPCPVGAIFSPVARAQNGSPVRNSVVTRFNSGPLVGGALVSLCLFRSCLPLASPPGTK

SEQ ID NO: 980145 - protein, 190 aa, Homo sapiens
MLQYSTIMQQVNYVPFSCSYARAFMAILHIRNGVTIESEGASVIALRRLFGHHTSPASITEYERDRRADVTMFDGRVPYRSKGRLGHLCLTYGTCMTGPEVQLSPTFSSEIDCRERGRDQKERDYRADYARSDKRGPNYNGYIRWRAGKTPGKGSAGGYRQCRNRGPLIKGAAHSRETGFSQTTSRRIFL

SEQ ID NO: 980146 - protein, 161 aa, Homo sapiens
MSRGSRLVQLRAFLLGMHKLIIGAARQIVTRDGRSEERLEGQGVVDLPVLDETLRRLDVVLGASLFLLLSLTVFSMVSVPALHGLGPMLLCDLISLRIYKGVIRAIQKSDEGHPFRAYLESEVGISEELVQKYSHPALGHVNCTIKDLRRLFLVDDVVDSL

SEQ ID NO: 980147 - protein, 312 aa, Homo sapiens
ETENDYFKKKKKNSGGPVAPPPLFSGGVSLAWAPNFSPMSFCPEERSLWGGISFLFFHPGEGRLLLLPPRVVGCGRGGPWRILATLSALGGVTRWYPPPPLDSVEMTGGKNGAGLLPNNPGRQIWRYPHIYCCAQSGCLFKAPLEPRGVTHTRVMWGRYQNTCWKSDGIITTRSTWTGRVHYHPKEMLHQTRCVASIDRTYHPRWELRMNRTKLHRIKKGASKLNKPLKLIHHWESTHTSEATIRHDIMSTQVKMLIDTATSHNNVSAHAKSTHVRNHTTAGNSAPKNYEKYVRQPYQGKGDRTNPSRIDTR

SEQ ID NO: 980148 - protein, 154 aa, Homo sapiens
MGPDCPSSAGSGQVSLRFWAKVGWLMSMYVCRQMTFDRRLRWDSAIMLWSCGCDTGAVSKSTPMLKVYSVLMVMSPYALIHRLGGATDATHVAQVGLDRLGVGLRAANPPPLGAPTGKGGGRLASLHLPDLRCASEPCDAHFRGHTQSPLQLTG

SEQ ID NO: 980149 - protein, 190 aa, Homo sapiens
ELIICDSLSSKPQLSPPWYHQPMRQPAERLIAGTYFLFYILVGSRSPTHRTGAYTHEDPRLTKHATTQSATAQEPIETPEPNKLNMTAYSKELDIVEGYLFRDSMNDSLKPMSEAPIVWVDRYVDAMILFNVGGYGTNSASNSFSSPVTEQHAYALPCTIAVCGINYNRLQSAYDNTDLKFVIDIFNPAA

SEQ ID NO: 980150 - protein, 178 aa, Homo sapiens
MDTKASVNEPVYISTASAWSSVLDDNARKYGTGYKSVEMNSTLRALFILRGYMQVLEEKLNVVLLMLPFKRMFGDIQGFFWFWAKLSDSVIDNIIKQKKSELVSLGLLIRRITIITDEHRLALHHEATGRPGLTKGYADFFLVRGRKGRDTEGIRSKLVKKLEAKIANVLTLKDSVVG

SEQ ID NO: 980151 - protein, 209 aa, Homo sapiens
MGEVEVDSIAQHRVEQVRVDRYDREKTVEIALECTVIFNGLILCRVAGDVRCVSLMHTVTNLERGYYLRRGDTIVRAVKSPRGSCLEKYGQLLGTISGSTGIIGQVLRSELFGARGSAKEVEFLMRVHKKFLGIINTGESTWTCLMQYRDLELASHKPQVQSMFERLCPNSMWGMSLKLTKNDGLLVTLQRHKVAGAKKQLRGTSLAIS

SEQ ID NO: 980152 - protein, 105 aa, Homo sapiens
MWIFNVLVGDGNSCFSLTPSRYTTMLLRALGKSRNYNTQEQPGKRFITRLMVATVARFERLTCWLEQFFACTHLLAALNRNKHLSPEAFDKRPTTLGSGLQWHLD

SEQ ID NO: 980153 - protein, 49 aa, Homo sapiens
MNQFFRCPSSGSTSSVDVNFAATVDESWGNQSDGKGTSIPAQGCMAETN

SEQ ID NO: 980154 - protein, 68 aa, Homo sapiens
RWYMRSAADPSNESYSNGLVTDLCVGVHCSDRRYKHLWQAGPSRGAKIGTWLCIKDILRPCMGDTMTN

SEQ ID NO: 980155 - protein, 223 aa, Homo sapiens
ALETGPGSRAGAGAGAGRAAEARAAGAQRGALSQAPSREKLPPPLPARRRSPGRSMGRARVAAGAGSPGGQPLRRCALVPAGRSQAGGAPSPDPGAPAGPHSMDAFKGGMSLERCRRGSGAPQHPGHGAASTWPGRDPGSRRRIRQRVVVTPELPEKERGGEPQQHQQTHRVLSSTRPAQDSGTQVEPDRPRRAVIRALGGTRPEPYIKATVATGGRVGLRKV

SEQ ID NO: 980156 - protein, 80 aa, Homo sapiens
SLPVLAAGITILLTDRKLNTTILRYPPEEETPCLYQISILIVAVQPEVNIFILPGFGIISHSVTLLLRNKIEPVGYIGMV

SEQ ID NO: 980157 - protein, 249 aa, Homo sapiens
LDVLWKRTGRPPSGQPLLTGLYHAWLAAVVILGRFLQFHVNPRTIFSSHGNFFNIEFEFSLVAWTCTFFRGLGVAGGVPGYSARGSNWQTPVADVVVGAAVWRGRRRAFLLIEDLNWLLNSQPLPRFCAPRGAERSYVLWLACYQWGGLLRSSQIRSCSPFVLLMAGNRAVLRKYLAMGFWRGPLRWFPGERLMLRLWKSWWSDRHYLPQVTSQVLARSGPLLVTHYGRGVYPVQEPAGVSPPISGLLK

SEQ ID NO: 980158 - protein, 151 aa, Homo sapiens
MHEIDVGDLYCNLYGDLDDLSHNLNDARIRGSNLLVHVGDLEILKEKFSGSGGLCQEFIDEEIFDRVRLGRLKGGYRATWTARLPVEAIRGVWRLRVTTARHCKGAAGRAWERKAPLSEGDPTVRKGGTKEREEAEPASNKKRRRNQQTIN

SEQ ID NO: 980159 - protein, 128 aa, Homo sapiens
MQFPEVTAKHYYRTRPGVDYGQMADFGEQRRVDANVWSNPLESLNGPVGTYRTVYAVEQEQTSKELGPGGLDGLTWVRARGGSRRPRPRQGVTKTADTLEPTGDRTKPANPGENKQTPEKQNKHFRRQ

SEQ ID NO: 980160 - protein, 92 aa, Homo sapiens
MIILIQRESKNQQGEPINKGTADRLPRDTRNEEPPIMRRFKRITNQTRSHHTGRCAGLQGEQTRNMTQTEGTGQETTEHGKTTNNDAPPAPR

SEQ ID NO: 980161 - protein, 135 aa, Homo sapiens
MAVSWNACPYVAARYCATVPHPEKMIIAHRFTTDVAVGRTWKCGPFWWVDGLRSEGVEISRIGFKGNVKSSYFARWTFEMTVRLDVSEGDRGGKCSILHLCECLQNEINPWSMRTSCVDFFGHSDFNFQIVIELG

SEQ ID NO: 980162 - protein, 281 aa, Homo sapiens
MLRLMCPLYKEAGSLELPRDESLQDLESYDWPFGVTVLRWKELVFCMYQSLDCAETEAECHELEVFLDERCYDLLQARIFARPLTVVRGGDPLVRDEMFSLQVLQGVYYGFCAASCKPNGDDVGRIRAGTVGDYPPLPIQETLHVMECCPPARVIACCHWWLIDRALWPLFTCLCLRSCCHGWFLHGAQRAGGGRDETLKALPVIGHPAVHGGIPRTHATSQEGWYRLHAKSTGRYSRAIQQAGRSKPGIATGAQGESAHNKTSTRHPQHGAQKHLDDCVG

SEQ ID NO: 980163 - protein, 73 aa, Homo sapiens
HGSSDFYSSDFGLSWACGPVEGELVRDSPDRLNEILCSLEIQKLGWDDGGYMPCSREISSGGCRREKFGLKAR

SEQ ID NO: 980164 - protein, 106 aa, Homo sapiens
MHATYNWWTESIQYLVVQGLHLNQHESSGESGGQDVLATVGSDFAAAYVNPLLCDLSSIPWFAALTASWSLGHWSKVVSEYCAWENALGKRAGDGKGLRDLHAFSA

SEQ ID NO: 980165 - protein, 303 aa, Homo sapiens
MYIVLKDEQGQDAGGLLREWYMIISREMYTLCMPCPYLTGDRVTYTINPSSHCKPNHLSYFKLSDRMWPKLYMTTVFWSATFTRSFYKHILGHVTSDLPDSARGDALPLTTKVLGLSAATNDGPPNFRAYDPQPIQRTVQVHHEDGRYGEVRRPSKPKGAQQSLANQRENISTEVMHAPGYCPNDDLPARHTGRRGERALTPRPMHSIRTDTKRNHNMTHEIEVPKIGRPPKTEGRQSHRETQSTTQQTGQGGKTGQRLSRRHTPRRQQRTEGRAEEETQNRAKQQTEKTTQQRKKNKFIHDQ

SEQ ID NO: 980166 - protein, 538 aa, Homo sapiens
PLKLGASSGGVTRGLQPLRIEQAAYFSCFGAHLSWTTALMFAPHTDSHRTSRLRTHSTHCSLTQPSHHPDTPHTSLAPPPHRLRSTPAPPRATPATPCATRTRLYPPAPHTPPPLRHLCNNHRSPPPRHHLPHHYTTPARTPLPAPTSHHTLPSAPRRTPHPARTAPPHPHNPLRPHLTRTQARPQHQPHHTSHTLPRKNHPTPPPHPRHTTHLTTGHAPPPTHTPAPPRATLTPPPPNPPPTTHAPTHQHPVPQLTSNLPRHDPPPPLTARPPTPAQHTKPRDPDQPHPRLTPPTPPPHPHAQQLGHHLGTKPTGTSPPHTTTPPPPGPNTTHQPAPPPHCLTPPLRPPRRPPPRAQPPHCDHPAPHNPPRRTHPAPTPSTGAPTLPTPCPPNAAPRTNTQRHPTALSPVAHMVPNYHTHEQTTLSRHSLHHATRRNRGPCGHTHQASVQRHLAPHTRHISKWQTRNHDYDTAYQSTPPPLTLSIRHALAHPATRRQTPPPPRAAHPHQRRPTVPRIRPHHSRAPPTKPPAAHHTPT

SEQ ID NO: 980167 - protein, 154 aa, Homo sapiens
MCVCTAVTVDETLAKQCLPKAVSSMQESSRRNGVPASFMGKSRYDTSVESINLEEVLTGRALHEGDCRLKAMKLFHLDISIDDRLVVLSSSLCVHGGGLHPEVTWSCGATADNPQSRTGEVPRSENTDDLTILIITGRTDNKDGELHTPESQRT

SEQ ID NO: 980168 - protein, 118 aa, Homo sapiens
MSVRRPSAPLDRDWQCLDLAKNLVHIIHPMEDGRRTEEGGSLHGPWVVFAEWSLALHPLIPRVPVCPYPGLLSNVAGQFFHLQLSGSGGMGTRGGIYRWDAPEACQEAGGGKTGDNHR

SEQ ID NO: 980169 - protein, 160 aa, Homo sapiens
MRQAHVRKLCMPHKKGNICHQMQQGITAFQQLQQDHLRHPERTDCDKSLTTINSSYKRRIQESAKQIEAKIITITELLMMWQRLNRALKWLSQLTYTKWEPHQEAERVDGHSAAPSEISGATSGDADRQHKTYCIYGPLLSVTVPGECQEAVNPKCGVVQ

SEQ ID NO: 980170 - protein, 268 aa, Homo sapiens
DRPRCCLRGKECCVNRFQQVESRWGYSGTSDRIRFTVNRRISIVGSWLVWILIHGPTDSSSAIYEIDCNMSTHKQTRGTAMMTGAFSLCIADSITHIPGLIVSKGTHKRSCPNVVLHMPVQHSKVQIPTMAQTDCTTSSACRQPGLQASTRVHSFILVPLAIKEHGTSIERWTPFQKSSFITLNSSIHFTHIFGLNLLPYQSSVQKTSDGPQHKVVRVSLPSSHHCHDTETVSLDADRTPLFTSLLIPHSFASPHTSDKRRRTGNTSP

SEQ ID NO: 980171 - protein, 70 aa, Homo sapiens
GGNAVVTLGPRHEEPLLVTIDLPRRTRGAECVACVENAEDRQMFMYVVEYIEYSTLFCRSKDRDCEGVQL

SEQ ID NO: 980172 - protein, 233 aa, Homo sapiens
EKHWDSTPNEYIQWRYATGEDREELDKNDRMHGDANKKVMEQVFVMMVRSYCEELVVVESLSNLTNTKSLGGRSSVDNTWISRQKLEDMGFGTEDAEVDSAEAAKMGLNRPLTAKEIEKHLTDVGLEAEFATHSRIRGLSGGQKVNACRWCCHVEQAPYVWSLDEPTNYLDRESPRCFGYGIKAYGGGVVLLLNNVITEALCKESGWLRRSLTLLVKGFRYGALNRGNDLRPT

SEQ ID NO: 980173 - protein, 255 aa, Homo sapiens
ESVREGDASSFPSGSGVENTRAGTSSGTTGTISARGRSLYQSRERQNSQDLKKGRARPSMLCPIQAKGLQSIYNAVPYASIPQHLMCTIISADDIIAVKSLPLWIPEVINSPQLARLSNAYAIPAAAGVHNAPYRELLIMTNLGVKREALIARSGTRKLTMRRTPFFHHWNIKPNTYEGDDGPRRIARTTRHAAAVSRQPQDDQLGAQDSAYQTQNQERRSSYIHSKRDSSQGEMDDHETQGNCQHVPQAENSRW

SEQ ID NO: 980174 - protein, 142 aa, Homo sapiens
MRIEPIAENPKFCVPPYHNCHAKVKVSWNKLIGTHTPEEMSVYIPFLVHTVLILTLDTQSLGHLASAVFDRSTLIHSDVKLVTEFYYYLELRPRKTKSMSSFKLPKFLSEQSDARGSLPEEDVAHTTGIWRFQRNRQNRVST

SEQ ID NO: 980175 - protein, 198 aa, Homo sapiens
MIRGREGASREGKMGFPCCTSDHRCVYSDYVLVLSSSNLRMRAPARGLSDEVILHAELSRIAQSQKGSSHRCLMQQGRYQSKSRTITHYDADVVVVDGVRLLILLSGTSYKDLMPHDCGYSSASRVCASDQCPLRKYVDHIIFGTVIQEGENKQCGYERLTFGACFSDKTPAHTVTMALYLCQPSHDHRLLARFASGQ

SEQ ID NO: 980176 - protein, 84 aa, Homo sapiens
YVRKRHHDTAIYNRLLMNRLERLIAWQREDTVTKYYARYQEHMGRHCASCMNKCNFWSGVRCNGLTVEDRPFTITTINLMASDN

SEQ ID NO: 980177 - protein, 271 aa, Homo sapiens
MTARGFLVWVNEEDQLRVISMEKGGNMKEVFRRFCVGLQNALREIFKKSWHTPSCGTRQAWATLLTCRIHSVGTGACVEACYVKLCATCEQSYPKFEEILTRLRRQQEEVQVAWRLAAVGSVFDVSELTDRLGFVRREQVQLVGDGVKLMVELVKKLERRPDPWTYLFPAESRRLAIVANAGTQLGTGQYLKSPGPHNRGTAPCDVSDGSSTHRLEEQSKENRSRAKPRIRHRECPQAFATEAPKDHRGPEQRGGTGKLGQQKPCQQAQGA

SEQ ID NO: 980178 - protein, 390 aa, Homo sapiens
GGVIMATSELSCEVSERDTVSAGTRLLGTTWKDSDNCPTQSPTDEADSPDLTDATTHHDTETLPTHARGHAAHGRSAATASDPSAWTRLGRDSGALPIRAPGERAIAHRTKPTRTWHPTPKTRGEKSYRHDRAIDSHPTMPQAHSGPGPTPTMRRGKPPPGTTTTPNPQPITQRTPRTGPHPRTTHEPTADPRRTPQDLRPHQPTSDRTASDRRSRRQSPRPKPPTLATTSPKHTPTSTPHTHTPSRHKGNTPKPHDHRTTTNNTKDRPHTTRTHATTPAPTRPHTATAHPALQDTHQARHVRTAATTHSQMGITQETSGKSRHSQLYVHTSDNTDTRPQPTPHTPRRQDPTSHNPQAKATPHNQQEHSPYNHTYPKNTTRENHYHNTTE

SEQ ID NO: 980179 - protein, 137 aa, Homo sapiens
MGDNNNGSHLTPNITQENTQHDTHTSQNQCPPMRISRTQHTATSKQSAKTAATPTSGRQLLAKEPKQSTQTHTHTPEHHTHTTQNKHNPTANQHNDSKTTTYTANTTRSQRGHKPHTQTPPRDKTKAGKANPATTIR

SEQ ID NO: 980180 - protein, 283 aa, Homo sapiens
MTSHTFVLRPFPGVHRRRLGTILNQERMTINYVFLTLIYIRIKDKIYGTRTYGHARYVYRQHHSLAKYIPESINTKSDIEFATDTMDQKENTGKNDKKNPQERKRNKLQTAIRTPGPKTPRNTQTNKREIGIKPDTQKNHEKTTAAMEHTSTHNREEQSTATKTRRRIRQRKHGRQANTLASRTQIQHDKARTRKQDKSHTDTHETPLTPTPRNTNSQEIPQTTRRTHIHTNSNHELEMKRNAQRKQNTQEAPRQPRDSASTHQQHPPAKSITSRPRTNESKH

SEQ ID NO: 980181 - protein, 175 aa, Homo sapiens
SVWVSSAAAQNATDSSSEMLNTSTGSGDQPADCIGTVGQGEQNPLTRQTFSIGNAERSGSTKESGSRSMREGSCMMKYGSMPEIRPRRALLEVHKEDVMQHAKRATNSLGPKQVHSDNGTSPCISTPGPWKGLRKTHASDCYETGSLWKVKDRQYQANVKIDQIEDVQRPRVDAI

SEQ ID NO: 980182 - protein, 72 aa, Homo sapiens
MNDGAEARQPGSGDRQANYRVGRQRLDGPTVATSHTNATDSTLDDNATTQTHERTHTRPYYHTTLLPHHPHK

SEQ ID NO: 980183 - protein, 234 aa, Homo sapiens
ALKLGSQFGGVTRGFNMRIDKVLSLYRGPSTPGHGMMFVRQPHRNGVQHFAQLYMSSKLHTTNAQTIDKRHAATKRIRRNATLRTPTLTRGPNQPTNLDTTYENERLNQSTPANQPTAHNQLIRNRARNADADTHTHNTDTRTHDTPTTPRNPQLRQANTNRTRHRTHETRTHTEKHTNTPPHADNNPYPPQTRHEKPTNRTQHPQKANNKHGNNKDNAQETTKNTIEAKVQQN

SEQ ID NO: 980184 - protein, 136 aa, Homo sapiens
DSLSTTSHPEDLLTTTESGESVRGLASLKLPPKAQKPAREEMKTGHIDTLVTMLLATMIHQWTFTSVTAEVLDMAALMHLTDEYLKLYGQDGKFTLRSPNLLTGAKKQSPPATQIPVWENAKATLGSLKDSNHYSL

SEQ ID NO: 980185 - protein, 206 aa, Homo sapiens
ALRDRTSPQLTSVSCRCCVSRRTDRSIMSFRADQISCNLLGEVTFYVACLGRTGECPEDHTLKPGSRDVLRALGHDIPPVQSVKESSGETPGNDTAEVRLRIVEVYDTRCNLAYRWPSAKLSKQLDGPMARPLWKDCAVRRGSKLVVHCLTTCGKAIWRLPLDNRVIVWDTIAALCFHMTQNTLGDVLIHGTMYGKLMLATDPFVL

SEQ ID NO: 980186 - protein, 207 aa, Homo sapiens
MIRHCPFGGKAVVLDGLRTHYVCDTGHPRGTMEIQTQALRRRTGRVLIIAVGGVALLLCTNGGPRCDHGTCRWAVEVPYAVRAGCHCFHSWEFLCPAQDLLVVGPWERKLCLGIRCRESSNMKLSRGRPPVDCPGGDCGKVEIQMGRRKSGKPRLKVDSLREQWSKSPPFFRGDWVVPATAFNEGKEFKNLKGVNIQGNPGIGDLEG

SEQ ID NO: 980187 - protein, 320 aa, Homo sapiens
VPLHSNLGDGNETPSEKKKKRKKGRNNIPYQIQGLKLTWEWLVCKWWWLVDVVALQICFDASASFTQPTIQFTLAVINHLIGGSRPSGRALGNHLAWGAASMLGLQRSKELKWVCTPGGGATGVWKKHLVVTLEFREMTISGYWKEIRALAREYRKFEPTSEGPNQGRMVWETNYRHRTAPEEPGRREPSLVFGATTFRSETPYTWGESPDPTLHQRRGTNTYSVYDKLTYPEKGVTQWGGLEKPALALNHRAWPLFNIGVGLKITYTCPTLFPPRKRVTNGFMGKSGDHMTTWPFHYGTQLDGTGAHHGIPVFAINIDI

SEQ ID NO: 980188 - protein, 217 aa, Homo sapiens
MATSELSCEVSEENCERREAFWAEWKDLTLSTRPEVGLLPAGGGHPETMQTYLPAGASAMVLVLAARPWLLMRMGVLGRGLQEYQLPYQRVLCAAHLQPCQDGAATKEVARGTPTSMLQELLALDDYALVWPVCGRGRRWLEITKSRGPLLVAVSNARLLASYAPCLRSMSQEAQERLRGTVTLGSVVPGLGWAFLAIDCGMGSLWHWLLVVCQSWG

SEQ ID NO: 980189 - protein, 73 aa, Homo sapiens
RQYGCCISGPRIEFSCRRCMIFGCILGWDVLRLCQLPLPSGAKRYLLTDNVVKLKEFQQKKVSCMHVIYSGTK

SEQ ID NO: 980190 - protein, 106 aa, Homo sapiens
MEISPPETGRITSAPQTNMCSPKGARRTLVMDFCIRHTVWQLYQFRLELRLSSCGRQCAWEDTFSQQNVLSIAYRDNYITWHTGSTFNGGRSPQRHRGNNDYGIAR

SEQ ID NO: 980191 - protein, 88 aa, Homo sapiens
QPSTPPSSSPSEEEITFYTKTIFCFSVTLQVNVLSYAGFGTNLPICVTLLPPEKQSNHYGLHRLWIMNVNDYHHWLSERVESGVKHDP

SEQ ID NO: 980192 - protein, 397 aa, Homo sapiens
MANYACGLVDKTGTSCTVAWSQLSAESHRPPCRNCVGKSMVSLQVWHPPMEAFEQADGHVMVAEMIKEHVGSLLGTLETSCMILCAHDALPRSHAGLTVLMCLSVPDKRHENDVVDTSEIHIGKEMQEHPESSADEISGGSNDVKSVFRAASERHPCPWMDEAVSPITCILIVKEDDMTLTAFDTNRGHKTDYNHEGSASLCIGSKPYWTIGRSPFTAIHHWKATPQWRTPSKQNKGMAESSRSRRAGLTVGAGLTAHPESKAPHRGPYYNEKKRTKRAPATPENGDENGEHDSKAPRIDRSDELNNDHGNERRYSIEYTRDKNMHNQRRWQWVARWLKTYDESMKLSTSFVTGRMERHEKSEERNTITYNEKHRDDETVDERDQRRKGDKDNSRSK

SEQ ID NO: 980193 - protein, 301 aa, Homo sapiens
DDWLRYGNPWEKARPEFTLPVHFYGHVEHTSQVPSGWTHRWYWPCPTIRPCLAIATMLSVKRINMAHLCIAGSHAVNGVARIHSEILKKTIFKDFYELEPHKFQNKTNGITPRAGWFCVTPGWQQVIAERIGEDFISDLDQLRKLLSFVDDEAFIRDVAKVKQENKFEVAAYLEREYKVHINPKSLFDIQVKADSRILTTVLQQLMSFNLFHRIKEEPIVLCSDCVDWGKVALVPHGTMVLRIVQASGVYMTCGVAPGFSGPRFWRKAPGTFRSWASSAELLPGLAGACKGDIFSGPATLF

SEQ ID NO: 980194 - protein, 89 aa, Homo sapiens
VAGEDGGGRSTAGVDRGSRMRSEQLPNKDIIIRFLQEQVHMRFWHEHKLLGHIHECGHRTSYFKDHMVVYDAYNLVILKLSVCKGHLIM

SEQ ID NO: 980195 - protein, 73 aa, Homo sapiens
ERVGTVRLRIGDVYVVPSTIERIDMGDVEKGPEDGIIVRCAHCRTVETWEWKGQEWAKSRMVIFVRKRGQAPG

SEQ ID NO: 980196 - protein, 168 aa, Homo sapiens
MWRIDKERLHSLNFPIILRLHPKTKPTAKIHVTIIFIWRKSKLSSTKRFVGLSGSAPTVYSDYPDAYTTMDTSLSSVGSYIALNEGSNIEIIIMIREAFAFGNDKSLIVNEPPVNAGVTILDAGYLLDVRKNRVFDPIYDTKEGSDRDKGGFKATHWAHDVLLKKWLQ

SEQ ID NO: 980197 - protein, 289 aa, Homo sapiens
MEVTGDAGVPESGEIRSSKAVSAAPRLTAANEHGVASPPASEDLRSKACDILAIDKSLTPVTLVLAEDGTKWDDDDYFLCLPSNTKLVALASEMRNGHTTIQMEVQLGDFPRVLDVDGRRTCGAGFAGGRLWRRQLKEDLSRIILLSEEEPPDACRRSLAQPGSGKLRQSWATVQRVRKPPEVLTRRGSAVGPAVLQRDLQCWEKRWAPTTPDSQVPWREGDTKTGSHRDQDMQERIIRRGDRAHAILYDEKDKTTQGGTHKRREERHHANKSRKKHKTNNERGHNHDN

SEQ ID NO: 980198 - protein, 279 aa, Homo sapiens
EEQAEPDGTEVADKGSLSPKSETLKILLKALVATLGSRSANDVCHQRLEIVQQAVQCSGCSGQGWSTYKMYLWMVTRINLVKHGTPKQSQVRSTFIGVLGTIAGFEIFEFQLAWSSWCIKFTNEKLLQFFHTTTCIVLEQEEYKERRRLSDVDVCIDFGMDLAMPGSELIEKPMGLFSILEEECLYCLGESSTSFNEQSCYEQHLCEIPINCRIKPEPADRHDLRATSLQIHYAWSPWTTTLRVGWPRTGDPLNETVVGAYPKGWQETLVALLVGHRGP

SEQ ID NO: 980199 - protein, 171 aa, Homo sapiens
MLNFVRIYQVIAEVIVLFTCPLAVDEDAGWSTSLTKDDVVFLIIVILVSIGYVIVVLNCISVVTSTVEHFFHVLTGCSYILFDYLSFFITFTRCVSWVRVLFFRVKALSIWGGLFPGRFLPFTSLAKRFRGIAPWGSFRARAFPCRGFGWGGAMGAPFGVGWSTLCSCVRP

SEQ ID NO: 980200 - protein, 102 aa, Homo sapiens
MACLLDTPIRMSVLFGSNRCTCADYVDWLFDPDPTESSTIGRSVSFIVYTTARTSGKAYHNAAIAHITPFVLYGRMYLCMFVSVLSAIDNCIYPQTLRLFDM

SEQ ID NO: 980201 - protein, 120 aa, Homo sapiens
MLHVNAWGISEAYRSQGGWELSFECLLLYLVPPSVKEYLSKLYGKKSFGFHCRVSLRVCCHLSHTLYYSKCNRFDWEADDTGGRRTCDHTGILDVYSCMNKTSCHLLRPWSLMNGEAICF

SEQ ID NO: 980202 - protein, 155 aa, Homo sapiens
MRCEGNMIARNKSTMQTSSEIRCLGSNYNGSMPLALMPREADFVEKQWEGSLSLDGTSMALCNALGFRGVNSSFSGLCAFYGWGLDHQCGVGAPRDFDLESQWEAGLGLVVLVHSCSWSLCAHDGGAFTPNLWFAIFLPDRVRPWVHPVGLYARG

SEQ ID NO: 980203 - protein, 81 aa, Homo sapiens
MVSLVPLYRFASTSFGLCSLPEGGGATKTTHGSIHTEDAVKVNGKGGDPRPVGRPPQEGGHEKGEHKRTENGGGKNQPGAL

SEQ ID NO: 980204 - protein, 81 aa, Homo sapiens
TLRSDEQGNGMPVPEHKRKDGVLPCVMTQTWHIIGSDSRMLLVLSKISEDADPTLCNREVVSRNYNRCGNGDNAYAMDITP

SEQ ID NO: 980205 - protein, 322 aa, Homo sapiens
GVVQVENENHCDFVKLREMLIRVNMEDLREQTHSRHYELVPTRCRACERDGVHGTLTLTSETLLVFRQTYEAVEGMTFLGKLQTELEGRNETNVVMRVKEKEAELTEAEKELHEKLDLLKRTHPPNEQEESGETNNEETLEEEVKQPSRRGKQRLSRLQSQAQQLWGPANQRRTRIRNTLLLYVTILLNEPYSLLLVMSITRAGASVRTCRGRVHLIQPSTPVSLKVWVTILSLWCVLVNGCLVLLEVTYSPEWLSYLIKQRAVTRTWPTTLVGPCDFCPRRRRGEQGHMGPGHVWALAAEPPGSHLVWGTFGALFPRLSFG

SEQ ID NO: 980206 - protein, 103 aa, Homo sapiens
MVMGQMVFAEFRDNEWRESSKGLQTSEEKTIREASRVLIRSGKWPIIRCMLNFVYVMTIHLERSELDEEVDELIMGSRYGGDGHVNYEELFKDDSEVKSVQKC

SEQ ID NO: 980207 - protein, 155 aa, Homo sapiens
MVFGERPFVPTALDCMTCRKEHVDVRKDTAMVGYAQCTSWILMTRVVGQRYGLSLDGFRAEVLDFRALGIGLRELLGGISIGRGFAHCGCLLGMQSDEASLGWLALGLVRMAILGFLIPLGEVAFVIVCRGTTVGAGFGSARGYLAEVALSVGVR

SEQ ID NO: 980208 - protein, 95 aa, Homo sapiens
RVVSTQRAHYGGGCSGFVFCSSSFANASRSLVSLPPVVSVSTPNTMPSIKLQSSDGEITWKLMWKVAKQSVTIKTMLEQIGNGLMKEMMTQFLYH

SEQ ID NO: 980209 - protein, 138 aa, Homo sapiens
MRLLIPMQIICLSSTYNFGPSHTFQFHFRQSFLGSSSGAQLNAGWGTMVPCPHELLQMPLSLFSQRAWVLQCLDTWKHAPVNQGTWFRTTSRESTRPVAVKFHLGGGRKPLLKLELPFRGAGTVRVPCGPAQGFWGWP

SEQ ID NO: 980210 - protein, 169 aa, Homo sapiens
MSVGGAARHPPELEEQERVDYSVTLIREMSRGENDGGVGCSPPTKKKHRRGGGNPRGVINKHSTPRWGFRGPIYSVGDNNKRRETLPNVRSPYNNIKISPPAAGALVKPTTNRNSNTINNRTYKAKTKINKIHTRTPKTYKYEYIYKLELLQTGTTKHSTYHTLNSHYH

SEQ ID NO: 980211 - protein, 180 aa, Homo sapiens
GILNADNILAAMSRSETKLGSGYSLCLGLEAIQSIRAKTIHVFDLNGKIHVEEHMGRSQSFALNLAECCTGCTIASGHGKKYACTEITWNEETVAYKVVRTARDSSVKPNDLGLVYSLVLHVVILPPLMNMDVSCACHDVDTTVCTMVRADPNGNGSSWDAETIVKPCIHEYALEDDSGI

SEQ ID NO: 980212 - protein, 184 aa, Homo sapiens
MQNITSYHTDSVFKHTTSYYTTHYGRVQETSTIYGYTSSHSPDIVHTLNIYSHKLLNYHQMASFSDKWPLSIKGTCIASEPNDTATPRTTHLTTTKHDSQLADHHDGHKGKTTTEPLQGAHNTAPWLHPIDRTTPARAWNYPDHHTPRTQPPPTRDTRHARSTHSNTDNRNNEHTSTPTTTHTA

SEQ ID NO: 980213 - protein, 118 aa, Homo sapiens
RDNELHGSWFQSHGAIQAEFCVVRETAINELARHKQHVCLATSPSAHSCIRRSIGPGQHHRKWSDHPHCRGYVSTFRTSNSEARIPKDSMLVRARALADLRVIYMGVLLTCEEIQAWR

SEQ ID NO: 980214 - protein, 334 aa, Homo sapiens
IVTFHLNSRAVLCLIALIVTCCIFFHLYFDKVDAVDAHMLAETRWEASSALLLRLAAQKLLDSDYYTKGTGDSTPTSSNNLGITGLTNDNTTGFKWFPPMGSGTYWAFGAYGEHRKYSLKPVGNFLDTYGLIQTFPERNRLAGRINEPLPANIWVPKAGLSHAGPIKDPIIYPIPKETARVGDVDTPGTFHFGTTPVAHPGGPTPVMIKRRNVNTPAKTHHRAPTEKFTMMPCIESSVGSIQLGGGRIYHYPVHYSGLLVSSVVPMNYKAQIYTIASLRSRVQKSVRTPCGKERHSQQGLGNIPCNTGGGMETSNLPFCYTETPRSSRIVLPQV

SEQ ID NO: 980215 - protein, 345 aa, Homo sapiens
MQHQQNPLHCVLREGTIISVKQTVKASSIMAKAIHQSDRTQEQTRPHNSKSRQPHGQKGALPSPRISNKHSTRSMDTRTRDIFHHSIHRSDNPSQKGTLCTTSGSIIGNGTTVQDASRKERHGSHYIRAWVNTLGSQNRNNKSSIGHSKEEGAIFTSDEHFKQAKRGKEKTQKEKWPTRTSNDKYGPSQGKKGTVTQGITVTQITREPSYQRIGTKQLTRPGVPYNSKHTETHGVDNRGHPTWGSGRLEHNYPGSTRETPPCPYDTTQQRRDNDAQVTTCKLHTSESQVGEKKGSHKQAKAPVNREPPPRQPGQPQTTKHNNTHTTNQIHHKERVKTRTRENTRK

SEQ ID NO: 980216 - protein, 181 aa, Homo sapiens
GRSVEFFLGGSVGSSSSRVTYDKAEYTAGVRHSIAVRLSLREGPNIQDFKEWLHYSCASMYTTLMAFLFDHRTNLEMTPFACAAGDECSCRNRSCIEFAAFWITGLDPGIQYNVINCVAVMRGQERNEDLSREMQMNTCSENPFSLTVGTRGRYDSLCRVKGGDDIGRNYRSVAHVLAIDT

SEQ ID NO: 980217 - protein, 95 aa, Homo sapiens
AYKAAAMGHVVQLGIALPSELGNPGCDGATIPIIGRMNTFDGGFSYVGLCRNLIFPRTLVTHWSYVIDQNAWRLQPDVTDPMKRPMSSNASMHHS

SEQ ID NO: 980218 - protein, 147 aa, Homo sapiens
DRRTVGVRPEERQVGGVSCVGRSHCGNLACKCRKVVEKKLGFTLLHRSTGSAYADSGEIMHVDLYGVIDKKSCSVWVCQKEEIEGHRGALALVIVTKRLTVQCIWEACCACESQYKVSPKDGFYRAWLVTLGVPKAEETSRTTDAIM

SEQ ID NO: 980219 - protein, 208 aa, Homo sapiens
MSTENLSTQSPSTSDRRCRGLLSSFSFLQMQGSISRHWSDYKLCWVQHTGSKIALALTAVLIYYLQSNSLYTHRRICARLHSPTRHHARPGLTRSAHPSPTSEHYRKTLATTRPHTDRTQPEISHAAPPRAVRAPDIANTGVHNPETPPSVTTRTHQRRHRHHIRTTLLTDPIDGDQVAQQQPKTIARQLQPYTTTRHPDTTRSPAHT

SEQ ID NO: 980220 - protein, 159 aa, Homo sapiens
MAWKPHCVGISTLCRVSNRERGYLLSNRGRFPFKHEDKGMALGSNLQRVCVVGRPSVPMSTGHEGEIAVGTFTECRTCPPCAFGTFCACRSGCTRERGAPVYRVQVGLNVFQSCSTDSTERAERSTKSSTVRRFCVITTDAVTVRSPRIYAFAVASQRE

SEQ ID NO: 980221 - protein, 114 aa, Homo sapiens
MSTRGLAVVAKEIGARNQAGGLPPKKKTPGGPRERLGTKPQRGSQGLKGPHRLSRRRRYMPSRGGKTTTRTPLRQISSRRTFDRRQQISTKSPPAESAKDLVGATNTITINLAP

SEQ ID NO: 980222 - protein, 90 aa, Homo sapiens
CNAEAGGKMVADVPPRDVDRGDSWAREQMLTRIGHSLYSCLHVEPLVIIRILADTINSIYDTFNICWYSTRLMKGPTCDYRPYYTALLLE

SEQ ID NO: 980223 - protein, 92 aa, Homo sapiens
DDLRRESSGFPASTVLVTEPERYDSPPPERTDPETSPPSPLHRNPRTSPKDPELYLKYAAMTDRDPPSQVQPEHTTRTQRPANQPPDQHWRL

SEQ ID NO: 980224 - protein, 107 aa, Homo sapiens
MLLATLWCKDEMRRRSGSPDGRSSKTPHGCINYEALAPGNVSVYLNWSSQDASIVYGTTGWKLILMHTHEMNSPDLFTISSGKQSNLEVKTEQVPEFMPSPGSLNDS

SEQ ID NO: 980225 - protein, 221 aa, Homo sapiens
LILTARASQLNETNDNNLRTYVDLDGLSTTPDLMAPVSAKKDNTKVILHVHYLMGGCTVSARIDRNRIAVKVIEISIHADFAEYMYRIVVPKAAIVARHTYLANGQTKVLTQKLSSVRGNHMISGNMRIMAVKRAYRGSEDQAILSWDCKHPYELEYSYTDLCQPYLDPMKVILELAPGKLEADQVKSQKNHPAWHRPNQMKQRWEELTHPDTQKDHPEKG

SEQ ID NO: 980226 - protein, 109 aa, Homo sapiens
LHIDDDDKSGFDYEMETREDAMAMVDHSRKISSVSDSKGEMMKVDPVLYEHHNRNWASCRTIQTDEARCYMKNKHYCPRKKYLTLRKMAMESPKDDESTPKRDGVRRND

SEQ ID NO: 980227 - protein, 187 aa, Homo sapiens
MVVSYDMNGFLGLICVSTTYIFTVLRIDVDTDHIIDSPLTIIIGLIPNLAVERYLRLDIGHNSYVKQYESDLAAVLLSPRMQSFFPPVGWLTGVVGAKSSLDIVLDDRKYVVAQFHVCPMQWERYSRSHRQGSFTVVPYSRGYTLVPETEPKAMFARHIHGCKVYTWFPEIFSAMRNAPGDSDYPDA

SEQ ID NO: 980228 - protein, 159 aa, Homo sapiens
MGHSIAFKTVPARIRLLGSHLDERWVRCTTLCKASRCMHYRHGVLTGGEESEKLYDSRCRYCSRSTLLSRLIGGIANDFVIGRHSHGGLSSKKPGVLDRTYKSWWSIYCKNARWADISRMFGLTCPILQFSERACPGLGMPPVKGVLSNLCSHAVTVAI

SEQ ID NO: 980229 - protein, 105 aa, Homo sapiens
MAIPRKAKETAEEHPRDGGKEEIVWTAAQSPKKTLSLVTTVRQTDGRRHGGQYHVRKGETTPEWRIEDIGDLLEITLGAAASYENGQMMSESPMKETLGTFGPQL

SEQ ID NO: 980230 - protein, 142 aa, Homo sapiens
MLRFPDARIGAGSRRCGAPNGLCLLAYQGSHKTGGDRALDLGPHALRRFLIPAASRRVMFLTAPVSGACDVFILFQIVNHGTERVSFILCKGPVLARGVVLVVGCVLFPIYGPARVRMYYLVSPHYCEEGLGPSWYTSVPQL

SEQ ID NO: 980231 - protein, 144 aa, Homo sapiens
SYFYGGLVALDASMLMEMKQNSPCPKKKKKKKKKFVGRPQKVKTICGGTERPPRKGTRMKPRRHRRCTTKRTNADAKNQKRQGKIKQEKKTGPERKTPTRLENNHEREDNEKKKEKHTKKRDVQQEETSESIQNRNPHNSRKKK

SEQ ID NO: 980232 - protein, 286 aa, Homo sapiens
ADRILTMISELRARLEALKTPGTWNRITGSRLACSGFTGLIPQCRLMYLVILKRHIYLLPSGRINVSGLDQPLNLDYWLTSIHEAVTKIHVKETHNRPVPPKVVLCHVCALPAHDLHVHIHGLETLAGLKGLRLVRAASCVIAGPTSEEEHPLDDRSLGRRGIRASWRSKQNSRFLNEGHKPCSTSILENIRSLVPLTEGGVFVCGRHVASDVVSTLVLMLVPRDSSWSDRRPRVNGGVRPAAKFSSAPEGSGPPGLLAGGPEPRVVLGTGGDGLHEGGVIYCHFP

SEQ ID NO: 980233 - protein, 125 aa, Homo sapiens
MCHARIFSSSSSLVVAEHLRFPSGWPTILRPTLRGNRRLGSDHYPWSAYMAACSPAAIFPGVRYARGSACTIEDFCGREMSCGRVCELHRRAFWCVDQGFFPDCEALVPLQNLGRLSSTFFGKRG

SEQ ID NO: 980234 - protein, 94 aa, Homo sapiens
MWDATPPYERSKTSVYLYSRHYWRDLNPQRRLQGSHGCMTFRHCSYSANTVGGLPLKIKRTVAGDPKKQRPSQTPVHRGSQNPAALKQGCRIKN

SEQ ID NO: 980235 - protein, 300 aa, Homo sapiens
MPVYQAVVRITVEVCSWAVEESWHYRFVYFFATGLSELNTITYEVLSGGSLQYWDGSRRVNVIPIASGLADVDIMVSYARCAYEAGIALYAFLEYEVWVMTLASWRRICMKENCERYRRVGDAEIQYQVRGPVGLNGINLTGAISKIRLKGFACDHVLSVSTFWSLLDKANRFGVRQMPLEWWMTRARTSMTQGRIRVIHSPRSSGLTKAQTKWNDSWSGRDAMGQIGSRGGKRETGVRQAKSEWPGATDTTTGCGGRPGKTRTSGAAHAAPDVVPRTRDPGAQTNTGPPNTGGPAQAGY

SEQ ID NO: 980236 - protein, 179 aa, Homo sapiens
MRTHELDGTGDRQAPRYTELPCVMAELQEEGNWLLRAYMSKCTTAVAEAQRAVYPVREIIHELQRKISLNTPWMAKLVIQQGNRFTTDEEQFSDGESEIQQKYKARSGKAFQCSAHGGNQGSGMKTVSRLRTTHLAAVKHCQKAETQGDKLGAPMRKFSGARCTRQQASAGVDAERETH

SEQ ID NO: 980237 - protein, 286 aa, Homo sapiens
GLGLGLVEGAAARLSDWALACFGALRLTLGVGGCGGDSSKAPPPSPALNEPTMDYGFQRLQKVIPSVFSFSLSNMISAVKQRSGLGPPWWPPKVSNTGCPRAPPERGSRTSLGEDSDKFHCSSRGHSEAWNTPNYGLQLFPWSPDCRFPLGFTAKPGWWHQNRCRVRAIGRTSSVSLTGEEAGTNDQASRKQPTRLLYASPGKGEEEAQHVRMAHGRTAIAGTLRDQANGGAGPRTMAGRPAVKRDMHGTWDREPGRPKPVAATRPATLYRGQMNTREAKWRPPET

SEQ ID NO: 980238 - protein, 104 aa, Homo sapiens
IERRKEVESILKKNSDGYGMVKSAGKYSPQGSSSLNTRSARHPQHEEHERHEERGHILCRISESFPSISAALSFAGHSDGDLYGRRLTTSTSTFDEELESDLVR

SEQ ID NO: 980239 - protein, 115 aa, Homo sapiens
MEQDKCQILQRKDTPAQAHDSKTHATKKQHTHNTNSAHHRAEHKAPIQHMQAEGATHTHMRKHSCTERTSQTDDRTDKTNTTDSDQRQKTQTQYESENAQHRPDTGIATESTSNG

SEQ ID NO: 980240 - protein, 222 aa, Homo sapiens
MGSLTRGSTRGARILNLRPGGVDTTRKTHETDEETSKQDTEWRSSNEEKQRQEETTQNKPRDSEDNEDKVAEDRTEQNTTRQADEYVKHREQGRDIIKSGRNQKEEGKRGEEEEGRERKTETKGRTGSRTTHNNDEGKDKNRHREKKHTEDHKKKKTRYGNRKSKKGERKEDEEKRHNEREKRGQEQEEDSETTPGEKQQTRKEARKRERQETEQGKKKREK

SEQ ID NO: 980241 - protein, 110 aa, Homo sapiens
MESRSVAQAGVQWHDLGSLQPPPPGFKRLSSLSLLGSCNHRHVPPCPANFRIFSRDWRNGESAVNPGRQRSAVSRRSRHYTPAVGDSISKKKKKENINRESFVGAAFGRF

SEQ ID NO: 980242 - protein, 157 aa, Homo sapiens
FRMRLLLLLLVAGLDGPEQRPRPIWVGAQEEIKDARTPGGRVRLSSRLVLPRGYRRVSDGVECGVIRPGDPDIRIEGENYLPVNLVYRHCKHLSVSVFKPSINRVDNCVARILCAFLWMKAVRIWQGGHDVKVDACMMVCFLRQHDGRTSVCRIRCV

SEQ ID NO: 980243 - protein, 91 aa, Homo sapiens
MAERPHAGTRTSKNDNTRDHGQADRHKKKSNTEPQTEKRTDIKDKTQYSQRTTTKRCAHKATNNGRNRRNQKQETNNDQKTKKQKAQRRKH

SEQ ID NO: 980244 - protein, 112 aa, Homo sapiens
MDCAATWGLDRRSGTNCLGGTWKAHADLGSVPGLEPPHEDDTSFLRTARLRRRFCTASRGLGRNEFAAPEWCICAPSRVEGGTSVLSNEWGDLARSLQDWAHRGNELDGNAQ

SEQ ID NO: 980245 - protein, 126 aa, Homo sapiens
SLRPISCLDIHLQSNTGPTVKEEVLYRQAGPSLETIRRPFPNSKRVSWMTLENPFSGLLKIPRADVTSFLRQDVTLGIYNQSPSHKGFRDVRLGSPVTISSVVVQETGPNEDQRKSSLDLIAQYRD

SEQ ID NO: 980246 - protein, 229 aa, Homo sapiens
MGTTRGTTTGAVGVSPPNRKPRGEPPGVLQDTSQGRGPGGTTLRVLTAGRPERRSPRLTYTPRRGGVYPSTAKDNGTGLEDGKKQLEDRPSAAMNAVLPSHSVSLPHQMRLFPLRQKEGHLMEIQGERRHWWGEKLDWARETVEQKATVTKCGAGWRDRVTGGQGRVQGSQLWPPEAARDHETGKGGGTEPGGHSCRGKAIGNKIRRAQRGEKAETRNRGADSEGRRHS

SEQ ID NO: 980247 - protein, 297 aa, Homo sapiens
RARGGGGGPAEAIRAAAAERGAAPAAPALVRLGPGGRAISPPSASARGGGEACARPIGPDRENPSPFPGAPARRHAARNSGLCLRGNKVKDPRYPSGQTEGKNGPQGGDGPNHKKDSKKASLARKGTNSRCLTAGGLAAPGRGVAWQGRLAWGTTSGLKRATQLCGTGRSAGASCAICLQGGLLTGEKGEREIKGTPDEGRAIVTQTSTVLVGGKGQTQQGGDGHLRTSTALERAGQTVRTSYLGGPGLVATRGLPPGGESWHKPAGEPRFKEGRTTLPVEGGDDTAAVVIWTFRLP

SEQ ID NO: 980248 - protein, 174 aa, Homo sapiens
DCATCISSLGQQSETPVSKKKKKKKKKNLVCGGGLGPPAKKRFTRTHIRGVGARAGPQGRGKGKSGHTKAVIPHREKTLRGPEKQNGARGEFPTPKYTKKPPRGGTNTEHRVLCDNKYPRKRGEISERAPKSQGGTTLNIQHTGERVHKKGETLQKNILTTIYTPPGTPGGGRG

SEQ ID NO: 980249 - protein, 197 aa, Homo sapiens
LDRGGRVPLPIEGRKEGVYIKVDKSVPEPADEVPTPGDGILEHDPFFCPPTEAPDRDFLVDALVTLLVPLLVALLLTLLLAYVMCCRREEKAEERPGTSDIQMVHHCTIHGNTEELRQMAASREVPRQLSTLPMFNVHTGERLPPRVNSARCPSFWTSTDSQQWFQVQPEFILPSLSTPRVDIPLVIPAPGPLENQV

SEQ ID NO: 980250 - protein, 381 aa, Homo sapiens
MGTRPRRVADHPGGVGVRYQIQPILALMPHVLGIRVLRIEVPVPNWIARMEEVREPKEGLTHRWYHLTSVKVKAAWGPCHAVVSEPFVLQAIRDCTLNALSPERYLRDIDLQTRQTPVPYRTIHDLQWGLAAMHQTIMTFYGLHQGLLVASRLNQSIEAGANAIMRITLHCTHETLSMLAQMVRAALDWAWKAPGRQRALANCWGPLSSRWEKGSDRASGEGGRATKAQAQRGAPGGPNGPERSKTDTKGTRCTSGADMTSANPVLPDPWAACGCDTSTGRRPCDARPRQPGSPHTGPAMRNKVRRSTSRDESDRALAEPQIQHKSGPHSKRKRDERKGRERGGPHKSAGTETDAVGRSRTQPRRQRRGAAGTDEPTERHQ

SEQ ID NO: 980251 - protein, 117 aa, Homo sapiens
MTHTITCLSYSKTQPMNPNSVPSQPSYMTSRAIHVIPLAFHYAPHIEAYSPITCNPISQVIGADVSSRKHNTKAITHHLSNRRRFRLAGDETLVYYLRRFFPFAGILLMRLYAIFQT

SEQ ID NO: 980252 - protein, 125 aa, Homo sapiens
GEDWMRLQGSEAVELCERSTRISGEILQAITMSIDTGVTLPSYEEMTQASKFIRCAKEAPCRTRCNSGFGQQVLHMGDIDAEELGEIAQECPFHRDPHAVWEGQCACGRSNECGMGYAMYREYVE

SEQ ID NO: 980253 - protein, 157 aa, Homo sapiens
IAPLHSSLGDRERLSQKKKKKKKNFFGRGLGLGKRFLNPSGWARGPRLVLGVTCVVHRRVPWGRTRGPCTRWLWDFSHQFKTSPGGHPEGSLRQISREGGSRGAAIHGETLLQRGRLKGRRPGNTQNFNAPGPVGSHTNEKEEQQKTIHRNDQNKRT

SEQ ID NO: 980254 - protein, 73 aa, Homo sapiens
MGDAVACKSLSIDLTEFSPIHRMSFIYSYMIEAHLVDLMYTFILTISQVLGMTLCAVIQSTTKHYLNDLYDSS

SEQ ID NO: 980255 - protein, 207 aa, Homo sapiens
MRPWQGAQVHRALQQVLPRPRVSMKQFLDFGSSNAVEKTSFTFLRQGAACERGNYHEEIKLFPDRVPEPHPSVQLVAELVCPGSLRDPHGVPLDRGIARTNRTLEPVSLTPVVQPFGKPGTTARVLPNHWQQRLCLRYKDTYGGMTPFQTRNIKYFRARGSTSADLHPECFNQTRTPSFWWEDQPANSKHEALTPNGRSEVVKCYAW

SEQ ID NO: 980256 - protein, 128 aa, Homo sapiens
GSLCELTTLESANFPRCRFGGWNCGLESRVVASSSIQCSSSQLVKKTIDFFVTQLHLRACQKPDTIGDTGSSIKALTGMAEFSDMTTCFEEDEADVAELIKTPTERPAYLLVWPDEYMTGKEYEEREI

SEQ ID NO: 980257 - protein, 295 aa, Homo sapiens
GGGGNGAPRGPPHGSAGVQLRLTVTSNSGTQAILPPQPLEQSEAGVEPPHQSNLGIFGRDRVPLCGPGGPRTLGLKQFLGLLKFGHNGALTQCVAPAQKRALKLRVNPPHWVHQHLVKRKHKKDKAKEKLCVGGHMRRPREKEFSNTNRWGGAGPIRYKNTAPTRGSNRGNTAGKKRGGGFSPPKKQAGGGRRLLNTPRGVCEAGMEPFYRPNSGKKTLPAGGGNTRRRKQSRTKQEKDRTSKDTNTHQNEREQAKQHTRQQAKQQDRKVNATQKHRQRNTSEDTERRHDRDTCM

SEQ ID NO: 980258 - protein, 164 aa, Homo sapiens
MQSMHTTLSLGEQAKDSHNNNIINEEEKPVLHTNMTGLEKPCVFPKVQSHFDLNIGSYAGMGPGVGHQAGIPALGKAKGAGHRHRGRRQPGHMGNPVDKQNSERNHLGRQPQRQTARTRKRRDKTRRRESDHNNAEAHPKGYCDRKPQKEASKTKRAHDDLDGA

SEQ ID NO: 980259 - protein, 281 aa, Homo sapiens
MGCRECEREAPRAVFLDLPFAWFVAPLGPRALPPAGRKFALCSCATACGWNALSAAQLAGKMKLSLVARVLVVLKRGAGRGGGQRRSDVGARVAPGIRPRGGPHYTFSGGRRCPKNGAGWGESSAKRIQGTSTESKRPSLMVRLSTSVKGEHGPDWGRGPPKEHQVHHSKTRRNKGPCGRPKGVSSAARWNWTRSVPGRTSRFWPVHGWVETRNTRPYFPVDTGGCATQENWPLKKISARVPLKERTVKLIGKEVPMRCQCPAYFSVPRPDTKRWNMRHML

SEQ ID NO: 980260 - protein, 115 aa, Homo sapiens
MLASLGLHDRKSISLERSQVAVLQFLADVESRVGKCVDKGQKSGRKGRYGQGERRRIEWNVILCFPFVNWVEHEDCPRWLRGVVSITRGPAFLLGVTQLQGATKGDHDALNHDDP

SEQ ID NO: 980261 - protein, 265 aa, Homo sapiens
ISNFSSILLKLFNLCKLTCSGPAVTDGLCLVIPSTVGCQCGWTHCDVHEFETEPDANMVNIRVSTKNTKFIRGVVACSCNPMHSLGDALSAWRNCLNLGGSRLQLSPSIVPLLSSLGRARGDSGLHNKPKKADVPVPTVQGGQKRQAGYGPYNSNKGEAQEFYRAGPLFHITLDKPRVTLSCSRVNISDPVFPTIRRKGAGASTVVKGEKSSSCFVVAPVGIPSAEVPQGVVSSGDDHVDDNFGPGKWITTHFFGGLRECVGAAT

SEQ ID NO: 980262 - protein, 163 aa, Homo sapiens
MAEHRRNSTNVVKLNERPETQREKSTAFQRETIEQEKQAGEIVMRRAPHNIALVHFPPKALPFPYFYFTILGVVVKRSVHDWPKPTGGGTSEALLTFDLWWSWRPPFFTTFTRGNIPMEPQAGKATRADPRGPLIIPTGTVGTLTPLSIFPLVAIWGPNRWCK

SEQ ID NO: 980263 - protein, 101 aa, Homo sapiens
MLASALLFRRTVPRLFVMFEQCGQTGRYVDCYGNDHHRRDASLLIIIPSRRVPRCPQLASRHVSRCRKGGACGISASIFAICPLSSAPVSGPLHILRSVHI

SEQ ID NO: 980264 - protein, 213 aa, Homo sapiens
MEKTFMSCTVAWLSSQPVIPGLWEGRGGQDCEVRSSRPALANIVKPRTLLQDKTNNTFRWGIGRQGAVDPSKLAQAQGSQMRPRSEPLTSSRVDNRRDHVQQKHETTQTKKSVAPRPRSQPNNGGAAPREIDTAQATKRPAHAGCIPQKAGDRCKLGSGLLQPQHHPTRKKSKAQSEVPYSHLSKNKQESAQHNQSDEGPDNRQIRKHKARAK

SEQ ID NO: 980265 - protein, 303 aa, Homo sapiens
MAPEEPKGEQLHETTKSRNSYYPTAGGKKTNTTTKQHTNATTKDECRTRQKSNNDEGGGREREGRERRTDRKRREHERKAQTEDRAGTQSGKRAKRNTSSEARDRQRREREQAARKARKPRRDDADGSGGEELKDSNGRKPQENSGLSNADQTTRGPAPRTGSRVEADEERRKRGSRRTAINNTKEQTTRERGTDGKRRRRTARQEHKTVKRQEEQRRHEEKRPTDSERSTAERRQREKRRRNGDSDDAPSRRECSNNRQETRRRLGHTPETAREKREGKERERAKTRDRETRQTERRQRRGE

SEQ ID NO: 980266 - protein, 447 aa, Homo sapiens
MVHLTWSLQGAWGIATCEVTFDLQGVPCIFLIALSLRYTFGLVQSKLFPFYFHGLHGLCRFINLCILAFTSMLWASAHILCRASQLYLAVLEPYAVPLVNARLAGKHLDLSCHVGLQPLEKDEAGVGRTREHQGAGTYGSARKGSQVRSFRRILPRAWLGHLGPVVVRDRLSKACPEIEPIIARHKTVSRRTQKNCVAEETMAPLGMVIVGVSHVLCLASRAPVVAAEGEAAEDETEGTNGQEAAGRQRGETRNEQEDETDREEEEKRRTRKSAERTRQERRVTQRQGSEAKRREAKQQTEEKRRKRQASRETGKDEREGRTEQTEKKNKKEESTRQDKRQSTTETARAENDQRRRTQKLASKQDRHRKENNSTHGKTQRRHANREDREERQQSRSHHRKRTEGKRDKSRQRQHRRKERSRTTDSQTEQNKQDTNEGKKSRTSPNKK

SEQ ID NO: 980267 - protein, 349 aa, Homo sapiens
EAKMAVLSAPGLRGYSGSLVCAPAWAWLCRHEVSIRAVATDGPSSTQPALPKARARGSQNPASRGEYSGGQRLNDLRKLGARRKILCGPIDLSAMDLVAPVSIDGTIGKAPRYGHCDPAIWEVDDYPGSTDTVRTRSRTGPWTRMGHGNTHQPKQKNGAHKRCIPDNEGIKQTQEVTRKPARHTSRNPHSGQACSPNREEAGQKNQIITKHGVARRGARRHRNMSGHWNINDPQGDGPTINGQRALETTGHSCSVQRTNQAGTERTEDQGPGRRRSEAPTGPVRAGPKQDMSPVRVKYQRPGRAKRQQTEWQRRQERTRKREGRDSCERRGNHRGVASRHTETREQRGK

SEQ ID NO: 980268 - protein, 439 aa, Homo sapiens
MRNVFMFRGRFYPFYQFYMTDFQEVPDRLPALQFENFANKQRSTRSWFNRIPLVAGTGPRWRFRPGPNYKRGGGAPRWREESVVVYTSNRHDIFASFFSFSEQTEKTEHSERIATERVERARNTMDSTKYARRQGERRSKAGARTPGRPRGQIAREQERETNEEKTKETSERTEPTAHRQRSRASKHHSKRQENSRTKEDPTAREEKRQRRTRHRSDRRQHTGRTTRPPATAHAERARGRRDRESARKRRNASKQTQRRTRPRRGEEAEPDDTKNGRAEKNRKKQSKTDPKGRRGARRQTDEEESTSRQTNRPTKPTTTKPHTHTQTAQQRNRPAARGRGEQHERAEREQHSGRDRDHQEETTTENAHNQEARARHRAESTPGTPEPKRNQRRATTNGQEGERNTGSRGSKRETTEADRRSKGGQPEQRGTESSRTRQK

SEQ ID NO: 980269 - protein, 157 aa, Homo sapiens
MSARRIGIPVYWFPLLGYTAIGYAEKPHGGLVILNRAKREGICKRIQGVWDAIGGKSSQSLGDYGLSLRTLVHNRVHEHKHFELCERSLSVRNNFDRNLLTGYETRREMPSRTPSGDHVRSYKGGWENTRKAWEGGPHEALKTCWDQGWHKSPKWVC

SEQ ID NO: 980270 - protein, 122 aa, Homo sapiens
MFIQLSPSLYSLNRIIPVSLKNKQKHLVGAPHRKSLTHCGAGPIYEKCKWIQKRATTVVSKKRGESHQGACFDTSLPRVVINAEQHNMHQHTIALIYSLVHLKRQKQISEKDTRIRRGKKKN

SEQ ID NO: 980271 - protein, 425 aa, Homo sapiens
MIAHDEPARPGTPSWASYSKQLLTVLESDLRSKEILGLKLHLSGGSGLVHQDLLEGHIPPVQVPNVQLRSQDARAQKMANLKMRILYVDHLARVKGPGQCVVPDIVETSQETTSIYYTILQTSYDQVVHANVDRITARAVSKTQPALELWLHTKSLTAPIGLRKPYYTGNIREEIYARVDTAITTAYHSGRHKIIQSSRAKTPRYYGQAPKLSDDNGRMVHDVPLNKTSRCMIKDSFLKTTQHTHSTIRTSTSKSNPRTAPPITTSRTTTNRDPTIRSTDDNKLVQQNNLNNSYTTTYHKISIHQIQHTLIHHSLINYYNITHKSYEAQNENLAHAGTDTKDIKLTQNKRTSETYYTKSSKHRRPHRQIHEGYQGNKRTANKRRVDRTNSRCIERGQNPHDDSRNRAATSNSRMPLHTCTDTISH

SEQ ID NO: 980272 - protein, 199 aa, Homo sapiens
MSRIDLLPSSSRTILGMKIEYAHFDGWIGCCWARQPCCINVKSRGDSHHHSYHWLEMWKQVRTMTNILFPPVWDVGGQDRIRLSGSITSRIPRSYLVGSIAHDRRKESGSSRWSCSTMLLVTMGLRGCQCCYFLCQPNQDWPMARALRGTGRLTKGFGLLVTGPWFCFRALCAPGLGLCVCAPRGVSLRLPRWGRGLPG

SEQ ID NO: 980273 - protein, 137 aa, Homo sapiens
MRGKAETRREARGEGGEARRKEEERAERRGEQGAGGRGEEEDGTGRQTARRRREQDRTERDRGRQATRTGTSEEEREKAGATAGAGTQHKEEEEQQRRETRREEGSREERGERAQQRREKRRERRTTTRTGRTDRQH

SEQ ID NO: 980274 - protein, 134 aa, Homo sapiens
MGPNVLYNQYKMYHLIVCNNQAQCCHLRYYTACKCMRVSSRYAVLVRVSPRGALVDHPQLWWTFTPSVLRCDCKLFYSFLEWDLLGVGFLLPWPFVWGGGVNKKGGFPWPPLSLQDLSLDRFDGLFYTLSRGGY

SEQ ID NO: 980275 - protein, 134 aa, Homo sapiens
MGLWYISDFLPGVCYSSLQTMMCQIQAVKARLANQYIQDQLYKLGCGRQAHRFLFNQVQNLGPVLSMPCCLGPPLVPRLEPLGGGFKSLVGKGAARLGPGGTTRFAFPRGWGHPAGGSPAGATPNEAGPPFVGT

SEQ ID NO: 980276 - protein, 78 aa, Homo sapiens
HAATNEYPDPDPDLVLKEIVSSFNIAVMPLRFLSHMESSSGIVVIQAATRSSKHLGLLTADLSEGSKPAQWSDALFTR

SEQ ID NO: 980277 - protein, 239 aa, Homo sapiens
HLPLLGPFHPSFPTFPMILVNFLEWFHDYWLSCLSVFLFQTPITRYGAFRTSVPLYLPHLRFLRGLFVLVCVVCVFKTGSHSEMRRSLSLECSGAVMAHCSLKLLGSSDPPASASCVARTTGVCRHTGYIFVEMGSRHVAQAVLELTSSDPHACDSSTFGEAEAGGSPEVKEFRDRPWPTMGENPCPLLKKYQKMWLGMAVGACKSQLLGGRGKEDHLTQGGKVAGPEWALRHRGKRQI

SEQ ID NO: 980278 - protein, 237 aa, Homo sapiens
MGADMCCLLSCYVVLVAQELVPAMIEIMSLLSCVLDMSRKLRFSENKYSRNYDHRNNLVVSPCPVLSGWTERTLKVLERPRPVFATVLLVGFIQCEPSFARCIHFVSRVSVCTNKIIGRLTNIVGLVKTINSFLPCGVVQHAVVKLVAVWLIRQFKADNDVLPAFCGLLTECVAEIGPGIPSKTVRHWNTVCEDSFHEIANVRPVMMVRCYPGGISRPFRELEHAKVGAVVTVTLPF

SEQ ID NO: 980279 - protein, 137 aa, Homo sapiens
MLKAMIQDKEGIPPVPAEAHLCRPCRLNKMARTLSDYWIFHVGTSDSVPRWSLPILKRVRYADLQEKTLGVKEQSAWKLAAQGLQSKAVDRPAILVKVGIRPELVEARSLSGQASVQDVRMSCLNLELFQTGGQSRD

SEQ ID NO: 980280 - protein, 114 aa, Homo sapiens
DSAETRRYGCRCAPRGISLPADTPSPWVYPAPLRSTHVRELVLHSTKGQPIPPGIGPTVVSERILPPESIVSLHEVDIFGAPRNEPPKQVEELRVMKFPGLCLLGDNLRDIEGD

SEQ ID NO: 980281 - protein, 78 aa, Homo sapiens
SESGSDSNGSNCRGGVAVPGLAELFCLFSSDARGTLAPGEWVLRRRLCLAVSQTGLDFLCTFTFAWGKLGFTRECWGT

SEQ ID NO: 980282 - protein, 173 aa, Homo sapiens
ASGSDGRFGRNDDRETSCCTGRCLDGQCRWRAAGYLLMLDPCKDSHDVGEESRARPGTRMDQHRGQFLTGVLRILSYLFQSPCGSIFIDVCMMSAAQSLLNPSDETRNSLSRLMPQSLLPPFLMTSRMFLIRKSDNLPRRSKLVVWCENVFAEVCLVAQVHALLYKDESRLSL

SEQ ID NO: 980283 - protein, 277 aa, Homo sapiens
VDHWSRYYASYVRIVPRHLVPVPVWLTRTYRIAKAYMRSTAEERPTGMVWPRELRLDYETPYDMRAHRDYLSTHQVGPTLESHDHHFRQYITSNFNTVAETYSLHTPIGSVDIMEVLSLTELMECTFLGTEPSRGNAGPAPQWNLLRHGRTSWPESENPTSIFIPDSPGRMPSQGRACHIFHLPNLFNLDEAPKKPEYVVYLSMCVITLWKKYASIFLVRTVNMYFLRTNVLPNYVTINVRLNDQKVTKTLGSVSRKFFRGLREYKNAFIGWFNLTG

SEQ ID NO: 980284 - protein, 112 aa, Homo sapiens
MGQGRSSKVQKLLHLSGDCHNWLTRGGSRESRYALWLAHVFLPAGSLLLVEWYRQCRFRAYLDGKRPAPREWVVPLTIEVVNTTVDHTPGIRGIFKFRVVVSPRKAFISKIP

SEQ ID NO: 980285 - protein, 88 aa, Homo sapiens
MYVDDEVLSSKRSRDASSVRKDETIVTMGSEEGVQVDSDEEGAYWDVDDMTIRGVTRWVVPGFEKRSEGKFRDRAWGKSWHGVEFHRS

SEQ ID NO: 980286 - protein, 108 aa, Homo sapiens
GRRAAGRGRRKEGKGRQGGNGKRQEREGKGKGERKGKKQLYCNSQKLETTQMPSVEKWLNKLWHICYVEYYSAIKRIKLLIHATTLSRELLSEKSQSQKFTCSIISLV

SEQ ID NO: 980287 - protein, 344 aa, Homo sapiens
LTPQQSQAEADQKLSVATRSGEGPEGTESARDGASVQEGAPVNHGPRKCAVLPTKIHSLKSNQFSERVSRAREMQASKTGSNARPRDRQIGTTGGGKPSDEGLEMMTRVREEIRRIAGMRGTCAPDGPHAVTGEAGHDHTGKMPLGRRQVTEKRSGKRIVGRGGGRKWQLIRYRASGRRLRVESGGVKARGTLATGESWDRGRLERTIAQSPGVQGQVDVDAALGGPLRSNRLAGPEDVSRTSADRCMRVESEAFECGSSPVEARGEWNRAMFDGVSPRDKEWLEISRESNVHRRAGPQCGESLSDKTGAARIGEHGHCSRERPQRGVTPKHGGADQTGFVIYH

SEQ ID NO: 980288 - protein, 253 aa, Homo sapiens
EDSPAGKTNALKTGDKILEVAVSRDHTMHSSLGDKSETPSQKKQTKNKKKKKCVGGAALGALWEERFLIKHPFRGWRGGGGAQGGGTVGQKGGAIKGWGTQIRERNARAPQETIRVRCGRVSPPTNIKNTPRPGGGKNTRRASRWVPTLSPKMGACASKAAPMTGGAVILQNRREMPQTREGRPEKLIKKMYARPGPRGDDNRNRKAKDKKKDSNKRKKRTSKQTETHRTRRQKKDRKKEGQRADEDDRAETT

SEQ ID NO: 980289 - protein, 328 aa, Homo sapiens
VGGPLESRSWRIAWATQRDLISKSEKKKKGNFKNGTKEGRETHTTHTHTPHTRAHTPKHTKGRGKTPPPTQGGGNTHTTHTITHTHTIRGRRTTVCQHSVKAITSNLGGPQEKGAKSSLGARHRVVTKHPLSLKEQQLGQKVGDATGVATTRVKPPTHEEHDRRGGERTTEDGTKKCEDHLAGTMGGNPLFAAKERQKNRGAKDGTMQRVHPQRARDDGRAQSCVTPGEGEVSPATRIISTGHPTRGNRWSLHPKQHEYRKKKGCAHDAEIIKTRGGRPKILDGHCLQETGESGVPQNRGTSETRVAGQAVAAERKTHNDARTRSHIG

SEQ ID NO: 980290 - protein, 236 aa, Homo sapiens
DSGQQAVGVAQTDSPPPLAPPAPAPSLVRTPGESCARAEAAIVESLVPLQPDMRRGMCGRRYKGCPHERAPMYRSVTAGWQESTDRRWSTGKLLRKGDEVMPRVGKVVIKKKSTRGRSLMGNWDPMNCRGHGGAPRAENATTLTVARDFLTEEPDLGSGDSAGAAVGRKRSALGRAGETRTCIHKLASVHEYVPVQISAATVENYVTNGESTGTRTARAGDSEEPRTRLSRKSQPL

SEQ ID NO: 980291 - protein, 76 aa, Homo sapiens
AGRWWRVPVIPAIWEAEAGGSQDQEVETILANTVKSLFTKNTKGWPGVVARAYIPIPATREAEAGGSLEPGRRRLQ

SEQ ID NO: 980292 - protein, 286 aa, Homo sapiens
LSLHNDVNPTMCSCHTIENSKNDSVAFQILSQKEEWESRTQHHPRKNPPHLAGYEKRAKDDSRRVVKSTQDLSDVFHGMKWASHSGTPERSNRLVQDYVKRSHKLQQRLMIQICTLPDTHRNDDTQSPLAVPRQKCAELHDGEKVVTEVGHNIPLPSPSSSLRSAQKEMTGQPPEIEKVDHKEHMRGRGPTEHLELISPGKVYGLTHEHDESGYYGPTDSTRQSTHHACEHATALTTGPNTPPHRHTGDRERHKRKEPATTSAPHTNQPGRGATRGGRATGPPHPR

SEQ ID NO: 980293 - protein, 150 aa, Homo sapiens
MTQRAGTSPVTTYSKENEEKHYQGRTKQHTTGKGNKQKKGHRGGPRIGHTKNERDHKEMKNIKDTSSRGCPEGRDTESQEKPKKGGEPRKKHQTSGREAQDKNSRQVYKRNARGSNQHKTEEQENATETKQDRETKNKQQQPGVDAKHDR

SEQ ID NO: 980294 - protein, 156 aa, Homo sapiens
MLNYRNKGRPQAKCNRSLNNFETQTQKYNKKHFCCPHGPERVSEHHLVLGAAPSWSSDTGHIAGCHGNTGPTMRVVSPQYNSARAHRRVNNPQRELGGARIFTGARDSIHAPPRETSYNKQQHHARRRTPTEDSTSQTIDETDDKTRRSRASNART

SEQ ID NO: 980295 - protein, 112 aa, Homo sapiens
MLYTMGYKQQHTGQIWPTACFCKNKFYWNTATLIHLHHINGCFRATVAGLNSCHRDYGLQSQKYILSGPLQKKCADVHHIVVTCFDDLSPLLDCEFQGQKLVLFIFNISLQK

SEQ ID NO: 980296 - protein, 67 aa, Homo sapiens
AERLYYAMKGAGTDDSTLVRIVVTRSEIDLVQIKQMFAQMYQKTLGTMIAGDTSGDYRRLLLAIVGQ

SEQ ID NO: 980297 - protein, 131 aa, Homo sapiens
MQCGQPIKLNDYFGTSKLKRTTRPQVKETFECGGHRRVPKRKYPERTKWQEGRGSPPPSLKKPRCADNTVCRSEETTCQSGKSGGRPFHRDLNNRAGPKAEPVVQQYPRDGGEKGNTGILQQRANAPDINT

SEQ ID NO: 980298 - protein, 149 aa, Homo sapiens
MGMQHYELGEYIRKRFRKFLNESYKHEQVYIEAQTVDRHLDECYDKPGSPVSPEGVSIWNPILLWEPVPVLTGSCFLKIRCYCLAVVGNWPRYKKLESETFEIDGSRRGARYRFIATLGTFRYMADFGLRHYTFFGVVPILLRAKNRME

SEQ ID NO: 980299 - protein, 94 aa, Homo sapiens
GSLWLSEVGGFDQSSACWSSSVGTRCFVWTHFSALDRTGLWVHQSGTMEDHSPSMIRRRLMMVAFLGASAGNCKYCSFVRRGDDCYPATLVRCV

SEQ ID NO: 980300 - protein, 126 aa, Homo sapiens
VNPTQSCKFYFWDARLIHHTEINKCDSPNKQNQKKNYMIISIDTQKAYNIIQHPLMTKALNRLSIKVAYLKIVKAIYDKPTANVILNEQKLERFPCGNRNKTSMPTFTTPIQYSTGCASQRNEERE

SEQ ID NO: 980301 - protein, 199 aa, Homo sapiens
MRIEKCYICSGPIYPGHGMMFCPAMIADGCARSRKSRRLSINNFRQRMRNPRKVKVDQTHPESTAGKELTVDHSVEFEQASEMNLSNTSESYGIKLLMRRRELKKSDQKRQAKFTNGQMGRATKELHESFRILKEKSSKSIHRLSEPLLAAKGTQWGRAPMVAGRLQEDVDWKMLLKESLLPIVFYVHLKMPLGFLEPA

SEQ ID NO: 980302 - protein, 95 aa, Homo sapiens
AIITPQTCYAGAVSMYQCQPEPQHTHVGQMRYNPVLPGNQAFLRASFRMAVLNETYPADVTISITERLRLPDIFSHFIIRQEARALPDLTSSGFL

SEQ ID NO: 980303 - protein, 130 aa, Homo sapiens
MNSKVFGGSAGHRTQGSKRLAGAEEPTGIQSMQELWAKNNSYAEVSRKTCNKMARGPRRVDQSREALRTQEAPSRRRQELLMPDQGGEKYGDEKKQTQRGPTPKTQGAAQVRRRQNRRDKNSRQQGDKHI

SEQ ID NO: 980304 - protein, 86 aa, Homo sapiens
CCIDNGNPRDLVVLLVYHQADGDLDRCWANTVIARISSIEASMKLTVGRSSSGAPWCVRARLHHRSDLTASEVTGDDRLASSRASF

SEQ ID NO: 980305 - protein, 136 aa, Homo sapiens
MRRHTSERERFQYAISQLANRTTDGLAEQRNDPDLGDWQHSVAKSGQDDLISRPTGKRLLMSMSRYVVFAGCLDKHLWSPGPPRTYITLLKTTCTTIWSRCDRTHSSNPYSYRVGSKHFTEITRKRGEKRRLIPKK

SEQ ID NO: 980306 - protein, 67 aa, Homo sapiens
VKMYKHEHIAFSGSILIAIPIGVSVLMLSRQTPRKRGWNDCAAVVPEDIGYIALFSLCRVVLIWNSS

SEQ ID NO: 980307 - protein, 153 aa, Homo sapiens
MFGHHVVTHLVGENTILWGEMAKNKRGRGGGMPCVKSPVASGRLTRSKIAWDIRGKGEVSLGSRENPSLGNKRSRLLGANESNTPTKHFVGGRRQKNVSTTSVWAAAPQITATGHSVPQRIRLDSGWFPQKTGGAGSRPRGSALGSRGSSGAR

SEQ ID NO: 980308 - protein, 136 aa, Homo sapiens
MKTGLFLPMSLGNCSCSPDEVLDYYVIIPRADVETVAPEYHCNAPCERADDDEPCDNKIQTQPIVGGRALEDFGATGFGSGVIEGSECSSSTQGSRWNICFGFFTPGKHGGGHRRVFDEHDGALRLNGSVPGDQGT

SEQ ID NO: 980309 - protein, 324 aa, Homo sapiens
MKFFFFSRQSLALNSSLGDRARLHLIKKKKKKIRGWKDTPGGEKSFHILYFQQRDYFLDSTRNFKTNSVREKTKLGSLQPGGTERKNSFFFKKKNNNKQNNTKLCGGGLGDMKKSFENNHWLGGGGPHDVFDCKPWRHKHVPPPEKHIRCRTKPGGAWASPPTIKKPAAGQTRGVPLRKTQLRTGPAAGRQGGVLTPGDVPGRDSNIKLARRAAGSSKQLQRSETRTPNRTKTTPTLSQTPDRDTSYEPTNSRHNLRKQKHYNHARSTAHTTVMPTQHTKRQRTNATTTTHKNTRHRTRYTKTTEHIIHTDKNSQETTTQQSNS

SEQ ID NO: 980310 - protein, 141 aa, Homo sapiens
MVTHMWLTTKSVKIFYRIDSFGSHYQKLFICQMMTQKFEEAKPFITLYKFGKEQIKISTLGNLVMLYFNAQLQKTYIPGDVSGCSTELSADYSTSSPSGSVLGSPSTSKYSDFNLEHCSTGTWGPHCNVLGARLRGPGINP

SEQ ID NO: 980311 - protein, 110 aa, Homo sapiens
PVPRACFEEAFVSGRGLGLGLPRRSRAAEIAALFSRSWCTEQQQRRSGGRHVLLPGPGRTPWLAPASGLRHSPVALDQFGGSFPALVPPKPCRIEDGVSPCVAEVWSQTS

SEQ ID NO: 980312 - protein, 218 aa, Homo sapiens
MPLHPAWVAEQDLISLFFFFFKRMGSCLGPGRSEKRHDLDSVKLHPKFKRDLRTSRERSRDLHPRDTKQKHTHDNNNYVAGAQQPQEKVLKHTGWGGRGPKRNENHLLPNRRVPKESDLRVLSTNGRWRVPPPKKKTRGGRHPRPFVNNTPEGASEGKGGHTRGHTEAEKNPRRRRDRKTYTTLASNTRNARSLKTDNYMTRTTSRADNTTSTNKHTT

SEQ ID NO: 980313 - protein, 129 aa, Homo sapiens
MAMCPRLNKLEANIMETCKKGPYSYEGNNGRYWRSMAGEKYCRSIRINERTIREACYAVYTPNSAIHRTRGLFGYRNSCTNETVKGHMGSAKRGIETTGLTHGTQQRVGMVNNTGSELFPLSLPSSHRR

SEQ ID NO: 980314 - protein, 184 aa, Homo sapiens
CLSQYCTTALQPGQQRDSCLKKKKRLLAEKNPACQTQGQPGAGQWEMGSGSSSGSQNLPNGPQGHSLASFPIKSSWLLGHGPWARDLAFPSQFKAPSLSMCGPNANWSLVADTWVRMSKSWPNGQESQETGVSGGDSRVEWPSIWDWEAGLCQACIKISKWFQEKPFQFIKPCFLTQLWGWWLG

SEQ ID NO: 980315 - protein, 106 aa, Homo sapiens
MWRYTYVCARLGLRKLSGPCNVIQCLSSRRPECCLVRIHMVLDAPICDSESSSPFVLCVLTLQFLGSLAMGLARKLIKIHIHTEAHSMRQHLFVSGGQWVMSMAPC

SEQ ID NO: 980316 - protein, 90 aa, Homo sapiens
MGPGSFPREMPQRLPATAVPGMTQCDYDKTKTQGKRSKIKVAKVGHEKGNTSRQGNEGVQTQSKTGTELKKRDGGDTKNAKKWRFNKQGN

SEQ ID NO: 980317 - protein, 169 aa, Homo sapiens
PPGFPQPSPVQPGSREDEVRVQKKSIRFEKRRSEGREDPKEIPGPGVPVIVEKAPKARIGDLDKKKIPGCLLIYKFGQFYFLNPEANFISELKDAIVLPLCQPIVIPPQPVPQIGFSCTRNTMKKTFFLYSCLQVHDRVSTGLVKACVPLEAWEGGLISTKREVGPPFL

SEQ ID NO: 980318 - protein, 106 aa, Homo sapiens
MTCSRSLCSKDMGLSVETGVRVLIIIAQEDEPCVVLVPTGYTLTQSNYSAIVTEESAHQVNVIANPQFAYPSCGPWYLEVSVTASDEALILAEHFGGVLHFRCRKN

SEQ ID NO: 980319 - protein, 143 aa, Homo sapiens
MAVVTSIEAGGDDRHRKKEIAGRGNMLRTFVKKHLMESDNASIKWGSITKKGPQSSLVENQLCSRGWWFISLCGLQFMASKEIKKTTTFETSAIENLERPWGHTKSGFKDHSSMEELLLKGKSCKEERVPGCEVEGVNASRVH

SEQ ID NO: 980320 - protein, 338 aa, Homo sapiens
AFLFDFHIRWFLLDLPQFYLPFNQPRFSCSTSYLEDQTNSLAVHVFLFTVVWVSFLFIFSNVFFSPFFYWQKRKFGSSCKPEVMEKAGAIEIPKGPVETLLCLARVPKRHFLWRGHPANVGGTLMGRRRRATSLGLTPGLLQDNNTGVPTNCWPKQSAPNDTSGTQVEPDAAIGTTKGEQGIQRRCDAPKPTPSDGQRNRTTVWDRTQGKDMNPKELECNTANMWDQESHAHHGTKTITHKLSYPRRVGCATPHENERRKEHCGGARHEEAQSTVRGATNIRIVLSAKARLEFGSKTSGDDDKRVRVEEKTSNPRAERERVTAQRSTQTNEHTTTRNT

SEQ ID NO: 980321 - protein, 101 aa, Homo sapiens
ASLAARAKIEALREAGTVERALRSGYPMLDYLPPLFVQYAGAPEQLNGVATPLLCAGSQRWPFLMKKNTKLGFSLCILSSDGSYFNPLVKTCRDLQGTRVT

SEQ ID NO: 980322 - protein, 135 aa, Homo sapiens
MFTTRIQRVAGRWWCVACSPSYSGGCGSRNRLSLGGRVLLVEPKLRRCSEPKLRRCNSSLMTELDSLSKKRNKNSSKAKMRSRKVCPETRDYFVYNSGVAPGGTHVRCKCQKELWERAKAHGWTHPCALSRFSNT

SEQ ID NO: 980323 - protein, 144 aa, Homo sapiens
MKGVYCAAWSQLRSSSLLVNNTVNRSVRMMPVVARHKAADHSKSPMYNYSRTRRQEEISVFCSHSPQCRRSPRMKACPGVILYSLMGTVKLKRRRGYTTLVYALCEELRFAYVELMCCNVSMDLGNDVVCVLKKESSRNETQLH

SEQ ID NO: 980324 - protein, 124 aa, Homo sapiens
GVTTDDASQELVELIYQQATSIPRFLLYGSSPVYVTCPMHRDYISPTAVATSANSYFKDVGVNMTVQGSSCKKGMKLLENDFIAFVLFLGELDLNLEIKGTNGRVTRADILQVWSTRMAECPVF

SEQ ID NO: 980325 - protein, 71 aa, Homo sapiens
MVYVRTLGPLTRFPKGNIAGPENRGAVVFSHQIKKAAGNPHVCGTNPERSPGGPNGSYQGVQGERFNTACG

SEQ ID NO: 980326 - protein, 102 aa, Homo sapiens
EARACERREAAKGPGVGRCSRSSYRQNSPGERMVKYLKPEEPSCKNVVASISLTKWTQYKKGKDSWYAQEGGRYDRKQSAMVEQTKPIFRKKAKTTKKMVLR

SEQ ID NO: 980327 - protein, 100 aa, Homo sapiens
MGGRPWALEKVFKTHRVVGAGPQGVRYNPGAKGVVPKERTRGHGDIGAGLPHQIKNAPGGNPNGSGKNPRMGGPGEQITGRSINRGGHRRALDHQIKARP

SEQ ID NO: 980328 - protein, 117 aa, Homo sapiens
ECSSSPCSQECANVYGSYQCYCRRGTSSAMWMESPVKDIGRVRPAQPCGAHIFAPTGCINIPGRLPVQLPLVLLPGLGPQICRKLPKTIDECVTWASTNCSNQEDLFQHSRAVFRLL

SEQ ID NO: 980329 - protein, 81 aa, Homo sapiens
KTAMHIDADNRTRGRVSDLDAEYSSSRSLLTEMMINPKDRWRMRLNIGLHYEVKDVHELYDEVCIILGALLMMFDGGRRMT

SEQ ID NO: 980330 - protein, 103 aa, Homo sapiens
GRPENLATEAAWPAVWGAPERGSPQTRWRSADRIFSRRSSVSSFAESWDPSCMSKGHFQIPFVRQSLRHILVIPLPLANVNCTRLDGTSLSQSSLATRNISIP

SEQ ID NO: 980331 - protein, 62 aa, Homo sapiens
MTSYRVNAALGSAVAVLLVWRCNPEVLGLITKKFTELGPQGCRLAVTSSHTVKEESSQQADA

SEQ ID NO: 980332 - protein, 172 aa, Homo sapiens
QQLLGALRELPRPKGLQDVVLIDNAGSLGDVSKGFVGPELTPLKEQLRGHVNCDLHARAVTSSGPEEAFPGQSVASTEPVVNILVPLCPGNFSKGVGAGTVCERRARDMLVQVLALEEPNVRVLNYAQVLWTQTCSSGPGRPPGDPDMRTGAGRSWKATGKLRDGRGVSPRK

SEQ ID NO: 980333 - protein, 278 aa, Homo sapiens
LRPEGKQSGRARWEARRASGLQALVRLGKWGCGPRRARAWALLIRSGWGPPIPFWGKTFFNSRTGRFLSAQDFPGFGDKRAQRGRKGPGEKRDNWGRYCQPGSRKGPPPRGVSCLDDTRKGSRHPRGRAMGKRGYRGDLVGAHEACGADPPGKHSGGDGLGEAPVGVLVSREHRAKRGGRDFNHILCWKDGPPPISSRGGWKHNFVVGANYVWRIPPPYVDGVGHSRFVGHPPPCGVRSYIKQDPPPQRMGLNGDALNHHENKILFLHPYYSPTTTRV

SEQ ID NO: 980334 - protein, 120 aa, Homo sapiens
MAPASLIILPRGGNWAGESSGFPFLRSWGYLFKQFGTPIHGLVNPRAILEEGQSRFWVSQGPGGSRDHFLARALGLKPPGSSFLTDLLNNLALRWGARPLALWPPGLLLRRARGQRRIGS

SEQ ID NO: 980335 - protein, 110 aa, Homo sapiens
MCTRTTTRHIKTPEHNNKAEKWHQRAPTKQNRDTTDTQHTTTQGRTPGQQKNTPKQRYTPPHKNTHTHAEKHHEFNNTTTHNEGHYSSTKRRKHHQAGTTRDHHKKATTK

SEQ ID NO: 980336 - protein, 236 aa, Homo sapiens
WWLTPVIQYFGTANDWEQSLSLGVCRSRLTQPLRDILYSITHNKTYTRYDSGIDVHATCSSHATSGNAHGEIGNYSTSASLDGFQVAVRRYVPTLTLQTMEEQIGSILASLTGHRYSLVLNGDYLLNMGTSTGVRMKTFTTQTQNTTNKQRGNNNLSKTKRGPKHTCGSTLRQGNNSQQDRKNQRHKNYTGQKEKGAHYLCHQRLQYDEAQSTNEKTFSFPKRGQSFTLNTRTIIL

SEQ ID NO: 980337 - protein, 526 aa, Homo sapiens
HITVLQPWMTDDPVSITQHTQQKTTKHTQTSTNKNTTKQKPKHRNRKRQTKMGQTHNDKQQDTQHTLQRRETTITRTKTRETTRDTTTNKRARETTITNVRHTHKDTKTPQKNKTTPPEHTSHRKPHTHQRHIQRDPQCSIHPYERPHKQRLPRRPPPNKQQAGNHTHNTKTTTPLRTQVSPPTPTSKPQLPQPQPNKPPTKQRTTTVRQPTPHHSRENTTRQKPPHPRPQNHKHTTTPTPRRKQNRTTTRHRDHKHTTGPLTTNSPQDTPHPTGTTQQHDTISPTPPTHGSNSNNTATTNNDAANKVVTTPPTTEHPSTHPRKTRKQTPTKTQQTAKTNRKPNKHVQTATYQPNKQQTTERNPPDKQTTDSTVGNKRQWGEPHPHPQEDTTHNTQNDTSLNRQTTTTTALHKHHETKKNRAIVAHQQQPHPMEHQPTPRETTSPRGHPGGSDDSAHDKQQLVGKYKHPQGVTKGLGTHTLYNSRTQPAPKNCKAPTVTHTRDNVLYSNHTPHNRTNTGTNKRTEH

SEQ ID NO: 980338 - protein, 116 aa, Homo sapiens
MEGIMDGSDEVIRVPQSMAIKKVYRMICGSKVSTVGSKDDTTCLLLLPPKLGLTGESGAAGGLVYDFYSLDMRPFHILPEKCQLCNVSGGVGERNSVSLLHFGDRRRWAGANLIFH

SEQ ID NO: 980339 - protein, 668 aa, Homo sapiens
GPEQLIIIIFFYLLFIYSWREEDPPRGHTHNRVANKMTNDCVKSSQKKTHTTQRETTQQQCKAASKRRPHRNTERNRGQETKESTTPTSYNKRRHPNPPHNTNTTRRRQTGEKTKNTSDNRKKNKRRQKKQAEQTTKNETEKEQTNKPEQTDNRRRSKGKKQQKRYKEDKRKHTRKETREKPPPRTTKQRGKKKTRRKNKQHAPDTTRRNAKQQGQEDRTVGEKKEREKAERQQRKQQQGNRTQQNRKSKTRGQKTTTRTTQQQNIAATTQQQKQHRQRKREQHDQHSPTPRQNNNTRHAERERRKDARHAQGRNETQRPQRHKNDGSTRTKRHGRATRNTNARGPRTERNRDKGHEDTPTREQRQDGHANQSRQRQAANSAGRRRHRRTSRTTAAERNNRDKTRRDARRRRRQREETKDDIDDTRRRRKRHDDPIEHYVQEHRTNIERSNWMRDDTCRQHADAKTQQADDATRERETETSTGRHRTQTHTNVQDETRTNDQDTHESTGCSDETRSEDEAQDRKETARTDERTRPSDEREREHEEDTEGPRRSNHTQEVENTNEGKAWQGIHEKQSEESQDARRRTEAAGRRRQSSRRQRGRTRVEQTENIVAEQRKDHAGDNGREKRKSRKRAANERREESRQTEKIASREGARDSQQPRQTREDLI

SEQ ID NO: 980340 - protein, 198 aa, Homo sapiens
MSRTTAHETYLTLTTRMQQARHTTDAAAQTTQHEPKRADSYAGRKQHADQTDRDKPKDESAAGPATEARPEKPDHDRERMREQGAREGDSARRARRRDEQSRQREKQRRGSTRRRTSRRAQHRARGDTQTTREERQRRWRRQARPRKERAREARKQQQTKRASERVGNRSRRKPQEDRHTQEHTNTGGEEEPREQPRK

SEQ ID NO: 980341 - protein, 622 aa, Homo sapiens
YRVYKESCFINELNVLRGQRWVICCPAVVHFMQRHSMRISYLQCSGSATGDSSLERIAMDPSRGKTILAQERLVTLGTNIERHLWSSSVTYALSERSDNFSMMAARGYRTRMLRIIMTKRINWTRGTLSHDTGGTAKIIISGATTEGTADKTCYSPDDTGITLRVLLCRHRDTQAKTSSSSSVLLHSCLDVCRPCLISNKTLEQTRDKQSSTDDNYTGIYTCKHKTYRQVTEGTKHKNDSNTQDNHQLTTYNSEARRTQTSNIKSGGNAQERRPYSMHTTLQAEPENESEKNGRSKHNNSAHPETSRRSHGKEIEKTRKKRQKRTKKQRREINKRERRETEDKQSNRGEAEKRKRQNEEGKRKRNKKTKTQHNRNKEETRKKTKREESKNEKRTQSTEKEKRGGEKRREARRAAETGEQQRRKKKGSTKEQRSERSRGGGRKEQRREKRGRDEENKAREQETKKPKRGRETEEKEENEHKETEETRRSRGGKGGRIRRQKTQTQKKEEEKEREKRDREKTKSEKKQRERKEEKKEEESKREGEKKEESNEKDEKGRSSGGEEEEEEEREQRRDERRKREERESEEKTERGQEEKGREERRREKKGDEGEGKNAEGAESRKRT

SEQ ID NO: 980342 - protein, 410 aa, Homo sapiens
MSNKVYNSNMRHREACTYTYSGPLCCECTLHVHDVDSGRLNLLTEQCVAWQTYPSTGLEIMDETHLQTLIPLDSTSLKTLMVHHERLLLIGAWSPHWTHDMEAPGSTTHTQRGTRIGKPSGNGRCIVRHLTSDDNAKRVLVQHGPTPSARISRDFSRPHANGLQLSRRLPPNAISSLPYYYIVTETLTSRKRPAPHHNNKRHPQGKMEAEGGEEKRKGRREAENKKREGESQARGPTMSRPAGETADNSNRGQRRVHDEGRSPGAAALGSRATGGTNATRPQKHATRERQKDQEDARGRPPTREDKQEPAKERESDRRGKPPERDETRPKGGSKTPGRKSRKRKKAKERAKRKEETEHNPHRSKPTHSDERKEERTTRDWTTTNTLDKHPNTNKQAQNATTNDHHNDRGA

SEQ ID NO: 980343 - protein, 207 aa, Homo sapiens
TATCRIRRRSRAMFVLYSHVLRLLAETWGWNPQQSRGPFAAAIYALAFQRRVLYWQLLEKILQSLPSDYSIELKGYQVHTRDSPKCYKLTDKTVIGLQRFPVETCPYADKDSWKQDYKMYKHSNNKAMTRRAMAGNAVYNPVSKALLSIPMFTTSSVDLIEDATGGCIQLCTHVGSNQRDSFTDGRSACACTDLLTTRVVEELHDGE

SEQ ID NO: 980344 - protein, 111 aa, Homo sapiens
MLIITFSASSGDSNPSRVTRRSTQIDRTPTQHNINNNRSRSLQYAKWRIGQPSGRHKQRRHRLETHAQQRVNENATDEYTYERKTQKATTPDREHKENIIDNETEMMNRTK

SEQ ID NO: 980345 - protein, 275 aa, Homo sapiens
MHKELGPVKITFLEGLTGKAFKQNGPLPGGGLGQMRYREAALELVPSYHWWLPRSLSAAHSVHSPSPGLEMYRTQNRPSNTLRHLRDWSDAVLIMHLSSFPGPDNFIAISARSKCAKLSLAGLEGSFSTVMIRAIWTGALYVYSVFQVDISMVASRFSTRSCKKPFGATLLGLRHRLAIAWPLSGLGVPETVRNVQAPCCLAHVGEPEAVGARSAGPGPVSRGGLLDVVPFVLAGAPSVWRRVSFSRLAKPKWGGATPCSPLLLPVLSTSSSLWR

SEQ ID NO: 980346 - protein, 157 aa, Homo sapiens
MAKGKSLQWRTDSRTQWLTNPEKQSLGNKGDLRFSCRDNYRNTREQRQARRLRTLFPIQSNILLLSQRSCKWAFSPTSPLKIQAEQRLGPGELSAYARVLAAVIQCQLETCALLQPGEKPKSAKPDQLSKTFVRELLLPYKALCVRDWCASGTDPYE

SEQ ID NO: 980347 - protein, 210 aa, Homo sapiens
MVRHAQDALGREMHQKNPRTVPPNVRDDLSEVRAEKNVAAADLSLRGLGIFNYVFKSKVHDLMPTYIGPYIWDGTVLPTRCLTMRTIICRVINSLPGLYGTSFPCKLSETSNGPRCPAQDTGRIIDHLSLLSKDRGSHQGMKAPYFCSIGFRLRQQIIFEMHYAQFRYVCGANPWYYREIPRGLVHETKVGCNHNPFGSHKHQQYPNFAN

SEQ ID NO: 980348 - protein, 123 aa, Homo sapiens
TLQLVRRKLPATLNGALTELRDVLPSPNCYAGNLPLLVNENRVYFRIWATENRRRHVDDISVTEIYATVVTNESTSNIVTHSATRLHTTLVFEANAGKRNCSSFPDFTLVQVRTIKAISSGID

SEQ ID NO: 980349 - protein, 143 aa, Homo sapiens
GARRVGGGSARVRAPLPSSTVPPLLLPFLVLLCARCADLGTSLCEAAVGGDSGARIGRGKAQGKGVKELENRPNHITFGTVAGARDASCGVQVQRIREGHTPHLSNLNVNGPIVDPTRDFCPLGRRNGIQVSPYLDGGKANSN

SEQ ID NO: 980350 - protein, 108 aa, Homo sapiens
MTQNKKNQPQFRRFTVNQNPKQSPKPLQVPLDSPAIFPKQEPNISHMFNVDHSSTKPQERPKPATGSQVDSQVIHKTTKRGPIYRQSSHLVILNAKVPGAQPQPPASH

SEQ ID NO: 980351 - protein, 101 aa, Homo sapiens
ASRITLHMVSRRFVEVGRVPMSPWDLMPENGRDGQMYGSEQGLGLMDLCTQVRRQAMPFKCLQLTDFILKFRTVPTRSMSEKPGEGRTSIQNGTHTMAHRD

SEQ ID NO: 980352 - protein, 317 aa, Homo sapiens
GAIFGLSEWVCNSVVAESYGSPFRFTFPAVEAFPLAVRVHETKVRDEHYVRDTLLIVIISVCTVCSEKGAITLGPVLPWNRPRTRRLKGQNWWEQPGVTTQLGHSTAREPHNRKSDGSKTLETTTQGRDQGTETFERNTAHQRLYHMFRNGNSPCSANVAFVLTWTLKEHCPTSNNLSGYKVGDKSFLYYPLLSNIPKGMSHRNLWGRLTHKTCTFNFLYYSSVLCRSEEHQNDSRPGAFKERTQRPGGILGHNLFVGRSMELRNLNVIIFRPRNSTGACWAAPEVAKLALPVAINLCCKGTAHACCCQESNGETAI

SEQ ID NO: 980353 - protein, 183 aa, Homo sapiens
MVTHACNPSTLGGQGGRMALSSGVPQTSLGSMVTTLSLPKKQSKNKAGTWVACHSVVPSSLREGLGVGRITVSPRRSMAAVAVIGGNWQPKGRVTGAGPQVFINKHKTVTHTPTHTVGARPATRDERSKPPRGGAGTRTRGRTGHTGPRRPGQQGAGPTTNTRGTRVENTGARLGSRAGVYPG

SEQ ID NO: 980354 - protein, 316 aa, Homo sapiens
LLLADRVVIKQIITSRNKVLAIMERLEKVNSFKSWSKYSVNFWDNEMVELAHLSGDRPNMICKMTQKTAKMAAAGQFLKKCHNDASHSFNDMSEAILTANQPIKNKEGVLTRMKRGWDKGHVTTGDLPVTPNGELDISSISILTDIRNSQMNIEALRENSFISSSKENFCDMERHLERMDGFMILLHSMSHRRPAFLKLSNFRRRTGLQRRKLCGIQRPQTRNQKRIRGQNWNSSIGNPAPATDYEQLPQTRKQGRDHTTRWHGVKGSTRRKAIHRGQPGILTQTGPGAHLHPERHADRRHNRERTTTIGPTPIGD

SEQ ID NO: 980355 - protein, 101 aa, Homo sapiens
MGGRSGPLIRGREHHQGWGNLPGNTVTRASRKAKPRWRGQIRESGTNRRKGAARRTGATGEDGLDMAAHQGAAGPRRCMCRKGAEGAVGTGREDTGRNPGL

SEQ ID NO: 980356 - protein, 138 aa, Homo sapiens
MERETEKATDITYKTEEERQHRDRTEVSSMTPHDDVWDVRQREQLRARSAGRGTASIEERRPNQESRQEQREKQKTDEEAKYNTQTASTQKRSRQQDTGQKRRKRKERSRQSGERSKTERSKKDQHDVKRATNQGDTK

SEQ ID NO: 980357 - protein, 184 aa, Homo sapiens
TVALPQAGPWRDRRIRCSGRYTRTGYPGVHGDNHQQQIKKIADFSTRPICLVVQDWATLKEKCDSPVHRRIEHMERSGDQQGETIHLRTVPVLLWRKWLYTTQATWKRAQKPKDLSFLLKEQQANLVSFPHTVCGPWGSDNSWGWAGALWARPFTRTPVGHPRLGILHLSGHHLYLYWVMVLGH

SEQ ID NO: 980358 - protein, 113 aa, Homo sapiens
MRESQEINQDTAWISKETKPNKLGVADWTMCETCTVYETELSWFAPLFLTPGGFMTNDNGQRIFKKEDWQLISVGHDRGPKKDLVCQCTGYSTVVLVRHRLSQARPQFSFGLK

SEQ ID NO: 980359 - protein, 352 aa, Homo sapiens
EFLRFLLPLSRRRVVRSYVARALRSLEGGHSAARSPSARAPGIDLGDDDDAEQGRGPRWQAWGAPGAPGARQAHGRGVQELKQPGVTDLGCRTHLARGLGERFSGLKFLTKHFLANQGDLAPAGHYHIRLNPQRNQRLTSVGWALSGEARFLAHRGKSYTVSHEIGWTHAGPCVKVSSNKPWRLRLVQLVPFGGAPWRFLPTLKASLEIIWTSHGWIVTTAPGKFILITSCERNEFAACHNDGETFGRTHLRPTATIVRDNGTRGCSLKKETLRVESGDPNKGRTSRPKTDVRCSSVFFVLLALRYILTSSSTMIQCDAITIHHIDQTELTRYQQNQTHTQQARAATAHDYT

SEQ ID NO: 980360 - protein, 107 aa, Homo sapiens
MRSIQGLSYRHLLKPPEERAPHTGHGQGRTLADHLQFGGAPCSTNAGRATTTHKGEKFGACREEYTSGRPKSNRRSRRRGGSTGGDIGVAPTGAAGETHTLSLRQAE

SEQ ID NO: 980361 - protein, 186 aa, Homo sapiens
MVELMFPLLLLLSALPILYMVLRPKSRKMLSSGVCTFNVYSFLGQASGGHRSYYRVSGKEAQPKEAVHQTAGRPEDHIIAVSRDIAAPTGANWGGPTEDPKTKGPREPSNGVVAAQQLAPCSGLTKGITHESFCAKGPPSAEGTSTLTGLDHHWKDVDAWRSGTRTQDNGLEHAPSGVHHWRSTSS

SEQ ID NO: 980362 - protein, 309 aa, Homo sapiens
MRKKRGPRTGKAAHRDTSTSRDGASAREREAQGPQEKRKGEPPEAETSEDGTNTARGEETPAGARSESARGADQRQKTATSKLSQSSNSNEADTIYAGDGEQRERRNDHSRRHDQHDHRSPDATRRQTATASDQAHGPTQREKTRESKRSKRTATRREEPNREEQRQQVTNVTKNRDGTKEARHKTIDTAHSSREGEKEKKRRSNDEKEGRAHMKKTGEAETREQTGSAGQKDRYNTRDERHRANKDEHQRNTPSNDHHRPNTRPNTEQTEQTRPHKRQQDNDDTSTQKQRKETQAKRHEPKAQKPANQ

SEQ ID NO: 980363 - protein, 31 aa, Homo sapiens
MHVKKQRNRSTKQDSAAVNIRGTGTANPTKA

SEQ ID NO: 980364 - protein, 154 aa, Homo sapiens
MFAKPKGLRIILGAPVVLPVVGRTTTSGSGHTSWFPQALHHVNTRLRRVGTSISRLKQTLTLGPKVALLGYKGARNQHITDYNSPVSVASVYTQTLNLYAKHNPTVYPKVSLGVAEATPPGLLMRFNTNGFKDNSPEKLVHKRGSLSQTLSKRY

SEQ ID NO: 980365 - protein, 152 aa, Homo sapiens
MLRHWPEKTLNHGGAARPIVSDLARVPQNRRGSAVVPKKRGADGSNTGPALGTGRITPRRRDTNTERTTNKQQSKEESVEPIDASSMQRTRRGNTARTTQPQNRETARDDAARQPEAAQEGDDDRRATKTNRRTRTPKRQEPTTKTGGDART

SEQ ID NO: 980366 - protein, 368 aa, Homo sapiens
MGDVSLYSTSPTKTFKECLFYNEPDNTGWAVMTTGMEISSTCDRAAIAAYFAPGISRTACNIGEAIVKLCNIHYKADYATIAQQRSSKPDTQRAVVPRTSLCADINPQTTWTIAKGNTTIIVSYIRLYYIIVVLSIQKTTHNNTQKYKAHTHEPIANSKHKTYTDRKTTTKQQNEPLHNTTSKRKEEEAIRGERESVTRTRDRKEERRRDADVASEVRKKEVKAEQKQRAYKESTADNEKEERDDTEDEEIIGGRTRRLEREHERQRNAEEPSREPGRRREREDEQETEGKRRERKKKRKGGTEESGQRQRIGITRETKEQETAGKGRRTRRRNNRRRRGQRRESNDSNDEGTRGQQDSTRHKHKSSG

SEQ ID NO: 980367 - protein, 200 aa, Homo sapiens
MDGVGTWTLGVAEETGLETPETGVSCVSLRGSGSTQPICSGPRSGPLQGSGGDGSKLRRAKWVTVLYLTAVQMPPLSFTGCLSRARTQISNECPIGNSRTQDTLASDVAWVATDTGHLQGLGTLEDEKLLSCRDKNPRGKKGIQLAWPIAGDNCQVRADRRFRPKLGWSVGLLVNSCLKAGMISVWTVSPFFVAGTPVPS

SEQ ID NO: 980368 - protein, 125 aa, Homo sapiens
MREGMKERRGRGDEWWTGGRETAAKAGRERSAEEEGRDDGKGDKTKQQDRKKKTPEGKEEKGEKRAENKGRAGGREEQRERGQENKGEQKDRKKKKSEEETRREEAASRGAKRQERNEERQATQT

SEQ ID NO: 980369 - protein, 534 aa, Homo sapiens
EPKLTTCTRESCVTMWVPGCLPHPVRDVDWRCAPHPVSDCGRLGMCEKQFPNPGRLLVASRGMGSLRPVSWVHPQLGPQSCPLCIRNKSVILLGSGQPCFILKTQARYFQVSHSFPNRSRYEPPEESIPQATVIDSSQNSCCPLCKSLRVTDAVKGMDLPTQEPALGTNLYRYRVGSIEPEESLNPKKLQVVDLMLFHWRVSARHPQKVPSSSGVVTSTVGTSLAWLGALLHAVQGPCGAHASPSDRVSRCALGPRTLVVCSSLSFAPSPLRLVSTEKKKDESRGESRRRKRERATKEGEEEKADTDQEERNEETDREAGKNRDREGMKRGDDGGETGGTRRRERARPTANKRRGEDGEDSRSEERENETEQEKRRGRRETTRTAAEAQRKTENSRIPGQREGAPERQNEKREKRKKKRRRGHRRRDKARTRREGKARRAEREKGDGAEGREAEGETGENEDQNGRREETREDRGNTDESAGRSRRSKSRRHAGRRVRNKGTERHEQTTDTAASRRHGGRKRRGRGAKKSKRKR

SEQ ID NO: 980370 - protein, 359 aa, Homo sapiens
EDEWLTRITNAEKSLKDLMECENQGHENYVTNAQASVAGFDHLEGQGLMGWKTHMTLNTARDDRRTVYDDHNTTYNQETQTKASNDMYWDLLVTTGPRIYVLLDCGCTLETGDWGEDLGHSTLWNAHSCRVFIQENFPKFSKAGNIQLSRNLQTNATKILLKKLHFQDTECVRFTKVAIDGTTLFKGQPEQDRSGYPTKGAHQDNRRSPWRKLFQAEEELGPIFTLLRQAFLPEFYPRNIGSTRKGDNTPCQEATVCSIGSTTGPKKSLRDTLWGRPAPSLALALLHLRRIIDSLTPWEKPILVDGSTILSTDSSSPCPPLFYLLLHNHPAHRQPGTSRTIHNTDQPTASYRVSVEHTP

SEQ ID NO: 980371 - protein, 337 aa, Homo sapiens
MIVSLALKPGEQSETRSQKKRRTRTRTDRYIKGELPIIRYGANGKPGAVFELCSQGETAARRIGGKKQKILGFDSMTCMGLNLGKHFFFQSPPLSKMVKHPGRAPRSGRGRVHYKIKEEGAHLVARVGRSRLNTQTNNNFARAAQRFTPSVGGPLIHRHWPRTGQRGGPKTGRAETQCGMATSNYLRSAANTDTHEPTTPNDTTLHNESNHRDPPPHKTMHEQTQHNAHTRRNNEERVGSKQAEERGRERELSAEGDAARLAEHRQERRSAEGQTTRQQQRRTGSGAGDRAAGTRRGANGPSHQPARTHAARAKPPKDRAEHEYRGDSARRRQETGT

SEQ ID NO: 980372 - protein, 430 aa, Homo sapiens
MAWQGNDFCAHFDDGPKVQRPFILTQARRTTGHPITCGGGGPVLPPIGGRRQDFGCGHLAHTTTFGDRDNTTLRRAGFHTTHSVPAPQALSGQSGGDNQPQAQKHVVGRRDANHWRARSILIYHQCPSTAWFIAVRHAARRSSNDIRNEPAERRTTPRGRDSQATTTSAASQHRKRDDRREAGGTRGSRQSETRSQTQRRRAKHRRGTRDAEEAEREAAAGDDNTPENGEHARREQGEKTGEKGRRRNAGGGRDTGRAQERGREGATGKEEQELGRKRPHQREEESTEGTSQEGKREERAERGLGSARRGQERREGSKRDEQGKQRGRGGEEGGASGGRKASAGRRDAERSRHESSTGRGHRASDAQEQEQRASQRRRDESDDTGEGRGGERKGKKQTGRDSDRPTHGQETRAQKGRRTDSDETKKKRAS

SEQ ID NO: 980373 - protein, 174 aa, Homo sapiens
MLLQQKHTHQQTFVGPGLEKFKPSVGGPMSIELAKCQETGLEGGSQKKRGAAGNQGRACKAVHTRIAPDKLSTTSANQSEEHHQKRQADTSNHAPSTETRHEKTGKQKERRQQTASEKRRHTHERGKKRKQNKTQKRRQNRKEEQQERDDSEGSERAEERKRGQKKREAKERKS

SEQ ID NO: 980374 - protein, 191 aa, Homo sapiens
MIHYSDHCAVCPSDPKVAKIQLLDLPGIIAGAKDGNGSRSTVICQWPEACTLDPRVVRACPCNLGNTTHAHWTLRGRFGHFVRPGNPESCVTSTAREDSSTSFAPVSVFIRARSGTNYTPQCQGLCNGAYVVEPTSAHEKGPRGLCVLPSLFFFASPSFFVFVTCRRAQYAGSTKYELVARRRNVRTELQR

SEQ ID NO: 980375 - protein, 527 aa, Homo sapiens
FRRASRMAAQGGRAWAGVGGAPGAGRRPGRKLALQAAENGAEHPKEMELVRAGLRPAGTAGNRTPKVVTKESLWGGDLAWKAWNRWDPTLRPVLPKECFKVPTGCCPGATKRHKAEARKAPQGETPLRGATVAPSWAHNGSGRPVAPGRKPPEGGNRQEPTRAQDGLGPFRGRRRLIWGPPLGARGKPRHSAKTQTAERGDIPQAPTVDGMVRPNGAERRHKGAGLTPKGGLVPPNRGGAGHRGAPWRGNQNRTPYNAGQGWAHTSHTLFNGENLGAAPKDKQLLVVTTTFPMVWVTPHIAPTRRRGMTNVGLNPVSPVHTGSRTKYLKTRPFSPLGSERFQYSFTTHRTPRTHKQHTTHNTTHSVVADGRTHKEAPPTSEAKTRVSVHDQPQAETMEGAQRDRRTPQKVADNEYAAPSGGESPNKRGRYLKQEKPNNTRCENDRDQKGGTMLRNYSDTQQTKQTTAAGGQHTTETPSLLENTKPHDQADALLRHTPTRGAYHKTGTATQQATRDYTKTQPTQQKTE

SEQ ID NO: 980376 - protein, 70 aa, Homo sapiens
KWRGMDVFGVLNGYKVSDWQDEKVLEMDGGDDLHNSVNVLNTAELYTVKIVKIVEINKCSSYLKGKKFQD

SEQ ID NO: 980377 - protein, 110 aa, Homo sapiens
IIFLFPPHPPQKSLLCATRVRVQLAHWAPFPGFGQFSCLSLLSVGDTGAHHYTGLVLYFEEMGFRHVAQVCLKLLTSSDPPRLWPSRVAGITRLEPPRPFFCLRSIVRYF

SEQ ID NO: 980378 - protein, 71 aa, Homo sapiens
MQNRLILIFTAGLGSGLFRHNTHGGAGAGVNPTCGRGGTLWRVNAPILEGAAQNKGGGASGGKPRGTPGKK

SEQ ID NO: 980379 - protein, 200 aa, Homo sapiens
MPPRIYTFTSKSATTVSSLQALPPPRRASLSAKFGSISARNTCCARARAFPRPAPPLFKDSLHVSPRSRPTLAGPLWDWFPGRETESLSHLWIRPRERAEAGGLSVSPPSCVRSHKENRVSQKKKETKKCCGAGRKVPNHSGAGPEVSLARDRTRAPGWFPKPAPVAPGPARNAGPPRARDRHENHHAKHDSRQQAPPRH

SEQ ID NO: 980380 - protein, 194 aa, Homo sapiens
DIAAGSQSGRRSGRVWQERRGASGISLPGTSGSRHSDRGPGRPGCREIGGVAAAAGGGGSLQSREPARDALLRKGGAPNPGKFPYNMGQGVGGPGPPRTDRGPGAGTVSKKGNSPGGHPAPGGGGRKPFTERGTPGKAGLWTRVEVVATARSDVDGEENTDGTAGSEHNPRRGARGIDPQHFGGSDSVRREGQL

SEQ ID NO: 980381 - protein, 343 aa, Homo sapiens
TAPRTAQVHGRLLIPLWRGRRYYLINLDGDGELQADAAGPTQDLHPRSIEQSGQDGIPWRCAARWIHGPATRRWVSTGFTVRSREGYPGTSTAHFHWRGHTLARQYREFRHSKTSAEQSPGGEFLDGSHHKHPQEKTNQSQRNQTNLMGGDDLGSAIGQAFEPRRVLQRDSLREGDWLDTRERKQSTSAGQHPKGTIPRYFTSQHNGIGNKARKTQGTQEQQPGMNRLPYTIPRHAKGTPADPDAGPQPNCVNPWKVKDPKEAKGTHLNVGSHTTGTNKQGAKRATGNILPREHSQQAQGKGKAPMSAIICKNTFPIGDLVTQCAKQRVCQIPFFPQRVKKNP

SEQ ID NO: 980382 - protein, 336 aa, Homo sapiens
EEERLQNEGTCNELRLTTNKDRLVTLEESSKATEKTEFLEPDSWEHIDEQQFFTEEDTKQNLHTISHCFTSNNDTSPKQGSMSFSTTQQTTYNVRMTQPGGSDAWPYHQVIQPDGTKNTPPTTHHPLPATPYTHTHTHSYNTHLLHNTLHTHTIKKYKNSITKQQKTHTHTPSPHKTRRTRKTHHKIKKTHWGAHQNIKRHKYQKEQQRQQNHQDKSTKETNREQGKKKEPQTGNTKQAQDEDKHTSTDEATIATTHTQRKTTAKQKQGTPTRTQGGGAESGGGRGPAGGDERGREQRAADQREGRTAEASPAGEGGGGGGERGDSREGRATAGEG

SEQ ID NO: 980383 - protein, 129 aa, Homo sapiens
MNDYPCPLVYYFSKTHRNFIGHFLLHPCRKKQAPDHVSCTSTNHASMAETIWVLLWMTRWSPWGTSLFVLAPFNGFLPRLLDLLPMVGAGPSWGHYSGGDSVFPHGGVRWAGIFRPLAASGRRSLGRPP

SEQ ID NO: 980384 - protein, 150 aa, Homo sapiens
MVTVSQMTALLEEKHVQYIRASFKVGKQSLQMDLPELGYQIALNCTGGVITSMVEDNAYNVWTFKRNQDSNLRRKAPIIVHTVGVPPLQTFNNGTITFSGSKRMGTLGQDLIVWIRELDRSFAFMERGASRGANQGSGGQDEGHRHPNGK

SEQ ID NO: 980385 - protein, 299 aa, Homo sapiens
EAKRRAEHHWAADGHQQVCQPAGMKAYGTRRHLYDPKLAQTSLSDQATISLQMGTNKGASQAAVTGARTKRQIFEPGLGMEHCETLNVRPADGQSNKGASQRGMTGVWAATQGLRPQVLSDSRVPELCEACQKPQGTKILQFGLGATRAFPVFPPREGCGVLVDPSKASRPVSWIGFFQPLYEFNSTGLRSGREQMAGGPCGGRDLRRSVQGPHRAVVQQGQWRSGNVSGVPNPQSGTPEKSPGESQRTVGGHHRWEACCIPGSVWRELVVEGGEGILSGRRELKKKSAGRKEEKYEAT

SEQ ID NO: 980386 - protein, 77 aa, Homo sapiens
MVMKWGKTGAKEPAGTGGSTKKGARVRTTKVRVRSNRGPVLPPSAGKDREKQRRPKTRRQRTNGAERTKKSTEESAT

SEQ ID NO: 980387 - protein, 240 aa, Homo sapiens
FPLGVSCAGAEGRRSHGPAGMDGLEAPFHKDAGACHCVHQPARKICRRSAGSQGARSFGAPVWCPLRGPFVRLPQGFGAHTRVGRGPGFSSWEGRLQGGRVPTEGWPGPFGIFVVDSRGEGGNNVPGDCPCRANGAQRFDRALRSPKFILFPKGSPLGPKKGTRFWLKNLNLATKLAGTVNARPEPSIKTEEKSEFITLGDRHAFQKASESHPEWRVQTPGFLGIRAKEQGRGDMVVEEK

SEQ ID NO: 980388 - protein, 299 aa, Homo sapiens
EKHLQDLQDIFDPSRNMATYRNILSYVKRMQPPITSTSSLLSHEQTTDPFYHERKLTSKRYDWLSVNPFGHTLTTLTFQRTHSANVDLDIALYWLTHWNTKLMNDNGHKNGSTLKFPQAHATNHYPRNPSGLWTLRSPKHGTRLAYQPTHITNESKPAQAKASLTWPHNPLCPPKATGTLNSLASGTWHHQKSRLTNSDTTRLEDTNHDITSYLYPPKGSHSRHTGFTTSANPKRQLCPKAGNVTNCVIRQTGTVWKTLVIPTSLQANTDWAWQMSPLLPHTYKFARTYRPLSDTPTYT

SEQ ID NO: 980389 - protein, 136 aa, Homo sapiens
MLVASCPFQLNSSCGPLSLLAPELQRHTILLQAVQVVFPLLKMKLYISGQCPTGACHQGTRGRVIRWSADPVLSIEGEPVRLPLPQGSESGNSGHQCPQEGLLGQGEGSVKTSRVVPRAAQGGERACLGGNNPAGV

SEQ ID NO: 980390 - protein, 263 aa, Homo sapiens
LRQKDQLSPGSRGSSEPRCTIALQPGRQKENPVSKKDTKTTRTIHDKRRRHTPTGHKRRDDERTTQTRPTPTNRPEHTTAQEQKDPDHTSDPTDHTVPERPPDPPGTTQQQHRQQYNEETTHVCVVAQLTRAPMKEKRRFFIQEPPIFRVLVGAGGAPPKGCGLSCSTSCAPNSRAPPQRENPLGGKEHQARAWRLLSTQIIKKNAAGEHNRERRCLKQTSHKGGGSRQGATTRRRHTTTERRLTKGERPEIKKLRRGHGGGS

SEQ ID NO: 980391 - protein, 36 aa, Homo sapiens
MNWTGKNRRKGSKTRPVTGGCTSPPPPHKPKNQQTH

SEQ ID NO: 980392 - protein, 114 aa, Homo sapiens
LTAASTSWVQAFSRLGSRVAGTTGASHHAQLIFCILVETGFHCVAQAGLELLKLLSSGGLPASSSQSAGITGLSYCAWPSKAIFQTQRKDKDISRHTKVEGIHQCQTCFTRTVY

SEQ ID NO: 980393 - protein, 155 aa, Homo sapiens
MKEADAEVAVSQDFAMHSSLGRQSKTPSQKQKKKKKTKKKKQLGGRGVGPEKEGFYKNHLGVVERARHPTVECNWREPGRKSGAPKRKTRLQKTNWSAGFPHQIKKQQRGRKPGAGFGTKLQEGGSGRHTQRGPTQRGAQEEPEIKNTTGDAGGR

SEQ ID NO: 980394 - protein, 116 aa, Homo sapiens
MALACLELLPGPWLQYVILDPELRVEKWVGEFEALRPYGAPSPRGLSGGLAWGLLGAAAWLNLVGNLRRLVSLAFDKSLSPFKHFWMDLAATLFILGKNSLVKWRAKDLAHWVLPG

SEQ ID NO: 980395 - protein, 201 aa, Homo sapiens
SAERLGRRWAVLVFARGCGLPLGMLRSGRAGSGEGWPKNFLRVGVERKVARNTGQDGFVKVPTRVVGKRAPREKPGWATRKGPAQGKKGGLPSSLTRRGGVKKKKALQCRGIKRGAPGEQPWWGGPFAEEKGNSGDGVILTRKVCWTAGKVWAVKFHGRKRLCALFSQKKGVSGGWEGGRKNFGEDQGSDFSQKKKAEEPL

SEQ ID NO: 980396 - protein, 132 aa, Homo sapiens
GPAGTPARTRRLSDTKMSDDAGDTLATETKQKLLRCLIVILYLRMQKCMVIQLQFHMSQHQVTPEGRGMKMQAVPGAGVPPMWAPCASLRNAKGPWSPPSQMETVTEDTLVLNVWDSVSLGREEPKDRENTR

SEQ ID NO: 980397 - protein, 166 aa, Homo sapiens
PVPAAGAGEWRLTGAHLPPQGEGGAGCERAESELSWKVATWCGQRITEVKYVIRISLLPNWFPPGCRGGGRGEGEGMVHALRRGSLAGDLSRVSTPVIEPCRQILGQVTEPSSSFPKSERFEGALPLVLTAPSVPSSPSSKMWQDSPRALGLLPVFSLHWASQMIP

SEQ ID NO: 980398 - protein, 238 aa, Homo sapiens
RATKRPALPGALQSQKSSMAARAKATTTFPWCCTDRGTCAGELILSLNQAQMRSVLEDAFCVESVAQMSTTGSMGRMREFHGEKAHGAGHMKLRGTVRTQWDSFGKAPKTRVIVLPSSLCAPRENMAEFWQGWADTILSPSIFFCARPPDEGETSAGSIRHNCSLCVTSFLTNVTLVRKGRPDRGHFLWGDPIACRKRAELTLGTPRSLLCGSLGQIREWSIWARVAKGNENNSKVVG

SEQ ID NO: 980399 - protein, 115 aa, Homo sapiens
MDRGARLPDGLGLWSLRGRSAGVLFNQGKLCPWQELGQSSHILQVILINKICGRSQKGLKGSLRGRIWEVTKYFLQVLSKHKVNILIQDNNVMCQCWVYSGRFYARYSLKEYEIV

SEQ ID NO: 980400 - protein, 238 aa, Homo sapiens
SAAGLLGVKVCVSFGVTRALGAVVKEPSSGSVIMSRYGRYGERTRGVCVVTVGTWRWQKGELEGASSYNGSFKECMELGENPPGFGPLCGIRKDPKEMQKDAVYEDVMDQGDCVGFPSERLTLSTGNASEKITVCDRPLALSVSFDSKLIDAMSVAKKGTSMLNDGHLLQPGGKKQAGPGSRSTFSIQRKGYSRFTQEGASGRSSGSRHLLEDQDLSLFEIKVTFTQKNLGVGHQRAG

SEQ ID NO: 980401 - protein, 213 aa, Homo sapiens
DTQAGKEQVISTASTKCVLSSVSTGMCHIAKSRITSLHELLVSKDNKTLTSPFQKLHKTAYIRGWLVLQVEGADQPVTPQTHLATMDIAIPPPLDPPPFFPFHSPSRLFDQFFGGAPVGVWIFSRRSTSLSPFYLRPPSFLRAPSVFDTDSQRMRLEKDRFSVNLDCEAILPRGNSKVRCGKDVLRCMEKHEERRMNIGSISRSPQEYRIQLM

SEQ ID NO: 980402 - protein, 128 aa, Homo sapiens
MRLKNQARDPNLKYPIEQRIITNGGAFGRKILHHSFYNELLCSHLKETQTVSPQRLPLNSQGQQGKDDARSIVGNLHVPAMYVAHSSCVFPLCFWRTKGIILGFRLMGVTPNCPQFNEGNALAKCIMR

SEQ ID NO: 980403 - protein, 310 aa, Homo sapiens
QRLPKVIGNQSLSRAGLHRPKMMADEALAQVGLSSGVFPDKEVMLMLPYALGGEISSKSPCWRLPTAPMGQPWVYSPRPFRRAGDALKIGGRPGKLCSFVGRTQKEPPVERRPKGPRLGHTQWGFWKNAVNLFLPNVFWRKPSGCPRGPPKARGAGAFAPGLQSQRETGGRIGPEQTGWVHTGPFSGTTGFPPGFQSTFYVHRCHAFPLKGPKGAFIFFTPPQKVYSDLQRLHHHHHSSNQIACLLAARVRPSREQVYKQTTWWWGAPTRRECQRTTCAYRVFPKTTSLCAHSYVVWGSTKIKHPRGTPM

SEQ ID NO: 980404 - protein, 78 aa, Homo sapiens
VHHNLHCLYVWKCSDCILSIVRLLPVQWLYELVSCATCAIVGVPRHIADSMSLVTFAFAWLGSPRVGALGLLPVVSTE

SEQ ID NO: 980405 - protein, 176 aa, Homo sapiens
NVLDNKKRTALTKVCSSQLYQHEAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVIASYFLTTKKNRC

SEQ ID NO: 980406 - protein, 84 aa, Homo sapiens
FMMSMEPQANLKVVENTSAALGSILACVSLPRWLSRDFGGYISGTDVYVISYERKEIMELQATIHVPAKDMIINFVQPLFIVSP

SEQ ID NO: 980407 - protein, 119 aa, Homo sapiens
MRSKTGVAIGARRSSVTPRGNVQCAALTCYSRTGGRNIPEKGELRTAGAGADRAANGICHGHAQNRGAEGGAPAGQQVQRPRQSRGIRYPWRNKPDNGAGKREDGAQKLSAGGQTNRGG

SEQ ID NO: 980408 - protein, 107 aa, Homo sapiens
PRLFLVVSSSAATVVSSGVLSSACAVTQRCVVDFVGLMLNESVPLASLICCESPACSNHGRHVKDHSEGELSTLLGNRVDLLIPPICRNEVRWAYKDREKKLGKSCG

SEQ ID NO: 980409 - protein, 136 aa, Homo sapiens
MWAHTLYPALGAATGRRLLSPRESGNTPLATVDNLAPPETYTICHGLGRTRRPALAAERGGLPDPRSRQPWEWSRPSKVNTSWGNADSIGSRGIAPGARQSRAAERAAMGRGTHEETALKRRPQERGRTKADKTHL

SEQ ID NO: 980410 - protein, 297 aa, Homo sapiens
MQWGDVGLNNRASEENVCYSLTDVTQKSTQIYLNDSSCHPLDHLIVGRITVSASTHDIIVFFDRCTVKHLSPEAVARLKSFCNLRPWLVMGNRTSSHIGMQTPIKWIFGGGGIAVVLPRLGFTCFILRLYCSRRVSPVCSNVDISWAQSRLGALGFAESFGWCHHGRSLIWASRDGGSKVLGERSSVLQWLCILCSIYAMVRPQRKPGTSGVVPHGGGPRNSCLAGTRGWTQRGPRWARGDRLSVTTGLVPQWRSTSAIGANMEMKRPLHRGRTRKVQASKDKRHRGLYHVKQRSEI

SEQ ID NO: 980411 - protein, 162 aa, Homo sapiens
MRFFHETEAPGPKDFLSKFYVAPRSMKSFSGKMHVILFKSTNNHYTIKKKTKKKKIGRRGGAKKKFQDHRLGGGDRGFVERGPHGAKEHAADTVRGFPPQKPGERGCEPSRGWSKGQQGQALSPRAGETTHKQKKTHDEMRKTSERHKKNTKRERRNKNATN

SEQ ID NO: 980412 - protein, 108 aa, Homo sapiens
GANRSAAVAAVVAAGGGCGDGGSCQDGVLHQLPLGPGNLSWKHCPKKTSSSCAKKQMMLIQKAKSGVQNWQKRTLKTSDQNLLLKDTGDIIKALTERLDALLLKKQET

SEQ ID NO: 980413 - protein, 74 aa, Homo sapiens
AVVTAVVPAVGEAAGGRSRGREIETSCERGESLSLLKILIVNRLLAMCGVRRQTVENVGIIVRLPLRGRDTMNS

SEQ ID NO: 980414 - protein, 176 aa, Homo sapiens
EPSFAKSPPDRDMKLVFLVLLFLGALGRVSGARRRRRVAVGAPVSQTEVTKCFHWRSNMRKVCGPPVSCITRDAPIQCIQAIAENRADAVTLDGGFIYEAGLAPYKCDCSGEVYGTERQPRTHYYAVGVGEEGRQFSAERTCKVLKSCPNRPSQDPLDGNVPIGTLRPFLNGAGPP

SEQ ID NO: 980415 - protein, 79 aa, Homo sapiens
MCGGSASEDCYNNSVGGAPDDKNGPKVQETRSTRGFPRKAERGVEHTGVGLCGSAPTPRAPAEAHTTRTLRGAHDRRQQ

SEQ ID NO: 980416 - protein, 190 aa, Homo sapiens
MGQKWILISEWWFKLTSYGGSLTIVKIHAEKLSEYDQISPPNSQPDKENPVCVNLMKHSKKTYDSFKMTLKDYIKVQKAEVESKTWFRHDDGDYWEPCGLPRSGNSRPTFRCLPREFPFETIKNYQEYGIFPNSEKSVPQGTALKRLERPLGTGSRRMCPKHTPVTYQTHFLAPGRKRYIRKETYGKNMR

SEQ ID NO: 980417 - protein, 112 aa, Homo sapiens
LSPGVLVKARDRGWVSAGPGLSSLSLLSDIVFKPCVQSLTHRRDAQEDKGDLEVQYFLKIIQYWMIIRNVSCVGSRQCGLKQMQQIRCPFVEKAVVLMGKNTMMRQGQSEAT

SEQ ID NO: 980418 - protein, 101 aa, Homo sapiens
MTWNPWTNRWSQEEPPGPRQVCGVHQKKKTRARPSLQPTPTNGSKRAKGLNRGPRKQIYRASGENKQHHKSRHNQSRQSRHNRVKTKQEQKKTKAPTQEKR

SEQ ID NO: 980419 - protein, 301 aa, Homo sapiens
AQSFHPRCIPQKQNQSSACASRTFYIWCQGWVGCKGQASTVISSPVCSPKANAGARMCSRILQSVNQVQNNSHSTIRRLRGCHRVTGREQDHRDNQWNTQNVPTMLAGEQSRPKNGEGVGTKEAPKIDTTKGQYKDNLVRKDHYSSPKSIFKGGKWWYTLTFLEVLHEYKGPILNRYDTNSGKHRVDPSTPALYNAFRPARGSRLVSSMCRPKAETFEETVEPAVTWDPVSITHNTHNTTVGLRPKVNHVGGPQMSTAGSRHGSRGFTKHGDGCNTGSASVHDGNTRGDKTPNTQRRESTH

SEQ ID NO: 980420 - protein, 143 aa, Homo sapiens
TKEAVCLLGPDGELSTFVAMCSSPSPSLSHLGNLVRSHSQSRQPRRRKSRATSKFVRTLQQNSCARGTVRLPNCHSKIAIHEKSIWGGNPGCLLGLLEKLNVLTDMHQEQLCKGDEPLLKSCFIRKMWHPGKNNLWPQSSLFD

SEQ ID NO: 980421 - protein, 111 aa, Homo sapiens
KETKEVLGRQRAGKRGQEMEDKVTSPRESRRSKIKSKIILIWDKSLEVQILFKETVCRKGTKYSDSGDYNAKAKMKKQSNFLLQLRIRRRPLLTTFPLRKTFLKESRPCVW

SEQ ID NO: 980422 - protein, 67 aa, Homo sapiens
FGSELTLIRAELSRGAARPPPGEGGYRWGAAVSVRMIEVLTTMISEIVHQVNALWEQESRCQPKVCG

SEQ ID NO: 980423 - protein, 253 aa, Homo sapiens
DAAKDSTDRLTYVGCFASVRGKRRAVFLDLPFAVVRGRLVDPRAPCRPASRENVAAVLPLCLTAWWGWDRAWVGCPNGLGNEVKALPLGGRGMAWLLRYKGGGAGPGREGEGTQKGEATVGATGVVRAFGPLGETQPYPSLRSGVVPRDTGAGLENSFGPREFQGGKPREFQPPVLNCCGLYNLSWKGRDPFWIVDRTAPAKRKTRFIFKNPGETGVWEKARAGFNRGGTLRMDAGFGGNAGNIKVLRSVPGC

SEQ ID NO: 980424 - protein, 188 aa, Homo sapiens
MGGHHCFVTAPSHFKAAIDRRKDCRNRPQSNNLVVSVPRTRILDSLPWVGLRTPYDYTGFLATSAPKRVGTSRQLTKRTGNNMDYITLFASTDSKDRTSGQGTGLTLSSHNSVPHRGSTTHCTTSTLGDEETRKNEPSWLLTPTQHSQPRHTLLDLQRTCAHSPHDAHNVSYTHRYSFVTSLPRTQHT

SEQ ID NO: 980425 - protein, 104 aa, Homo sapiens
MVTRANGKGLPRAVKSCRGSSGAVRCIPVPSRERLSPSLECRREVIMSGRGKPGGTSGAKAKSVLPGGLASSPVAVLPGLAGTTGTYAAGNLGPCVAGFHLAGM

SEQ ID NO: 980426 - protein, 249 aa, Homo sapiens
SKRRKHKGRKEAGDRWGTREAERAGGAARGSEACVLGNRGTRLGGDPRPTDTGSRSTQSINTLTAEHAQQSSWLQRLLVKPRYRCPFSTTKQAEPCCFVHTIKHAHPQEQSSQKIIGREHVTGQKGFWKNEARAFSLWYSIVCHPGDVGLTKVYCGAAKSLDCRFMGPKVDLGGSPGGLGLWPRGIHTFGVCRVNPIFFEGSVRGACLCSNRHNRAASLPVGNGTIQDVQCDGRPSASLLNLCLGFPKF

SEQ ID NO: 980427 - protein, 95 aa, Homo sapiens
DKEPVVYIHQEYYAAIKQDELISFATTWMQLEAIVLSKFTTGKKLKYCCMYLTYKWAAQIMSPTGALTSMGTISTLQATSQANGGGSQDRPEVWG

SEQ ID NO: 980428 - protein, 185 aa, Homo sapiens
AKKEKAINRNNEEVTDLKRQAVEEMMDRINQEEFILEPLIRQQTEDQSQNLRKAAKVHVDELQRNELGHLTNPPSSRSLKSLDPENSETELDHGFASHDTVPAEADSSSPTGILATSESTSMPVWVLYPVSTKTALNKNNLEAEFKAVPPNTEPGARARKCEGCTSSQGYVSASQYALAAGNNFL

SEQ ID NO: 980429 - protein, 97 aa, Homo sapiens
TSGGGSAADTLLTHVRMVCEAADDAPSSEEEAIVVLCKDAAAQPQDAVILRAQTCTLMTRASSTDQLLEVGWSHGFPEKDGKQQVQYMGSVLVTKKS

SEQ ID NO: 980430 - protein, 127 aa, Homo sapiens
EEISSEDDELVEEKKQQEEGSLQRRKLEMEDIPVHGKALRFTVYRNRTLQKWHDEDQMLLKTGKGSGAFERSILTQIDISDGTNERLLRRTQTKRSVLSSSWKPEPAAQPVPESCGQGKPEIFLKPC

SEQ ID NO: 980431 - protein, 173 aa, Homo sapiens
RRNPTLGGLSGRQRCCCGWEGAGSGAHERQEVSRHSVSSVEEQVAGTLKWGGEDAIGLDGGGKGFGSPGCWGASGEGAQKGESRIGLFTGAPTEFFPGTGGSEQALRKKGGAVLSQMVWDGNTGGGELVVQGGNSLGEAQRTPSAEDRKRHDMSNEVLHEDFGDVTWNLKLGA

SEQ ID NO: 980432 - protein, 94 aa, Homo sapiens
GRPSGKSKGKARSKSTRLQYNMDLSGEASQFPYKMMISECSRLQKVLNILSEQMILLFNEVAFGHSGYQMQPYSFNPRMPYREWGWLPQFMCNN

SEQ ID NO: 980433 - protein, 292 aa, Homo sapiens
AGRRLSEGVELEGAFMAMQELPLMLSQKQVSQNPFPMSLPQNHGGNQSTHAHSLDDPDAPAPLCDETNASVKHPMNNDHGLRPAEEHQRDRPVKSIGRWNIGPLPLRSCKEPLCNAKKCFPKLCVGEELAVMILTTNFKGFTVMNEGERRSLQNVVRRGGFQEMSVDITPEFLEKHKIGLVVHDESVFLCGLMMLPRTLRSRYVVQRENEVLISDYTRMCDMMLCPRTSKGLARLAHVYKDASSDRAIALELGSSLRGAKRSHGNRIGSRPAAIKSVVHVTGPFTHLGGQAL

SEQ ID NO: 980434 - protein, 119 aa, Homo sapiens
SLKLTAFGRDVSLRLSCARATLSFWPGGYPRYSKDSGSTHVIQQQNGKSKFPECAMCLGFIPSRLLHVDFTAPTCSRDSDHQVAHPDLSFQQRTVLLSLVLTLDIHPQLNNTMSHAWPL

SEQ ID NO: 980435 - protein, 208 aa, Homo sapiens
AGDVVTFVEENQLGMWVGRLNHAVQKVWQYQSMCITTYSNSNTLTGRLTVYATYGKLGMDGSNIQVKVQKKLQLGKQHNDFTVSRVPKPSSVKVPCVEKLMHLISVDTSHVCTITFLNAKKKKQHSKTHTCVRRPRPPNNPFQPPCLSRRPQQLRAPLRTTGAQGNPRPRKCSWLPPKKPRGQRISEPLTRGRGTRPPRRAPEHPPGG

SEQ ID NO: 980436 - protein, 134 aa, Homo sapiens
NGSRCGTLRKPGWDSEQEDVNSKPPAFQESSPERPFVGGPEQEEEFGPAVAAVLQSSGPFVEGSIVRISMENFLTYDIVKYLLDPTVKYDRGSQWNQGSRACVCAIVPVVKLEKPCFPWDEQDKVRVFGRREDV

SEQ ID NO: 980437 - protein, 73 aa, Homo sapiens
KHGINAEWPLRPGAVIIGFRLRLKMPSPFLPQGTTTPLIPILVIIETISLLIQPIARGVRLTVTLLQATYSCT

SEQ ID NO: 980438 - protein, 129 aa, Homo sapiens
GGYLCRVTSCFLSLSRAVWWQQAQPSLKCKKERREVRGTLYRCRDKWLPGKPIRFHRVPREPVIFIEIEGCRGMTMVPHGRVFQGARLKHIVSAYRGGRHFRRAWGEHQEMIPMPPDVAKGRCGIRPKR

SEQ ID NO: 980439 - protein, 108 aa, Homo sapiens
QAEKMAPPSTREPGSCRRQRNKSDGEMVLPGFPDADSLVKLALWVRGGSHQGIWGPTTVGDEYDFYRSFPGFQAFGETQGDRLLQCMSKSNAVPLGVAETLRIEVKVT

SEQ ID NO: 980440 - protein, 112 aa, Homo sapiens
GWRVRGFLALGRFFKRIIYVNGRQVCPFLHMRNDSGIKKSFEKLKRHYSYRVNSPGLAAIVAYGLYKLKKQGKYVRMSIHLIQMRVEPRLCRSNDVWYGLFHVSGILGKTKP

SEQ ID NO: 980441 - protein, 78 aa, Homo sapiens
ARLSAELLSWRPSVELLSRPVLCCIGGCPELGGARVVLRDREGRWGRHRRSLQDVRGVQLSKGVEALQGWYLGGPECW

SEQ ID NO: 980442 - protein, 139 aa, Homo sapiens
MFTILPLLLAKKKKLVFKARANAKKAWNEGSQRVPNRETTGTTDAGKDGDTTLHEMGCTQTRPEATCCTAHYWAPCYTDTRAAGRNHRAPYTPDTGPLQPLWHHTMCWTHPTKPRCAPPYEPARRKQRTEKVTPPSNVE

SEQ ID NO: 980443 - protein, 321 aa, Homo sapiens
CSPPCFSTCYTPLSGARGCRSASSTHAGTHLVLAEHCLYTAAETLLPYDNIYQTYNSLLLSHSPGSGYQSSKLAHLRLRQPTSPVNRGSGCATSGTPGMHYRTPARTAPQNAALWCAGVTSHFWPGGANIFLGVQHLPHCGRVLRARQPRTRTLTPYTSLLPRHPNQPTQHTQHTTHTHTTLVRSGTRAHRRRPSQTDTGFYRAPLSGVEEAQRGAHKVAQKDSTTWGHNTRWPTKRENHSGGDNILQTNERAPGATLLLPHPANISQNKTGGARGGGTNTTGRQRLLCERRKNLTTKSGGSRARQGRASNDYTEGGEHDT

SEQ ID NO: 980444 - protein, 128 aa, Homo sapiens
DCEAGSDAAAFACGSCDRQALYSGWNNRKVMQQKRNPQFTCGAFLYDEDFMDPLYEKGKMSRNYVWMCSHTKTAILGRHLGLSFQFSRCNSMEVECEGDFFAMLRGESCVIKKKLPCSVDTELRGTLF

SEQ ID NO: 980445 - protein, 85 aa, Homo sapiens
SCGRMCTVHAEAERVRKFSPFSHRETLTGRVGTTDDTGPHALASPVRVTIIMTKACRQFIFLPVYFPFAFLESCASQKLESSDVH

SEQ ID NO: 980446 - protein, 69 aa, Homo sapiens
GPPTRDPTAGPDVHSSSSGARRANGPYEEVSVSGFEEFHRAVNSTSAEPSRTRGVCSTLVKDVCHLVAK

SEQ ID NO: 980447 - protein, 75 aa, Homo sapiens
AGRKRLPAWTGADLTRSQLRKMDSEVQRDGRILDGIDDAGREDKLAYEDVAIPLNELPEPEQDKWWHHRIVSREH

SEQ ID NO: 980448 - protein, 242 aa, Homo sapiens
GAEVAVSQDGTTALASLGKKKKKKKKKNLGAGLGLREKVFKSHIRGGARGGPREGNGRHWAPKAGAQKERTAGHMETKGRGSSSPPHIKKIAPGGDTPRGRVPENQISHKRGEVQGGEPKNGGRSYPHQGGVPKGRGLRENIPKNLKAARVSGGGATHKANREHNRSKKKIDKKQHKDEDKRRRKTKESTQRGRWERRDKSPDDTEQERDRQQTQSNKRERGNADHTTAQEERNTREERKKD

SEQ ID NO: 980449 - protein, 103 aa, Homo sapiens
MGRQETWVMKREKKEFLRLMGAGNEQNILVVLLLGDHKSTSHFRTGEEDPRKLTEELESQYQQSMASTTYQEDIGDIVDCGFSEVEDHDGEGDVAGDDDDDDD

SEQ ID NO: 980450 - protein, 276 aa, Homo sapiens
CSGIRLRFILFLRITPPGLSSASQPAVSLTPEHHAFNEVAEFCMAAASFAQLHVATLPKPICALIQAPMLAQHIGQWHACKRSMLHPKFTSLPKHGAHCEANHLTHTHGPIPGGMTNTKQKRECTIQSIPWQSNACSTPQSTKRKQIGILPLDLEELNGPSLGQTMWTQKRNHPLDGNIQLASGVDEQHNLYDQFKTGLGYDLINIAKERSYWPNIIALHRGTQTPPLRKHIGTEPFNYFQTALRFQTLTARQDKAPRITPKRRNQLGGDNDRQVT

SEQ ID NO: 980451 - protein, 132 aa, Homo sapiens
MNTDADAYLVDDMAHGLERHINYNPRRRTTYTRFINTSYIKTELRTYISAPHYYDPLGVILTKRPQGTRTYTQVGGEQRHKKSNPSYYQDRPTALVEAIDCHRSIKERTHPMKISQNMPYYPNFIVTFAKSL

SEQ ID NO: 980452 - protein, 113 aa, Homo sapiens
NSIAHHVFHFRQIQIIISILATMQHHSSNSNEVYSFSSPTVTITSQHFSPTNISTSQFHISYMEAISDSNHTHPITAHATACASASPNYSKCIHIYLNDILWFHRLCLNYRAI

SEQ ID NO: 980453 - protein, 72 aa, Homo sapiens
LHPGERIMGQVLHDEVIPDVRLRKRRNYSSLMAYPVWKCNEYVFLCCQCTSVSHGNRILLGERSGTVKKRSR

SEQ ID NO: 980454 - protein, 289 aa, Homo sapiens
MLTDVRSLPGGPGLDDRGLVKTQIVTVIDSHGTRVLKKEDSCLEAKHNEASPVGGSNMKLDGWNQSSYRCKKQSRSDLAMPGGLMCRNLWFLRLGFPVTLTRRHESGHSEEFPLGLIQEGMSVYEKTLNGDTLVSPGGESHDRSRLFRGTVLDRQVLGNSGVQVKRLSVRTLLDNPGLQLYTERDVQTASKVVCNAVSQRLDLHWVMSKHMCPEQEVRSLENTYDLERALDTQVLVDQLLGVQSAALLNCPVHHTLVVGREHKIAGAKINGGAQKDVKPKATNGGHVDV

SEQ ID NO: 980455 - protein, 70 aa, Homo sapiens
MKPGRGGRKPTKTADTNNTGDTEEHNELTSTTAHTRLQITQRTPQVQNTTHTKTTSRTTVKRRQQTTKTR

SEQ ID NO: 980456 - protein, 98 aa, Homo sapiens
MVGQCAISSGVRIQDDHNIERKPVYIKLSEDGQKRERDTEPPKKDWVCKGQTPNGRSNGLFCDKNTVGPNRENPGHMWQGGGGSPQKSKQSPGGEGKR

SEQ ID NO: 980457 - protein, 82 aa, Homo sapiens
GLKMAAFARSEITASLRGLQGVRSMSPLTKVQKLASNSMCVSSKYRENNFFLADRHNFITDEAGKLQKMEFALCGPACNAMV

SEQ ID NO: 980458 - protein, 293 aa, Homo sapiens
KPSRGLFSCSLAPLLADSSARNPNPLCLPQDAEASLAHTDPPFVPQLLWGLEYAADARDDHTDGWRPKMELTRAILRGGSPGVATGSPRNSPAKTPLQGTQGPGGLPSFDSVGPGKTLLDRQTLRGCIPNGPKRRLALKSPGLLVRTAAWRVLKEPVYRRTEHGKPLNPGAKWARTPRQAMERGESSESVRACATGDKTQENSGYQHNHSNAHTAPAQPTYRHKNTLSIARHPPRTTSTLEVAGAHIEGSPDWPTKRRKSGAIPTSAARDSTRRGAGQSAGKYRVRDTRTRTG

SEQ ID NO: 980459 - protein, 151 aa, Homo sapiens
MYRLLRKLRYVKFLAINEYANVWLTMSYSVILKVNWYDMADLVRELMGSLTIYLELMMEGVGTRNGTYNVNAKVVLVQKPRRLSLVSELLIILRRGRECDLVPKEKACMHVCALEHELRLSQKLACDVCVSVPCSCGSVHLRVVSLPDMWQ

SEQ ID NO: 980460 - protein, 96 aa, Homo sapiens
MHHCTSSPGNRRKDLSSKNNNTRPKNNPLLGRLDLKKLYDTTGGAGGPEVSTPGHGAPEDTGPTHARLSPKKPRGPAVVQLQWVGATAQRSGDPRR

SEQ ID NO: 980461 - protein, 249 aa, Homo sapiens
DVLRRESSGFPASTVLGRNPALSPPRPAPIASLRHLSHRTLGLPQGPRRRPAPASNRRAAALLSRRHETASPRRCAQKYQQDSEGPHQPPDQPGALRLLTLPGPCLTTFDRDDVALKNLCQIFSSPNLMRQREHAEKLMEAAETKRVWPEFFPSRDYQRNAKNVVNEWEKNAGLNCHGSGCPLPFVDTHTLVDFHVTYWERGTTLGTDKKVTPLCVAFMATHTWKEQVEASKIWVTRDHLARWERPNLV

SEQ ID NO: 980462 - protein, 218 aa, Homo sapiens
GSKLEHSSLRKNFVLWVGNLGLFRPFMKLYWLSTNRHLTANYLYLCIPIFLDNDYRKDNKFIQNKQKKKNKKNLTGHGQRGPERRRAFRRTHCGRRGGRGDTEKETRRKTVAKKRETQGRTAGQQEATRGASETNPPNKIIKKQRARGGEQTPEKSVFQRQTEIATATWDEYHREGAKTNNDGHTPYHKERSSSPKVTEAPQKTIKKFFTPPRHRGGR

SEQ ID NO: 980463 - protein, 292 aa, Homo sapiens
METTGAGPGSISSSRGRQDLDTNLGMFQDDGTGTEKRKQVLGFKEIDNTGRCNYVNRARYQKTTHGEDPRGDDLCPCDFALSKEVNQGDREFFTIGGEPNDNGCTQQFVDVHRDTWGRPLQPGPRGGPSKRITLEGPETNTLNPSRGAQMQEARGEQGKLRQMASRIGVTKNREVHNHNFFTDMVSQETGGNCTFGALLVGNQTMGDEQRDQSLAPHKFGGPSVAFLVQHNGVTRAQETHRRSADRATGDTQRQHSRTVNTRRTTWGRPVKRDHEADQPWATPGNQVTGDTE

SEQ ID NO: 980464 - protein, 114 aa, Homo sapiens
LYGGSRGDASDTSVNVNARAKAYLKVPSVSEGTGTFECGAVLEWNEGRVGEDIVKCSTDETLYQLKTWMLDCTEEKPFQNICSNNGQCVLRTCVCVRKRGYYQMKFMLANDGEW

SEQ ID NO: 980465 - protein, 134 aa, Homo sapiens
AFTNQEAQQLLLGVGSSIRVCPRSKRSGSAAYTSILKKRHERKSVCHRATRCRDKRLKNRIPRGNAGVASYGSGAHVGVKGVPPQRKTCGSMQVEGGLLQQLKYMPGWRYPAQFLGRRQLRRGGIHAGENKEGP

SEQ ID NO: 980466 - protein, 157 aa, Homo sapiens
MCTLAWATKEVKTPILKKKKTNKNKQNTVCVGARPGPLERKEFFLGPIVVWGGGGGPHVLGFRVNHVWPKEGCSHRRRPPGEQEHNSVALGGFPHPNIKKKAAAGGEHPRGGFLETKFSQDGEITGKAQYRGPISQNTGGPKAGPPEIKKLRRAVGG

SEQ ID NO: 980467 - protein, 90 aa, Homo sapiens
MVLWTLGAKRRWTQRGNSVSAKGESAVGGFSPPKYRNTARGQHTQGSFGEHTSTEGGSQEGATPGGSFYTEGGVQRGSRKYKNERRGEGS

SEQ ID NO: 980468 - protein, 100 aa, Homo sapiens
VFPFGVPLKILVSPWDAPVRSYRYGKNKPYLQSLVFRTGVSLNAKIRILDRECGRRQKWDEYLASFDGAINAGQNEIMEAEVIALQRPMAGRGAEIVCQN

SEQ ID NO: 980469 - protein, 98 aa, Homo sapiens
GWQAKDAKMAAVRFASGGSVGLARCWSSRECCAGICCEGARAGRAVVGTPEWSGRGSVTGFRLTRRSGGRGRLLSESRAMLGGRGVAGVGRVVWIPGW

SEQ ID NO: 980470 - protein, 138 aa, Homo sapiens
RKKEQEERQQEQKRNTRGHTQNKRKEKEHREKKRTSQKKRRRGGTGEGERMEQGGEQAEQRARDAKTRQEEKASTDRQGEKPRMQEKKHEKEQQEKERKEDEERGMRREKHQPEGKKERERSSRRAEKRRERTRSREE

SEQ ID NO: 980471 - protein, 272 aa, Homo sapiens
MGLVFVKGYVPEREQRRDECVVWFGINLGFAERRKIAKASVSDDYRKDDKIYLKGLRKKARRKVILDEFVYKMTRGYPPGWVHFMRRLMDEVTPETFKVYENSGRQICRNEEGCRSLGKIDRLRSELPSVVFQGDAREQACVLFGHHKGVDTVCMSAVIWEEVRRLVDRVFIEARIETLGMKELREYHQMDIKRIANEREKQYRCWQGIGEEELSYWSENYSQDLWLIGMGSEEGEPGLYSEGDRGLKTVLSKQGAYNPQGGGAQKRGTWQP

SEQ ID NO: 980472 - protein, 246 aa, Homo sapiens
ILEAEGGRDVFCYVICLLGVYPPHERWRSGVCQRSPRSYCLVAIERLRERSTGDTKKLLADVLKVNVFRQDSGDQVLSREATVSSANQGGLVHPKTSIERPTDELVLSSFKSPLVGGTVNGGSEGDCCWDGGELTGVPSCGLDKKQHQSCPVVESVFKLNEAQLHHCHQMRDSLIESLIVSRLPKCPVGSVLWTVGQLFQSSDQLCPDVWRKVAESLTGTVGGGTKSFVTLLFCMEFILLAKLVVW

SEQ ID NO: 980473 - protein, 30 aa, Homo sapiens
MSVQQAGAVTGRAVTVPPGVEPGVANRATT

SEQ ID NO: 980474 - protein, 163 aa, Homo sapiens
MQKRLTGGKQPGVFAHATSVETGDTQSPRVINHSKSTRVHTQAGEVNTQKTMYHTQGGPNKKRRGPPQTAHTRPGTDRQQQPQATNGITSTPHSSPTPPEQENARRATTHTQQSRDSRRKDGRNTNEHGPNTQPRTLARQHANHATQEQQQSPSSPQHAPPTR

SEQ ID NO: 980475 - protein, 255 aa, Homo sapiens
SRMSGELMCITMNVLLGSVWDLCHLRDFCAKCARVLYSYLNEGSSRTRATTEMLWDLERTTNTQVNSEWQTDHCETWHLLTETEISCLRPSGVLHLWVMTKDNCQRIFKKEDCKYIVGWRPKDPKRTCSVSEWVSNVLLDRHQGSQARLILLWASNSQLNVYAMPISNNDFSETNKQRFINKYRRDFFRPPGHLWRSVSESPHPVCELGATPLCNRNTGYCFAATEKSRGQHTLGAATSPMENGRYDNPRVIEKS

SEQ ID NO: 980476 - protein, 67 aa, Homo sapiens
VLIRTGTMEGVEGDEEGGSIVVPEILKKTRRNAQSWNNQCAHDNRIDWPSRECCRKGQGRDTSYSMT

SEQ ID NO: 980477 - protein, 202 aa, Homo sapiens
LKKKKKLLRTCISRFSLCYKELPEAGRGGHACNSQHLGRLRRADHRVQEFQEPAVANIGETPNRLPKKKNKTQKEKNFFGAASALTEKGFLKNPSCFGAPGAPVGVMSTNRVAKQRGPKRRTPATKEHYRGGGGPPPQNKKKRPRRGTPQDGFGATTPTSRRDPERANRGEPLHTQRSTNGARQDYQINPATGVERTARQTR

SEQ ID NO: 980478 - protein, 79 aa, Homo sapiens
YLTPATVGIGLCCLRPPPREPPVTVTASLACDLQVLGDSTVRCQDILEGWEKMEFHSCCPGLECIIPISVTTTPPPRFK

SEQ ID NO: 980479 - protein, 139 aa, Homo sapiens
MWLLMGKRNPLTTTHAVTTTDWTVLQQHAKTQQLKTRWTNDRRNLDYKTHRTHALGTTGNLTTLTDTHNKTPTDAELILTEPLTDSQPTRLPTVTQPQNWSNRLTDDTKGPDVTYKYTKELTVLRHFGPHLIQDPNCIP

SEQ ID NO: 980480 - protein, 118 aa, Homo sapiens
MCQHPCVFIYTEQIFGGYPFTAISTAAQMLQPECCVGATTAPQGKALVRPQSSSGPQRPPRQLKANPWTKGRVTRDNTGPNTNGREFPQVKRAGATRLWTTPREPGAHRAYTEGQGLI

SEQ ID NO: 980481 - protein, 283 aa, Homo sapiens
MSHQTGIQGKSWDSGGDWASVRCRAPASEDVKRSLPEQTWNVQTSENIYLTNEQTVCWDSYKSAFRFLGYRDYDSLCFTPCWRTNNHAIYTQVRFSECPGYDMAIHVHGLQIILMFVKKCCMQATRATLKKEFGGGHINDERIGPQYRKMYHLPGIYKKYLRSTILPLPPMNCSWREETTDRFKLTEGPDCCGGWPLQHSNTNRSSISPFLEKPSAWGKLDHRQPTNVRVHQLYNCILLGTQTSTWSWHAFRVSRPFVVNFRGHIQPRKIRRDSDNGCHSNGQ

SEQ ID NO: 980482 - protein, 127 aa, Homo sapiens
MSNQSREGLARALTGVHHQGGPGEARFNEPPPEGVTTYQEHDRNHRNRDQTPPTGGDPVTDTPTRQRANSANTDQQDKRRSRTTKAEEQQHDYSNEQTEVTHDNTANNTAAGQPTRQTNNQQKHRKP

SEQ ID NO: 980483 - protein, 288 aa, Homo sapiens
MGNRREIPRTLGRPRGGKIPLGATGVRKPSLGPNLGGDLPYFTRGKNKTFSKKKGGGTARYIPGGPQGLNRTTRCSVGDELRFEPQKRGPRGLESGEQWNHLPDGQYFSRGGTQDVTSPLFSPTNNRSSNKNNNIVGGTQRHPQEGTFIRTHICGGERGAQQSITYTPEQQVRPKRTTVANHAWGDSPHKKKAPPTPAVLTQHQRGDWQPTSSLSTRAHKRANKDPPDGVGRSSQTRNARHLIDSSEAGSRPSRQTSRPTRQHDDQAHDKQRIAQMRRPRREQHPTYR

SEQ ID NO: 980484 - protein, 294 aa, Homo sapiens
SSSLALPQACSGGCHTLTSGKGETGLVPPTAGKPLNKIFLMSSKKKTNAQQTTKQQTTETTHTRKQQQHQQTTCGGDATQTPAKRYNNPTFGGAAPPHGMMKTAATKEGPQKKNPVRKTHVGWINPQKKKAGEGTTTDDVDNTQPNEKLANNKKTIKQTGSSPAHEQKKTNPVVSIWKNKDTKMTKEKNDTETNRNQNRQEKNRTEKGDEQGKQQRGKGGRRRKREETNKPDARGRGETDREERENRRKGEGSTEQTRHNERKANKNEKDKETEKEKKRASKKRERKKRPKRRR

SEQ ID NO: 980485 - protein, 70 aa, Homo sapiens
GSLHRAPQWFLSGLRRCVDLLEESLPAGQDAELPAMLALTKPESIAFDRTNIGSCEDFVILEYSGSVDCV

SEQ ID NO: 980486 - protein, 104 aa, Homo sapiens
MVLAIEFFFFKDYYTLQELIRSIIHQKHSFNQFNLEENRWIYNSLKGLCDCVRSLFRREWSGPNFLTVSYWWLRHRGLYWGAKPKGEHKGEFYLTRIFRLTKGG

SEQ ID NO: 980487 - protein, 95 aa, Homo sapiens
DKVSAVWANRISSCSLQPRTLIPAAPYRAARRFTMVKNRLQYPYRRAQKEEARQDVEALLSRTVRTQIRDRQELRVANPGTKTGSLLEKMYAYLS

SEQ ID NO: 980488 - protein, 93 aa, Homo sapiens
MSLKGYEETHVCGKQCPKPRKTGFVTIRNDIRHAPVGSPGNSDISGSPKRDTTIPEHWQEEEKSGVPQYYSDPRRRGGSLHTTGNRLRGRREI

SEQ ID NO: 980489 - protein, 104 aa, Homo sapiens
MSRSPPHCFGADTLPGRALRAVRDKNTDPAPERDDFSAHLQCNLGAGEVPPAWSPFRHQKPVKGRNSLAFTVFNCSRVLILPDFWIDTVQQMRANCVTITQQVR

SEQ ID NO: 980490 - protein, 62 aa, Homo sapiens
MESEKGAKGVCQRERQGAREKGEGNLRKIKTPGGKQGVMTKFQGAPRAKGVHKREPKETRKV

SEQ ID NO: 980491 - protein, 110 aa, Homo sapiens
EQCGGPEGRSLRSTVLGTGTDPVVLSSSLRRPPIVLSDVGDLRDPVILRPNLLLLGPDSNVLCVGLASVLGKQCMSSQDSVMKLFARRGERQACLDMPVSNFVAVQASSD

SEQ ID NO: 980492 - protein, 305 aa, Homo sapiens
ECSRERRPTPVNPDPEVQTRPGPESPRPCQEQAEKAAAGRGNSLHSGARSSVLRTGARGPVAGPLRPAGLGACPNRPGPMGRPPVHKTGVRPTHGMRGSQETRAHLGMSANRSHPGVSGSKARDLQGALPMNRLGRTLPFGARCRSTVGNTGRNARGMRHFDESIRSSGNQGGTAQPEVVVPGRFQGPPIQEARSVRGYEPRIEPLVTPDIAQWGGAALGVPSMGSPGPKGGEDRRTERGALDNADAQHPKVNGGGDAGVSLDSEPSGQWKRTQGEAHELERSQGDGPEHGGARAPQRETRAGRA

SEQ ID NO: 980493 - protein, 129 aa, Homo sapiens
MRGDLVHIRDPEEVGTGGFKALSGTFGFRNWSSLWESNLFWVLGHLIREMGGLGSLSAQVGSESGVDLPRSLGNLFAPGVQGHFRALNLPRERWGSQGFTAAFQVFTTRVRFTRCAGGYTFDSVFAPGL

SEQ ID NO: 980494 - protein, 259 aa, Homo sapiens
GPRGASVVGGCWGSAPGSESHEAPGRAAGCPRAEGPSLPRDGAKRSSDQLEQGQPQSSSERSPGNLRSGHYSSVQMQTQAPGPRERCIGTAQPTPGPIYRTVYYSQAHKGRPLSEWGLEVLRTELGRSATWPRGNYLGQGPRLRAEFPNGSRNLRRASNQVGRTGWSTSPGGPTKGFERPVHIYHRGVGPGRETPHGRDRRSTVTLESPGEEPRVTAVTSAFERAWYHSWIVNDYFEAGGTQGDRQNWLHKDRERREAT

SEQ ID NO: 980495 - protein, 102 aa, Homo sapiens
MVSLLEYLILGVTSSWSISYTNASGFNLVVVYGSTYMEFDGEIYAIVLGRVLNESTYLQKLRRVEPFGLNDRVEEKLTCNRDGPGMTFDNLLVGVDDRMGRR

SEQ ID NO: 980496 - protein, 142 aa, Homo sapiens
MITEYTGITYKDDRYGAHRPCAYMPRSGWDTCLVRKETRTLFVLRARTPKNTVFPSTGTRIFTKTYTHTQHWFTGGSLPLIPWLWQVPPVTIRFTETGLGAIETDWTMGGHFLIGGAPFVRPRNRVTLVHPCPLRETQGCAF

SEQ ID NO: 980497 - protein, 244 aa, Homo sapiens
MDGDPVTHVSSYHTCEVRQILKIRSFQVVHPPQGGPSFLPEDDENKEKRTDDIPVVGPRIPEMLTKEHFGTQFWLQDYVRHQQGCLGVTCKTVCQYESRGKPPEEIAKTFKYQRVTFTEEEDPRLRQRRNQWCDEKVNLSVPALLPCRIVHILVPCSVICYSTTVTQQQQSLFTELSPAVCWAHSQPRQFLSLGGGLFGWNRRRPKGVGSLLESGFAPCASVVPAVRPLSLGRNGISECRYPRR

SEQ ID NO: 980498 - protein, 87 aa, Homo sapiens
MVNVWTLGPYNACVPLRGLPGALALWCVGVFSPHIKTTRPGGNPRACCGKTPKNGGVQEGALKGASFYTREVSKPEARDFNFTPRLG

SEQ ID NO: 980499 - protein, 150 aa, Homo sapiens
MGLSHPTINKIKSLIHRRKHPHVQYTYPPFSSYPSNPDIITGFPSYEKPNASSYSESVSRGPPAKYKLEVRNPVALSVSPRELRQEIGERRPHGGRETQFPEHSESAGGLPMNRGARFPPQVGAWLQEQAHPPHQRQDRLTDEEHTHGEP

SEQ ID NO: 980500 - protein, 107 aa, Homo sapiens
MTREYSAEQIMRKSDCIAVGLDLFYKGACRFIGYGTYMCGNENSAGSPGFVVVGGAGPSLQLTGARLLERHSRRLGTRVPYAGPQSFRSNVGVQLREFAIAPFSTTP

SEQ ID NO: 980501 - protein, 111 aa, Homo sapiens
AARVLHMLSAGPLGPLFFLYTCLCVFLFSSLSFHLRRNAHSCGGAGHSIWCPTWMLFSRVKGLSSVVIEDKSREIPEYVYSEPVWVKVLYSVVIEDKLTRESQVRPRSALR

SEQ ID NO: 980502 - protein, 114 aa, Homo sapiens
PVGIQDHTIGLHSVCEIVTLSLKILIDSSTGGILSSCAPTNIGSWLKEMTLTVSSVFQECVQETTMRELYSCVKAFSEMIIIHFVVPFIVEVQEKAIFHQVDLVDPFLRYALEA

SEQ ID NO: 980503 - protein, 332 aa, Homo sapiens
VPSRGLGTPELDSLEVQIKMIVKGWAWWLTPVIPAFREAKAGRSPEVRSLRPACLTWCNPISTKNTEISQAWWQVPVVPATREAEAVESLEPRRRRLQMNRDRTAALQPGVAEQESISTKKKDSKGLKPYENNLIQASRERTIKYKGKLVTEMASGPKIPDTEERRKTRRIIYDGTGQPETTHDSPMADTPDSTNKYYKISGQMRHNATKSAKTHEDMSRKNSAATREGITLSVTPTNTAMGVTNCGETSQTSGYKKKKKLQTYSRKAHERETPKKHEHGPDYRERRQGEQKHPAKEYNAQRHTDIVRAAKNTSNQAKANNTHHTTGPAAHQ

SEQ ID NO: 980504 - protein, 175 aa, Homo sapiens
MEPSTPESPRRCVVSPFDSPFVVGSVSGPIQANARVKVMTCTTEQNSWGVCEEREKYNTYNHTQSLWVGAVARVSRGVKVFLTTPTLLWRAREGAHIQCDPGEQKVCRKSCDTHNKKHARRGKKRAKGAVGGSCPQEQTRLPPMVSMERLLRNQHPQKGIKETQLGVISRKGDRT

SEQ ID NO: 980505 - protein, 35 aa, Homo sapiens
MVWVVGYFKVNLNSLLQGLNWGTRTGRKTFGVWEH

SEQ ID NO: 980506 - protein, 131 aa, Homo sapiens
MPVAPSRCSGSINCAGTRCVERKKRTPVHSRFPALIEYGYESHRSVEGSVMTDIAQVGVVQDSVTLELISRELKVNTRRKVRGPPKINEAVPDIVLDVLTEHNLLRQGEGWPLDASRQPAEQLDSGSSPVI

SEQ ID NO: 980507 - protein, 246 aa, Homo sapiens
TRGWIPERLYCEDPQPPAETQACRVESVLYWALFSHLIRVPHPQDVNLSPSRPYTGPNWAEERLIEDGRTCMDPAVIHCSGLCYDHTPTICQVPPQCTGPSPKRPGDTSQATGARRPTDYALTLHTQATAARKAAGKRHAHAPNGTRCTSHAADPTKEPTTNPQVRPGHMPHEARTPTRQRPNTHHAHTNKTPYSNCDERETTTAPKTPAGNDNTATPETHRQRTTARTHPHEPTTTTPQNTGTNI

SEQ ID NO: 980508 - protein, 236 aa, Homo sapiens
MHCSSAVAQTQLIRVMHDLSCLMFRVSRAKAKRRQTELRPGRGSSLLQKAPMPYQPSYVLTYFEMKTRETVGVMHDLIIARNDEFRANLVSVLTPGRGCLQWRSLIQGSSGSDDFNVWIGLQGTPKKNRSMAIVRHVWSLVRPSEVLGKMEPPGQSYALAYLGEAVNLKSQQECQKVDEMVPMRKEQREHSLDTVEAQQRHNRQTVPIAWTSQLDQDTTQGEPEERRDRLSNRPMR

SEQ ID NO: 980509 - protein, 456 aa, Homo sapiens
VAAGPVQSQRIREADGQKDNGLRLGKADVAVTLRIDDQVRYEPESTLADNVRSREETNRARRPTSETNKKSLASGERDMREVADPSKTMKNTQSCTSNRDSWVYTIMSGNVDQFSGQHFLYTEAKGRRASEITGTGHIVWRPLGKRVKARGTGILGMEEAPVVHNPDAGPRQWTEQHHQSTNIKGHQQNARAPRGQSCETNMTHDKFTQEITSERKRLEARLTNLAIDTPGIGETGLQGRGPKIRRHTGQTSQLMGMEKHGDKLPTRHQENNQPKDKGRETNKPEYDDAAGVHAERRAHKKQTQEGQKQTPTTEKEETHTQEVDQNRENKTNKQDNCARDKHSQKNKKQRRAKQTRAQTTHTRDRSWAPLENKNYERQRPEPAENSPTTRSRATAQQKTNRNKRRTTTRSKRIQRRHRTHYNTTLSRCTEDKNHNNNPNCKMTKTKKKDEKTHYNK

SEQ ID NO: 980510 - protein, 320 aa, Homo sapiens
QILLCVLLVLFRYTSACSCSYLYLDIVILFFIFYWGSSERLHTGHPRREGKGKIREITRIPRVKPASPATRSKRGFRAIVVHQRRGKYEGIIRVAERGNHKVGGHPKPANIEGDPNTPRALPKGRGNSHSGGGDTPGPETTKPIYTTAQTLYTLSSLTHWANPGGNNGRDLTTKTPTQETCEQIKPQDEGRSKRIEPYQRYVKTQKIHSTETKGHTRGITQTVHLPIRAQMVKTNYSPRAKNTASSIAPSRRKRGKKLHANNAYNNPQQVREPPPSGSRYKITHPKRTQDIQERARRPGITTEGNIAGNARTTDGQLTQK

SEQ ID NO: 980511 - protein, 383 aa, Homo sapiens
MRIRSFETSLATTGRNPCRLQKQKQQKTQTKQQRGRRDPGHPEKEDTNDNIGRGRREEPHSTQQERKRGQNARYTTRRNPGGQEATARGEVTSTTRKHTDRPTERPKTAEAGDRQQMRQHKPARRTQRENKQRRANIQTQRSGAESRSASAPQRTSLTRTHTTRDREGEAKYNGDKKTTATGRERRGHEPAGTARQHSRVHQEHGSSTHGRRRGAQQEHTQTETAEATAQSGTTAHTKRRGDHMTSGEAALQPERRGNNKRWGQGKSTKREGKEEDRTGENSKHTQTGHAGRGTPEDRESEDEREQASSGRPRRTPTDERKREEPSTAENGRDEGSESKHNTPGEREGEGEHEDRRQEEPKREDSGTARPPTRDEEGHRGQQK

SEQ ID NO: 980512 - protein, 490 aa, Homo sapiens
MTVALMNRLLFCDVVVTLITTTYPSEGDSDGDPMTTSEASSKEKTQSNMRSEYMKERHPVREARYNGLAQYSDASSGGSTSRTSTTQQHSHGSSTIKQMGADDIKRSIICRTTNSRRTQHRNIGNEEDNRMRMKKERQGDNPWRLPTRRTRRQHTHNNSHYNQSSGEQQRQRLRQPYQPNTFPKNRANPTTQGPDEDSSDHQIQITEDGQPDSRTTRQEEHHRWNKRKRVAVRNQASNEDITGTNHRMKRKKQHEETKNNKTAEADMETKTEGTQRTKYTRGGQQNSRDPRKNTATSKRKTGRAQPHQQPDETNTTRTRIEGTRLTIQENAKRTNKPYNHRRRVDSTSIDTKQPASEHTHEAKTRQLRGRTRQRRHHKELAPYDYTPTQHTKQTGRRQEKPLRAQGASTTHSEETHDTNSPPRQHAATRKTHSTDTSKTRQTTAIRTRTAPPHHKPDPHNDTRTERTAAHERERTRRPKPNNRDDASQQV

SEQ ID NO: 980513 - protein, 84 aa, Homo sapiens
DTEVAPNRKQDEEKYTCPATPETKPGPCNHHEQQRSISKQQPSYPVQPPGNPVYPQTLHLPQAPTYTDAPAAYSEVLPVLPDLN

SEQ ID NO: 980514 - protein, 105 aa, Homo sapiens
MGHMAVIEYRKRGRQLLTQEQEVRTQKRDIASTGNKLKRSRQNNTTRKNRREKVKPSRTKGTSHKAAGQDNHHSEGHTTQKNHAGREQGAPDSSKQCKQRRDETT

SEQ ID NO: 980515 - protein, 261 aa, Homo sapiens
GLQDGRLGKEASGPGSSGGSARERVSLSATDCYMCYEIYNGENAQDRVGVQSWSEALEAQYKYIVMEPTRMVRRDEPAWITVGERALKARMACLVGTAVALFTPLAAALRLLPTTFPCPAGVLSRGLLHASDGISWQFLTLAASSQVEYDAINCRAVLVTTLTSSTLVVLVRKDDLRPERDCAITIALAVWGATGVKEDLRHSMPYDSATTRTRSNTPGQQETAESPDRHTREGSRAGRFGYMPEKNSPVARVQSYQMVPP

SEQ ID NO: 980516 - protein, 306 aa, Homo sapiens
SGGAELQEERLGALYWILAALRPRSSGLPRNTVVLSAADRRPGYGGANGPIPADPGALGRNVLIPVKDRIRLCAEYLKEIVTSNVPLSQNELELLERVYTLDELQHVGSFITLGLHWSPSQWQGLTRRCTSTPEVLPSNTRLSYHTKQVKNQETPGDTPIVGGTRGPYTGEHAGSSQATEAKQLVGNAQVKPEASTNTQGGRRRDHPILKASSAPIPGMPTPGGTKKRQADTTSQLQQAEAAGNNGAQAPRTHHTGDPQHDRPHTRDEQGDKAQSPRLRPLTKNDTGRDQISTRRQAKRAQRGQRS

SEQ ID NO: 980517 - protein, 115 aa, Homo sapiens
ETFFAESRLGFPASTVLGRNPCARSPPRPAAHSHALRHLFTATLGLPQGPRSPLQSLSQPPPPPPPLLIACHDDRVHLAGAARTYHQELRGPSSNRQITPEASTAIIRYTLVQCS

SEQ ID NO: 980518 - protein, 240 aa, Homo sapiens
GSGGGTSGSGSSSGQGNHGSKSELVVMVLEVATKDDKVQENRNMNLLYQLSGEKEEENKGTRCCQQTATGDTSHSVPVTITDTLAANEQTIFSLEAQQFISNIRNKLKPLRTRQSHEEESINKWHDSEGDPDVRGTLEEIIDDNHANRVYICGLRTLRQHSYHTLDKDLLDLDCSDLLNHQVHAVIRVLMDDTDPLGHRCMTGRKVPQGEPMQHMAGTGTTQIKNINEIGRIPLTHTVIY

SEQ ID NO: 980519 - protein, 221 aa, Homo sapiens
MADNLSGMGYLKTRELAEEIRRMIHQYLPENLLQNWIPRLEGDNQGRDVEPRYLLANHIIGVGSPTRDWEYSTNLGATTRGWRTSIIKGTTPPLTMVPLLAMASVAEFTPRVLGKFFFLLPMWVSKVTKLIRKRSRVYQGHYRPICDTLPKAKKGTQGLRVATTNAPNGTWKLMWVPERTQTHQVLEAKSWRNQRRRHQMTGVASAAKRVRTTGLTQGQRR

SEQ ID NO: 980520 - protein, 30 aa, Homo sapiens
MSAMQVTLQGTEVVVMQARNYEAGPGIVSF

SEQ ID NO: 980521 - protein, 203 aa, Homo sapiens
MGGLALLAQGWEVHGLGSRPPGGPPDSPRVQGDSPWRSGSPGYSWGSHGHLAHHAPGLIFGVISTARRMGRVSTTMCGATEKRAPVRSPCGTLRRNLGPCPPLKGDMGPLRAGVMEGLNRGVSPRATRISHSNRNEENPTQQTWGATSCATAGEHTRASEVTRPPQTLNRGTKAPMRRAGRGTTNTPKGAPEEACKERTKRPR

SEQ ID NO: 980522 - protein, 103 aa, Homo sapiens
MGITWGFGGSTPVIPAPWGKPLRGVWIPTWRLREVQGPTLGNLVGGTLSSTKKRNRREHTWGARPRPEEDLNTLWGAGRQCKQGTWAQGTGARAGGSPKKPGA

SEQ ID NO: 980523 - protein, 36 aa, Homo sapiens
MSTLKAPRRWGEQRGGHEGPPKGKEKKGQSCPRKHP

SEQ ID NO: 980524 - protein, 107 aa, Homo sapiens
VLRRLCGPDRPGLLWRPREQFGAMEEPGLPLNRIWGCSWRSYAGLWQQLPEGMRPDSNLYGFPWELVICAAVVDFCCLFFLWRSIDRLGVGLCGTERKTLASKCFLD

SEQ ID NO: 980525 - protein, 335 aa, Homo sapiens
MIGITLPYMVEYPIIDNIYGIYREHVPELQIDPLQSTVNGASWRCAKYCAQNTRSTPQYNDSDKTDKHTFARDSASLTIQEQNYTAKYTKTQNVLTIHKAKLDKTRPHTALPYQYNPKNNTKPKAKKAPVDPTETYNTNPDPRTSKKETKPQNLNTSTTCYGTGNQTPRAQQTRTDIAIRTTQPQIQRRKPTAEQTRPRPHYETNLHGRQIHQETSLRHHTTTISKNHRTSNRTRTDRKSTQNADEPLSPETRRNTVDKERGKKRNRTKENTKAKQPKMQPTRSAAAKNKQATKPREAKQRTKQRKPATARNNVRRDEQKRDHQRRENDQTKQEN

SEQ ID NO: 980526 - protein, 98 aa, Homo sapiens
MFYNTLSGGGAGAHQLGIRVNLWGPTAVSPKENPWRTSTTGLGVPHPIKKKRAGGATEAGFVEPTPRGEGRRRPQKGETYHKGGPSRDPQNKLTPRRG

SEQ ID NO: 980527 - protein, 223 aa, Homo sapiens
MDVISCMLTPREYRRVLTCASQTVKTAVIEINPYLLGSMCWGLHGIAGFLVNGCWFGKCQNYELRNKERISVAGASKLTCQPCCISTKGMGLSMGTMICGWIREALALLRGTRESEPHFMATFSVGFWLCVCHLGSCIGAIPNELEVGAAYESGRRASYQSTTEMPKQRCITFTVRKMLNRALRKLCLMKYGPPERGRVCLGETEDKTTTFGGRNIRIHAKED

SEQ ID NO: 980528 - protein, 89 aa, Homo sapiens
MDKWDIGGHTACSQEERIPGATGAITGLGGFSLPHIKQPAAGGENRAAARGHKLSTEGGESQEGNNGSPPIPKEASRKTLNINYPRRVG

SEQ ID NO: 980529 - protein, 144 aa, Homo sapiens
MGANILTHHRWPGIMFLHSKHRTPRSHYHRTVGVTNRNQRHQEETPSTSEHQLTKGSDHGDKQTRAKRTDPHKWTRKGTDQVNLSTYKERHIRQPRPLSNNPPYPTNTTMNQIPPCETSQNEGPSENNTTRGGQNKGRSTGHSN

SEQ ID NO: 980530 - protein, 160 aa, Homo sapiens
KEDAKPKEKTEVANTGAPRFIKQVLRDLQRDLDSHTIIMRDFNTPLSILDRSMRQKVNKDIQDLNSALQQADLIDIYRTLHPKSTEYTFFSAPHRTYSKIDHIVGSKALLSKCKRTEITTNCLSDHSAIKLELRIQKLTQNCTTTWKLNNLLLNDCWVNN

SEQ ID NO: 980531 - protein, 75 aa, Homo sapiens
SREWVSFSSAFPVLVILGPDYYQVCRCLCSQRVVHESMKWSDHACPEIRSSRPSEMEGEIIDHVESCYSDKLLPA

SEQ ID NO: 980532 - protein, 161 aa, Homo sapiens
MAVELDPCLACVSHILSACQLRVIVALQSWRRHMIIDTESYAPKQVTASPEFERVLRAQQELCGVLSYIHNYTCGLAWVAVSTKVYATCLGLVYSIWPSPILLEDIQKLLKKRITVFRLRSGGFGLGGPSLGGPADIATQLSWMSILNLILPRHLKRIILK

SEQ ID NO: 980533 - protein, 330 aa, Homo sapiens
MTCAYAPSGKYVACSGLDNIVSVHVQSEKYFVRGTCCVIRELNMDTARVTLFACCPSSMDDNEKNRQRYRLETPTVVPLCGYNLKNRPTKMHHVIPGATLGDVLSRFSGFSDARTWASLGACDAFQHKTTGDVGIQAIVPSEGIFMWLNRSLDIQIADKLAFPNGKAFCTHGPQEGTATLEGQKERVRCLTPESLHGTDSPVTKFILAGITLLIIFSSMKRCAHRRLVGPPTGIHAEVMAIDVEADLGRVAGGGMTDRVSWLVLTGARTVGAGTDRDKCIRTELAQQGGPERENIAVGYSEERSKDRGHNPRDKGGARNGRATRNGDKGA

SEQ ID NO: 980534 - protein, 314 aa, Homo sapiens
HGGTCLQSQPIRRLRQENRLNPGGGGCSEPRSHHCNSSLGKKLRHHLKKQENRVPQTGKPVRCTLYSSLGKPLTHGEVTKDSLAVTVDLVAKLALLPTDRIEKYETTSIQAGGQLAGTHLQALKAVEVPSSEAHDGSTTNSLPWGCKPKTKTTRYFLTCKRRRSNIYWQAKVCPEHGPPERRGTMWTKQESTNVMQDHQVKQMRCMRQGTPRDLQERHDGDVARVCNEDWQKDLEEEESDMVIYSTGGDGRADKGMRWRPMTERTGTRGKKDARKKKKTAGDKITRGEGQKREKKEKRDKRAPKRSRRNKEKGL

SEQ ID NO: 980535 - protein, 94 aa, Homo sapiens
YAKLMRCQQPDSVNGMARVGTDDVWKAESFGGYSAKKQYVGYNTVPWLHLVSRMFALPLNLDLDMQHVVWLRLLVFPVWYFILPRLENGRVRQS

SEQ ID NO: 980536 - protein, 164 aa, Homo sapiens
MARFPNGSQTKANYILNIVRPLRKNSKTGAELIAARPISRIAAHRASPVRLRKFLFGIIKTRAQMNPPRTYHSRIECGHHKWYVKPTECHRSIRGGLTSITLRCSWSFTTQYSHRSAGDLSSCLDVDKRVVLADGCPHAYVITSQDVCSHELSQLGVNPDASRR

SEQ ID NO: 980537 - protein, 68 aa, Homo sapiens
DNRPFLKVLPVCWQNVRYFRMVRSNDVAYVGRTVKSQTCCAACFGGLAGSVQTLSKKCMEYNLKASHN

SEQ ID NO: 980538 - protein, 175 aa, Homo sapiens
RCQRGRRDKKKQNKEHMQTTERQMRSESRDKDTQYDKHTKEDKRIVKEKREENTQDNSETQRTKMKRKESAQKTKTQKQEPETPLKQKKQQKTKTNQKKDTKETHTMDTTHKIHGNRTTRNKRRITQNKKKEEQKKTKNDTKKEKETQKNTQQTQTNMTTLNKKNTSPLAKKQDK

SEQ ID NO: 980539 - protein, 227 aa, Homo sapiens
MQVAQGPTDSMKECHESEIAIKPKHLIFSDKWKIDGRRRGELHAAVIPAIREDVRRAYQPECQGCSGADPDQSLVVETLYLLKKYKISGVWWCVPVVPAARGGWGRRIAWAREAEVSVSQDHTIALQPGRQRKTPSQEGKKKIKNKLGGGPGGPSKKGFHNPNGVWGPGAHIKNETHRGTKRVPGRTRGKTRRVESHQKKHARGTGVSRHTEGIWSNNGLQRARGRL

SEQ ID NO: 980540 - protein, 66 aa, Homo sapiens
LIALFIILDVFYTVVVGPRSYCTCADIVAGTHFMLGGTCVSLGGLRTTVVSQGIEQSLLSCVIVYV

SEQ ID NO: 980541 - protein, 170 aa, Homo sapiens
MYGNAWMSRQRSAAGAKPSWRSSARAVQKGNVGSYPPHRIPTGTPPNGAVRKGPPCPDPRMVDPPTACKVHLEKLQTLYASPGRQPGGGGLPCNATEVELPKAVGAHLSHQCDMDVKHGVKGDHFRTLRFNELPYGFGLAWGLWSLCLASVSYLERVYLPNACAPVYLGM

SEQ ID NO: 980542 - protein, 225 aa, Homo sapiens
MHTTPPRKPRTDRGANEQAAVGKYPMKNKRRPRDKRICIEENKPNEGYDEKTLVEEYIQQRQGTTRKRLHKKKKPHNAAVNRPQPQKRINDKQPATQTAKQQRQVRRQPQKPEDLDKRDDTQSAGAEAPARGKERRGRTEKQTERGEKTRQPQRKGREKQANEKTTRRRNQTKPKQSNLKTHEKHEEDKEGEDRRQTEKGEKAGQDYGEEKGREKREKSDGRRQT

SEQ ID NO: 980543 - protein, 310 aa, Homo sapiens
MGHAAQVGLRRRYFPYHRRAYQPFMITPLMNHFSFICFLVLYALFLTLTTKLTNTKHLRRSGNRKPSELILPAIILVLIALPSLRFLVHQQTRSTMPPLPVKISWPPSGTETYEYSRRTADFNATKLLAYITAHICRRTRRPWTSLTLTIEYYSRWKPPHSYYRLTSQDVLALMSVSPQRLKKRCDVPDRLITKHIYSGRDGGILRVQGSGNQWSRTTGDNAQCVPSNEAHLRISAGRARIDPKKRIYHSKRQERKIRLKNEAENERGIVGDRRKRDKKEERQRRAEQRHRPRIGDTNTGRAKQSQDAND

SEQ ID NO: 980544 - protein, 84 aa, Homo sapiens
TRGRPLRRPALRSLVVRLALLHSCSANHCLDKEPRYGLEYQRDILIKCETDTKTRDSDEKEIRLPFREENELRQGDRNAGGMRN

SEQ ID NO: 980545 - protein, 180 aa, Homo sapiens
MRLPKKNIKWPYNNLILYPTCGLKKVFSQGKPFNTLVLTNIWTGGLFKFGGEQDITGAYGRREGTYHCGGHEHVGGVTHVVRTPPRHLGTGVVTRATKHTLRGRRIPGHPRWGQQWGNTRPPHKRSARNYARVSGAVPVKPTLPGEARTKEIAARGRQGWHAQNGPVTGGITDTRPEKSK

SEQ ID NO: 980546 - protein, 275 aa, Homo sapiens
DLVQQLLAAREAPSGDPALTANSPPCPRLVLEEAPIMKEAPPCDGGGPEGGPRKPDQEPGNQSHKDLPGHARRVSKLAGAPSVVQFRIRAEVPRLSLMKSEAGPHQECLRLDEKVLPPLPFAARMVGNHGAFTQELCFDAQKLASPLLSLGLHNLAPHKSRRLQPRSPAPSTFGSTCERWVPCGDPRLSPLGITMKTNLTKGADWISAPEKQFLTITRGGAPNTEEYLRHGGVTLKKPGPNWVRVTQKKNPRGTGSWKKREGLGAEGPNRQGTCN

SEQ ID NO: 980547 - protein, 118 aa, Homo sapiens
MPIAGAEGKKREHKEKTKRRESKDKIDHEEKETTTQTTKKSQDTTPRHDETRRNTTEEQQRNRQDEKQPETKRRKEQRDSAHDRETGKTEDRKEQTNANTTRNEQEKKEKKRNKKDKE

SEQ ID NO: 980548 - protein, 75 aa, Homo sapiens
MGLGPPKKPRRAPGSDTRGVWASGLQGRPNPARAGESRAETPQQNTLVTTNHTQHKNNKHKHRKTDRPESHSSRQ

SEQ ID NO: 980549 - protein, 142 aa, Homo sapiens
MPFPTVLQSGCQSETLILAQTQQKTKKTQNQRGGRTTGTPKKDAKNPPREGAAGGPTMGTTDHKGENKRGETQSMKTKGERKTEHKNTNNKKNTGSRSATQEGTRKRQRQGGDKRKRTDTRAKTKKGNQTESDREQQIKHTR

SEQ ID NO: 980550 - protein, 103 aa, Homo sapiens
PKKSLALCPPGGGAGGDLEFSGNLLASSRVQGDSPVPSALPGYAGIHGVLTISAQLNLGFSIEREFAVWTQGGPSDSVTSGDSTRLGLPGGAGITGLSLHAGP

SEQ ID NO: 980551 - protein, 106 aa, Homo sapiens
MAESHNAAGRVPCPANELLHLIVGAARTKYWKHKPVPILRFTQYNTGGYSAYVAWSTTTRWKTVRAGPTVVLRHNKSRRLTGRQHGILTQGGSQEKAKFKNSPPRG

SEQ ID NO: 980552 - protein, 61 aa, Homo sapiens
MTQGEWRHLQSSYTHLLERMTKMADSLGSGRMKQLEHDRQFARGDWKTRSTGRREKNREDR

SEQ ID NO: 980553 - protein, 133 aa, Homo sapiens
KNISTKAVGQVQAEQHITYENKYPEGSSEERQVMDHAYPPSQCLRGSTGETCKRELASPCGSIADDVLLGDWLDGTVHFLMRKDRLTYRKCHIILGSFDTYSCSTGAEGWGILCDLQKRSSQIHTVKVSGSDS

SEQ ID NO: 980554 - protein, 108 aa, Homo sapiens
RSFPAAAGCQRGALQGPSAYTIPTMSQAGAQEAPIRKKRPPVKEEDLTGGPRKPEQWSRKSSPRPTRSCESVSKLARSPVGVQPHRSGTETVCEKCKAWTLPRECLSA

SEQ ID NO: 980555 - protein, 167 aa, Homo sapiens
MRTNPKEESPRRAKNGGAHTTKGGPQSERAQSQINAPGRGGTRAEETLDKQQQQQQQQKEVTQNKKHTTKEETHIKTQQTTKKEPNGSAENNMKREKRRERSKTQARRRQKKKKKKNKNKKKSKRNKRQRQDQGKKIKEREQKTKDRTQKQEKKRKKRKMKKDERKR

SEQ ID NO: 980556 - protein, 208 aa, Homo sapiens
MCFTTVPFDDPFPQLDPHVTGLLNGPLRILAELTADWAIGAALMKIGRVYEDRDSRIKIPSDRESYNSLNHGFNSEKHQIDVNRDIYYGFANEQYSQRKATVIPLKNGCRALLVIFVSVTLDDHPGDNTEPLLGICMVTVYLRKTMGISRLALELRTGRLSHTVCGSGRSDHSLELCLIVSLINKDTMDLCRTGILELEVWRPRHSWI

SEQ ID NO: 980557 - protein, 137 aa, Homo sapiens
MIDTNKKQNTQGRDITRENKETRTRDYKTREYGKHNSNYQNEQNKAETDKKNRNEAKPYEKKEDKKEEKDEQDERKERQRREKKARDRDRSRRSEKGEREKNREAAAGRDGRRRRKEKKTTHRDQARMTRQEIERAK

SEQ ID NO: 980558 - protein, 115 aa, Homo sapiens
MGLTTANTGYYTHFLGTQPNFCGSARQLQATLQLLARLHTPPGTYQTFYSTSQLHLATQHLVAPWFKPLGENRLRRARPLHTRELGFSPFISKPSPKLLKRKTLGAKNRASRFNP

SEQ ID NO: 980559 - protein, 251 aa, Homo sapiens
GVFADGHMELQVESGVPFSDSAPWRKTWRPRDQELQVPPLCDSRLAPKQNPRLELAAGRTTWTFTATVRKVNDRYKEAISLCANGTSVLLPVPLAHILGHRAGMSIGLYGTFPVEDLNGLHLPFLCSSMLLPGMVKGDLVPIDPQSEDLESSLTVASKKTHDGRRVMWLKDDGALTTRMIHLILTSPDEPARRFSSREHGPISCTKLPSVVTPLRVGSAPKNNPGGKRTLLKTADRRVGDPNAKGAQRRKC

SEQ ID NO: 980560 - protein, 112 aa, Homo sapiens
AVYLAYNPRHFGSAVVGRIILKSRYFETRPGLHVMYPRHYCQYYITWYQSVRLGYIVLFTFHVTLGSADVSVTKLPRRSGMIREPDTVDVTYDHLPAVARALPSCSCGHIPD

SEQ ID NO: 980561 - protein, 138 aa, Homo sapiens
ALSLMSNAMYIMEGPRGRIILIVGMMQQDLGYTGCNALFTYLNSSRNTSGMMLVSELHGKSYRRDIWRRLEYKRRNLRCNSPGKGERGCSEAHESADHLPVRTSWLNVQLICCRPKRKPRTEAIFRETEDIAKYISAG

SEQ ID NO: 980562 - protein, 70 aa, Homo sapiens
WELFGKDGSLTMLAQAGLELRSSSNLAGLGLPKCGDTGVSHWHLAWCKSLSGICVCNPLVYWARSESPGS

SEQ ID NO: 980563 - protein, 142 aa, Homo sapiens
MGHQGFNVPSNVFAGHLPMNEVNLVERVVLEDEFSSLCAPRRMLRTYVCRLYHGDIRAPGNQISGNHLRLIGVVSVHRVVDDFIAHKVVTSVKDTWTTEWDLYLWSDRRGRESRVYETHKARITLVIGHQREGYQWVHQFFH

SEQ ID NO: 980564 - protein, 42 aa, Homo sapiens
MCGRDPGVSTTRGPPKKTRPGPDAEGGPKPGRSTGGRSDDTH

SEQ ID NO: 980565 - protein, 194 aa, Homo sapiens
MIVAIGTSSLVDKDTRLRLKKKQKIILRNPFNSLHEFYQDWRASSPIGILPPNFSVHKGWKGILLAQLLCWETSHKVITLDNHSFPPVAFVGGQSFNLAWHFAHIISPGPQQCVNPWNPTLGRPGRQNDKLSSKTPAGAPEAQPPCRGILGLGERYPVDGVSDPDLCMPRTRGCIGYPAAGYNSTTTLWRYIIQ

SEQ ID NO: 980566 - protein, 181 aa, Homo sapiens
RLRLTETGIPCLREYVCAVTAYSVWYAIINKLEAAQCHDSVYNEMDSVMKVIIGNGHRIVDPSVYLGTQTILVRTWKLDVWCQPIPAAFYLYRLFSIVKRTMPILPVGLLSGRPSSFRDSYTGVLYPKAITRNLGLQGLPIHSGYILRISWKLLYLEELGVPAHVSTYIARSLGHSGSCTD

SEQ ID NO: 980567 - protein, 126 aa, Homo sapiens
TEISRACWYAPVIPANRLNLGGGGCSEPRWRYCAPGPCKQKRGHCKKKTNKQKKKQPNGGETCGNKILSHFLEKTKNKQKKKTFVRARRAHKKVSFTTPHLVGRGPHNSVRENSGPNSGSQEISGP

SEQ ID NO: 980568 - protein, 131 aa, Homo sapiens
MPKVKSGAIGLPARARRSSCRELKERCEDSCSTRGLGQHILKNPLIINSIIDKAVLRTNDVVAWTVVDLELGNMTCKPGTDKAPKVVCLLKLDPKAKVAELHKRVQGHALWPANFKYWWVDVLKNRFGHCF

SEQ ID NO: 980569 - protein, 151 aa, Homo sapiens
GFDPGLKTGTVKVTASVGATSPKFHNGGRGLGWHIGGSFLIVIPKYEMRCTGSSLAILKATPFLSKEKGPVLSQVHTGEVIAWLRVNYVLQNFLISPIILLMGLIWNDEPWGPLSPFLVPQFEMYEGLWVSRWEWVEAARVNLYTDLRPVD

SEQ ID NO: 980570 - protein, 285 aa, Homo sapiens
GVVSEKCRCDTEILPSLFMRWTTELNTKDKLPGITHLKFLCLVVPVCEQRALCGGVQCSIHGEYSVGRCLCVPADDGRGTITARWIANRSSHAASPPWLVDETVATILKWRILSVNNDLDRVSGVAAGHDLPIVRSSRHSLLQVAKRLLGILALCLEAVSLGLPLNVRVVLRPLHRLSLQTMAVFYTLCWPRGLVDEPAMNAAPVHRVAPSVHLEAMQLSWTSLALVGIDSTGKLSVLRSHLPWATRWNVGVALRRCSSAEYCMLPVRLGDICWREPVGPELVEA

SEQ ID NO: 980571 - protein, 544 aa, Homo sapiens
HVVDELKIEINRAKRSGTVPMDRLDRLTGECGMHSKACSLTRSTVWANQLDQDTLVIVKMQFMAGLLQGWLQTLSHDLLAGVWLLDLFTSALPLSGQSKRVVASITRESAIVMSANKVLPCVKVVSWRGRLPYPVMPVAEGNGVQVAREAEEEDKPNKVAIPSQLLHKDGHRGSRSYRTARKKGRAVTADSQSTRTSRMPAIGNNTRRVDPARQHTSSNLRAAQRNRTNDHRRELKTGMDAPGPGDDDSNAKGLGHTHENKGTEIEPAALRSTTKKPPATRDLPKLLGAYRKWTGTEREKAGPTPNNRQSNAYRTAMNHDREDRETNRHPNQHARRTKQHRTIAHHTTHTRTPRPPTSQHRDDTNITPETSAVTCDTPQIAEQEAVAPPDKGTTSETSKPQEDHGRPEPPNTRRAQSMARNSGNDQQNRDDHPNVMRTRAPPNPTNYGDKQERESRTNTTETTAHNRRQTHEQEERRDSRNGQEYNDKKNPRAKTPTTQDTPHTKRKQNEKNNDTTRNRRTQAEQERLNSKRHEDNREARYTRN

SEQ ID NO: 980572 - protein, 275 aa, Homo sapiens
AFPAVTTYAHENMPPRKGSPSSLSRRGEEEYNKKKRLVQSPNSYCMDVKCPGCLYKSPRSLAMHKRVVVVGGGAAPRVLCQPTRRKEREVYSNGCSFREEASTGKHSESRLKRKPFSNKQHLGMDSHKRTHGGNKSLVAAGDSFVKEINATHFWLGRERHPEARDEENRINGTFRKRDNRECKEHPRVGLTARYKKKRTGEPRMACGSNITNQGTRGRSKKGENYNRESKEPVAENGRAAGENLKQGRTQNQLDRARSYRGKAQSDTRQRWHHNV

SEQ ID NO: 980573 - protein, 190 aa, Homo sapiens
MQFTSELVDRSPRTLREQENNTCDQIPARRETIFAQAERIKKKQLQVALNRSQLRTKMKTKYKEEMTRHLTLLVKREADPHLRRRLPLKRTSTGTFTGEAGTHRTAGSRRNQKQGDVGTLLVQWPRHKRQRMGPPPGITSCLAREQPIVGEVHRGEQLCWCRLRETQNLSLKDTARVTRGERFPLHCTHI

SEQ ID NO: 980574 - protein, 69 aa, Homo sapiens
PIGPPWLAAGPTPGVRPRTVDAAATVIKLCLHASETGVVNNLSSVKGWTQQDQNLRGHLSGGAILLLTF

SEQ ID NO: 980575 - protein, 442 aa, Homo sapiens
ESCWSLQRGLCVGGGNPRTSGSGSSAPAVRCSCGGMPIDHGSRWCGAARCCRPHMTSSFLSAFPSKCADDCRCSCGGARVGPWLALGLGNLLCVLPACRFLAVGHPGGLGVCGLLDCGPEARGRGDSAAATADGLHGVGLPDHQVWDRIGSTDTERLNVPVSDDSTTTILPGPLPELMTTHLTILILGGHLSNGVTALRTTYCQVVQNPDPGGLGQADTKGIKGIMIGNQGHYDLATIRDIEVIQGGYQGTSGPPTIPGGDHPFLGTMTSPIRAPRSARKVQEEANKASGKGPNTGPLGNGRQGRCLGSDDMNGTIRGPKAHGIDPELGKERDKKEGTGHWLTDRRGVQAPPGTHRQGHHGRQMRTPRTDPGPGGDGHQVHHKATATVRTQTCGRRARDDANNTTGDKNTGRWWRVPWTGPNEGRKASPAAGARRETEVEET

SEQ ID NO: 980576 - protein, 75 aa, Homo sapiens
MSAAVFPKRGDPGGPSDLWWSGVSYPILKTAPRGGTPEACFGTNFPESGGSGVVHHGVLSIPGVPRRTSVFNYRP

SEQ ID NO: 980577 - protein, 208 aa, Homo sapiens
MPGGPELGCRKNLCEPAETLREHLVSTKSVKLIGEYGLRTQHVRSGGSTFTLAKIAQWPPGNLVTSDEKEPTDVCLEGQTPCCGGLVRYLGVAWMRAKDEELELASLGAVKSRGFFLGGDRLARNPEGPSGKSWALGAQCAYHNPRPRQLVRVPAQAGRLFQGGPGKDRVEWNTITVVPFNLVTVLGLSPGKTTVRISSFGDFSPYGG

SEQ ID NO: 980578 - protein, 333 aa, Homo sapiens
ERSRAQTPRHFSEQTSRAESARHDLSCLLSPFSDSCWGPTHGDPIPDDMDTRICLTSIDTGHSEHAPVLAWSELVSTWYTAEHDKHVPRAYRCSTTMNTHDTDQSEEAPPQGGARKTTDHNKKLQTASQTEHTYRHGGRSIRAESRTTPRGTSKAGDSPHSACPTQSSDPREQKAMTGSKNQEASGGWVEKEFQPSQLHQKGKPSTAPTAIGRTIIPRGRHIHRRRTHNHTAVHPPEDGEEPHKATEERNPYPFTPVDHPRLHAGKHAWNHWMEARHHPNAHNKRKSPSANDPQADAANTRSPQGPHPSQTDQAESPQRLGRAPRNRDGQKIP

SEQ ID NO: 980579 - protein, 250 aa, Homo sapiens
MVGIGEATVVPGADLKGAQQQPLGPCLPKPHLAPPALCWGLCISASMQGDAGTPQLPVHGFRVQQVLLKPHLPLASCSLSPLPLCLSRGGRACGIRRLLHLNSLQCRERSLWNYTQERICKGYSGFSQRSEPRGNSPSNHWPLKQAEVPVLSGPVAHLVQELMVTRSWFIEGSWQLYLSKIVLEASWKIHVPPLPPTKAFPRGQVPYTIFLGRSPGPRGRWPQGPRAEPRFGKDPVFYAWGPPPGFKAPR

SEQ ID NO: 980580 - protein, 67 aa, Homo sapiens
GRSVEFFSGGSAGSFHHGPRKQEESGAQSKVSCRTDQSRIKEAFTIMDKRMVMTDDLKNLLPGDDVK

SEQ ID NO: 980581 - protein, 599 aa, Homo sapiens
GDVSQKVLRHPDMVSLETSCLGQLQQQASVVKVKSFPEVMTLSKPVSTSQPSCGYQGWHDSTSVLGSRPVPGASNRCNTAHGRLCCAVLVAPTWLTDNQHHMWCAKMGAYCWVLTIGKQPLSVPSSAPFPQQLVYLRCSHHLRCMPLATVRAGITSYTAQLGPSEIIQAQQCAHSTTHTFTLPKKEHTEGGARRLRNAELGAPQGPGPRTFGRDTGDTCSKARRSTYEHGERNALSKNGIRQCTGGTRIVGPHTRRAQRTSAGPSCQRPYTIASGTSGNTTHVGTSHPRSGRGDKNVPRDGEHTPEEHGDPPWSGASPGSEAQRHMEEPSGDATDGPDRELTLSERASSEKEVNDLLSVSTRPPQRTGSQGRAQGTRNELKHHDTGYATTGRGNCHPQSGDQQTRRYRTQVEVPHQQDNRNGDTPQTRRERRHDPPTDNSDHKREESPMTTPRAVAHVYQSGSTVDTTVQPEAKHQSHSHDTTALVDKTNGLPHHTRQPCEHNRQEPTYTTEQGHNETQYTQDTATEDTHTQTATRIPSTYKGAHHHWRRRYTIKTATNQDTRTDRAPNRRHNHNQRSAHEPPPEKKKANNETEHSNNT

SEQ ID NO: 980582 - protein, 95 aa, Homo sapiens
MREGATKGGGLYINTKGEVHNRGESAPRDISQKYIGPPRPTAGWGRSQITHNHKTVGTTNNSKQRQQQKHENLNKAHKKPSRDCIDRINDNESHE

SEQ ID NO: 980583 - protein, 75 aa, Homo sapiens
ALTGTLLDGWRDSATANCGSDQSELRAAMNHTHDSNVMRDSGNLRVGKTDVRQNMNSGVPSAKCACNQMSMADLS

SEQ ID NO: 980584 - protein, 661 aa, Homo sapiens
VTSCCGICPRDSTAAAVSKCLPWVPPACHHASGNACMLLASLAMPCLPMPAAHLPTPEPKHHICPTVKNEQEQQITRYRERKTCQSITWDSRIVQTTTRTLAIEEYHPVSHPQTMKPGPPEQLGAKTDDMTPVKTKYKPREERRHQETPRHTQAPSPRTPAKEETAEREEPADEHARSTHSRRNKEEAKTAERQKKTEKNDRRRNHQRSSSEKREARRRQKTTTEDATQDSRAGTTQSTRHTSQPNDEEQTRQQAAKERETAPSSAREAKKKEQRETEEDTEHSNDQNRQDQAEQTRHDKQRRDAQPGRSKGDKNTSDAGESRAREDRKQQSEEAAERGDTQEAGERARGERRGSTQEKKSDRSREERESEQEDERTRKTRRSREEGKQGDDRNEEERQSRAQPEETTKKENKRSNRQPEEQEQRNDRRTTAEHSAQRQRRAQIETEREHDSSEHGTAERQGASELVVGRTDETDATATDTENTEAAGAAQERPRARRTQDERETEGVAQPGHQQQRPHISNTPQHREEQTSAETQKQRDRKARAVTKVEREQIHRETEQQRTEQERQKSKRKKLDEEEREQSQNPASKARIKAKTSGSARKSSARAAESQNRRQQHSRETTGQEQRPLVHQTTTRASISARSLRVARKKAREKVQNRDEE

SEQ ID NO: 980585 - protein, 30 aa, Homo sapiens
MTETVDEETRILNNSEIGDHRTTQHNNERY

SEQ ID NO: 980586 - protein, 416 aa, Homo sapiens
PTPPLSTISCQTGPSVSLVALWFMFVGVMTIPRFPDSSGIQWERGCPSTPANAIMPSPLHERSHPPMCEPVTSAFDTMSAVNPASSIPNSHLSFQAHPMAQSRREGGTMAVRYNVSRILLVLNINAIYLLFNPQHTTIHHTLPQRTNITNSHRKQQQTETDKLGAVPTPRNNGHPRIMETQREDDQDGNYSNMRTHRHTTTSPDGKTRDSTREARDKEPRNQPTHTAVDAARDGGSEQNATPSTPKETTERRDTPAGAKAMARVERGRTGAWARRGGRAAGTARERDRQTWGRAHGEERHRSASEGRRTEARDDERAVGRGITDKGVRRERRRGEAKARAGGADGGTGQRRTERQRRGEDGDGKRQGAQRRRTEGGEAERRRNGRGGQSEDGRRAGRGPERTAKHSREPKEERHGE

SEQ ID NO: 980587 - protein, 256 aa, Homo sapiens
MMRRSLCTIKAPEYPLHECAQCENLSFAVFLDRSISHELEYTMRGDAARTRRMPGGFQLAVPRTEDRILRCTVVDVGQRVVGRGGGTGWWDSVCSVGEGLGLLPSTCLVSGRCRGASVLMLGGVPSDLCSYGYVGLAGYHKAPEEVVGGDSAVGESGGCPWDGGGRMHSSQGQFRDVRWGRCHGNAPSPYEHVACRRTGFWREQTLACGSWLRTPCVVTKVAAPPVCGIASGRWFVATGLSQQAAGGAPDFLRPGG

SEQ ID NO: 980588 - protein, 116 aa, Homo sapiens
PVWGICLGLCRCLSPGEGLVVGVGGKSLAPGFVPSPALLGCGLVALTQLLTLPRVLLYFFLFWLDNWRVERRHDGFHPRNRSPLSIPTERDREAKFLASPGALVPVSSRCPAHVGP

SEQ ID NO: 980589 - protein, 55 aa, Homo sapiens
MKPHQGVGVGHDKRGCHRKGGPRRAREYKYPPPGVRKPRTEIHIKQRSNQHTEKT

SEQ ID NO: 980590 - protein, 206 aa, Homo sapiens
AAVSGNCFAARAPAVRMLVCVSVAELCLLPVCCGMPEGWCMCPPVELPGVLGWPALVGAAHAPAGAPARTLRLVPPCCLLIALKMAAGSCAWDLAACDSWSAAPAVHGLSVHHMPCALDIPFNAASNDVRASSDAELPWQLSAREDPVVSELLGMNDSLAVARLAKEAENQNRLQGAMLNARIACARAMACQKRMRPVMARLREKQ

SEQ ID NO: 980591 - protein, 69 aa, Homo sapiens
MRTRHTWRIPKGKAKKGDRDEFRQERQTNEARGRKGDPERKKKARNTQRTHRAQTSKTDNNDKNKQTEK

SEQ ID NO: 980592 - protein, 70 aa, Homo sapiens
MSADDKRLRQVNDIMTRQKNIVTNATKDKRKIQNKKKKINIIDNKLENRIIKKISGKHVVTKNRGTENDK

SEQ ID NO: 980593 - protein, 265 aa, Homo sapiens
MPHFHNGLGMLAAVATVCSTMPGPVKIRMTVMCPGNANGCCLHLLRCPCVGVPSWPIVLLPHGSGTTLKVRLPGLRLFSLEELSGGLAFTRKVGPWTIGISVDPEDGGTMSTGCPCRPTVQRLTGVPAPKLILFPQEALVPQEGRQFLLKNETVHQLTGPVMPVRNVYKKGESSSHHLRKEKTFKAFASLRMARCQRPGLRHTGKKSQGSRRTGMLTRQNKALLGTWTSVAVNAGISHVGVFRGTTGDWDGAPCCDSSCRDIGAS

SEQ ID NO: 980594 - protein, 193 aa, Homo sapiens
LPDCSVMRLDVARHKRLDRVDNPANSRIRRFTHHLCRQDYESTIHSYISTDVLCPLWYKNAYLRNTRNRYIQQHDLANNYHETSPNTEHGTMKRRTHEPRRYIKTNVPEKSPSVDECPNKCGNTRTKDDNTKIPHYSDPPTINKGQSPRHMSANCRQQQIRLWTQYVNHDNYSLIQQLTSSAHTGSMSQSITP

SEQ ID NO: 980595 - protein, 238 aa, Homo sapiens
MTVEPGAFAVSVGAKRGPLDTRDITSRGMGAWRRITSLGDLACERVAGDPHIRMAPHQWILQARRGAVAPASTWTTSDSPQNCWKRHSSNEQAHFTNSPTLGTPLFPLRTPPFWLLVRALVPQRFKRMLGASWWRPGGRRRRGYLSGGTGPWRGATRHYTLGPGSSPSYRPSRTTQEQTTLGQSRYMGPKSARPNKCGVLPGDADALRKYPPGCAITGKITVSGTWAFDRTRGDSQDN

SEQ ID NO: 980596 - protein, 496 aa, Homo sapiens
RTSPTVVDANSTITSALHTLFSPAWTFKSDTCKPTTLNQPAISKQATRNNCRDEVSGTRYARLQRHQLATAFYADHTTTCRLARSVRHMQAPDPAFNTVAHLIRSALLNILAATFPLTATSPDTAQPPGPTHASRGPSYAETPNTQITDATTSADSGNLSDTIEMQRTRADRLPDDRAIAMRPWLTHHTPDSLITSRVITCTAQVYSGRTTNGANPAPLGSSLEVSYPADPQASDKQPRQGTQPIIRPRTREANTRPRRDCTQRQNPNTSPPPARTNHYNPQPHATATNPKTDRDNPTTQAHSRSAHPTHGLPQDPETSTTCHQHAPTQPHNQDHAPLDTGPLAPMPTNTTGTPRTPSSPKYPTTHTSHTAATPPRPHTNDHAHTHTHATHDQTTHKARQHDTNTEQTDNTKEKRKREKQTKQTGRPQRTTARRATKATLQNHPTITNITDRSSRSHSQQAKPRQTTDERTRPTESKQNTNVQPTHARDTTTHTQH

SEQ ID NO: 980597 - protein, 332 aa, Homo sapiens
MNQLGKGTDQPRTDPEANYMGQGHAAVSVHTNETTGTKERQYRLIAPRPLFSHEQTEQSTTTQRSSKTAQQSTKKHSKQPTKNKPQHDKHNNLKTNAAQQGGQEADDGRREMRRKTSEEEREKTTGEGERGGSKRRREKRGKTRTRGRRGATDRNRRKGREAEATEESKRARGREEEREKEKQRGGEAGKEEGEGRKDEGTEKDDESAEEHKGSRERGDDEGGETCGEGKEARGGGEKRGPRRDENGKRDGERQSEEKASREKAEKTRATRREEHRSKRTGEGKTERRRREAERDRKHGEDKKETERGDKERRAGGNEDEDRRGTKEETSKR

SEQ ID NO: 980598 - protein, 173 aa, Homo sapiens
SSGKWDAPEGASPASCPNPQATDMDPKLTHSVLPLSSPDGQSSCLPWPDDTMELLAEMPMVEQDEHTAERLKHAQKTATPRQVKMWAQAEKEAQGQEVVLRETIPANGGKTEQGAPLKQSPLYHIPDSSSYLDGRMTQNMTWQQDRPDNLKKMEGPDPEPGTKKDGPERDLKT

SEQ ID NO: 980599 - protein, 144 aa, Homo sapiens
VRALVPSDCPDRPRGRASNPAKYIPCGHVTTALLDGSSTLLLRVHDARGLTRASVPSCYPYYNGIILPLCTLAQLTAWPLSWTLVLTPETDEDEDKEDDFRAPTVQERGLCEGIHGPALTVSMCHRCHFYQTSQQLTPTCKQSC

SEQ ID NO: 980600 - protein, 442 aa, Homo sapiens
MHQRRKLLTRLYERRYALTRTENRLTTRTLNTTDRTRQTTDTLTYTWRYTTNRNFKDTTQFDEEQGHYHGPLHEKYTRSTTTTTPRDNTAIEQTTINQPDTRRHSKNTRQPKIQAYQTKHMITDCTYKSKLSKGSIFLHTQQDSHNTRKRLNNNTNPRENTHVHAKREGQLRRCRITTTAPKNITQTNNTDQTRAKTRTNIGTAGLHLGDARTQKLNTPTGTQAHRHRYEHRVASHTLEHQQHTDKSHTDNRPTTQNEPTTDRHKRATHVAHANPHTKPYTATPHHNQPATVNPLTTTSSRRRQQDTRRTTPTYPGTSDTPKPNTQSDSRRTRRQNTRKRITHHGQQEHQAKTKHNKTHTHRSKKTRAVTKQTKPARHQQTQYTTHQTRTTTKPGDRRNITATQGNEDDSQTPKQPTAATNRKHRDLTTAHQTPTELKSHTE

SEQ ID NO: 980601 - protein, 123 aa, Homo sapiens
MEGVTIPSPAWLPASWLVTSYRDVECMPRRECHKGAYINKAIEPFTHWTGSGDQQSWKRDALRPINTPLPIATISRTLRLLAGGAYCRIPCPCTFNSADAQSFTGNTPIPLFATTHKRTIPYQ

SEQ ID NO: 980602 - protein, 484 aa, Homo sapiens
SFPAVTTYAHENMPLAPGSPSSLLPEEENEDTKKKRLVQSPNSYFMDCDNAQDAIKSPRHTRHNATNGSIKTDDRHASTLTLLTSHTREAKRTDDNKNAMYPFSRRHPQGHPNQQHPAAHAKTPAAQPKSPTQPSTTTAHPHNTKTQDTPRPRPHTRHALQHRTVRPPHYQNRTAQLRPHRTQKAHPRGTHPKPHTDNHKKRNRPPRPPRTRQQKPEQQQTQKQGGRKQQSNHQDTNNASAPRRRTNPHTEDETRPPQPQNKHRRRQRHSHTNNRHTTKTRRARTTRRAIDSNKQTTTTQTPPQPEERQQEREQKEKQTKHKQNTNKKHTTHSQPHTTKNNKTDNDKDTNSTKTQDNTTDQRQTHAHDHNSERHSEQEYTQEHKRTRKGRRSKEATNSTQHAHPPSTAADTGAQRKLNTRETATYSPRTDSTAPPSTMKRKNDNRKEKQRGTGTDTNTAEPGKRRRSNNREQEKRNRHHRSTKG

SEQ ID NO: 980603 - protein, 454 aa, Homo sapiens
RSLGGKMVARRRKCAGAGTREEPVSPAHWATQLFQSSSLKMQQCFSRTIYCDEHTCVRAMAPESNLDHQDRWTYFQRYLKMVDPPITGRQEVEKPLFTAHPVSTMWDHTYQCSQKLARRKPGTWAEKPQDGVQRDRKVTKTSHKSQVPGYTHGYDIIVGRTQAKAPALERCQRPGPYEPPSKSGPPPWPWRKYHTEDRTANTHWVGTARWGNIPHKSVRHQSVNLTAKDPSLGCPPRTHYEVAPLCTAQLGELVGNQTVITLRDKGSQNIMCTSKEKDNHDTVKETKRKRTKCGRHKEVKGKKYKRERTTPMETRHRHSRPHMCKMKEERVDTHYMSDDTDRIAQSEGYPHGGDTNRDNAQPNTTKTGQQKHTIQNEKRRKTSQERTNGQNTVKQTERQDGRQQQDVTKHHHVRSNHNQEKEELNEPTETNERKQNITAGEQSSRSTGKEELKK

SEQ ID NO: 980604 - protein, 104 aa, Homo sapiens
MTSGVYASSLNEQKCYVMSDTWGILHKLYVKLIASMTSTGSLKRFPILGTKRNYNPSWYLHLHSVVIFYTKTLLCCHCNLGASPLQYWLYSIHAFYELILTHEL

SEQ ID NO: 980605 - protein, 411 aa, Homo sapiens
GTHVDPRESQRNPILEIHIKNRGNRPRQWDHETSPSVVLGAYITGFVMFQTESTRPHSVLSSSRTGSRSQVGLSESLLYREFLAPWDGNVNKDAHIIGLNFHKRCCRSALLNLIVNHPYHCNATPITPNHPPTAREERAVCYAQQPKPGNRNNVPETACSSQRSSRVAARKKHRSATNHKKQSVTRHNRGAQEKWGAMANGETHQRNDRRVETHRKQARGQQSSKPPLGAVTTRHTQGGEGSHQQQKHEPTQNAKHALSAATSPSCETPYNEKDGRHENTTRKPQERHPGSRHTDDYATDQSTRRERHQHRNKYNPVCKQRMGNTTKDSQGHTKRGVTNTEARNHKHQGPPTTRAPDRTRKGDPTVEQHHAKRHGHAQYHEEQTRRTEPTRNIPKKKHQTHKKLGANHTGT

SEQ ID NO: 980606 - protein, 111 aa, Homo sapiens
MVRNKRHSRQPTGLILERSNTRRANYHRRRDNYTTASLHRTISRRTEHPPHTTKSSPQQKECCGVSSHPRTPPRAQRRTKSTNQKTKTNEQSRGSTQREGPLPTPQQAGYD

SEQ ID NO: 980607 - protein, 534 aa, Homo sapiens
GRGGLRAAAAAAVADGGCGEAVRQGARRPVLQRLSQAEGRRCSCRDRRKRRLRGLNLAHREERERMHGHGGYDSDLVMMTAVENPAKGKTGQLKMTYCSKNHFRKKNMAQGGPYTRCSQKLLDRERSNEIERLHLIALAAYSKTYNVRTTDYIYTMVAHKKTSSVGGNDRTDWDVIRGKSYDPKEMRRRDGPDLEKGLDEKYRTHIKGYGLRSRNMRNSWTKRPINTTYLPATAISRGTKLHQPATRSHGTSTQNKPYHDPMSYYPAAMEHGTLVSLYALCILLSSKRTKKSSNTTALAKIQPDTTEEDRRSTGREQAERVRSRAQTKGKQHNERKRSEEQQTNERGRRGQHDGRKTRKQREARGTRSRGGQTRAANRMTEHRARRDTTTTGGATTQPGEVTEADTTTRNGTEQSKQAAAEGVRNDEADRRQWCTASTRRSESTYARKRDKSRRRNNESVERGQREQKKAQKQGSEGSKKSTEGARGQRERATDRSERERGREDRQTTRAPEGRERERRPRSRAKKDDSGEEPP

SEQ ID NO: 980608 - protein, 326 aa, Homo sapiens
MAACTCNPRTIVEAEVSRSPECRMFNEQSLVATLVITTIYPSRNVTRNPRRGVGWSHSTRGPTARQGRLDGIAEISLNLGGHSGGGRTLEALSISANLIASQVLGVTKDAKESPNSSQERIISSNQSKRRDGRKTLSKWLSFEMGHRGVKKLCLGKAQRHQKYPGDTEGPEQGESTTNRRNPPRRKREHPGTQSVRTPHSRIRVIAVASPPEENTNSRPGETESTETAVGMRHETNPNSKTVSQKKDRDTQGEEVRHSSDDNKTQCQTYHKELVPPPPARRPICTGCRNTKREEDSTNKKGAEHSEDQHTAKGIEQQLKKRTRHSE

SEQ ID NO: 980609 - protein, 132 aa, Homo sapiens
CCAEPPSALAHVCAAVTVKLLLCMLGMCALVCLHVLGACVSLSPLTPSLLVLPTVPPYVLLLCHHVLSSCLMDCASNCAGCLVRPGEDLGGSRAMLECAWGSWPPAWLTFYDIAMTCGTETHSVAQAGVHWR

SEQ ID NO: 980610 - protein, 282 aa, Homo sapiens
GGGGAGAGQEEKRDEIVGLTMRPPMCFQTYADGDVEMFMTHTRPKASHRRLCPGPINHDIHASLPEAAWSAGHHVGPDRVTAENCAENDDLATSLVLDPYLGFRTHKMNVSPVPPPAADRRICAQRWKLSWGKRDLEAAYRALTLGGWKARYFQSRGPRQEASLKTHVTIDKLRDFLPGKWLNHPSLATLLPPWRPTGPKIVSTRAWDNKNEKLELLVGCFAVACGRHAAGLHAGTDADCLPDVNDHQACKRTRSPVAAPRRMINHDCNQLTVGACNGKDTE

SEQ ID NO: 980611 - protein, 157 aa, Homo sapiens
MKENKTADEPTGTTTERNADRKGKTRKKRQEERPRERKGRARRERKEKREKREREQRAEGEEEKEAKDKATQTETEQQTRRKERKEKGRRNSNTEQKRTKRKRYKKTKRKTTKRAKKRDTKAEEKEERTEEKDETSEEKQKRKRKRKKEREERQKKK

SEQ ID NO: 980612 - protein, 206 aa, Homo sapiens
MADDFVTSRHGDAVASATFPMQCSALRKNGFVGASKGRPWLATRQKKCHNFRKDVAAAVVHRIGGSIVVGYDIFSGKKYEDICPSTHNMDVPNIKRNDFQLIASRMGTYHCSRTAWEVREDLLSSLREHLAGAFEQKVQTVEEEILITGAVCMTRGGQLVAINGHGKITVSQVAVVASSDPLNCIEGPSELAGLAVSKWSLYTLLR

SEQ ID NO: 980613 - protein, 313 aa, Homo sapiens
YTSCVQRHLSAFCCPSLTKHVYLKAKKHTQTTKKKQNKHQTATNKKHNKHPNNTTKQTNKPKEKPKKKRKTTKYNTHNTKATNKRENRRRGRRAAGAQHQTRESTTSGNTHTETRGADRGGGRTHEHNKRQRAECELGRSMRHKRDGAGADRQRGGRGTANKTNSTEHQTAEQGGSTRRPPPDSKQKETRRETDDGARRERREQEGKKTERERQRKTTRGPQARRGRENTRRQATGTQTERGRKDREEDRYRAVARGGRRVRARQVSAGQQDVSSKVAGVGGDEKEDGRSERADAHGEKGRGMANLYTSIKIT

SEQ ID NO: 980614 - protein, 258 aa, Homo sapiens
RGLEQEGCTGTPGQAQLKTAGRGGGVETPATPRLGSRKARGGGWKAKATSGETGKWLACGPRGHLLYHPGCTAPPAANPEPNGAGLSCAALWSGAQWDWCALALIAWAQPSPSPGPAGGCEPSLGGVQMLRWHVASAARPPPLSRKACRRLWRSTTAVRGGPSSRSIYRLRSPCLTVARNGPQLLLHHWCLLRLHRAPASAKSANAPPARRAAAPAAPWACAKCAHGVSAKGRLENLKLLCLMWEPGLLPDVIEQLTT

SEQ ID NO: 980615 - protein, 313 aa, Homo sapiens
RSLTSGYVSLVAVWIAEPDWSGGYTDVQLAIFANMLRRVRLFYAMLSTKYTYVGTVHTNTHHRRHAQHLKTSLCAFFIPVPHKRIYHGTIKILYGHNECDGINEVVNILNKPHRRIDRVRRRYLDNPPKFRTEHSKLTQIKAKPHSITGGGQSGISPRRETPCTNIDDEPNEGITSPTSSYTYVGKPNGEERATASETVTGVSKVKKGRDIKAIMSLNITQSIRQQRLRQCPSNIENDATKHYEHKARRGTKNTEKKEQTKKRTAEQNEQKQRRTRARGEQNGRKKKLKLITRKKKKENEVRGDSKRGRRHAS

SEQ ID NO: 980616 - protein, 394 aa, Homo sapiens
MLSYSKSTANEPTNKNTFNHTHWQANNGPRKAPQTPTTDMVHHRDPERDKRQHTGTHSLEPKSNTQWTDDKEVQDIIHTHSKQRRRGEHKKRYMQNKHHKLRHPQHQHKGTTHKQGIANKNDSYNKATKPGTTKTTENTNNDTCTRRNKERDRNRQKHSIQEREDKTAQRHHSNDALNASEETRDGEEGKGRGRRDVEENDRRGGGGEDQGSGLPQARGRDGKMEDEGEAGEGRGKTRDRARGGPVARAREKRVEQPYRETEHKTEREPASQEEQQAQTERRQARRSTRNRGDETHPAKTKTERSQEEQRADKNQTEPGRQRDDERKKEASESRRKRKRKRRQTKKIGSASSEQTQCEESGQAKHAEAMDRTNDDDRTVSRRRSKERVVRARHI

SEQ ID NO: 980617 - protein, 464 aa, Homo sapiens
GEERERTSLEIFFDIYFSLLSLSRAAVVEDHDDRKLENRITTTRGKEDYDRLSIEKKENRKNERNDSPPRRPARRGASGAGRTTTPPSSDGQRTRTRQENRAGRRPTATRETTRERKKTAEPRAYGHTPHRASPRNVNRGEQSTPDGGAHSLTGNRTPHRTRRQAGCARSDKREKTTQAEHTRHQTRHRTQQPAPQERESTQRPARARRQERRSADRKNQESKTKGLAARQQTSTHDQAEKTATSQHKRERQPPRTAAQGHARRRRQRSRRDERERQPPRRRSGTRATRSGASESENQQRRHESKHRRAEQTVERETNTEATEEGADRHRRRSSTHTSQTATHDQANNTASECTTELGADRHPQHTDEDDTRDTHTSLLQPDPNTHRHRDDCKPDRPHDRQRGPRQTSARPDRTRLRERHRPTPTSTTNTAPPTNKREHDDDTTRTKARTVCTRDDPATRAVVR

SEQ ID NO: 980618 - protein, 564 aa, Homo sapiens
PHPLALHPSETLARQHSTCRTSQRPRASHHAMVTSDWGCTGLTLALSLTRVPGCAGRRRTPPSRTTRARTAHSRRTMAQILLRQLKTPTSTLITRQRYGKRSQPSTTEFHDLLITTKPLNHVPKNLGYDRSSLPNVDAWAHEDSLSMDLIPYFFRPHIVIVYNRESTPSNNAWQPTVLHSCNVNLGQHSAHPCAVHITAARPSRPTPQKPTHHTTLAPATDTRLASPKPQRQTDKTPHRQTPTRKQPITKTHTLNRRAPTHTSPANTRHTPSVQMTTQGHRERTPGKDKHNTDTTAATDPISHGRTEEQRIQRPTERPQETNQKETTTPHSTRHKPDAQRPNDTNTTTNRQRPTPANADTDHAEPAGTPERSAGRDPTRPAPPAAQAEHGRSSDEPRRADGAAGWEHGGDQQETGERRRQTRRRRGRRDTRRSERRRRAGGAARGQHEAADGEERREGAETEWLAERRAGRRGGEREQRTRAKESKGREEEQTEQEDDRQRRRTRSGKMANRRHEKIVGAAPQEQGGIREEHRGVDAESEKREGGGREKVAHSERKRLTRRARQ

SEQ ID NO: 980619 - protein, 123 aa, Homo sapiens
ARSCTLGGGYDTAGGLCLSNDIHKLGIRSRPGHGTLICDKGPALARWRDFHSASNAGKVYMYVCGEHVSVACIGAHCSEYSKQMRIVLRTRNSSRVDTQEKPEVLAGLVCPRMSSGLALRGRT

SEQ ID NO: 980620 - protein, 408 aa, Homo sapiens
TDLQLPRVQRHGALQEVLRWGETVNDERAGSRVMGESSSALMNCGQWCLARHLRLVCCSPYLPISTIALCRRYDSQDCSSAAARTATKVDKCGLLTGGPSALCIDQHELLEAHRGTAPWVSPHRDERACIMREVPMKQTRGQNNEGAKTQARTDLREVTSPCHRGEKAKNDREPGTQRQAVDHEQTKGPQTSGKDRTTDTQERKSPGAPMRPDTLDNHKDPGIPRQPDSRANAAERATNPETTRPARARSAGTANATPDEDTTRGKRTQNTNMPESTRQRASEQDSQRGETKRQTANPKRHMTHTNATPTTPRPPHLPDTSLNTTLTYTTFTPSSTRGHQGAEATAPARRDPHTKRPRTAQQRRQGTAPRTREVNREIQRGGAGREWNKKAGKRAKAHGGTHETEQEA

SEQ ID NO: 980621 - protein, 225 aa, Homo sapiens
MVPMAQALAVVVQGPMDGRMLPMDVFPCLPEHPMGCISWGTLACAGLKLARRYQFQASSAAWTSEGRTLDTWTVPLERIFSSPLWQPCYLTCDKHPYLSPDGQLPGTLAIMEPQAWQEKPTAQPGTLNTTHEKALDLRTPLRKARGNRRTDGSSSTRAPRQNKPASGQLVKGPETKIYHDGVGSTGETGKYTHNSRPTRWANGDNTNAGNKENALRRARKRYGRN

SEQ ID NO: 980622 - protein, 402 aa, Homo sapiens
MTIPHHTLQAYAVTVANRSDTCHGLGYGEMTYLSASIVLGGNTGSQNNRPKLATRSRRNEPGIGKRKKRRHRHSHSDGDTRATTPMDSGQSNQISYVGDAKYSPFSYQVHFREAYHSHSIPPSALETTQGNGKQGTRDPVKRSSQYEYSKDIRLDTMDHGEMQHKCQLGSAPIPQNHITQGTTGGHDVHTEHIAQRKQKNNQRTTKIHVKPSTDRTPKRRTSRTCTYTRAITHTPYTTSTREHSIVKAWRTKIENHMCTNRSIKHKETADTLATRMTPVGKPHHGKKATSDTTAAQRATGHQPGEDLFQPETRSTRMTKTNITHNDNESINHTDAAALPYSNDQIIRARNRHPRNHEGTWRTRSSERTRETQTKTRITAPKHSSGEHAETPAEHEENQNHDG

SEQ ID NO: 980623 - protein, 332 aa, Homo sapiens
WELEPEAPARPGPGALTGKMRPWPEGAGAGRAFTPIPFLAMTARALLGKAATMDDPYPRERLTAQCYASLQLHDCGSVTQDLQPGDWYVMDPNPQLNTTHFVSVCAKGALLVDCDLTPPQGSGPAIRIFTYTNSIIMVPGRLSAGIARTIACAAKRFAHTLQANVLRHSTHPIHAATSQPTCSISNRILRSEASPRQLLDPVRALAASSALCTVWPAAERTRTRRHALLDATCSPVHSLVAPGAALAPAVPTRRIHARWRARTPRHCLPRRCTCPFGLELFLSRNVHSRSIQTEGNILGHPTLPLYTTAHTYHIATHMAGTTAFLVQARGTI

SEQ ID NO: 980624 - protein, 289 aa, Homo sapiens
MQVAKLHNDYPTQFDLTLVIDYTARIPTRNLRDYGNHRSSPEYTYVVSDDAQMPAPILHVQRQYWVLGTPRDHYRPGDPWLGAKRTHNWNSTTRHSKSPTNATHQRYQIIGAMAQHGPNPPWKRDPAEHHEDISVHAFLLGRLADEITNCCIPMCVTTTVGNLAHTFRCVKRNVTLLGSPTINPHISRYLDHSHTRLQHGAFPRSRSNTHKRTHSEEQVATAPKTKKQQSRGQDTTRYRVWNTSHHADRGDGATTCDKDRLPAITTSGRTTDSETRCDHTDNANKDSWH

SEQ ID NO: 980625 - protein, 278 aa, Homo sapiens
ARTSPPTSRRAEMNAIAADMCTNARRVVLQELDAQMVNGAQWLRMTAYTTFICETGNDLSRDMMGVGAWLRDLPATEVLRLGPLVLNALLVTLTSLPAGGLQHISASRNDTTHNLAILLSLSYLSSTLPQDTRRLWLLDMYPRNLMDHYTVHTPLYPTPEQLVAEDELTRSDSVAVQCPVSAYLYETHSVPAAGEITGSPKPKTHSRHHQHSNRPNQGDGGSGHERYTGRQAHSTRTRTSQPYRWRSLKATSGPNQVGQPTNERPFDVAMATKAALLN

SEQ ID NO: 980626 - protein, 97 aa, Homo sapiens
MDTVNRGKHFHCCANGPRLSRSEEPNVQSVCAGRDVGRPVAGKNAPHACLGPAGSGSPSCLSRLTTSVTAAFGVVADGVPVGAEEPTWDEGEAPQTA

SEQ ID NO: 980627 - protein, 70 aa, Homo sapiens
SRRKRQALMACTRDDEIRDTAIQEVVLDSGDSGGEATSNLRDRRVQLRNDVSRRVRETSSTYSDDGASLN

SEQ ID NO: 980628 - protein, 101 aa, Homo sapiens
MQACLQLVVQQKYNKGKRSTLVKGHSNKWRKPVRKGDRRRHNEQQGQEDCRRTCETYNKETMQGTKSSESHFRSFLLIGLDRPTTNNQATACQSDKRATGN

SEQ ID NO: 980629 - protein, 297 aa, Homo sapiens
LRSREHHGSYIGPCEHPTPSPHLCPCACHPEPMRVLLSCMGLRSWTESGWSGGTDRMAKGRCGVQRWGVWRGWGQKAHRILDTGHLFTCTKMNVKTIKAMTRKNDGRKKSNKYKRKDEDNNSKDNMHGMKKKIDKYVMNRKRTIKGKKGSSRGRRKMHTRRGTRKQRKRREEDKERKKRTRRQKSRTEEQRKPRRRERARTASAAKREKKATQKRQRRRRQTDKEEKRRRRTNGREERTREREREETEKRNEATDRGTRREKHRRTSQDKTDNKQEERTSSQETRRNKRAQKHTQKR

SEQ ID NO: 980630 - protein, 155 aa, Homo sapiens
MSSLVNKYRIELGKRKLNTNCGYCSRTRLDINLTRGGVVELARHTARFPRRLGYPHLRVIHVEHWDGPLGVHRGPHPHGLCMLTVAPACNKRPGIPSCAWNTGEVHGNTPGGLGMNNCVTYPQTAHWNADTETGSAIWALLGERPPFVGGGRKSV

SEQ ID NO: 980631 - protein, 241 aa, Homo sapiens
GAGAWEFAEEVIEEASEGPVGSDPGGMRRRWPGYDKLEKIKMRMHDRSVERPAGGPGDTYALMSSVLTRGCIEADNECLTSSWREEKTISGNYAEELGPVAEAEVLSEKETKGSVAGPGPVDERSWSPERRDVDRLNNAVPLVRMVDLMSSKDDVGIECPGDCETVHMRVLEVSTWRRGKTQLEELADDRVGPPKNAHCMQVARAQRWIVPVTGQLLRGDLPWSRRVERRDERTLMRSRTM

SEQ ID NO: 980632 - protein, 117 aa, Homo sapiens
IDAGILCGGCELDMIIIRRFTASKFGSTRCCRNCVLMLFPDQVAIQLNDTHPAVAIPELNVGSFMWEYCKNCALVSTGDVRAHPRSTFRFLSTQLTTVLPVKPMGSRLLTRVDLVSK

SEQ ID NO: 980633 - protein, 227 aa, Homo sapiens
AATSSQPPPIHLPSSPTDLHPSPRLERHTPTQDGGQPIISSRNHTYIERAAYSSNNSRDRQKARNDTQQTPKNPHGAATGTAHSRLGDHTTRTTNNSTTASRPKQRGWKPKNNPQTKKTRKPQQKGHQRNADTTSNTLKHRTNKQPEYTNHTRYDTSNPAPHNKAQNSKSPQERNKHAHNAKQRNAPRDTHKPNHPTSSHTEDTSTLTTQIAERPKNTYTTRNNTTT

SEQ ID NO: 980634 - protein, 97 aa, Homo sapiens
MLKEKITKEDIAAYRAERKSRDCSKNKGGVQGVKQGHDKPLKDHEATIAEPGQMHGNQQGTVGRPGCRSLPSASTEGTTQRADTSAQHETEGTKVPR

SEQ ID NO: 980635 - protein, 337 aa, Homo sapiens
GGKPSPVETLLLTIQCWAGPSLTPTPGALRPQCMLLPPLSMPPDCTLRTGTGVEFCLAFVRHYMERDGWKSTPNDAITETGSQEQSRRPSCAPGNQDHTGHLQEGQEQSSSDWLQMLMYHQPCPLTREALRRRLRHLHGSKETRITHLYYECNAIFKPVFITSNVVLIHAQRRCHMQWSSWHDSHAIALLRNCLYKTAYRLSTAQEPTNILPHKQQTGQHAMTQSGSKTRTQAGSPQRKDKGRRLTPPQHEQTTPTHRPPPTHPINNTPPHTHTTPQDQPPNTAAIAPSPDPTPTPTHTPPPPPDTRTTLRPQAPPNPHHDHPPRPQRQQRPQTPPL

SEQ ID NO: 980636 - protein, 497 aa, Homo sapiens
ITLNVNGLNAPIKRHRHSKLDKESRPISVLCSGDPSHVHETPHTAQNNRDWRKIYQATWNNKNKKHGVAILVSDKTKTLNQPTSSSKQHTRQAIYINWAKGHPIRTRKQLTHRKSYHAPESSGSTPEWTKSKSYRDLQMRLRLPTHITEWRDFNTPTVKPLDRKLTRISRLETQYCNQADPNRHLTELSNTKIKQKYTYFSSPHSDTYYPKLGPHRRPVHSNSISPMRQELDSLTTLGLSAPQCPPTLEHQAYKQHSLQNRSMAAHMHNNWPDCTTGTSLDMHDTTNADSMNTTGTSRPYTSIGDIFPQLYRHNSEQVPRTSEQLSKTQPIDTRTRQPTPRPTPTRRTTPHTERTNTQRDALILLALETAVGEEELQREEGEEKQKETTKKHGETETETTRGTQDRRRGEEARKHHETKNRKQTNKTKQTGEQHDKGPPTGKHSKARAENYTDRRATARQQTPRQKKQEGEKRHPHKHVTDSRGTATTDNTNDEPQD

SEQ ID NO: 980637 - protein, 396 aa, Homo sapiens
MSQANKRETDEHPARARLTHYKHMTTGHHHIIPKGNELRTIPHNPAGKRNRHRTQHQDQLSVNQPTQGLLHITTVPTNLQYTNKPTEPGCEDVCEQAKTMINPPNISHTILYRHQKTTMPDKQNTETKDTNKHNSTGDRKQTAKTRQEESREQKNDARAGEIRQKDGNDAENAAKSEQTTNEKRRKTRGPTKKRGEGRDREREKRTTAQGNTKQRIRRQQEDRQDRRTSTAEETRSQRGDKEIESKRMRQETERKKHESETQREANTRARRGQEPTETRDTGRKKGTIEGTRQQDTAAGERDGKRRTKAIRDEQEQKNTRREKAEGSKKERTDKTRTEERGGVTRRRLEQRRGMRQQNEKEEAQEDRGRQRDVDAEQRTTKQQTGRGHETGNEGDK

SEQ ID NO: 980638 - protein, 539 aa, Homo sapiens
MEAAAQFFSESPDVVYWPLMAHRRLHILMYLGLTRCHAADGVAVLNGAPHCPLRFSFRTCPGRCPWLGVMLVWLVCGGTTGSTLTSRWCLANRLRYVLCPLLQLACKEANYYVLADSVLGTVSLGLDCRGPGGVRTLQQRMLPMVEPNDLVYDGWDISSLNLARRCWRAKVLDWGLQEPTVAAHGGPAARLLITSRIIAANQSARSDHSYQARVRSTARIAWSIRDYRTNEVLEKAIVCRTAKRTAWKRSSLRQQRPLAHYLPEIPPQLRPLQRASWIPPATHTDTIAAHRTVYSPLFRLSYAIVINKQETHQEATHKPLYKKYTQLNNAPAYQNHQPTPHQPYPNTPNTPHHHRSQHNNVTQQQTTNTNHNNTPHQPCGRGAQADRSRGQAERGGWRVGEEGREREGAPSGRERGRGSSAGGGLERGGHTRSPSETRTWHGRDGRVAREKEQARGGRRRDATRASTARGGSGESERQRHDGRARQSAAGARVGGGGGAQRGEGDGKRRRQTEEEHSERRSSRAARTHVVGAARGRDGD

SEQ ID NO: 980639 - protein, 659 aa, Homo sapiens
VKALCAPCGHDCQMKRARSVTKTALHEADGRADLTEPVPHCAASCSGGIQRSSPQSVLWHLYLHRKLGSLAQEHVRITPRKQQGYSTVSHFNIVHYRLAILACLSGLVLEAGKSGRVACPAEWQHQSATGLLPGLGDLMSLNQLICHLLGQDTTLTSRTVQCQREPTYQLNIHDIHLLLPALRMEQLVQLQTLYVGVPGEQQSQLIPYIIHTVALRPEENPKTHYREAEEQPKASWTSQENGEHSSVIDGPNTTQTEALNLPHSSRPPRSTFVDVQPNATNISFHRKKTSNQQHNNEQVTYIVQQDTTNPHTLPLYHSHHITHTPIQHPQKKKTPPTPHHTNTHTPQPLTPPQHIQRAPAHPSRSEPQRPEESKEQREQRDRERAVNRADRSEKRVKAESGEGWSDRTPRETVSEEARREAKTPAGRRAESRSAGEAAKQKEERTGYEGSIPYTSLLTPHTSSRHNTHPSKHNHQTIQYTMKERTTNNYNIKPSHLATKRRANTTYTNHTISNHYIIKPIQLPLTSHTHSHLTTNHTPTTHNPPHRQDRRVGQEHTKATEDSDKGYEAEGSTRLDSTHSQEHKTKGHMAKYRRKRNHQQRDSYARNADCTYTHTQKEKRHKRQAKQTLADTQSTTSKRQEEKSTAHTAQPDRRTSRDTE

SEQ ID NO: 980640 - protein, 380 aa, Homo sapiens
MSTTQRHLQLTYAFGRTYHPHAQAAPMAAARMCSARDVNNGRVIRYTVLRPGRTTWLNTPRITYEQKETNDITRNWAETMKLDDVTRPGNNGDKTTSRLVDSTQKTLHNYNNIIYTITSSYIFIPPPLNPTNHNLTTTTHHYHSTITTPEHTIILTHYTTYLYNTHPHTHTISTNRQYSPYHTITTHITQKSTTINLTLPNSEQGVRANSVSEASQVADTDRQDNQISNQTEVDTQTSNPGTRRRSVQTSNGQLTDSAVTEQLPRAQAQRRAHTSPRSSERLDDSTHLDRDSGNGGEGGATHRTRGEETEMTSDREADRSACHAAPRNEESLEEHEKRDWRMLQHEESARGEQEPSDAHTSLDAERRGETRDIDQTRRRL

SEQ ID NO: 980641 - protein, 60 aa, Homo sapiens
GGFSSGTRSQSLRAYPNNVRELLCVGASGSRTRDALVHRPFGYWSAAIEIPPVAFAPRNS

SEQ ID NO: 980642 - protein, 76 aa, Homo sapiens
RFVVRTESSVLRAGEYGDLDLAREVRDGGGGRAEAVLALADLGVPALRRLRLLVWPVCPSLKGGRAGFGLPEGSIA

SEQ ID NO: 980643 - protein, 134 aa, Homo sapiens
MFHCFFEIVRGARCVGATLVFWLPAGGACPVRQRRRHRAYDLIPSSSPGLRCVATDVAWNFEKFLVALTVCPYARYSRRFQTIDIEPDIEAWVAKGPAVPRAPLLPRCLAVAVLLSRGGFIYEGCSSKLRGRDT

SEQ ID NO: 980644 - protein, 123 aa, Homo sapiens
MTHVAQKLFIDGFFLIMSKSSNHISRRHAVYRDTDLEEQHGQQLKLSTFMEIKEVGGQSRFGVTNAGHVSKSPHVHALDRRREAFLYTVDFSRPADTALNGVNSYIKLVLIMIFLWDISENVN

SEQ ID NO: 980645 - protein, 76 aa, Homo sapiens
MRPFRSKHDNRRPFAERMGFAPRKRQRTPLVRPGQGKSRSRVDSDSTSQKRHRVKLRSKWNPNWGRTTTHIIQKRH

SEQ ID NO: 980646 - protein, 222 aa, Homo sapiens
GALPGGMCEDKDEEEKDVSSERGGGMLCCEAQSVGWAVSCVALLHNTALLASSCSVCGGPNAGSRCHWNPPPHCTFMTGDPDKRTALSQESQDPAQGAASRNGAFEALSPIGGPRGGSGSFHDEESRVGTRGNDPGPLVPSATYRLITGYERTDKIIPFHDTPSYGFVDAWVGGPPFDLYDFSKPFGLQEPPMTDTARQQGGSARLSLLIVYSLLLAFDLHT

SEQ ID NO: 980647 - protein, 249 aa, Homo sapiens
MLILSKGGVRASGATHGEASSWGARGGPLGDTTEGKHVLQASESSKGTVVGPRLDPCAEPRKCERRETRGHSDTGPFRPSEEIGGAQIKGEHPEVKPRGTPRRTRDNKTRRHTSHHTCGAPRPGGDTSNHPQKTETKNTPLEKHAGDRRNPIYVDMVAHKQRTTNKRATTKAVPNQGKTEHSNSTQRPYEAETRTEQTVTNENATEGELTPERTHPREVPEPKNPRGSINHRDLHKQNTHSVSKLLPQT

SEQ ID NO: 980648 - protein, 97 aa, Homo sapiens
ADLRRRATKALGRCTQKDNIRFDGLSRVSHVTDATDWRVEYPFVVLTPDSEAEIAGLIKACFDARALTCDPCAGGGTGYTGGAVPLTPFSAVINTEK

SEQ ID NO: 980649 - protein, 153 aa, Homo sapiens
GSCDARAAPDPVLEAWPGGTLGHCWYLLVLDNWVCSNVLLAGWAVSLGMDPGPEPACSSALVCCPALSVAVGTGVRVWALQVGNSSGQPGANALDAAARPSTECAGQLELQEFAAGLQIPGTWVSPHKGCVDHPIVLTEAVCKPTCIPRQMIV

SEQ ID NO: 980650 - protein, 115 aa, Homo sapiens
MGRQGVEKSNAIKLKLCRVESLGAKKLRKLEEKTKRERPSVRQRKAEREERKPNSSPSAKLRWKERRTERHSTWKKDAEQEEEERNRPGRNRPMGIMKKVPRNEREDYVVRGRNA

SEQ ID NO: 980651 - protein, 318 aa, Homo sapiens
MTGRNAHTVHSRNTRVWDVGPSLLVSAVIRRGPVESIIAVTTLHPGAVAIAWDIHPDLPPKIVTQSSINECGSGVQQNVLIRTRKQHYRRDRRTHTRLCEHRVDHYAVSVKDDWMRTNNLTSTCHTSQKMDPAELLGNSRTVELANAQRIKCTSVNQSTHDLTVVSVKEHWYTCRLAASKVPMFTCEVLACWLIGYINGEQQILVIVDADRSGGKTEALYTSMDTKQMNECYNRTETSCKVDDAQFKECRHIHYTQTVTIDSIGRTPRMTNEKAKRTRTNSKQQRRQPGGTTRIPHKKETEQKKGLNNRQEGKRDRTN

SEQ ID NO: 980652 - protein, 309 aa, Homo sapiens
AHFPFHWCPRTFPAVGAFDSEGHPLSSIAEGSVQRGPQKVPTRGWVASMVRTLGAALPARVVLSCQDSPKPGADEERGQAETRVIQTVDGVQAAYISARILWRPHLSGLRRLKPSGYAVSHVLCKALSPGAPVRHPTYLARLRIRALGTCYGGTGDGASRKASAAERLEADRAGSRQGALQRGQTPARRPVWSPGVQTERSSGPETRPVQGVKHEQAEPCLAPAEWDKMHLGILRSLIELCDKPVSPGGSEPLEGTTERESNRGTIGTQQKGWTTGESSPANGGRRTHRKKGNSIKQVEARENKERKRK

SEQ ID NO: 980653 - protein, 204 aa, Homo sapiens
MDWAPVLVLGTLVMLLPVSWLPDIEQVLMPSSMADCGPKVAGDRGDRAPSMAHWTKCLACLISLAAELAELLLHLEVREKLQRAGQLSRVRALGSCVGLSTWPVLGWLPREAGASEDGFRKAQKALSEEELKEVEASHEKLPRSRKDEQDGQDDGEATQGRQRVSQEQLRNWRNVWTLCQEAKEDATDDRPCKDDRYITYLTEL

SEQ ID NO: 980654 - protein, 243 aa, Homo sapiens
WWRKGGAVAALAALVQRLPLSAWTEESLESGLADLPVRSMQQVELCLVALAWILSDAWLTRRQLQGGPEGMLISAHLRPCHGVMYRKDARLSGLRLDRRRRPRPAMDTMLTYRGVSGDGHTLHGALRGTMPASPWSPRSETVPKARGGGQTSAAGGQEEEEGEDEAELSGNKGEPRPNYSSLSQPGASQRQCTKRHGTQAGGTDIGRGDTKLTIHVVPPGPQVLMNPDARDTMKSTRRRTKRQ

SEQ ID NO: 980655 - protein, 111 aa, Homo sapiens
MSHWSHATGWGWLPLLPPNGRMPALSSAGLAYGLYLLHRLGAGCNALTDDACEGSGLLAVFKPWEERTDRSKFVESDADEELLFNIPFTGNCQAQRHHYNGQRMMTHSPLR

SEQ ID NO: 980656 - protein, 134 aa, Homo sapiens
MPGLRWWGLLRAGGRSCCVFRSSFAHFPLPAGVGAEKTCRAMEDEVVRFAKKMDKMVQKKNCGWSIGFAKGAEEYSYDPGITAVVQLTPNGCLMHSPLSKSTRIGMSVNAIRKQSTDEEVTSLESLSSNPGKNY

SEQ ID NO: 980657 - protein, 182 aa, Homo sapiens
DRPGGMGRGDTCPEDWRGLQGSDRWLSTGGRTSGGLRSIPLPFGQTNRTPAMYSVHIILGGQEGPSFLRVIVWSSVLSGEQRAICLIVCEATEELRGSNSRGLWRPGGAVCVSVAVSADGAHELVAGCCSMLGGSNGTEKNTDEGPLDARCNTEGTLRADVLRALMALPYHWKTHGLFLVGE

SEQ ID NO: 980658 - protein, 329 aa, Homo sapiens
ALFASPPGSLQTYSQKRREAQYEDCGDSSVQLRDVLYRSGAMDPSCRDPIAYSPAASADEVKMLDSELMPAPPERGDPTRFVPSSPDGMAVKPCCSSGSHSRERVEPEYIHRRASISTSTAVLGFRASRSVDVLRTSDGSKATCLDRIAEALSCQVRSYNGSLSEEEANGPELGSGKAMEDTSGEPAAEDEGDTGRNYSFSQLPRFLSGSWSEFSTQAENFLKGCKWAPDGSCILTNSADNILRIYNLAQELYHEGEQVEYAEMVLSLLMVAGDPIYDYWLGNSDVPHASREPLRWPAGAGKPDTIWDALTGRDPGDAVRRQKNRGSTK

SEQ ID NO: 980659 - protein, 131 aa, Homo sapiens
MGGAGARGIGGMRRAERATSLDLWRTLCGPKPSPGSVAMFSEPGCPAGPNNSYCPQHHANNASLCPVCQWQTYTNSSQPFRLAERSYKPARYAQHYMPTGTHPNETLPGEPGTQQTMEDKWAVGEVKQQLV

SEQ ID NO: 980660 - protein, 234 aa, Homo sapiens
GRIRSPHARSSRSSPGPGSSPGGMSRPQPQPPSRLPGARSDSWPPGRPRDSCAQKPARSACCILTDLVSGRYPWLRALRAGAPHPLAEDSDLVSGDGCRCGRGGYSGVAPKCRWGAGAQQRGWAWASPPCQAEDYRLQSFQDEYPVRGVNASIVDSENQAETKKDLYLCVPLKNVDRNNADPPDSHVWHGDLTVNHRLCRQNSSETNCNNLSRHSKDLQHIWPFMYGDYIAYDC

SEQ ID NO: 980661 - protein, 320 aa, Homo sapiens
MGSSNATESSVSYILHEAKVLLCEIAERVWWRLIGSSVSHRSWQSSEERTNVTLKGPPKDVCARPCKEYAYEEIICTDRGKRHGDHLGNVADTPGRFHSILSMGSLNGFAGSPGKIDLGGFPACSKVNIPQDEEQLTNRQFDSNESPLVRVKNRGTERLGQGVAQAKRHLVDGPRSIHTVELMVDPLIEWIVLWLRTRRDVLRGWREQRLCGANGSMDSTPNVEAALGLDRPSCGATRRLGMHEKEGQGERGQAPVQDQKGVEDTHRRQDKEQSQRHRRLKENKKETGKGKRTTQDREEGTNTGETKKDATTPTEKKKKQ

SEQ ID NO: 980662 - protein, 360 aa, Homo sapiens
MILRRSISPRDDPQHAYRYARYSAEGGISNKLPTTIKSEITTYYTLYALTKSQVRCLGDNTLLTQGSTIASKAEHLPLDYKTTSHRTEDHPKHLGDRWYTEKRVLRPHRAKPLTRQPAHKDTKARWTVHSAQGNKTPTDNGTQTGKQDTQQRGADRTTGNAKLRNATRPESSKKKERNKQTQEQQEKQQSRKSTQPPMRARQTQTHRDKNTTKQRLHHTWRACNSTRSAGQAGQLNVRVATTTQERVHNVVSAVPSGHSSTDVKGGAVHPTKKLVKVYPEMPSPNYIPTLPNATPGQGKAERNARRGERKQEECGGTRNDKHHKRTNRAGETKTEQERGQQSRQPGRSRTAALAPRRREQ

SEQ ID NO: 980663 - protein, 137 aa, Homo sapiens
MHGDEARSTTRCLAIAGSAVANVLNGVDSSVWDPVASDSLAERYHAGLIHYNANDEVDKQIAYEKRLGCFSRCAMGPWKRHAVVTILLYRNSCEPEMRPPLDRGSFSRYTMHEQNYRWKLPEDVCWVQHVTHSWMNI

SEQ ID NO: 980664 - protein, 251 aa, Homo sapiens
ALGALQRSCGCAAVSGNCFASRLPQEDAVVVECGELACPWCGDAEAGAVPSGERLGVGGPAPVCALPLLGPAELAPVASLLLLMPEEAAVLAADAAPVTLVSAPRPDSRTTAWPDILQCASKEESFQEQSALEAECPGDRRQELLEKITEGQAAKKQKLEHGFRGQLNARMAGSSQGCKEDENSDWPGFGRAGGSWPSSSQAGNLNWGRPLAKICLLCPSWATGKAFDVRQGPWNGVSSLKNGPKPAPATR

SEQ ID NO: 980665 - protein, 75 aa, Homo sapiens; identical to SEQ ID NO: 780683

SEQ ID NO: 980666 - protein, 55 aa, Homo sapiens
MQTSSLVGPFIEHKDNADDPGCLIRDNCNSVSTMLGTGSLNSQGENDVKHTFGGV

SEQ ID NO: 980667 - protein, 134 aa, Homo sapiens
MRPRTEAAMNAQTHLAQLDNIARKFRNNSDDDIPRNLPEDWARHATRERRSITKPFMTASLATMNGDSPGTSDHDLGTPQASEGGGLAWKRGGTVGPPWQVGGHERESTIMVTSHDDTLDSIGRRTQPPDQHQT

SEQ ID NO: 980668 - protein, 129 aa, Homo sapiens
GVRVVSTLCAADVGVQLGSGAGAACGPLHGPAAGMQLWPPSPVPAGPTERRNVGACGGPLNPEPGQTCHEHPYCRRTYPRHIIRLVYKDGDWTLTSRPTLIGIKVYSQTRRTFTDLQCQHTRALSGTTI

SEQ ID NO: 980669 - protein, 315 aa, Homo sapiens
MTFSRVSAGSINEVVPSRVCGLSVPRDSSRRGRPRGPSLQLPRMTPGQSRCEEHDADDKMGRCSSLCSSSGKWSGWTDCGLHGSTDARIIISATSSSSLTLGDLNLRKQMSLGDCQAVQLRCSWVLQEPPACKTPRNADDLQTRAALTGGSAVRGSLFTSDNYRLAPRPRLRGKESWQPSIRTRPSFGRGIAEGPGQGGSLPAKGIILVTTKMAQTLGQDACKHERYLTCLLGACQRMAMPSLRTFAVLPVANAGNFPGRFTGYEANKTDNSNLRWPDTFRCCLVANGAGMDIPPLPGWMGASKPGRRLTVLTIK

SEQ ID NO: 980670 - protein, 246 aa, Homo sapiens
DSAEGDQAGEGPRGPTPKLRVIFIHKRTFRAPLRSVAVATLSPTSVAKAPCTEGCVLQGCDPFLWPPTSLEPSGEKGTQSMAGLGTSVILEPVSYKPPVLGAHSWCLRGVGRLIWPFQDLEMYPGHLLKECEKFYIHVEACDRPTYCCSARAQKPRGDHRQSSLDIRDCIKNVCGENFHTKEGIDPLRTRVKGGDCGLSQDGLWAKGDGVPQKIPYTAQKTSPINSVSRQTPSEFQNTKPYWRVAN

SEQ ID NO: 980671 - protein, 169 aa, Homo sapiens
MLGLMKAEGQGTKRSKKKVDDGAAGGPQIKENEISETQMRVRMKNDDYQEKRPGVDRAHLTSRNPKPVCAAEQPKKRSQNWSLDGPKELPTETNEKRLRSRRQNERYMKHATWPGKTRASQVLTWPWLVIIRHTCVRCSAAPASKAAATGKAKDDATFVQETRMQSLFP

SEQ ID NO: 980672 - protein, 119 aa, Homo sapiens
GVNRRQVLLVHAARRADRPGQSSVWRHGTCMVETIFPSETGQQPSLNALARPAWCTTPWMLDDGLELCFLRGDKKQSPLEFMLGNARMVDPEAWDMRGVGPDGRVGQRAKLDLYLQISA

SEQ ID NO: 980673 - protein, 285 aa, Homo sapiens
GVARVQLRLVCWCAWPPAASSCLPAALQLMEDDGLMCTDADCCQAEFTCLGGFMFSTRFMNVPASGPLRDVPLPCHTLTNTCVCLCAMECGCLACIKCPECCPFTCCATHTCVETAETSSCARIDIPANCILEPMKGWVVHHSTDVSSVGFAWRCGDPWGRLGGGMRLMGPGGQGPHRPSNVVPLVGLSNEVSELEPMCPHELKTAKLGVETKCELGPAYFDCLISRLWVDPSEKKPFSDEPCVARTESLTKVSHQHIVIQHTNKGQKAIGQRDTEARRIATRTP

SEQ ID NO: 980674 - protein, 251 aa, Homo sapiens
MCESAPRIRLRPDSKVHRTTPAAHRLSIIKKEASGISPTNNAIADTVNQHSRRHQIRPIANGPAIATRQRRCSSDKGAERRQNTSGDSSDAHESRRTELAHLKRTTRPTHSAHGRLAARRQDDSPGPNQGRPPVTQGQINPVTSQRPRPENRRTSQGRTATPTGDARNKPPNTKKRPPRKLRTIKRGLCTTQISTQTATKPRQAPKAATQTTGHTPMDTHNQQQTQGGLHPHNASRRTHVTSTGRSDNTKE

SEQ ID NO: 980675 - protein, 596 aa, Homo sapiens
MRCRCCPADGDVLCSVNTDPGVLAHWLAVCSACSDVPKLPCHVHLWTPYNHASYHHHTSPLLTLPPVRHHHTTHHPVATEPSPTTRTKQIATLHPEHPSHTILTTGATDHTKREPTSQKASDNTTTSSHPTFILVTHLTELTLYHYPSPLINNKYSHSLNINHTITSIRHMPPHHSHTNSTTYFLNLTHTPKQHYIQHQQHTNKANPTNHTQSKTTIDNNTPYTLNLHINTAGRESDARDRGDHRVAVGTGAIEPASISAEGGSIAASLTGRRGPGNDRLKHRHSHPLPLDSPLPSTHATLRELRSMTSRPTMCALRVTSINSTHTLSYSHDLHQPYEATSLTHLYHTHLNQPITTPYTYSYILHNEHYSCNHLLLPYLTPHTILLTSNSLSYILTSTKPTILSITHNPRYLHIMKRQARLPHYTHNTINHINPLILQDQLTSNHTHNHHTPPPPHTLLLLLTTMSDLAALHTNISTTLLHRLHHYKSHPLTHQPTLTLTHTHHSHTTHHTHPETITYTHTPTHPPTQLLHTRPPHTSPTTHRRIPLQSNPSSNRHHTNPITHHTNSPHRHLTYTKHNTHATTHTLHLHYRSHHTP

SEQ ID NO: 980676 - protein, 217 aa, Homo sapiens
RVRELPGGALSCINLPSCAARLPQTRPVGKIQVILGADVLRKKHRVDDERVRRFQIAQYKVLVIKYCQMTASLQQQLSCTHEPGYTNGWLHALLPLLRRSVAQEGLVLWHVITASTTVASFSLTSWMFCEGMAKRSGKTCNLWMNWMGPSRGSHHGAILEAELPVRLRCVVKLLAVCMDVLPGSRLYQEARHEKEVEVIGGRRQVPLRVSAHATTTK

SEQ ID NO: 980677 - protein, 403 aa, Homo sapiens
GTNALQQQLRKREVLLRAELSSALLPVFMPCGPTTLLACLSPDGALACLMWLLPCACETLVCCPCMCPLHVCLCAHMHRLPCMPLCCDLAVCSLTVIDVTVVSMCLRALCDERMLCLDHSWCGKLLACAHPSTTVCVEPCPFLTVILLRLPSGGWIVDIVDDDGPSCDQTLAAGAHDCSAVVPIAQYCQPAVQDDLLGVQPVRALFHRPHIDQRCARRCLRPATCWRVGLMWDTQASCCPQSDHRVQARVWVLVPSLNSLHQGSSRIVRGMNQGAGLLPLTVKIRTGLSRSCVNFGSDCCQHADLARWDSVSFTVGFGKQGQTKVLDLTVQLHFLLQLACTALPTPNAPCSGNVANLWHLRSSQRARRMYATGTDFAVSSQHHDLRTPARRWTLRPPARGPQG

SEQ ID NO: 980678 - protein, 316 aa, Homo sapiens
CVRGPEVSVRGPPVRLKSPETNHGCDGLCADCADWLCEWNPDNGLAYDACDLCALVCELMPVTPVPSKPQDKVEAAEATPVALDMTPPGAENAACECYAARCSLPCLPALFCSQQQGEPDLTEHEKVAILAQLYHEKPLVFLERFRTGLREEHLACFGHVLADHRADFYCAECGPAGHCPAPHPAYPACVTGAMLPCEKLIQGGEYFSDEQMRFPGPPAYEQYIGQYLTQEGAQWPGDQPTAPRPRSPRKPVGRTTNYDAQHTKERKLQKRLLQQQADEQRTCRKTTTRKKKVRKDREDMRGIEKNEDEWGPVENL

SEQ ID NO: 980679 - protein, 106 aa, Homo sapiens
MDHTQFVKPQFGPWLRTRNGTLPSMGNAGKHNGDTTSTTYPNPTQVHSAKSGTVEVKWPQSCNTPNTVDPTKYPPESEASTSKRETQSRTQRQTEKKSVREKYRVI

SEQ ID NO: 980680 - protein, 53 aa, Homo sapiens
MTDFSSEADDAPWKNCSRFPEYSWDEVDRTVLKGLDVDVSGTDLHATFDRDPD

SEQ ID NO: 980681 - protein, 294 aa, Homo sapiens
RRPSTPSPDSALRPPAPRPCLACCPEPSCLLSLHPLCCGLASCAPVKLLAVHVSWLQLAPVSCCDMSCCCPPVPCALLMGCSLAAGPLMQFPCRGVSWACCPVLGVTMPLLACSKCPVDDGLCFDAPGERQKGLCWECPGLRIANTVCGPWLLAVLCRRSLQLTRTPWDCLCMQHPRPLSKRTKEPKETTRLFYPRNKTCWSFRKTISPWCGPVPRHDQLAWRPSSWRAGENLYPYLGNGSCTEGGDTPSHSFPIPSNLMCHSRLHAGQSSTGTFLPTPRQFGNDGKLNYASAP

SEQ ID NO: 980682 - protein, 328 aa, Homo sapiens
VLAARYRGSIVGCRVRGYTLATGAAMSLCAGAPGGVPGGIYSSGHALGCGPCCPLARVVGERTRYTTVCLSGIAPEELMRLLHGASQTAGRRGIVNTSSPRSVYSKVCIGLTRVPRQHMRMSAGEAQTLGGHNAPLVRVRHLRTTPSQGYCPALNWHQANNASLVDVGSETQRARQSRAGRAYLQTRYDEGCRALSDMSRISRAIALFPSRRDAKLTPRAKVCGASGDLRPNGGLAGGGHRWTGELGADWSVGLRPEAPSLRRSTSLRRYGGFLDPLPGQHTDRAPCSMVLPHEIRGRLSFYFWYKMAKRIFGSDVLRTGTRVRCVDG

SEQ ID NO: 980683 - protein, 286 aa, Homo sapiens
MLEGLLGSFTAVIIFLILISGGLLWKQVMMTNNKNLIVAIASILPPYRVTDYMILEDSMYARAERESATREQDVSLKTWHLSGESWLDQDEYIAKINNVREGQSTDKCERNTSIREEIQIIYHNLKASFMECEKDPREDWNQNPRNRTEPEIIPEETEQRNRMTPEHEHLPRGPTTLGTHRDQELAEKVTEEEERAPEKNGKTVVEHTSWHAHDEQTRREENMPRNRKTQAQGKRNHKEPKKQRAKEKKHVDTRAAKATKDGDNRKTITERENRHRKEQKNKEKEE

SEQ ID NO: 980684 - protein, 294 aa, Homo sapiens
MGSQCWSWIGCDRHLTMQIFVKTLSGETITPRGVSPVDSIENVKADGSKIREGIPPDQSEADLLRGKSSCEMMERSPCLTTTIREKSPPCSWCCASGGGMQIYAKESDWASSMSLGGGARVMASINVMARVSMHGDWHSLLTKEERFDALAGKHGWDDGRTRCCLNYELLHEKEFLPCNHLSVIRLHMGGKSRNSSSGDYCRRVKTTINATEVGRRSEHAVGGDGRRAKGAYEKGTGITVPGDHKPVNYRHGKGHGQDRASTLGVIPDSPGESAELAVVGNVRAETNSRRTIGR

SEQ ID NO: 980685 - protein, 71 aa, Homo sapiens
DCLPAWSSCALRDLVALQLSSESLNAAPMELKLCAGLMIKSVPVSERQCCCETGDCAICTCGACLTEEPLI

SEQ ID NO: 980686 - protein, 407 aa, Homo sapiens
MVLGLSRLRRCGCMIVREGRLSVDLETLVCMSGAWCPMAGECDIRLSRRREPKGSWLRSVTQGTTQVHLELPGRELTPNRLRVTPEGPCGCNLALGGELSSRNWDPPMQVVGNIPNVHWRKSGSQWYLQKFRTHKWSSMVATHHGGVHSRNPHSSKSPEGANYIYATTKRSNRLNGQPGALSRAEEGWMADKCTQDSIGHTNTNVRINCPLNRGSTHRDMVQITSIAEKQAICAAHSNKMAQTRTVRESKHGGDGHTCGKGEHSGKRTPRKPKSNADGHRTADQCRRGGPRPTMVDVDHIDTRKDPAEFAERITREKQGSLTKQRHMPYYTQGHKKSNTWSTRSDKSKTHQEDTGHSTKEHARTSHTTRDGRRPQIAHNTRQGPHTKISASVDLTVSTPHKAESFKN

SEQ ID NO: 980687 - protein, 505 aa, Homo sapiens
YQRCQMWQRCHNADGWTILRYELYVRAGPMARAAYSERTQRLCLQHLTQGTSANTDGACVWLLFVCVLCRSGPVHGALRRRAVADDSVYTSRAEGHCLGRRQLGRGAWRRTVTTLMEPWPAKGTSSQGVRSPRWQGLGVIARLWALPSLGGVGRLVDGLPQGSWLRCVEVAVTSACPGGLQRRESMPLLRHCGRLERLILSEWPRTPLRTDRTGAWGGTIPGRETPVMQRALFPATAPLFILTPGLVLAMGIHFCPRHRRIGSASNVLVKGGRRENGTGNWRNGGGDLRNQPSQDDNGYCETCCGNNAKDIAMKMPPMGVGAPQLQNSQRAKGEGHHHDEKGYAQTRGGTVVGQREYKHPVNARTKGGPRSLVKGVRGGLRLVALRARLRQGPVGPPPSKDRQGEKQIPKKEFAAQRHGVSTQRATPGQPQHTRTQRIGSHNRRHCWGTLGGKGETPKERNPCTQREMSHKRHTNHEEPGTHHEPDSSTKTDKTTDSTHTEGIKP

SEQ ID NO: 980688 - protein, 51 aa, Homo sapiens
MDARAANNNQNDATSERRQEGHAPPTIQRPAHTYYHTKHHAISGHAQQRQL

SEQ ID NO: 980689 - protein, 409 aa, Homo sapiens
NAAPSAEDEDDEDYCALCACYCACAWHATCSRMLLQLKTAMVSLRRNDACMDMLVCDTPVVDDGLSIPAMALHVQAVQALLRFMAAMATFTTMNVLDMLLANDVLPKGTQSKLETVTRHAEQNSLERRGYDLNEASEGHFWTGPRLTREHWAYRGALYQLVALNPQLQKSHVWEHPQHHRFKWLPVDGRLFLWNKGCWTNCRSCQIAVYQEQHKPIISLCRLVKVRRTRGEFPQTKATTSEVCTAYPKNGEDILEKRVLPRLLRGRQVPLWNGEGGSLVHVRRNRWGHIFEANCAQCESPQCFRMRVLPLGGAFSAPIRPKIILNYMYVALGCEPLLDFKGRIIHWTFISTPVGGVTTLQAQMKHNPFEGILIPTLVYCAPEVHNPMFAYPYAAIWAKPTCDRNQATCV

SEQ ID NO: 980690 - protein, 109 aa, Homo sapiens
MTMGGVLRGACTESELQDNLATRVQELQHSRVAYAVTWEVSGEAARYSAVWNRCVLIISGCTKYDTVHQQASASSYSFIGARFDMGLYRHQLVVYPRRQSIYDLMLRSL

SEQ ID NO: 980691 - protein, 262 aa, Homo sapiens
RGEAECRSLARSVADSPERFCGRSAAGRSRERALWNGGDGYVCGGMPGWAGRAGSNWDVAAELLPPGYSAGPELEGLCAACPPDLEEPCSYAREPCPRLAAPGHLTAGADKPKPDPGLGCVLDLTTARQGEYLATSWSTELLPQKDMKLLGELEALKANQLTAGLWGDREDCPHHWQRFEEPTHVKMAGRKTNNMFKQVLPGKGQAPTLLEALSPPPRTSGLSPQQISKSQGGEEGWPLSDKVEPQEPSSNLELQRSMSPQA

SEQ ID NO: 980692 - protein, 363 aa, Homo sapiens
GETRELALARDGQGRLGFEVDAEGFVTHVERFTFAETAGLRPGARLLRVCGQTLAQGSGPEAAAQLLRSAPKVCVTVLLPDESGRARRPHGKAGSLAEPSRALSSSLSDEAPVLPKTTPDLLLWTPQASHQYPVLTVRHPLTQDRPGKSQRLMKDKGNPGRRTLTGHPYSTRTVALWRNSSQQDHVSRPGSGTLEDEWQGHLGDRLYLQTILESLHPERAKPIPEEWADPYRETTKTLLAEARAWETSQQNGLSPELLLTDAARRTLKKRTREKRTTMQHRADEPRDTHHRRATKAAHSKRDINTNNQDHTKQGNNSGNEQHTGTTGHEPRNTRPKNHTTRDETTPPKQRGAAPPPKSEQTAN

SEQ ID NO: 980693 - protein, 366 aa, Homo sapiens
SCAPCLSHAGLGHLVNMASVYCVQQQRLCGLGLGSARRPSGVAYTDRDGAVYCATWPDGMPDEPVSPRAARVSRHTHVASCALPRLGDTYICDAWSEKASQTSIPPLTPGQAPGWSNVACKSSAPALHDHCQCTTYQHVQRLSDTWRDTAQSAITLTRTLLSTILRIKHLHLCAHDSSYSENASQTSQDDSDDATDVALAQRGSRRNLTNQDHRSHPQQAGESHHRAPNTYMPGNLQRALTTYSGQPTFLDQCTSDMRGDSRLTRLHWAFLPKTLAEHSSGLHRALTACHYLRNASIKGHVCNNSDRATQRSTFTNQCSDTLHGIRVRIKHQNTSKHRTNVRCNSSHPIRCSYTGNKERYNKRHTR

SEQ ID NO: 980694 - protein, 164 aa, Homo sapiens
MDHSDHLLLPDNLGTHIVTFTSPDPTLVANRRRTGACICMSTPYSANGGETHDYTLTWLFPLRFIYPNTLARFDCPTLYRRVCASIHPYGQWSTHGNQVRNTKDDPRGPSREATTSHPAQTPDPIPTSHRHTQDPPAAQHGHAPMAEQAAVAQQDHTNRTQSGS

SEQ ID NO: 980695 - protein, 87 aa, Homo sapiens
MSLTGTSTWCGERRLAFRQLLGTRMTWAITFCWFYRNEPLSNEFHVSSEHAGRELSLRMPVEPGGTTLWGTNWVFLVKLGGHVPLND

SEQ ID NO: 980696 - protein, 361 aa, Homo sapiens
RRSAGRVRRLPAAVCWRRRIHALCWFHLCVLCCAVLCWPLCLTASSCHADALHGSPGRLLPLAIPAPRWLACLVMAQPGPASQPDVSLQQRVAEFGNTINAEFITCTTARSEPRHLHQNESPPLHRELIYFGLTRRTDSDTTANTATLHTRLHKTDLGDQPIATPDCAANAHNATSSAAHHHQAGLCPNRLLLEETTQQPNATPTTHTQPSTTRTRLGKTDTHTVDTTTPIHDASHNDHRNNQDTGEPQCHAPQRYQHRNSALGKPHQARTPHTKNHKLRLLRPQPPGPLISGDTIQAVTCNAKNQAWPTTIGPPHQSITPTHKPLETMSHPSPTTHATADPTPPPPPYMPFTSPMVNKRT

SEQ ID NO: 980697 - protein, 190 aa, Homo sapiens
GPAPRWEEAGDWGDRGETEAEVEPDPEALATVFLGRREEMGSKAKKRVLLPNPPGPPRGQIWRMCGGAGEDQVTSWPGRPPVLQDMEDAEAGEQSTQSGYWCNQGEQAGNVLRRGVSSCGRRGPERGGQMSRQHYGGGAPQADLGLRLAARGCRFLGRADDQVRPGVRASVWWVRVSAVWTPCPVLAWLR

SEQ ID NO: 980698 - protein, 76 aa, Homo sapiens
MFCSAPRCVSGLCMHQSVWSPMSHPVGFPLTVPELGVFGPTESDLRSEYSGDGLLEDPLLPYPYSSHPLGWAFSLP

SEQ ID NO: 980699 - protein, 253 aa, Homo sapiens
MRTVRTRQRDYTTIHAAVGVCAVIVPGIEVQTQQAICTERIVDNTVRSDNVFTEPPLPVCVVTRLIMLTISPRLIDYGMLACGATTDHARVQRNDLGTYVRRWVNNTVEVCVPKRCGIENGVAERKVARRFPRGIVIIHAIPSHGMGPDVGKPITVPLGGPNPCTERFHEARLNGLQQSDDILGLLPPELATLGITELEYEFYRRLVDKASCSPIACTVSRGVNNVIDNVRWYIQINDEQAAGGIVLCGYLPV

SEQ ID NO: 980700 - protein, 235 aa, Homo sapiens
WPPSSCPGPLRLVCLPRWGQSVDAGGSSAWSGWASVTGPGPCLRKKPFSCEEKKKQFAVTNWERKRGLQDLAAAPVPTCLQLWSRERARCEHDLTPRTWESRDPSYPAGLTSSLLSGAGSTRLRPNLIPDCIFERDMQGSEVREAKGEAAPGSKFIQAGSVLSCIGAWTSGEVYQPWLKFLDIFLEGTSLWGYEMSKGAINERRGTELTRTNLGRFMGLLFWRNQYFEHNLKTLR

SEQ ID NO: 980701 - protein, 66 aa, Homo sapiens
MSKVAPIGQIYDVSHEPQLFFGTGVPHSPRPPIGSEKKFRKPGYPASNVRQDTNSKHQQLKNKAHT

SEQ ID NO: 980702 - protein, 290 aa, Homo sapiens
GKWQQQRGLAAEYTLHQISEDSELEMSGAHGHGTDGALEVRGAPSPQKEHVNPMHESGPWCITVSEIDLPREIHCLQKEILVWLQADSSTFVQRKTAYTWSSFSSIQNEIIGVWNGTNLQDLWKSVAASSSHRGAGEVYIITVDKYLAASSPSLEPNIGAIQYNRYGLNQQAPTKELTWRASHLLQMPEPDENPVSINCGHSLLPVEYQQSSLKTQGQQQLKPGEILLVPVNEAPKQMDKAFRTPTKERGDALTQKQPTKRAKATTEMAQDRGHTQTARSTIEQGTNQRG

SEQ ID NO: 980703 - protein, 144 aa, Homo sapiens
MVVAWQVITDFTLKKTAWFNSHDADIPSGSQDLWHNGHRTHFLSSNIAHRYTGETGKFPINELGKVARIRTNSGLVRDHSLASCCGIGIPLVNVLFTIPNKNIAPTGGATKLHPYYKGHPFGKDVYIPQRNSKIGPLVQPNRAA

SEQ ID NO: 980704 - protein, 529 aa, Homo sapiens
DSVSSRRILRGIGPIGHAPFNTDARYPRETRDESLRIPKAERVPSPREPGVEIPPCTPRLREERPVPYTRMVLSCAGIIVLISRRVLMAFRRPNSMASKAACGPRVVFQGCCTIGPRTNRRPHLCCFSCAWALRDGGRRLARGTTLHRDPGRPTGRLRLRTQVARGETKEIGARKAARGLGVARRRGGGIAHSGGARLTRPAGRGLAKRSRGDPGPLYPRTFEANSPVARGPFSGKPTRGCCHSVWGKRQDKCGVYTPSSVKQSFLRWIFRCAGGIYVAIPFSICALCALSPTVELIVTKVVIGAYVAPLKSSCGREFATIAPNSFLPRPPVGGEPLAEKAILMGTRGPKKGTANSFGVWAVILLAVGGGFTSPGRMISLENCDTRTTGVRAQTFGMRRCAQTGSVLTKSFNSSQQSFHQATGRLCGNSTAEPVIALWRHIGGKHPQEGVVSHDSSLVEPICFLDRARERSSPAQHLLDYTTTRWCYHAHDEYSGVPPVKKQRKRYVYHLIVACLVFLTSGTGQQFSVM

SEQ ID NO: 980705 - protein, 128 aa, Homo sapiens
PRSPVGPGLPSVPVRAPACVLVWRTRAAVLGPFSVPACYVLLLADRGASVNCLPPHRQASSVLLRVFSFEPVPSCRGLVGAQAPGPAVSASRPTVVRGADDSARESSPGWPLRQTKELDATGVDVGTI

SEQ ID NO: 980706 - protein, 315 aa, Homo sapiens
MPRPVCVECISIHVGHGVAVQMDDAWWLSSTGWNTASSPMDRGANDDKNIGGGERLLSNTLFRLEDRALGWTCALGRVLSMTVDAQQSYELKCAHGGDPRRQCRLQPLRKLNHRSRKECMAQYSYVGPRASYQPHWAGGDQLEPCRRTSNSTKCGLKRGAPGSFSGLLGYTIELWWGRMVPGVSVPGPGHVSRGELVATKVQCWRSSMVSQAPTGIHKGSEPYSVQCSPATATWNYSEVPEWSHNGALMSIGGKRGIEGQGTNLEDYEPDGLHNRCRIRGSQGEEINTGHPDIRGKPVGEPTADNTWAHEAAQAA

SEQ ID NO: 980707 - protein, 124 aa, Homo sapiens
MVLSTYTALKLRTTHQGGKPHGRKHQDKRSTKIIPNRYEREQPDHTRYTDSNIHTHRGAPQLTAAHSQQNRTEQPAQQRQTTTLTVLKENRTRKTTYTRQTGQRRHQYTAAERESDTKYNSARP

SEQ ID NO: 980708 - protein, 165 aa, Homo sapiens
ANPSWERHPQPAGTAAYELVLIRHGESAWKLEKPVQRVVRRRPEPGGHGEAKRGGQEATRMLVVVQFCMITRCTSVAGKRRGVRNHSWDLVSQDCAVCIRNVGLAHSAMEVIVWGDRLHEAGIFCVGSETRVVHIIERSDTCSAKDDGVTVAQDRKDRGRTACSS

SEQ ID NO: 980709 - protein, 136 aa, Homo sapiens
GPIHPPLPVSESKRGHLRVERPARPPWAVPPADDTRSPPPKPNHENLQQGRKREPITSKALRLFIVSQRYVVNKANSVLIFSIIYSLYIVPSQYSLRVRPVYIHAISRMTRKPALRQSSSVPTSDVYFVGVTDVRL

SEQ ID NO: 980710 - protein, 84 aa, Homo sapiens
CSQNTIGYQISKADDKIWFCCTFIYMIDSSIRSILTEARIELRDLVAECRIFPSYVKNPRAQGRYTLVEHIADEPRRGTYQEIP

SEQ ID NO: 980711 - protein, 134 aa, Homo sapiens
RGGGGGWVPRTLAPAWEPFLNGPPLSLHSTNWSFLRGLQALHPRSRMGEDWLHPLPPTENEPDFAQVFASGLHGAGRAGSQDDDPIEEHKKRCVRCALSFLSRTQLGRIEPLVNCLETGQHERCQDTKLHGGNQ

SEQ ID NO: 980712 - protein, 118 aa, Homo sapiens
MAVLCCRRYSRMCELSCSLMVVTRCSPWMVLGVLWCSMAQNADAVLLHAGRGMRITRTNDVSSVGGKQVSWYRSDDDGRIGDMTDWSACELSYCKRVRGCCQEDSAFDCLNGVRKRSG

SEQ ID NO: 980713 - protein, 113 aa, Homo sapiens
MGPNRVVYLDITFSTLEMGSGGQVSYVLGPRKIEGGDAADVEVQFSYHLVRIFSLLWGPRNGLLLHNLSSGISRGIIWGRGIGVGYRGGRVKPAGFYTAIWEPEVPILRYLIL

SEQ ID NO: 980714 - protein, 324 aa, Homo sapiens
DRPASCDLDPGPPRPGAAGPCCWCTLCSLRSQVGPACVASGPVMQHRHAVLACCSSQPRRNVARYPVEPLSESVLAPISPPEGFRREECRRRYLHSTRYDPGTPMEPSRGASVGTLLCQEGLEISPALAIGTTQGLCALRWERRSTLPDANHEQQLHVGKPPGLPAMYHVVIAQRRGMADCQFREVSKSPPFASGGSGAQRASDRRLRLDFGSHVLVFSPPKVAFNMIHHRFGGSFGGGEFHWGIDRTWVLVCEIARGVGSKGGHPEEMATVMQLRANRRRNRGAEARVRAHMGTLDARHLWWRRRNSGGNTGTENEPCTFISA

SEQ ID NO: 980715 - protein, 335 aa, Homo sapiens
GCNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTNGEVRPPNGHGTDLSVTHYGDSLEQLIGVSREDLALCPGLGPQESPEAGMMSCRSPFDKYPDDPACKETPSVIINRSSPGQRSVVCWPGAGSEERDTGRGPTSSMDQNGQLQLSINHPQRHQKDKHSRKEAEQKQGNPGPEAENHRKAQKYGKNPEKYTGGPVRGNTWGKHIRQHPAEGKKPRYERKQGENREKEPTPRETDPKARTEAN

SEQ ID NO: 980716 - protein, 104 aa, Homo sapiens
MRCGNVLHRDIQCRFRKCLETVELQISLKNYDLSSKGTKTAFIGRYAVMSIKTILITPALYSSSCDAVSCVSTHVMHLMHLKALMRTGSDIPLEDVTSYVRLII

SEQ ID NO: 980717 - protein, 188 aa, Homo sapiens
PETNRTRQPAMNSRGQYPRQPTYPVRPPGNPVDTLMTCVIFLTAPSLYRVHPSCLLSELYRPSFVHPRGCHESPTMSGALPGASLYLPMASSVAVGPVGSTNPHGLLSSRSHLSTWSPQCWWKEGMMRGATICELVATAGNLASSCSWMPSGLLLSLPPCRWFCVLVTQWTGNVLHWSGTDGGYHHPG

SEQ ID NO: 980718 - protein, 73 aa, Homo sapiens
LLPAVCLSDANYLRRGAGAGSCGPMSPLGPWYLLRRTCGGLEPASCGPLLLRVTLTCHFEDAVCELHQPDVGD

SEQ ID NO: 980719 - protein, 172 aa, Homo sapiens
GAARSSQAPRKPVCHRRQPVRPRALYPAAAPIPARRARGAAARACPGQVSLLRLRGDGHQDLTKMACLGGVQPGARRLGSAVICELTFKYRRSTIVPGEQGAGVPALHPACAQMTSWLFAFVLLHHRGCHEARGSKFCPHHVIGENVSGLHRAKTVDGQLTLGEGGRNRNFG

SEQ ID NO: 980720 - protein, 105 aa, Homo sapiens
MSGTEEADGMSKTDSSERRRRSSACHGEKKERQECARDMAQGQGRGRTERTRHRSGLACAWEGDGNAVVDLEVDGREEADLETGFERLGAPEGPTYRSEPIGHQT

SEQ ID NO: 980721 - protein, 162 aa, Homo sapiens
MDSVRSGPFGQIFRPDDLRFRSAVVLENNWARGTTQKARRWCPSVLDVVMTKEADELLTACRGFQLTHSLWWGDLGCDWVTLPHHVKIRERGTQNRIMIDVRVVPSPHRVSEHRGARPTMPALSSPPARINRRTRASALLKNLSRMFASKPKADSRLLGLDT

SEQ ID NO: 980722 - protein, 271 aa, Homo sapiens
RLVECDIVFKPCVGIPEQRRDAQRRQGRSGSPTISLRSSNYGMIIRKCAIVGRRDKCGTLSRCKKDPGNVPFGEEWRDGAECGNETHMDARRPDPEGSLENRPALEKLTASYPGECGLGVQQGGPQLTIKGTMLVRATNGRSDCCPMLVSICPQCEVSCASLTRHSVVGSHDERSSLFYPWLESISTVRNSSHGVATLADTLRDARMLQASESKNVVAEKVGSPRRNAPPLGDSVLQIIVPVLLRGGSIPAGVRPMGVSKDLKVLISRRTL

SEQ ID NO: 980723 - protein, 124 aa, Homo sapiens
MLWKDLGDASGDEVEGDDPVLMCIGPGVWMSRRAVKGKYRYGAKLKCESNLTADWTNVNQSPDKDPGVMGQAWMTARRPHRALSLSPLSFKEKKPLGETNLGNTATKGRPRIMHLCLSRPLQER

SEQ ID NO: 980724 - protein, 117 aa, Homo sapiens
QREGARPMCTWSRRREHGWRAIGRGHGTRVAGPRLIGSHLRLLRDAAWAYKFRCGTCIHEYNIDMTRDHYRPLERGGVAAGVSAGCTLHVEFCEVPSAAEGARDVWTWPIRCLDGVL

SEQ ID NO: 980725 - protein, 156 aa, Homo sapiens
AWVYVASFVSVSQATPQQACQGDCSGIDLGTTTLVWVYQHGKVEIIANDQEKLNHPSYVAFTDTERLIGDACKESSCIEPHQHRTDAKRLIGRRFDDAVVQSDMKDWAFMVVNDAGRPKVQVEYKGESKGFYPEDVSAMVLTKMNVKLAECLPWED

SEQ ID NO: 980726 - protein, 146 aa, Homo sapiens
QLPRERTRQASVSLILIFPPFPLSYCLSFSPPPLHIPLEGTREKGKSRVSPSRQHKGNAENTETKKDQTKHVKQSDREHTETREATRATRREKNRRQTTHNNKEDREDTQHEKKQNHQRTRKHTDTQETDSPYKYNRKTTCHTDTR

SEQ ID NO: 980727 - protein, 428 aa, Homo sapiens
QNTKWLDDCRVQLVVVPWSALCVPCGLVEPLCVHSCCDGFCAMLCILCGLCGLLACGPWCLGPEACWMLRCAVYSACSASQAVGIAQVLPKDIGSLLMDRKCTTAQHQMITLEQGKHLIIVSSHIGTQTFQQCQIASRIQNLAIFPFPNRMGAHHSVGKRHSQGLTIGTAQFSRAQMNRPSQKAWNSPWFDAQGSQNRRRPNTRRGDLHQSVGQTIYHGYIGTLKYPGEAETIKQKRSASISSRLEYKREHHLVVGLEETTSVGAAYPTNGATDGFGVAQNDTRGTRSIPLELAEAWYTPRIHTIIPTFGGAAIQSGRRFLFTTNTYRRYTPPRWICHVPHAQCGHIKIIGVCGVTNDKARKYTGGHIKAARPNAKNQLFSRRIFSGHTDGRELTAHEAYKTRPHRPEDSYHMALPGCAGINAARPDS

SEQ ID NO: 980728 - protein, 159 aa, Homo sapiens
GKVGFQSFFSLIAGPHHCMQWTYYRSTHEAEGNEVGRHEQIRSSLIRVVPKGRLRNLPHSFPHRRIHEQIRTLSTCHQYHLTLIGQAEKDKLQYQISLDYQDSRIPFLSVHKIYITSKTTNTTHPRATIDPRPETSTTQSHKTKQNQPRYKTTGHKTTH

SEQ ID NO: 980729 - protein, 622 aa, Homo sapiens
AACAAWRPNRKAGLLLTPPYWQTLSFPWCMQEHSSQAGQKLDPRFTPEPSSMTLATGRCAQHSSAPEHGTATQAGKPGHTAQQGLGVPQNPYGTGGRVRPRHGSGPSERTITRKRSTPYYGHSLAQQIKDNSWDGTNRSDVNATMVKQPRRETHTHSSALLGHKRVTPGDDALAHTQFAHRQHGRLYTAITAGPVDTYPMTRPHCSGRQDPFWQFPILMRTRVVIGPTEDTTTYINQCKPYHWDCATTLSLGPICATYDNFTALSTQNSMDTTYTHNTPVTCYITAIWRGPTQNQNARSSATHQPVGKRKLGGHQHHQLLAIQQQTDGAMSGTTTDDIERNTTTLSHTAATRPQRGITLEGHHHRIITADTHAHGDEKEKPRSGRTHARWQTTIRRDNACDGTKRHHTLDRSETPHPQHAYATNSRSQGEQRAAKQPDLALAQDTDRGKNETNHTSGRNTRQCEEQQRRLPPGQHRGTAENASGTTTRTTQYRTQARSNTAPTQPRGPTQTNRAHTKHAWRETPDRDRYTSHHTSGTDVDRTPAKRRDRVRRANEGHQSANTNTRGRAHQTTHTEAQPKQRGIQPVRQRPARGATRRNPAQPTRHRQTTAEQPSRGIPSGSR

SEQ ID NO: 980730 - protein, 106 aa, Homo sapiens
AGVMGGSSGAPRCGGCAAAVGPGPEPASAPGSGGPSWTRERTLVAGEARWLCNCAARLGHVIRALLSSAGASTAWWWIERLLAGNQRAVLCLSTNQGPAEASPSTL

SEQ ID NO: 980731 - protein, 476 aa, Homo sapiens
KLLLNFYFSFKPQNRVLGVYKHSLVYSLAEVPRRGCGAVSKLTRPEIPWGAPLYNKCVNHPEVLKSTCGRRGCGCCGTCGEGPPNPKVSVGEGVPVVSLSIGRRHRGGPRAPQGGRPRGAIYGARAGLCCATKCAPTILLEGAPHKRAPGGCVSAPVRQKRAHARNATILSQSLSLSRGGATRGPCETESGLSRRGHPLKNSPLEGKESRGVERGASPPGERCRVGSVWGARESSSPTRGGVGADTRSVWCPPGGQQGGALSGPQGLRPPGGGAPPGCCGPRRPSPCEGHLSVCRGEPQYLWVGFLRKNAVPMWCPPYCGLFQLPWGFEHPLHKSGGATRPFPQEDPHQGRPPREALRASGRTRGHPSPGGFAPRLEVPRDNFFWRRCAEKRRLLFGVGAAPSAAFEAALRSNPAGGGPLSAQGGGGGDDRRALWPLKREGDREQCPQGGGGRTPTGCVILLRQEDTPAPGERADC

SEQ ID NO: 980732 - protein, 80 aa, Homo sapiens
MDTGPKSGSTQRETGHRGTRVWGFPTKYKKGARGEHRRRSEDANYQEGRSGEGQQGAFKPTGRVQGGGRIIKNKPAAGIE

SEQ ID NO: 980733 - protein, 321 aa, Homo sapiens
MVCRRFVEVGRVAYVSLWTSCRGEWSRMVDVICSEQVFGRWTLPSSEDDGPCLSSACSSLISSSQFPRQGAHQKYVRTSLVQQGEHINTEMGSRHDGPRRLRPEERKAKMTDLIVSRVMKAKKMRNRIIKNEVKKLQKADSPESFSHEKHLVLRVLLLLLLLLLLRAAKVPAKKDHRREERGSSPMKVPGQKGTGQRAALLQKLRGVKKLHAESTCSKGIRKEALSGSHYKANEVLSDPSKREKQRSGAIMAGPRRGDGWPWLSWSDPFLPKWKTAAHREAKRTRDDIPQTGVHPGAPVGVQQTPQIQTCTVLSQPTYYYN

SEQ ID NO: 980734 - protein, 314 aa, Homo sapiens
MPSITLCLPGEHRQLLEAAYTTSRGGHPLAMCSPNEAAWCVGCPRGALNSGTLFARYRRVLTALCLRVLITLGLRSREAHIRVSVRRGIRAWELGPLLLDVSSFGGFLHSSCLGIVELLALPAVIRLRFVRPLLRSRISDRFTIYLIGAIPMLPRSGFRFNGVSVPYIIDCLSTRVHRLNPIVGVHSVRRYSHRLCGSQSLVSQRISGAPPVPERIPRAGTTLVPLRVTTALVTCGFRSVDQTVGKLSASNVWTCDATFGQRCELAFGALSGPYGTQRPLWQPGQCNNIYLAEPDYDKLGGSSEKHIRPSIALH

SEQ ID NO: 980735 - protein, 154 aa, Homo sapiens
MQKVGGERLTEPRAVLEACRSHKDYGVHGAFSEYQCTHDVEVRVIQAMDGSTHCCRPGKTASGYLELMGGSSWVGAEEAMKANSMFVLKAGLSRSRIWSFCLHGSPSPVGSDCEAHCGAERTSSCETERLIFSMFPMVWSYYWKDGHYLLCCTD

SEQ ID NO: 980736 - protein, 128 aa, Homo sapiens
ALPFGPRWRLRVQRVAGATGAVLEPRAALGWAPLNLPGLRQEPGGPRYSDKQRGDKAGEPYEGRATRAREIKSAHRKGLVVAGNTGYTLGWETGPIAGRAEPRGDRRCSFANVSIGGGYPYPSGLALD

SEQ ID NO: 980737 - protein, 130 aa, Homo sapiens
MATITNIVATNHSNVRRIVRHDGYTLGVGNSRVSHLCGPQSAGPVFVYMDRTNDLVIAVGVNTLKPIVMRVNDHRCAYEHMIYSGYEVVTTLRDNKLSESDPGPHSGRLPWLIPTGREKNLPLNNGGQSQ

SEQ ID NO: 980738 - protein, 158 aa, Homo sapiens
NRVSGETWLLCPAVALRSDSAGLRKMQAWGSLLSGREKRRSGEAPSSHELPCAGLACGYNSTGGFLVGSWGYVKTGSVSSLAAGLALRQVYPAWVLNPAVSGSKELLGFPSRYICYLVRGNGNEILLLWKIHACRFKCAGDQVVLMAAKVGVRNVDDI

SEQ ID NO: 980739 - protein, 291 aa, Homo sapiens
QSVRPSQWKMMLNIDVSATAFYKAQPVIDFMCEVLDIRDINEQRKPLTDSQRVKFTKEIKGLKIEITHCGQMRRKYRVCNVTRRPAQMQSFPLQLENGQTVECTVAKYFLDKYRMKLRYPHLPCLQVGQEHKHTYLPLEVCNIVAGQRCIKKLTDMQTSTMIKATARSAPDREREINNLVKRADSTTIRMCKSWPDHLQFDDGGTRTRLASSQASVWGTCVYRLTAAVSAQNKVSLARHRCLDCEAAAFPGSETVWPSLFAPRRWRGCRDFPRRRIPTGGSDGPGCESPGR

SEQ ID NO: 980740 - protein, 213 aa, Homo sapiens
MRKGKPPVALRKKPRSPESGACLLGGVPKGVCTLWGEEAIFFSLKCVSPVGRGKTIPERDMKILAESLLKEGFLKVTVPLRGGKARYIFLESFTPPGGPQARPYNSKEFGFPKKNFMGQWFAPQNQLLCVRSYSGARTSMARLNISIAQTHQTAFSPGAPVSEASKGVPLGALGGLQGRPSPPWSHYLPSPILRSSQGSTGCKPRLFSPPYPA

SEQ ID NO: 980741 - protein, 424 aa, Homo sapiens
QQFQTITITVLGARDNACLLRAAAYQHFLRKALLACTEPCSSLRTASRDTIRLTTDETDCDSCHATARTPSTSPLSTTPTPHLLRHDYTRLYLLLHPPKFSSHALCYAALHLATRTLPLHAQTHTARTHASRPSNTPWAAHARHTPALTLAPFHTLSTFHSPPPPNSGSTRANQVSTLHLWPLHLQLCLAPLFPKAPTPAQPLFPPYRLTAVPPGAHNLNALRHLYPAKTHTPAACHSGANACAPCYHFLGRHFSLRPFTRNSLPALTPPSPLAAPFVTQQPPSLAGATFSQFSPPWRQARVGSPLAPNVARTPPSAPRAPTPHILARPATPFPQRRPWRSAPLFGPRLGRHRACAAPAGICDTPLGPVRPQPAAPLALLPLPFPPFPPTGPGTHPFSARAFSPRRQHTISAPRGTPPFGRPHT

SEQ ID NO: 980742 - protein, 200 aa, Homo sapiens
ESGSAVGPGAPTSAFPPPAVKHIPQPGGLRSPQLPSGAMSQKRSARDCRRRACRGSWVELHFSNKWERGQRSSLRFSIYTWRPWKQITVDAQELSLDRSSSKSSHCGQPTSLEEPKDTKELLKQIPIACGGEKQLKVSEEDDIRKTGKKRVKASVKEKTSDGDIGMAQVARKNYLPPKGSSSLNTRKRRPTLSYEEHRAS

SEQ ID NO: 980743 - protein, 148 aa, Homo sapiens
MGLRAPLSGGPPERTSVAQKTPRESYEEIDRGPLKPRVSPTNSASCDPLTQCTSGRGDHRIGGQSGVPASGFMNTECYSVGKNMWQHQRQLFIIKQCRERDTETPSTTAARKPQGNIYQPNAQHGSLAHRVIALAEGMLSTRDGEPPP

SEQ ID NO: 980744 - protein, 358 aa, Homo sapiens
GGLCGWNLTKKHCHASGRVLCSEGFWYPREEWEIRKGLECSWRDLVLDYNLHLPARLPWTPKCAECCKPHDRDNSHVWDSDGEINTCHGTGHNRYRELMREHPNMTGHETQNEGQMRERKSDARDRNNTIIEKMREDGHNGTEHGTKSDQWTELSVADEATGPQNKTHEYRGTDDRRQNILERENRRNTQNMGKQDENRTIYEKHRKLKPNPRNLNKHMEQTAGIENPRARPPEQEKRLNRKAKKKRNKERNKTKRNETNSEQKDQKKQKKKRQQNHEETKKEEKKRKKEKREQRHQTKKNKKKKQRNKENEGKEKKNRYEKRRRKQKKRSETRGGKSGRSEQRREKEEEKKNREKEE

SEQ ID NO: 980745 - protein, 158 aa, Homo sapiens
ERQRSGAEAALSLVSRASGARGVSRYPAAPSFPKTRPSWPWPPRVPVLAGVVRVQRKRGRGFPSVSPRNHFSLKRGDFHFFPLCVLFSPFFACLFVVVSLQRNLNLLDVEGLFKKKTLRSSYYLWKKRGGVYGGSLKKKETLLRNFFLKKIDAFVGIT

SEQ ID NO: 980746 - protein, 144 aa, Homo sapiens
MSTVYLHPGRAAVIRSALRRSSYHPATLRAVASGGPPAVGYHVALVHGRPGRPSASSLSLPSMKRTWSMRQCRSGYYLTTGRAIMDRTTHSSVKTHNSWTPRNGLCRTWFYPLSHCTLSYHVMTLGEVALAVGLYRKGTSCRGA

SEQ ID NO: 980747 - protein, 86 aa, Homo sapiens
KSAENIPPKEFLFKHPKRTATLSMRNTSVMKKGGIFSAEFLKVFLPSLLLSHLLAMDGDLYGRRLTTSTSTFDEELESDWFVVDYF

SEQ ID NO: 980748 - protein, 106 aa, Homo sapiens
MLCARNTKNRKTGKYGRAEPKKTRNKGCTHIYHGGSKDHTRTQATPPRSRGTSDNRRQKTEAQRKKRKNTTQHNKDQQTHAHKETHTTGRNNNHQTTQNRDKKQEE

SEQ ID NO: 980749 - protein, 141 aa, Homo sapiens
MTGHHNQRRRSQQHVPNIKIKPDARWTTNQTPIHARLANLLGHSGTPPNDHNQAHTRTHNYQDTSGYHYIPPHPHINDQQKPHSVQLHELYNNSTIYSRTPAIITHPSNAYLYNTLPTRPSATHRSLTNTLLPQEQTHHTL

SEQ ID NO: 980750 - protein, 115 aa, Homo sapiens
MNRSGDNHESLRARYRGMPKAETDESRLKRGHTHGDHRTGAEPPYSRLQRRETPRRNINRGAAPAQRRGPHHSHARRTCTVNTGSTASRVGEDAHNHEARHATNVDEAKRTVETT

SEQ ID NO: 980751 - protein, 255 aa, Homo sapiens
MSQKRSARDAGGEPAGLLGRTDFSNNGTGQRSSLGFLFIMETWKKYCGRTAGVLDGVVQELSCDSHSCEKPEDTQRVSEKDTHSMGEKKTVTVLGTDDLERKEGSVKAFLKKNQMWIWDVVKCGGKYAPPGSSFFKTPEGQGTSAEEPERHEKGGIFSADSERFPSILGPHWGHDGANSEGLRPPTRFGETGLPGRRYLAGHARTGAGGRPGICGSAPYKKKPRGGPRHTRRPAEPAPHTPRRGSLDRRKIGLFG

SEQ ID NO: 980752 - protein, 221 aa, Homo sapiens
ENKSLPTLSDSDPVLLAPGAADSDEETEVLLESLGHDPFGLSLCKVAPAVADAASVWSGWSRSEQCVAPHKRSTQRVQSAYHIGRPTRQHQAEHSWGQSQRNHEGSFGHHNGKVEVAWVPKDPKGRMLAWGVAGLLIMSVPGCGPQLREGVTGQTPVHDGSLISPVRVRLRRSRSRGQYSAETSAPGMSSWPQPQGYARGASWYPGPYLTPGGEQEPGCVG

SEQ ID NO: 980753 - protein, 396 aa, Homo sapiens
SGFPVLQQVLGREPVRSFPHPGRAPIASPPVHLFTAPIEYCRQGPRGRRSSAAQPPLADRRLSIRSPNMTDRVHLAGCARSYHHETHEARHQPARSTWSSTPPTFTCTMVSAGGPKRWRGPWRGVPGRALGAGLGVWPLRGLIPHSPGALLDTHVRLLEVAEDYLWTQKSRGSWILLGCTLRMLPRYARGGSAAPFCMKRDLGVLKSWGSRLTDCVIILRLRTGGVQALPSVALPPHLDLDGTAEKAAGTPSYPGRPGGVTGRCREHRGEIANLGGLAGTMGHTEGKNTSRRRRDPHNAAPDNAQGPTGLERHSQGNDPSVAHTQRIPAPCPWAPTYHSGPTDTRRGHGPKRTHICKRPTSGHNKRTRTNTQRDATEPPEGETNNRVEATTTHTEL

SEQ ID NO: 980754 - protein, 76 aa, Homo sapiens
MNEAHSIGSNKDTTFLHREKPGAPSKKRVNSSLVRTDSMTMTTLHVYKQDMKQERWSTHEEYVEARVTERVDKRTS

SEQ ID NO: 980755 - protein, 176 aa, Homo sapiens
MCWLVALKLNILSQRAPRFPGGRCWPREPREPLRRVQTLVAWCFPRQPAGRNGKASWGAIVMRKNAEKEGRGETLALLGVTLVTDNRVTTYGEDQHVDIFFFSDSALQRVFVCVSHVCLALGRLCEAPYICGAAGLQEKCPELSDLRVAELQWEHHINERPRAGSVLTPGEMSVRE

SEQ ID NO: 980756 - protein, 133 aa, Homo sapiens
TGADVADVPPPLPLKGSVQITGIDGKPGLAGLANDLQLPLRTRGIWPLLCPAKTPPPPPPKTIRKQTIGGLWDRAVTSQGLLERVCALPNLHALSFCVPLSLLFDLMWACDVTISCDCFLHKEFSSHHGVSGL

SEQ ID NO: 980757 - protein, 106 aa, Homo sapiens
ASTSSSLPVLSVAVGSRPCRQLLYASLFLLIRLFAFDAHMQRHPYALDRWWSTGAPMSAFSCVSGPAVRGRAPASVDDGRYRPVEIGCMRRPRRVDQETWSLVGHG

SEQ ID NO: 980758 - protein, 217 aa, Homo sapiens
MAQWTPGAQKRGSQRRNPGGTSRQRGSERSLPNIKTARGGQNRGVVSGTKSPKIGDSHREGHLTGGVSIHKRGMPKQQEVSKYPKFKRPQALGWGRHNRHDNHNSKTITQETPHDHQENTNLENERNQHQIASKTSKPTHSSITQLSTRKNSKTKTAKRHEARNAERGTGARRRTKTPRRQGGQDLGGREAPRYNTKKQKNKSYIIKNTNNQQIHEP

SEQ ID NO: 980759 - protein, 324 aa, Homo sapiens
MALYEVVQKGNVAALSSFQWQPLPLGLTSRDIPSTPLVVESREVLQKPRKAGEKNLAWVVGFNRAQQFSKTSSVVPPRRPVTILQVYQPKVATGGRGPFGGGKGTSSGGQGKYTRREGPDIPRGRKAPTEGQKEFGAQTWARHYTEGSPQKRRRHFQKENNPRGKRNTGQKTSQCGSHQRCVRKYMWDPGEKTTFLEKTRGTQKVSPTQRWVTVDNGGTLKNSWGKGKSPPALDGGPPNGTQNLAGSQNLGGPPDMRRKKEIIGPLNKRGHKTTCGADGETSGGDTYELAKDGHKRYTRSVNTHRSATSPPPRTKSVYDPTEEK

SEQ ID NO: 980760 - protein, 119 aa, Homo sapiens
RNRHLPFLRWNEEHKGKEERLTDDVFSHEPILTRRGSRSRILCLLYPKSIKTGCMGHMKANVSVLSKGNASQYTMLIQGKTLNESSNGFNSYTDCIAVSSKSSPRVKVSRVRWLQKTFD

SEQ ID NO: 980761 - protein, 137 aa, Homo sapiens
QWYQRRVAITAGGGQKKKKKKKKIVGWAGHWALRKNAFEDTTPGWGGGGPQEGLGVTPVGPIAGSLKEKDPGRHVGLQCGRGVFSPTQFKKKRAGGKTTEAVSENKISTRVGVPEGHITGDSYYKGVVTREASNIPI

SEQ ID NO: 980762 - protein, 333 aa, Homo sapiens
GLEVIWGRGEVIRWPAAHAQDDHAKIKQVLTYSRVGLRWKQLRCTLSRDNPTRRYAIKPKANDYIGVCMCTLYHENTLWYLNVFDRLAQREEVCARCCDDGPQDKRGAVITRLWVSLRQELLEVLCWRHDYRIGVYAEDNRKKCNRYSHCYESSAVRVAGIRGMYPEGPAIAWRLPVILTRTCQWCRDLKPILLSSYPGDIEMILGDPRKHDSGRREAGAKGGGPEQSRDDYCSHNADGEYNWGLMGIGVYTTSKSMIEDVIKGGYDFNIDSKVFPQVKTGSRGCKGDQHKGTVPCGRKGPPCPWKAMREERRPGGWHRTQSKGLRKDAENWH

SEQ ID NO: 980763 - protein, 48 aa, Homo sapiens
MCSSQNWVGSPYLFRFDSGHTHISAHGFSHNTTGLLFRTHTINIGCPP

SEQ ID NO: 980764 - protein, 240 aa, Homo sapiens
RGRLEVARSLARSLTRRSALWRSVAGRSRERALWKGARLCRGGKPGWAGSAGSNGTSPRSFFPRDTVRPSGRPVGACLRILKSPAACCWSPAPAAAPVHLTAGAEQPSQTWPGCWPDLTQPGRAISAPLEDGAPSPKDMKLLENRALKAINHKADCGDRRCPTSLAGLRATHVKMAGDEKHMFKQFCRRAKPHRAGGTFSNPDFRTEPRQIRKASGEEEGPSGDKCSERPSSTDCKANGS

SEQ ID NO: 980765 - protein, 175 aa, Homo sapiens
MLPVIKLLLLPLREDDMPEADEMADLRAGAHVWLPLPMEGVDISPKQDEGVLKVTQAEMVHMVQEMPMIWGPSLCPLHLAGYYMAQSLDSEVWICKDKFSFDLGTKAEVIKGWDHFAIATIEWWRGGVPQSTCKPEYAYVFSRQSFHKIPPNATLVFEVELVGRKTGEDLTGKSE

SEQ ID NO: 980766 - protein, 307 aa, Homo sapiens
MTARIIRILLLIVVAIFARWIAPYDAEELFVITDNLNNGPSLQHWFGVDSLGRDIFSRVLVGAQDLAGGGRVSRVYRCGDRDVAGLARWIFMKAGGTRLIMRICDVLFAFPGDFTGRIADCCGCWERGIANVIILVAIFSIPVFARLVRGDTLVSKQQTLLSQHRMYGASDVTGLCVISSLGNRPLSIVGVFSTMAAIGVPSDESLAARLSFLGSVRSAEHEWSKVMRSRSKSSDKYLTGSAYVPTRSVTGELGPMEENSSSTSTHNTHQQPTQPRPATHTATHQHKYNKYTDNKGDKATRAEAGEK

SEQ ID NO: 980767 - protein, 328 aa, Homo sapiens
MHRNIIINKLSTAEHHTSHNPHIPTLPTVEANTTTNTTSTSNHTTQTIHAAKHTYQRHSPEEQTRDSSQSIEKQKRQTRHRREESNKRRRNESSAHRAAPSADSNAERAEPARARDVEERNLSARTQQNDKATKHSTIAATYRRAQQQSTQTNHTKESQRKRERRSETHDLGRDDTADYKTHAEQPTTPAQTERRRHDRTQRTARRATAHTHHRTYEAHTTQRNATQRAVEDDEKERARTRSQTKRTESEKERKQIESNTLLAEESRCHTARAQSTRKSRGTVTKTHRKAATEGTEEAERDQDSENTAEDRREARDAPDAAKQSTSRT

SEQ ID NO: 980768 - protein, 78 aa, Homo sapiens
FAVLHETRGVPSRIWASAHDNCRYVELLHMRHEQIETMGGNSAVFDFSGQVFERHTVREVREILPLDCPKVLVPQFAA

SEQ ID NO: 980769 - protein, 168 aa, Homo sapiens
MGPSGVLKRYDTRPRVQKLKEMGRSRANPWATEGQRGSRATAGPGGEGPEAPQVADRHTPHTRGDTPTDRTGAWHHQRVSLFVRREKQMSMDRIHKRRRSDKEAGRTPGGMTTDGARPSMTQQTITSSPPVHLYTHTILLHAYTTTPQHTEKREQIKDNTTTVKEQVT

SEQ ID NO: 980770 - protein, 206 aa, Homo sapiens
YPPACVVCVCGELRNVMWPLFMQNTSESSLPCAGPASPCGKKSLRVLSPPSSSPPSITSGLSVPVSSHLLPSGPTQPLVKRQSSAYIEDFLILTKSYCCTHGSWGENHYSYQQWVFPQGPLWRLQRGELAQPIFLTLKPVVVLHNVVNTQTNRPIAHTNIFSPLDTENTFLSCGGRGDHNNTTLGRLSPRGLSRHTLRAKREQRRQ

SEQ ID NO: 980771 - protein, 179 aa, Homo sapiens
RDSDRKRAVPVEKLQDVQTTVEKKIERVTNARRRLIIGKTQPGRSDDCPAQSDITRSSFYGSRHGKSPRHNDRAAVVRLSRSPIGSELLTIDIHAQTEVDGVYINHHQQAECQVMDRPSPVPTSPDAKWVLVHVTGSNTLDVPPKRVITPDGLSWQHASGYLIGGKIVSGRNCTNSGVV

SEQ ID NO: 980772 - protein, 126 aa, Homo sapiens
MRFFCMIQCGAETVKKRAVAQCYSELDSSSTLRVQHTNLGSRHATLDALQKTDRIILVRENTRRIKNAGESRRTSIRCHYEKMLERLFEIARVIRTHENVGDSDEERTVLQGRGNYDQRYKPYISE

SEQ ID NO: 980773 - protein, 95 aa, Homo sapiens
PGSPVRDSAGVVVEEMRELLGFALIAGAIVDLISVRWTWAVCSVQSGSTKGGVNPKVECVVGRECVNPRYGCENEYEEYEEKNSVKEIEGQEDFL

SEQ ID NO: 980774 - protein, 323 aa, Homo sapiens
ADLVEKVRSRGSMAARARRKRSASAERERREMSARREKERELDSASCECWLRRCRVSECECPSLGPSAPYRSSSLEPGRWRWRTVAPAYLGSLTLQSLRTLSEYARPHGSCHPWSIASIHSSVSPGGLWTPGAPGLQLSRACTAVIQLPGRGNGKPVNETSVTDSSLEFEVKPSELEALHGVPGTGLGSLSPTWGPGSAAWTTVLHPFPFHPSLGPLSENVSAGKLGSPAADMSMLSGGAEKADGKGLGTWAMDQLARLEMSNVNPNNNKKSKFTALAVGSKMIHGALLGDPYLALALRGAHKGTLYKGNFRNPVFTVAKGIC

SEQ ID NO: 980775 - protein, 77 aa, Homo sapiens
AFSLARGVVAAGAAQLEMQKSREFVDLYVPRNAPLAIAIIGARTTHHPDERWPRLTRSQAGLSGQFKNFMLSAGAIS

SEQ ID NO: 980776 - protein, 106 aa, Homo sapiens
MQQEKNNTIKNNKQTRQTQETHQQRTYHDTPHKRQKRAQEARQKNKTHKETTSEQERKNKRRKGAQKTQDKTATSRHNEDKQQRQNKRYRPEESKDNRSHEQRRTK

SEQ ID NO: 980777 - protein, 44 aa, Homo sapiens
MTVPGAKGQTTIDRQAVTRTGTEGMKLIGPAQYQGQEQVTAPQR

SEQ ID NO: 980778 - protein, 454 aa, Homo sapiens
ELLYAGLLTMLMQVLMSEERSSNDDIWPNPLQYLLGFPSMDDELKEKEKEDDDDDEEEEGLEDIEKNGDEDEGDGMMKMMMKWEERSREDDSVDTDRTKVVRAADGFQPLPVTSMFLQFPGEASLDHPQFCLDDHWVAWTRADPAEDALSTNTAARNTKIYLGGRRTARNGCTRGKRKSNDPLLRSTEKAHIENPHPGGEMQQYGTGGLGASQGMLREGDQARQRYPGDPMEGAVGSTPGGLQTPWAKLDGSTRVRHAKSRKRGPPEPPGAILRHRAGTIAEMSRHPRVSTRNTRQRSIRSKRHRIESPEYRGTLGCRGTATTKSYVSSVCDVRRRDTNTMTTRADDQTQQQTHGKHSKHHKENTHHNRHTQTRATDTHEDQPAQQRLELKLPAHSGIQLVDTAKHQKTKAENEHRKKHTPHTAEHPRIRNNTTKEVHNEQEKKNSEKQRNSKD

SEQ ID NO: 980779 - protein, 233 aa, Homo sapiens
MPQSKSRKIAILGYRSVGNTPHGRFQLCLKANLWTPTIHHRKHFYNVDHQSMAHEYHLQFVDTAGQRCNILIFPQKYSIDINGYICVYSGHQFKSLKVIQSLSMANVWIWRGSNNTYMWVGIRKSWLMERVISYERGNLVRNLMQFLESSVKKSDVWMFIRRILGGRTTVGTFTDSLCRDVILCTLRPGIFTDKACGPEIHVYSCNDNNGPSHSILTWLTVSPVINTIQFSLY

SEQ ID NO: 980780 - protein, 104 aa, Homo sapiens
DSKWVAVAAVAPRRKRRRSRLHIPGEREAQAPEKGPGLGERDRRRSRSGIPALKTVPGSSEDDIDPTSSFPVLRWKEGRDEGNVEESIRSKRSKRKGKITEERV

SEQ ID NO: 980781 - protein, 77 aa, Homo sapiens
MPFRLNEEAVAEFSVDNDTGVELKWRQLQFKGRLNECECLKIRGAAIIVGQSDSGGKVLHRMPILLREITAGFGPQR

SEQ ID NO: 980782 - protein, 382 aa, Homo sapiens
LNVHGVPWCAQCGVTAFRYMAQGEAHCANVCRCMVLAGVMPGGSAEMGAKPNADVWPSPRPSCPGPQDATSSACVCLGVCFWPVSLAAVVLDTCCGVCMKAPLFDFLAPGILDMATSAQAMCPACVVMCCQWLYMCDSVSQPCKNHDSTVECGALGASICLKAVLHDYVCPVGLAVFNLGLWSGRDVLLDEPEPQSSSSDCHSKPRIHAVTPLNLDRVTREAALRLDYFVVFSSVSCGLWHLRDRATTALPNSCMERYLVKTDGHRKGFQGLGLPVGAPIGERVTYVLTPMSTKDTERQEGTRWPRRMWYIGLDVCGNHFPVEPRPHVFLDPVLGRAEKVLSYIVDGETRGPGEYARSPNLASLRGHDTRDQLSKCALTHYK

SEQ ID NO: 980783 - protein, 442 aa, Homo sapiens
MTLNGGGSGAGRRACCVGVPCERELPSVWHAHPVWAPAPACVHLPACMPGVTDAADHACAVLLEPLCVAALTGWPAVSVLTVCDPWWSHVAWTRCPDVTSCWDSASVSCGVHAELMTEDAVLQRVLGCLVCAALCCWCQGCCHWTAAIFLAVCCELTGALNARRHACGNTLLIWLHLVGGTGMKEAITPWSTDDLGGSDVEARLVARALAMAIGGLPMSLCTSVTDKGSFGERAQKLRVQLRALHWRNQIDVPIHPRGATRGDLLRSREVSVHEGRGLRRVGHLEWQVPFDDHHAGYFHYNVQVPVMKAFVRPEYGCAVQLKVATPDVARPGGKSTFKQQGVFEAEFTLDRPSRVLFGGNQSLVQSTLSHWATAPNFGAAGEGVGSAATTQEFKDVTDRSARGATLVMDMQIEVTGGRRMQIYADGGRVSCGASYSCLSQQA

SEQ ID NO: 980784 - protein, 230 aa, Homo sapiens
AAPAGLVCSAGRKWNKRSPGWSWTMAPACAKRVYRVCDLHASPISEFCSIVRRASETPMGRSIAWRMWAINRCPSVKLSKVAAENIGCWLSMSPVEVPQLMQWQSDHQNAVRRFRTKNLGIARPSLATDYFLLVSLDVKLSRMIALSLDPWHHSLRFPQGTNDDEEVMIFIDELIRRNSFISTHPVDNVNGSGNSHGTCCLYPSYAFWRSTHRVHCQLELLRVIGAVHPP

SEQ ID NO: 980785 - protein, 282 aa, Homo sapiens
LSRSLSFSVFRSLSLAVGSGRAFLATPGVHEHYLAPGRLSDPDPNERLADLDDQGIRSNPARPWTCSPCAASSRSDRSCRRPAYFSAHDVIMEEYEENKTCIELERNHSRASPEYVSASEIKRKDRKIWDQNHAGIGRKRRPIRTEDTLPDPPEDTLIQNELRDDVRDQQTELKMSAANPLTVRGTYSHGQVTSDPYESSQARENELICQPPAIQTSQEMTGKLNKQLEEDAEEMHIARKGQKRNTRSKEGKGDPRRTRVPDIREKEAKQRTPEERSKEEER

SEQ ID NO: 980786 - protein, 243 aa, Homo sapiens
MVPGLLATLLLSMWPRPVSVPLCDPCGPLPCPCAPGPCAPVSGENALECIVGLDVDDANGPLTRRTDTDERVEDVDGKSRDKDGETDAGQVGATSRDATDSVRLDGRGKRQDNGKTLASSDMRKTRERAQDIDSAMHRTTNRSARAQRQNAKTERTDNEAESSPHGRAQTDTAMPGTEATDAMDRNEGLHQQQGTHQQRTTKEQTEGRKIRAKALKDGEEDQKHRSHTLSGKEDQRTRTTWEN

SEQ ID NO: 980787 - protein, 308 aa, Homo sapiens
LSPGWSWLSGAHSDAGSQCTDSTQTCPRLLSWTVPASGTPGPLLPPGMWPAACDWDGQLRHGHWSPWSVTWLGACPDAWNLLKECLPWTNGHPRGDPTGGMWGLPPDSWRHRRLQQLMLESSSFVDSDEDGSTSRLRQLHGAEHLIQTHPEAQTAGEESSAFGRLDRASSFSSNNRSSMSLNISHCHAQHGKTITFWPSASWGRANDRGRWRASTVGAPINEGAGELWRCVTGSIQARVDMVAAGDMTGTFENIKRWKMPCGCLQEIDPRRRITSCCTCWDKARDLTLPLVTGAAYRAVFTALKASED

SEQ ID NO: 980788 - protein, 503 aa, Homo sapiens
MAVAAAAAAGGNPKVLSPDYECVASYSWILVLSCVLCAECDVSLDADDPELAGVQLELGVEPAGGVAMSAAELHCLGAGTPCVAPAPCPDCTLPAGDCLGWTDAANHGMAGSVKPRGGTMTVVAQMRPGERGNHRGSRVTRTLRPAGHPEGTRHQDSRGGKQSLQNRGRRKQQGVTAWLREELHPGRWATRTAATCDSGQSFSAEEDETVTVGPLNAKDGKARGDSISDSAYAIRIRMETGGVTSMRNTDPSGSYRNDIRGEQQGTRSETALEFGPGPHLDIGRTGTTLPITGANEDGNDQDETRNRQADNGVTSRKEEDEQGTHGRGSQEHQARRAEERSEEPDVEWGGPQFNFPSERDEQTTEAETKGQAAPNSARGTAGREIDEGPGDPQSTDGEQLRSAHTDTLCRETNESRREANEVAARSSVTEKVREQTRKAMRHEHRPQDTPTEKETTSTAGERKDGVRRERDERQRDNEEKKERDDSDNQRHEHSEDRHTSHAD

SEQ ID NO: 980789 - protein, 169 aa, Homo sapiens
MPVGKRWEDWRNCLGMQKGMNHRAPGMSQSQRAREHRKYSVGSDHIETREDRNREEEQAQVGNRSKIDTNIDTDNGIRGPFAAERKALDYTTRKGTEAKEHMQIGRGYTGCRHREATGQMPEHRAHKPTGLDATYHDDPIETIYPGITEMHPPRCTERRTYGSHFGRPE

SEQ ID NO: 980790 - protein, 107 aa, Homo sapiens
MGRYSHPIDTLGIGTFASPNFMFVDTHMVELDRDFRRADYRGRDLERGIHKGRVAETFLYREFFSEVCAGQRNKLGPMVTGFRKGIRNRTEEKRQRFPTLGTTRAAT

SEQ ID NO: 980791 - protein, 136 aa, Homo sapiens
MTPPPTAAKPHDKQKSQEQQKATQETTEPRTQETTTETNKSTDRTRQKPTRQTRQNEHAPTTQTHAKRQKGEETSTNKEKSRTTQQNDKQHTKEPRKKGIETSENKTRDKQTQNSRKTTANKTTKTKTTKTTSLKQ

SEQ ID NO: 980792 - protein, 194 aa, Homo sapiens
MTLRDAPDQGPVRWLKTTVVCKCFQAVVSSCRVVCSVRQQESSWRTRDWGPHLQRFSCLNQRDCVDQTGTDKARVRLDKVGETGRSPLVLHRTVDPKLRRNTLPYHRSQEKEDMHHKSLNGLDTTGCTGMAPHRRSGPAVVPPGELTRRNQAVAPSKRTRHRRTTSVQIVDQDKGVQHNAKKHTEEEDKHETYQ

SEQ ID NO: 980793 - protein, 93 aa, Homo sapiens
LAGVLTAGLLDLTPITAWSLGKGEPFWLGSSIGLVQSCAVYGTVGGASLCKHPAVVNEAQPCKTGIAGFLYGFEALWLESVVYTLSYSVESGV

SEQ ID NO: 980794 - protein, 289 aa, Homo sapiens
SLREELCEEFLAHARGRLEKELRNLDVPELVALTSVLPDVLDVHLTMEAVVLLCGVPLPVCAGVPTRSCFACPWAQHGADEAVLAFCPCMLGMPAIFALVWSVLAGCSDAGWWVTTHLLVLGCSDLVPPVRFAWLPVGPAGRCLGSAGRCHGRIVELSWPASAWATNLQGLRGELPWAALTDCPAGRLASTSALAGNGGALAWDEFAWTSVVSSILEATIKGVSGQQVATFSRHKEGVLLQTKHYFRGEFCSQGLSVTCLIRGLRPLYVPEGSEILRVAFGEGACKPLG

SEQ ID NO: 980795 - protein, 176 aa, Homo sapiens
GKLGDSRLTREGSTGWGSGPVVQWVQPACDAEGQTWLAAPTDGNETRLITNGTIFCFEMDPAVNEPMRDQVGRDSFERGDVPNSEVLSIEKVYQNQVIEMHSDLRVLDFLGHDMVESVAGQEDMLSMYLISSKGLIIRLEVRFFLGELCRRAVIVYPVLDRCKRSLPTCWVTPNIQ

SEQ ID NO: 980796 - protein, 331 aa, Homo sapiens
GAKGVAEPEVFGNEQAIRPVNGMRLGRKGTPPGIGYPSVNTRGTPGRRAKIEALQSMGKSAERNLRVDFHPLDRRKQVGPVRHIPWRTEHASFPGWTARHSWYERKGNCRHARLMRCCPNARFAWDITLSRLSLDQGLPHLEEARLEVPRIPASLCVTALITLGHSMANYTCLGCKVDHVPRHAQLQPTFTPMTDAHWLGTFSIKGHAAEEDAKKDHGLIRRHYVNHRMIAIGGGPVQKSFDHLAEGQVRDIWRLGSLDTELSQSLLPLWIDEIYIPLNEFDSEPVDSFCLGRERNPTHFRDDEGGKNRHFFHSWNLDLDLYSRSSYSLLP

SEQ ID NO: 980797 - protein, 77 aa, Homo sapiens
GCTGFAGATCEAVLCAVSLRRALGGCVGMWLGLGVLLPVLVCAVCCVMVLLRSPVPLPLWHVLPADPAVSPVLPGLP

SEQ ID NO: 980798 - protein, 110 aa, Homo sapiens
RQMELGEENGAAGAADSGPMEEEEAARKTRTVTIRVSRNGEDELVGRRGRRGATRTGHGGMQAASTCPADAAMQQPQQQLLVAAKEGRWVRACVPHLAVLLVTVWRLPRG

SEQ ID NO: 980799 - protein, 96 aa, Homo sapiens
MGREMKTRTKKPTTLGLQHLAQDNARWSPLTITANTHEDPLTDATHQDTRKRAHASSHKTERKHEHGQQRNTKQENPNSKQTTTPEQENRRQGKTT

SEQ ID NO: 980800 - protein, 292 aa, Homo sapiens
SLPVYFNGCMFLGRRRVDFPLCSESKHKSDYRQILFYSILASSTCDEEKAETVLQTSQRCTLYMLCRPVSEPYQQQMARRWWCSITVKHEQNIDCGRRLCEAVILIVKDQTDMHGDSEYNIMSGPDICGPGTKKVHVIFNYNKGKNVLINKDILLARMMSTPTPVHTDCAARQNYELNLDNRQVEYGYLRTTNGTNCHPSKIKDPECLQNRKKWTERPRYEEPIRNSQCSQELGHKAGEHNPGTRECYQAPMTGTNSDVTCKMRTTRGIHNLQSADYKIPERRRHRVKAPRT

SEQ ID NO: 980801 - protein, 374 aa, Homo sapiens
LLLSNSPPPTCERAAVNCATPRLPNVLRLLVAWPDCCQHSPGAPAMLRILGSRRGAGATRLRVPEPAAGFSPIPETPCPLPRALQYESPGPLHEDDLTEQEKGLLLAPHSPTMSEDSAGLDHARRAPCSDTENTRTQENTFPKGEPDLKKESEDGQVIPVCIREAVRQVLKGYDVDAGAHAWERVNWSRKNKPDVKRPMNAFMVWAQAERTTLADQYPDLHNAELSQTLGKLWRLLNESDERAFVSAAAGGAVAGHHEVTQPGIKRYQTAIGRNSCLKIVDTEAGHTDEDTVYAEMEKFIATQGHITTVAGNADSGQNYHPPGIAPGAITRENSLEPSSGPPEHKQSTRKPMYSIDGKYQRTPQSAANHPNPQT

SEQ ID NO: 980802 - protein, 113 aa, Homo sapiens
MLVRPALLTHTFLATTRTSCDNRLPRLEGKRVWDTRRRVIAICGSLTRNVHVDFADHCVNCLWHLTTPVKPPTESDALGSPRAKPFLIICDPHIRAKRVSKTCWKLPQNTQDL

SEQ ID NO: 980803 - protein, 269 aa, Homo sapiens
MRTQKATTEEIRHVVSMLSEEALYFMDGCGSHDRAFAAYVQGCSCTSGDWPGSFTESIIPTNGRTTLGFEPGTVDRRSPVTYCEPRVHSCGNSVRMTNLPVVAEIQVAAPTRRVPLGERRRHIAPLIAGLDWGTCVAQDLPLCAYRSGDRHEDHPIVTKEVRRTGAYRRSADVTWLATATVTVGPINVKAIELEKRISQICEVKRCRGSRVVKINRCNEVGKCCRWHVNTVVANPEEEYALEEILDEHVRNVCKNDGDIRKVYNKIEHR

SEQ ID NO: 980804 - protein, 146 aa, Homo sapiens
GVSVEMNGWALVTGSLDPWEVGACRGDACCAACPVMHWLTAWLSSSCLPALPCPAAVLLLLCPGAWAAHPGLGPQPPLFVVPLCCVVSACWVALSHEDFHGPKGNNLGSLKDAWLGKSMNACMHIDNITQIRRCHREAQWLMHESM

SEQ ID NO: 980805 - protein, 237 aa, Homo sapiens
VCGVGVVCVCVGGGVWVLGVGGVWWERGAVVGWGGCWLFLVFACGLPCSCGGLLVRVRCGSVGVCYGEVLGSAVRSVRAAFLRSFGCGHGAGPGRFSAFAMVACAAWQRAARNGTLTCRSRRRLVGGAWAWRAVGCRLGVGGAARLVCSRQSWCLKRYWALSSWAFHDGPAQSGLRPAATTVDRLGVFVDYEAGVLALVDVTGGMSHRADRAAPRSRSRSCPALRLWEGAISIPRLP

SEQ ID NO: 980806 - protein, 190 aa, Homo sapiens
MRFHRTFSYEVVVYSPVVQAPWNRIVQRIRSVNQAPGSCDAFQTPAHRIWLFSPKVGLGTARQSTPVYWGAQEGVSRLVIPTKSFCPSEVCRLRREVPFLTSFSWSWPAGLRKCFDILPWKKTPMYRVGLRATRTRQVVFPNEELITQDGSGPVRGTRPCRAALMERLECALTHLFSGDVVEVRKDFDLW

SEQ ID NO: 980807 - protein, 216 aa, Homo sapiens
MVMAPRALLLLLSGVPGPDLSLCACSHIHECISDTCLLSLCPGLLEMPLLHLMCGYVDDTQFCAVRQRRRESEMGSLRAPWVEQEGPEYLGPGDTEGTMLPGHMADPSEPAGTLRWLLQPELRTGLNTPSRGCLAATWGPTGRLLRGYDQSAYDGKDYIALNEDLRSWTCVDTASQITQRKVGGGPVQAEQMRSLPGGARCVSGSARYLGERGRRR

SEQ ID NO: 980808 - protein, 268 aa, Homo sapiens
MSDAVRPNEVYCTETLALSLVSGAITCPVFSCELTCSWDAGLQWEGPVQTMAFGQAVIGLRAQGRPRYCLGMKEFPCSGLGPHTCECGDMWTAEQTRGLRNECAVDVGEHDGAVASDETRCVMGPKRQADLLHWMYLWRPLHVTGMLCQDSTPSEGPHKYPSSTCPGTGLDALHDITEPLRQAIFLPRWVLCGTSRLNCVQPRGLLTNEQTLPSYISRYLCPFTCQHIAERWNCAKLSSFPRWALIEAIWGGWLQPWITNTRGPGDLS

SEQ ID NO: 980809 - protein, 137 aa, Homo sapiens
MGLHWVGDKRLLGEKYDQFCVGGHCIDTCLWREHIVLENLNAWIEGHWKIPPEGTERKTIGRRTRSTDTTNHSFGPHADQNSSANVVRKDSSTTTTHMSGDHITREDGEQQRDTDNADKRDKGETNETNTKWRQQER

SEQ ID NO: 980810 - protein, 201 aa, Homo sapiens
VKAHDPGNLARYRGRLGSTDDNFSVFLGDGGVRERYVPRNTPGILAYQTCSEAQSYRMTNHSKYDEVDTSSKEILAAKPWTEGSHITLSTAKYLQLLCSAEDGDACQIGKATGDIDGWVLDAYAKVEWVDRPMDPFMGQIKLVDLCEGNCKTRSKMARSVADNHGITMRRGNSKYVETWLHKLCVAQPFDKDSKCRCRVNR

SEQ ID NO: 980811 - protein, 390 aa, Homo sapiens
QEPGRYRAPDGPSAVGVKLVHIPWALARYTSQPLTVRYATRFTCNHIRINHLKKAIYACYWRPGVAIWGRVFGMETDLTVIVISGDLRCYEDLHQQGGAKNANYRFDERVNMEYYQTASLVRFPAWSCAGEYDPACCVNSKPNSDVEGNIQYFVELMFTNGLHNSHKPIRGENATSHLRISLEITKPKVGMRAEMRSLSIVFIGLEEKDNFDDKTEYRYSSGMRWGYGNLGCNDSVDYHAQVEEPVVLLAIMTMTLIVHGSTHALWFVKQLQWNNEKDIRDIGVRRRCILDDRQNIAVNRRSSRWPSISHKGDATSVKTFPIYLTTHGWDTPPLVLFLSMGEHLSLSSIYSGSFFTTGAKLRDERELAIFAPRTNTGLNERSCSITQCVT

SEQ ID NO: 980812 - protein, 122 aa, Homo sapiens
MDSNPVDGVLRSEKLATKAHLRREETKSDECRKNKDSLNADDTNPESDQDDADYTSYGYEIRSNDHLITSNNDNERIAHIMSYHNYIQISIDMNTNVIIETAYDSNYEIMTDRPQDKQTAER

SEQ ID NO: 980813 - protein, 126 aa, Homo sapiens
MYSALGKGERWSDPAPKLTLSRWPTKLPKTSLHMPIAIIWLHPHPYRELGEPGSYILTHKEEYLHASSGLRVNLYAYQKVIMVALEESPEAPGVEPTKSGRLQSLQCLWRLEGDVGGPLDDTTFAW

SEQ ID NO: 980814 - protein, 171 aa, Homo sapiens
GLLGGWGGQSAECQRGSSGTDREASGQQLTLERDPDVLDTWFSSALFPFSALGCDPKMTPDLARFYPLSLFGNWADDTFMLFCGGPAWSCWGPSSHGHACPSAMGASSSPVVSEDRAGHGKMSKVPGEMCLDQEDIIKWGWRCRCCKEKAEKRNIWTLQEPWPLWLQDTRQ

SEQ ID NO: 980815 - protein, 175 aa, Homo sapiens
RARWLTPVIPALREAKRREDSLSPGVRDLPGQYSENPFLQNKGNHKKTNQRDQKKQKKKKKKNLVWGARPGAPGKEKVYNTHFCGAGGGPPYEDMVQPVAAKSGASPEEQPRGNTNMWAWGFLPQSKKTAGGDTRGCAVDNPRGGARRGALGGLHTQRGAQGADQKIKFNAASGD

SEQ ID NO: 980816 - protein, 170 aa, Homo sapiens
MDKQKGIACLNRGERQDTICVSWGEESAAPLWLTTSDPCAGPECKCVKDQWASITYEDRRISKKLFFHVPEVQAWDGAGGRSMRWQCSVILNQRRGGVERLVCLAVCEGPKAVAVLDLIGWSIALKNIHFWIDGQWFLAYWFFRQQGGPDKLNGVLVPTRKIPSKLGVID

SEQ ID NO: 980817 - protein, 165 aa, Homo sapiens
MRGDSKTVVSGKSLWVLVQEHSLTLRVSCGLQTCEWKDSKTLKCGCGEPMWGHSGNGHGDASGMKWRSKGKQLEGIQEGKTAWVDIAPAGRMNPWAGTEKQPRYEKRSNRAVGPRERFVNIISVVLSCGIVHKYTSDLGPCEKNSDENLRKRGMRRRSGFHERVV

SEQ ID NO: 980818 - protein, 269 aa, Homo sapiens
MLLAVYRQQELPWIRRCVCDLDIRGGSILPRPGMPRLLKDRHVVWEMLDAHLGLRIRAHEVRVALGGDTMGMPFDVSRASEDCAWWITGVISAPGVASLDFAPSMLQKMAVTKYSDRSMMKMPGALDWLVLKAVKTDWRRGYWHCSSGCCVHSLKYVCLWYIWRHDVMSLLDGKDKCELGVVVAVVLTWPVEKLERPVACLPPVGQGGITPRGVPTETGCNGPPFVPRNCLRRTSVKGGFVGDHQASYRAGENDPSHQYCVCAMSATLS

SEQ ID NO: 980819 - protein, 131 aa, Homo sapiens
MWGQVEHRGPKGGFPKRKPRAPRTRGGGVSHPNKKTRRRGDSTSGCLRHTPQRWGSRRALRGGLQHTGGGDQRRRMNEEKINAPRRGEETLRPQQHTSHTDTETMKKQVQNTHTDIQQQPKRRKQTADNTR

SEQ ID NO: 980820 - protein, 130 aa, Homo sapiens
TRPRYVGASHNRGGSLPMPSPMTTRQTWTTGSWPPSPSSTPGLLGIVSHIRGLYHSVAQAFPRNSHPGKGLRRGSRAPKSGRHNGLVDGHLTAVCALPKTLATGDRKTLGGTRLTFPRVCATRAPCGAPP

SEQ ID NO: 980821 - protein, 93 aa, Homo sapiens
GSSHGGMSLCGGFRLLRWQSVWPALDSPRIWGLPHSWFPKAVRFYYCIDWIPVAIFITLVNVFMCIPYQDGCARNFYDSPEKIYERTMASFQM

SEQ ID NO: 980822 - protein, 86 aa, Homo sapiens
GPPWGPVYVPVLAESSNGPKGSSKQQSEEDLLLRIQPEILSASVLGGSSCRKASMVSCHPNCVIRGNMGILDLIQSWLFCIGVMDP

SEQ ID NO: 980823 - protein, 56 aa, Homo sapiens
MRHNEKRSREYSPDLMIESEIESKTKTRKRVKREEMRAEHARTSDEDEIEQDASYE

SEQ ID NO: 980824 - protein, 355 aa, Homo sapiens
GLAGRVECCSQPLRESDSGVVVPVRAVYAVLLLCCVRCIVCCALLCINNGAPMVLNVLLCVPACWPLPALLHALCVPDVCCAVWTCWVWDDLCLAAQWTNCDAKLLTPPVPWMLLPANCCAAADAWMHSAVIANGLPLNLVHRIACEAGLLASLRCNMSKCSNDVLMCLPVGACSEERGMTPVAAVLDVSRLWRPLMLMENPVTVHQCAKWRHGNQENKALALCKAAYEGDPELEMAMAADFPQLDVTNILPGKGSDGRPCAGAAGDSHLLGEAHLVEAGQTGRLWGTHERVRIAWRKLEVPGWAQGAAVLPWGPELDTESVRNGESGGRPVIPCDESGGREHRARRSGRRDSTT

SEQ ID NO: 980825 - protein, 473 aa, Homo sapiens
QSACYGGRLSPTVDGSRVGSQGGPLRRAGILFPGPKSLRIFSHGLSAIGYSATQACGPLCCKYLRLRTLPVLEGRHLVTFCMADSVILDVSVDDHGAIGYHDVDSHAEQSSGTYGAPFSELTTYALSKMSNLLYALNRETISMGTGLNKRWAQARFIHSPQIQSFRKWKPKNYLARRIPVQHASGGLVNAVAMCHRHSEPCLVCLENRAQRHTWSPVSSDTLGQLESIIGVCCRSHEPGDLNPTGGYGHVARMLMRGIEGVGRTFVTVGITGEEPNEGPALHGTCPKAEGEVVLFGGSKHRDGGHYFFTCSFLKSIMCKRKDLNCSRGREQRGTAPQRGPMPPGSWTDFRCRGKFEKQGIERPVCVATEPPHEERGMWFGGPMPQRCVAGEEMHPWSPRCDKKLKKIARGIPGERESPLFPKRHVHQTGLRTLFARARTRGASAKPATMRHATQLESTGPAILVIQQLVRNKA

SEQ ID NO: 980826 - protein, 260 aa, Homo sapiens
MNADVQCRGCCMGIYCVGANGVLHLLMGYQGMVDRRLKHLQKACLGELSPAILQSVAGLTQFVPVPRVPKGLSELRGKAALNVHALANLLAARESPSLCVIGGDWGAFTGANTSSAKGQVEVGKLEDAWATENGQDQIHGMGPLQKVYRRYPSKSWLGRFGWGLQFQNTWNLLGRGQRTIGNRIRDHVTPGPVVKEGYNREGTDREANIDRKHMGAHQRPPKKEPYTITLGRVDWGRDNLVGVTWSPGDVAFAPWRVTDM

SEQ ID NO: 980827 - protein, 324 aa, Homo sapiens
LSGSRVPASQRAARAPPPRSSSSSFHPPPPSHRHPRSPSHIQRLQPHSPNIIRRYTSMETRDPSPPVLLHIHIPYPLHYTITYTHTPTWTIHDHITIIHRDRHTSHEEETRNKSIEVTPHDNTWNTRKTMNNRVQSSRTICANSDNKWKEIRTTAGRKSVHRRQTKENNQNPGHAEKDPPKRTTTKTERQEEHPRDTRRPNSGHTAGGRTNERTRFRTIGTLTTNTTGQPPDKATQRKPPRRQHHEHEMKQQGSPATEERTSTRSGERSDNERHIHKRRYESKDHNNQDCKRHNQFQELTKVHSTHKEQGTTTQGAATLSTPEV

SEQ ID NO: 980828 - protein, 356 aa, Homo sapiens
PDGEHTRRGHVAVVGEQEDRVVLHARSDDEYREHQQHDDRDHDTTGCDGGEPSQHHDTDGKVRYAIHSALTDQSTPFQSSVEGNQPVEERQVQEKSPGVGLSEERWIAGRESLEDEICPEQHEHESGEGPHPGQPQPDESNGGAPGVCTRHRRHVRVGQDESAEDEEEIDPRYPADDRWMTNCVKGPGPRASTISVRKCRRKHQNAARARIARQRTESAGPTNRWIDSRVDSRHRIREGPAYRLTLAGESSPESSRVRRAGTRRSTTQFAKKTGNRGHDDRECTGDSKIDDNDGVKRKDASTTNPRNPPECQRARGDNHDNNNIVQVHTKENRDAPQDQHSVGCTQQHIRETIRSQ

SEQ ID NO: 980829 - protein, 239 aa, Homo sapiens
GQGPGGQKTGPPGVHLTAVVPWVRDTAGGHVPGEVLAGMLDALIPVMEQSCTMTQQSPESCLSLIPWDNPKVALDLCPSLEKQLLVFPGTQCVGVCNLCQALNGLRASTKRVYLKLRTFILHNTNTEGEEDVRVELQPEDTLTTDKPSYCYENIHDQRNPYAITLAAIQDDNSGTCPIILMASQGNTPAFNPLRHSDGSGLRLLAHTAAGPYDLGAKVTLEHLHARNALSRRFQLGCLA

SEQ ID NO: 980830 - protein, 326 aa, Homo sapiens
VVCCLHQCTELCPAAVPEALVPVCTAPTCGVALPVLDVSCMDSAPDLVMNCPASAGDCATWRTCLLSQLVYVPTEENCLSKSADHMDWPYWIPACLFALLHNMIYNLGRTDFRPKTGRIAGFCAPVPQCITTALEVFTHYDLLTLNGSKVAEWAQGQLLSGGHKLPTGLQRRYACANFGTEQGVTVGCWDHYRHDIDLPVSGYHRCGPRELYLPGGIVNPHYEVAESDLLNNMLQCQLKVFYGTGLGCTTATHVHSLPSADAERYRTTRHQAPKQNVSEVYTAQFLDDANTHNPSGTWAEPFRVPNSKGSAWHRTVVEALNVTSPK

SEQ ID NO: 980831 - protein, 175 aa, Homo sapiens
GVWLMTCVSSRWCETTPKPRNGYSRVNQRTSDFGEEEGILMVKLEDDFTCRPESVLQRDDPGAWKPPTQNFLTFLLPGGSNALDEGSHQTPRTLSTMWLETMEADKWSMILELLVLEQFLTCHYLENYMSLWLRGAKQPEHVGEEAVTLVDGYAEIKPVMTNLRVGLTCPNVHGQ

SEQ ID NO: 980832 - protein, 217 aa, Homo sapiens
MRVGGLLTASGYWVPVSRAAGVPWAKPVAGSLTLGDVGPQGPRSASGPVSIAVVAGWKERLGLVFQQRSVNVPGKGSWAALGRPVGICADLAIGYIKGHPSRSINPRAGLGWRRPLGKSGLPEESVSVLKKRIGSCSLDRRGHSEEGQFGCICGKERAQVQTFVQCCSLVGNHCRDGYQISVCLPWEDERRGDLVGKDGTETINGKLLATDYLPNKS

SEQ ID NO: 980833 - protein, 289 aa, Homo sapiens
MGWNGVARACGAALLLVAVALSAWRRRCRAHDVAFDVLCRVASCIPSPINVGPVGTNILCIVHLLPLKGVDHNEQLADESGVTTEDHQHFTCTILDGPMVKSYLYFTQFKAECAGLRLRLRYAMAYSKAAFDREIDVPLKTEDIGSDQKQQWLTGPGAFKAELSKLVIVAKDIGHLSCDQQPVCGWTFSSPVKLNGPVALKVSSTITWFSSERTLTFSTLGLLLPWSRMCVLQWWLKPLGHETRGSRALLFPKVLSPLLLESSGSGSNLGPNEVATMGVCRESLVPDSR

SEQ ID NO: 980834 - protein, 297 aa, Homo sapiens
MHSQRRNNNRVLTRSGCPARIARVTTPSDSTLDRQQHVVVLINKDIASRCVEYENMVTKIRAQLEETLSAIVVQSVDSNLVSIYDPSKEPALVFFRRGIPILYHGEINDDEILDFFNDNLEPAVKELSDDNFEHLTQASSGATTGDWFIFFSSAECTVCQRLYAVWESVGGKLKRKLNIARMNSLESGISTATRLGVLEAPAFIFLRQGKMYKYSAKQYSPEAFVQFAEKGYTQSHPQPVPAIPSAVNEFLGPLQSYFAAENITSLATLSIFALVALLFVGKRCQNIQFRACETISR

SEQ ID NO: 980835 - protein, 96 aa, Homo sapiens
MAGKYHSLGAIELPAHETSQRGIEARVTERKHSRPKKKERITPSPPGVVGNPEGEARESQGASKGGSLGKSPVDAVGPQKGGHGKKALGISAHRGI

SEQ ID NO: 980836 - protein, 156 aa, Homo sapiens
MRFAFRCLLLFFPTVSLVQGVCVPDVTIREVVAFSVPCVFLRIRPLYTPLRHPRRFGEPGHVPSQGLVRFLGPPGTRQDTLVPGIAYIGLMRAFIRVYSDLSFVPEISSVRGLQWFVNSLKWPRTLNSLPVSCFVLKIDAIRRGSFSMIGAAKCDQ

SEQ ID NO: 980837 - protein, 358 aa, Homo sapiens
CVVSRVVPAVARVGAPGWACRVVDLGGIGFRGPRRGEYSLGLVSAAGGFSGRLSGHLHVARPAGGVGAHRGVQGSLRHGRGRGRLSAPTAARRLVLARACLQWRSMHPILAAVVLVALVRTVHLGLHKLCGGARFNLSAGKLLLLAAVSSMAYALLQVLRRGSNGLRYSSETLGGLQCRPAVVAPQMDTRMGATLPVDHRGKFACASYRVDVPHQRHGLSGEFSSISVRSTSSLIFVSPFLSDEGCLDARQRVVSIDALPEARHSCLEGHAPSSSLLMNLDPSFLSTLLGPDCACYLTTHTHTHTHTQTHRHIRTYVHTCTTSDTHTYTPHTHCISVPRPSHWSHLAPSSGFYIEEFY

SEQ ID NO: 980838 - protein, 40 aa, Homo sapiens
EDACQDEENQKRCQDLGAFTESMLSSVPLTYHTLTAHSKR

SEQ ID NO: 980839 - protein, 372 aa, Homo sapiens
AAGRRAGVCLVLLLLGPLFVARILCVVFPWSSCLNVLSSALLACVVSASEAPGVPTGSSAGVSYGPLLCALFGVLRGLDSFFAAVLEYSWHSYAMFLVCVCDTRLSLVTRWGLRLLRHQPGRCHVRLSEEIDPLARVHLASQGTRAPRCGRSTSSGRSLRRYEGACFALKEQRISRSPYRQGGCSCVRRRAPDECRRDQTRRSILRETVARDVVSCGLSHHRRYAGETGGSSHPEGGTRVLAIVRRSYARRVVRALQQPLFEVEVAPRCMTPFSCWVGDTAALPLPLWNGKIIKSRFLPTLLWATRALATTPHTHTHTHTHRHTDTYAHTCTHVQHGYTHIHTHTHCISERAPRTGSHLHLLQDFICEEIFI

SEQ ID NO: 980840 - protein, 183 aa, Homo sapiens
RCGRTHMGPGPTHTLNPPLTRPGPGDSVLPGPRDFSTAIEGHEARRAAMGRMPHVERFQGNLTWSSSELTARATSRPAPSADMPAFSCLEDRGLRVDISTVSRKRGPPDEERRQGCPPGLADFSGFTTKWQQWHMVIRHTVRPASPDPSQSSLAVATDRILSQARPECQDPEWPPAKTAEEGS

SEQ ID NO: 980841 - protein, 282 aa, Homo sapiens
VEGEVTGQAGGGGCVVASDAWAAGEVSRDGRGTGGDGEMSQAEQGPRAGSERDSRPPAPASPSQLWRQLEAIVRIAEALRQECSCSPVATEADVEEPLRLFQVSTLDAALSGTTCQGWRASPDTGGPGDSAEPASTKQLKRRNGHWLPGVSSTSIIKDVTKQKYPEHAIHQGAAASCLAARPRLQHCACERQRFYYAPQVRSHRSHWTHGLAHASPLLPLPAIDNVAGTSASIICSPRIFPGTTPFSTQTEGAVSVLLPLVTRHLAQFHREMLFNILAGARL

SEQ ID NO: 980842 - protein, 287 aa, Homo sapiens
GSCPGKTEADVAPCCNDVIDRLTKVPRGARVCQPGTGTTGDGADRPGRERLNGCRRAGSPDAWSWMRKRLVIRPPCRGRAQRIRQAAQQLTLLVGSATGAGPLPSAGLPQTNTGRSSSRRWGPGFTSRAAAEQGHISVLRWWGPGSPAPEPRKGPFPPPDLPWPVTAVTVMAGSVPSAQSVDALESPGHLALEGPSSHQESALEGNVYYFYREYFRDLGHGWLLPPAMQTCTFLLDSRSPCVGRIPGPMPASIDGAWLVSCLHLTPNSVNAGYGEPWWSIIEIGYRS

SEQ ID NO: 980843 - protein, 164 aa, Homo sapiens
MELGGLGVHESLGSTVVSQTGVLKTSRLEALGFLQVDPGDRGVGLLHYRQELGPRQSQSCKLAHGWVTCPVASMSHTRKEEEGAAKLKAPASVGQHWRRPRQWGEASQVPCVTNGGPRGCLLGQHVGHGRASRLATMEASGKSWEAGMAHCQAAHSDWNSRLSK

SEQ ID NO: 980844 - protein, 237 aa, Homo sapiens
MPSFKGKSWRDPTSKDTARKETGFTGREAGSPRLERKEEYKSPAPAPEEEMDANVSRRPGLAESTKAKDPFAHRPKSTFVLEEIEAASISNEDTLLCGYCHTFWEHFDKDGWSLMVLRVSRSLRELTQTFMSCDLITGMFPATGQVMRKNAFASVILVRNQQSQLHFWSLGLPRPGACLSAESRLAGGLRVIHMADTRSWQRGDPDRWLDEYFLLSVRHDSIVGQSLQSRARSYKRT

SEQ ID NO: 980845 - protein, 242 aa, Homo sapiens
AVSTNTIPSGPGGWTGKIGETGKRAPQLLGREKQEDSTPCLLTMVWLRDSPVNAPGAHGEGPSIGKPQYSALDRVESTEGLTGGHQASHTAREVARGAETHASTAEHWECQPSKYWPVRRLVVRAEPPGPHCPEPMHSHSLLPWVGEAGGHCERLDCLPPRVLPLLAIALISDNLQECSSDGNYLEQFFVFVFVFVFVGGGQLNKHKVFCVRYWAGQGSCAVGVVFFSIFLLVFTMCCLIMI

SEQ ID NO: 980846 - protein, 333 aa, Homo sapiens
VPSLPGFRGRSSLRVCWLPAWVGAELRSVCGGLLCSLLSACARYPSSLSALCVLGGALRVWGRALSSLWRPGLRWGGPGGSRLAFLAVCRLLFARWVCPSSACRCGLVAKCGFVLSFLRSLLLCLLCCVRPVSAGAVTWCSGSGGSLVGGGRRWAVVNARVVSGLVHVVCLVRGLRVGAGPLVLVERVGCSLLCFRLRSAVLSGMGARVAVCAVSWRCVAGGVTVGGSDCPMQACRWGVCWPCQGMVASGLAARPSGLGPRRFCIPCVPLAVPDACGLSVGVLRVLVSRCCSAPCASLVFVLLAFVWGGACCRGEWVFRMVAFGCVAAVSWGC

SEQ ID NO: 980847 - protein, 178 aa, Homo sapiens
FFFLVAGVSVCLLFFFFFSCCVCFVSCCAVSSSGCIVLLCLFSILCVVSSVCSSCVFSCLFVSVPLSVVFFFCFFSLAFLRVLSLFLVLSLPAFLVFRWLLLCCCLLVSCCGLPGSVCWGRFLVVLVSVLSLCRGVCLVWFGVLSVVRCCVFVAIVGVFACVVACGSSLCRLCFVCLS

SEQ ID NO: 980848 - protein, 49 aa, Homo sapiens
DLQECTRLIWKKDTISDTSGDFRKLMLACQRLEDQRMALSSDYELIDQD

SEQ ID NO: 980849 - protein, 203 aa, Homo sapiens
LFVSLLIRFAFCFLAVGCCLSVAPCVLLVLGWFSLFCWWLLFGLLRSCRVISILLCVLCPSFCGSVCAFLGLFLPFNVSCNVGGLFVSALGVLVLLGVPTISAVSPVVVSFLFSVVARCVFYIGALVSCFDCFGFFLFASCVPHAGFLCGGPRFLSFGASSLLVCPCIFSLGVSWSPLILICVLTLPLAASSVFLCWFVGYAG

SEQ ID NO: 980850 - protein, 116 aa, Homo sapiens
MMIDETELGTFEEDPMMFKEMQMEFLRLLPRSGVQRTDHGVNCSVHLARVHSDSPAFSLSSSLGLQAPTKPDNFFFFNTLSFRLHVHNVQVCYICIHVPCWCAAPINSSFSIGYLS

SEQ ID NO: 980851 - protein, 360 aa, Homo sapiens
PCVVADFACRYVRCAFFFLGVLFFLSHLSLCLVLTIWFSAGVVVSLIVYLLPSKAFMMVLRAAMGYSVQGGPSNALSGHKFNFSSLGFHSIACSSSPLDGLGKIEGLGYEAVPMYMTVSPCSHESGQDPVSVTFSLTQVRPLPNSFPFEVNYEIPTESAMAGSLSMLSLLMSGETVTTSCGEPSPWKGNSQSSSALGKGGPAGDDQQRAGPGDTGLGGEAAEASTTLADSPGFPQHVPRSLVPPPPKAQPSRISDVQHLGNGSVRLSPPVHKCPQDSWVAAVGMNPVLQNCAPGKGGPEKVTMYHTPKKGVGPGVGDTGSFFGSLTAATPAYPKAAGASRLGPNLEGGVNLTRPNLINSG

SEQ ID NO: 980852 - protein, 243 aa, Homo sapiens
MSVSLLSGSLVLLVSCRWRGAPSALRLFSVLVDLGCGVRGLCARSVRASLSFSLSSRFGRVSAYSGFSYDASVFHLKAIWYLLRQWFAVWPLFSRVHAVIVISLSRPFVVGRLCLLGHLFCHLFSGFSRGLCVCAVSAVCPRVRDFASCCGWRVGAMVSFVVRVFGWSVVAWVGGPLWFWMLVLWGEWLGGEWVWVGSARCRRRVVVPCRGAWVACASVPWVSLGLGRCWLLLCLPRAASVMC

SEQ ID NO: 980853 - protein, 282 aa, Homo sapiens
SGRVGSLLRGARRLVGPECGRCSRCAGGLVFACRASAFSVVFCPLGSGCRRGSRGVAGVCRAPCVRCVLWAARFSWGVLFFAYGLGVATGGFPLVGVPCFALYVVRVVFLGAFGVHGLLVVVSRGAEGGEAAHTGQLSATAPSGAAECLVSQGWRARGAGSVAAATGQSAEEAGGSRDRHFRVVPLVLYGLARVVCGPASPWSWRVLIAQARDRQINYGSGMMRSDLAAEAVAACRKALPGLAVGSWGSVALVAHAPCQWLTLCSWLRPEGVVTSTVSGWPV

SEQ ID NO: 980854 - protein, 179 aa, Homo sapiens
MSLFYAPPLFWRSLCLSRPFPIPVLLQLRVLSGCQVLLLSCSCCDVWSLFLVICHDVCSSGSCVLVCRTSYSWCGSHLLLVCSTSLSSVYRVWLFGVVVPRLPWSGVVFSVYSSCLLSLVLLSCQFFCGGSPLLSFMSPPGHNVSGSCLKSLSFFCLSSCATARPRSPCWSPGDLYVVI

SEQ ID NO: 980855 - protein, 338 aa, Homo sapiens
AGAQHRETTLGLGVGGLAAPELGELVLTTPDGLDDWWSGATLYLATEVRLMVDTGRGHAVSARHGPHRVTRHLHSLLSASPCRAQDIDIVGARCSVHESDMVCHAHEPPDTECAAVVYGQDARTGKEPAEDAMTGAPEPNRAIMRVRTHSVHCGNPSRKQWRRQREAPGGWRETTRRAPHRSDDLTPVPKDQAARRTEAISTDKGKGPATDQNRRGTEDGAGEQNDLQESKHHIRSPAQGEHTVCRAHKRIGTPPNGKTKRGVITKEPGVNDPCSPSGGITKMHTTAHMDIQLPKADDGVAQTGDTPNEDIQPRRSLSAPRNKHPNTYADTNRAQVGI

SEQ ID NO: 980856 - protein, 293 aa, Homo sapiens
GPGFPAAGPGTPAALLTLAKQEELDAGLAQRSEERCNVVLRPQQQDPEVPAGEWACAGGLGAPLTEDQQNWLSEEILRRSGLELEKLPLLGEEAGAPHCPVNQSRWRAPEGPQVTGTRPLEKEVQALRCPDWRRWLSPRVEAPQRCTEDPMDGIGHIPPGDTSHKERMVTRSLADDGSSSHMQVHGGAARGPTKREHARDLQPRRQGGGVLDCGERQGTGPQTHMNGPEQQGLVQDRSLRQRRLTQGDGLLQHVARACTPGKPNAVRCGVTDNESWRDAIASSPLQGLLGEWA

SEQ ID NO: 980857 - protein, 296 aa, Homo sapiens
YKIAVLVLLNEMSLHRRGAAVMPHGCWLDGSTMLLHAPAAVAQILHLSKLYNVNFEESLIHSVCQHSCAGIQQIDNLPLALTVLQFAHVHHWHTHGFFCIAPFQHFLSSCAHIEHERRVQQEPHMSVRSVIYDIIVRGRPNCNPSRGRYNENRVFHISRHDKIDYTIAVGNHVRAQHTLQSIKVNIFADGHIGGLQGTHSMARKVGAGPYAVGNSIVSTPWHPQSQPSQSPRSDLARQSHNNALGRRRDNARANTLLAILARSIRLTHSKEAEAKRVQSVVDHRIASATFSRRRDA

SEQ ID NO: 980858 - protein, 198 aa, Homo sapiens
KELSDVAHRIVAPGKGILAADESSGSIAKRVQSIGSENTEENRCFYRQLLLTADDRVNPCFGGVILFTLETTLPEGGMMGVPFPQVIKSKGGVVVASWYDKGVVPPGRDKWETTSNGWMGLSERCAQYKKDGADIPSGRCVREDMGNTLPSALAHHGGHLPNVLARLCQYLNSINVHCAIVESEILPDGDHELKRCSM

SEQ ID NO: 980859 - protein, 189 aa, Homo sapiens
MPCVQAQVWVLDPQGARTRFLRAYRCTTLRENTASDLLEVPEYVKCSMDLTKTEITAPLPLPRLRYLYGQIKNRLRSQRPPSQYQKCPWSGQQTSHKGTKTFRCTTYQRKRHQTTQNWEMVTHPGQEITRHHRTRRTNTQGYKMTQQHQWRTQEIHKTTTTRAEEITRRNDTQTRNERDRSRKRPQRHT

SEQ ID NO: 980860 - protein, 108 aa, Homo sapiens
MCLEEDRSNESDVCVTSLTCIQRQRSIKCLHLHLYVNGQWIEAHVATQIPYITESQNTKKIWKQGQRHPHREARSPGTPDTEESHESQTSIIHPPVQRTGPAGVTRVT

SEQ ID NO: 980861 - protein, 59 aa, Homo sapiens
MTVSKRFEQSDVGVYREPSGAMLVLAYEPVLGHLVLGKTENNPKGPREVHEKLRGWLKS

SEQ ID NO: 980862 - protein, 170 aa, Homo sapiens
MSQMDVVRPFEHPGMYVAIQAVLSLYASGRTTGIVMDSGDGSPTGAIYEGYALPHAILRLDLAGWELTELPHEDPHLTEATWFTHHGERGKSCADIQGRSLCYQFGLDFEQEMGTADSPLLWRRVEACRWQVLHIGNGRFRCPEGLFQLPPGIGLGVRTLTLLKGGAPKL

SEQ ID NO: 980863 - protein, 107 aa, Homo sapiens
MEFVPAVQYNLIRVEIRSILYKNPQAHIEGNNEVDYGDLTEQEPSLVKIINEVKPTEIYKLEAPGANVEITFDLAEYTADVDRSWAPLRPSRMQVKNSGLINSCGRL

SEQ ID NO: 980864 - protein, 232 aa, Homo sapiens
MRHPCTAPPAGRREKGDAGQQTIRGQRKGVGDGDRNGTNIDDRSVLHHSRSPRVSAGRPVTPTAGGYPRKAHTKRHPWESTHPGIITQATHTKGDLGAPTTRDSPLVRGRIATPTYPHKDTRHNHTGTHPIRPYPMGHTTTPRPPKQTRATPVTTTDPTRGDPPPKDRGPPSNELGHPPAPNGGNVTTTRRMSTAPHRAATETTPTTNGTNEDRTPKVPTQRRRPTAAKPTT

SEQ ID NO: 980865 - protein, 468 aa, Homo sapiens
PTGTTWREIWVTTLFYNELRCGHRRSTQLLADPGGSPPEPLMAKQSKKIDSRVTVLMTLSTHPGHCTDGQSQDRAWSPLSASWALASIGYLIYVELLETGVDPTNGCPSYEGYARVLPRSTPCRSWNSWLGSGAPVPRYDLSMEASIHRRQMDSKTFTNSNGSGKRDHSGSRGTIQRQASLVALLFQTSWGPFRKLRAGWGASSSMRSPPIFSILGMKGRLSDAGPAMGPSGQFTHKRQMMAGLPEMLRGGGHAVVSQGAVACPVESWDDPLLENFPTVSNPTPVQTFADPMQQVVDALGNPIPGEQATPGYWTKANGVWPVTRGPGTTQPNGEITGGQWPVTKVNDKNRDAISRPLGPPKGHPTGQEFPPQRIPAAPPVGAKGNSARVGNGGGTNSQGALTVPTHFKSNEWWEFDKRKGTYTTKRGAHPSEPNREQASITGALDEMRQHTGGQDVQRALERTAPAQN

SEQ ID NO: 980866 - protein, 81 aa, Homo sapiens
MNIALGSKLLVGSGTLGEVFLGKRWGPKTKINTDTRMAATLKSLKLVRYRAFCSPSAFGAVRSVSYWNVSSTQHGGQDPPD

SEQ ID NO: 980867 - protein, 391 aa, Homo sapiens
QAFICAARQRSSKAHIQCMHAGQQAQQHTGAATAQQASINSMHAQHHSPKHRTAWWSSSMQAGMHQRVKSIKHTQAHTLKHSIQQQHTSPLHPEQAHSNQAAQDLILETPGNTLTCTIPPPQKSSHRQHISSRQADRPTTHSTLEHRHLTYWTRSKATLYYLGHATRTQIWHTSHARPFRHQSIIYPSRYGETIPLYCTLFRIAGTTTGTGTNKATHNQSTDTLSTIRCPEPRLVLLYQYPNWGTNAVKVAIGTSKTETPKQCYIPYQNFTTYPRPRSLEVKEHNFSRGILGLRHKTNIRPHPDEAKTSGSHNRKAKEITITTHNAQHKAQSKHHRTTLTNTTGHIDQADNKSTYRITHRHTGSNVKKAPISHQTMTSHRARETNQHNSER

SEQ ID NO: 980868 - protein, 291 aa, Homo sapiens
GARCRGDAGLSRAGGAEPGGERQRGPGPETPHETVYSGSIITAIDCQTFGSESLGCDPAHSVKDGQTEIRTMVIYPQTEQQQQQASRGPGQVQSMQSSAVHSSAGKQPVHPMTMAKQQFCMARDRLYRTHEGDHDLILQRAADALPQRRQCQRPRHHHEVCTPNTSRNASLLDHSDGQRHNQGIPGPDQVETGVYTKKSILNGNPTKKLGGPMQTRDQARQANAKKGSRTNTILEKHQAKYRDDTATQDRIERTVETLDPQFLDYPTIEGDTWETLTLPKAGNERTFESLT

SEQ ID NO: 980869 - protein, 158 aa, Homo sapiens
MAKNVHLKICALIEGLAHMLEGPLPGKVLSKPASGSPRCQDSSFRHVFDSLVHLPIRGLSGKASLLGLGKTQTSKNVELLWWVPKRMTPGKGNSSSVCPVAWNIPVMRWQLMKGLSESLQGKKILLSTTREPAVLIKVLPENMAVPKRECVLMGATCA

SEQ ID NO: 980870 - protein, 352 aa, Homo sapiens
MLPEVSQFRGRSGCVRGLCSRAEEPRGDKRLLLFHICFVEASLTKSSLITCDAHITQFSSSHTQLPSSDKFAKYRRTLYKEKNTTRHINQGNVSITNISTSAFVLHYISIMCEDKNLYVDTTTERSESAQSTRRADEWSSRLCDINNIFFLQKSRRTKKIITPTTTVFSNHNKRPKSNPPSDFYSCVVTVYVVLKLIYIKQRKEKETVSYENDAVEKKYDVAHRRKHIWAYNMGAGTQREKLKHREVKKETFMAIGSKIQQGRISTRRENKQKQQHIINTTNTQQYSTKRTQWADSEATRPASGGTNKKRNGAITDTENISSQRLEREAIPPTHNYRAAPKRRITIIRRCNP

SEQ ID NO: 980871 - protein, 276 aa, Homo sapiens
QDQRYHASPEHRVQEPWRGSYTSEEFARAGKQAGLQVWRIEKLELVPVPRERSRPTSTSGDAYLVLHTCKTSRGFTYRLHFWLGEGVSQDESTDAAIFTVSDDDYLGGKPVQNMRTCQGVVSSNDVWFSYCQKAGLKYKVWSALAFWIRSCSVRTTLTGMEAPTCERVVVVVRATGSSPLAGTRGRARRDLLSVHLRLCAPEHLSVECGFPLRRGNYASVGTGNQVEYWIPAQWKGEEGLEVIARGRRECTLENGTKAKGETREVRAWVGEEEMLQ

SEQ ID NO: 980872 - protein, 45 aa, Homo sapiens
MITTGKQPDEDDSSEDLYETRLAQRITPRETPLIDLTRGKKKQVR

SEQ ID NO: 980873 - protein, 261 aa, Homo sapiens
MPSPHNRGPGGQIIRLVFTYASQRRDQRAMADESRGPAKTTSTSPAPSGGPRGSPDLYFTQFKATRCGAPEIEYAMAYSKAARGNGKVMSLLKTEEFEVTNNSSGSQARRHSKHELSNAGDLCAKGIATEHVTSSPVCSGGTFFMLRAKLVRGLVSPSHKGQQHLLGFLARRLLNLSTMGCTLPLVRRGPRRVHEALGQRTRGSRAHPGSQQLLQFTTFLMSYFWTSGSQIRGTKRVGNMRATSWGKQTMHPPRPPAEHPS

SEQ ID NO: 980874 - protein, 70 aa, Homo sapiens
LPIRSTTTSTVARDLKMRLHLAPADYALETVQGHHRPTELSIQLDVGNIGDICNGERPRLASCPRADTTG

SEQ ID NO: 980875 - protein, 285 aa, Homo sapiens
EEVNADLAARRTQAGGRVKELKKDIDVPGAAHWPKLSKADSKPHEQQGASNHDGKSMAAAWHESSGPGMTKAEEGNCKEAHHTGPWDDTAEPRRTKCDERMTKSQSSGLDATEWRDHGNASLETGRRSCDMDTGDGHTAQSRRGDHEDWQQAVRWTACCIKQKQTAERSKLKKEGLRAETRLSHGGWKTSRLIGGPRMQKKDQRSCRHQSGGAWKKETGRQKRDRHRTTVERQQENTQRARTSKPLEEKPDTNDRPRKKARTRNNTEREKAQGHASKRKKTKQKK

SEQ ID NO: 980876 - protein, 50 aa, Homo sapiens
MSESLKKEQEHKCTPGTDEADAGSVTVRELQARHEEAVQAALRGGKKQVQ

SEQ ID NO: 980877 - protein, 134 aa, Homo sapiens
GPIGVAETHAWCSSDRRWEEVSRVTWHLSQRRGPEIVPHSFPWAAQFNGGRKLGVSWSAGQQHIISHSRPRGEEMGSASRPSVPGRAPGGPVHSGCCGSRCVGCMVLVTGAVSGPLRRTLGGTSRLHFAQDVTL

SEQ ID NO: 980878 - protein, 291 aa, Homo sapiens
EHKIPCPYALHGHSPPSCTCPRWDWEFLASTRLTSELNFLLQDDRQLLPHGTAAGRAPKIERDRPGGITERESARSSNAEGESPEQNLSRSTGAPGDRNLLAKLYLALDVLILLLSAVPSPTVTYYATQKQNEFTARWARPRRGGGAGPAVRVSCKLPSVQCSASSPGVDIVLLCVMNSSPRNSSPLIPQSNYLESAQVAEERGVGHPVWNTSGCLQERAIKSSRWLIQESDSVTVTAVWLASQSTKGEGNGRNGTGLTRLARRSTFTSSFLTETGRDRGPWAVTTTNTSS

SEQ ID NO: 980879 - protein, 452 aa, Homo sapiens
ASSGPRSPDPRLSPGTLVPSPRRSPGRPHDAHAPTEERPESETEIHGRARLTVGDLTDNRRTRMMDPPFLGRHVVRQPAVTWTDWTALMTDQRLPTWITACSYIIHEHSWRPDDIWKTYTVANIGHIETMMVLTCTVDAHPHSAQRATQTALIHTQLEPPPRAQPRLHAHLPAHPPPLTCTPQPPTPRTPPRLRRTNNKPKSADTRRKRRLHSAQRTNLTNKPQGRPPQIASSRTHLDYEVTIAPRTLPTHRSKAQTSITLHVLTSTHTPIAEHTYASRIDYGDRKIDATIRLKCNNDTEKTNNTAHTSKHSNSCLRTDAPIDLTHEEMSQEAYFADRRKALPNPGHQHQTTHTTAARRRNTLNRDRNTEAEIGSIVEHKLVQPRRLTYTLVRTYYDDTPRDLPPSLPAHLTQTRTTDNAIHAQTSILPKHYTGLRKNTAEKQTSRDSQHDT

SEQ ID NO: 980880 - protein, 74 aa, Homo sapiens
PHPPRTEPMLRGEPARPRPLPRPGLGPGPGPGAVAPVNGWGRRPVIGGPRERRTHERAKDGHITLAGWWMRTEG

SEQ ID NO: 980881 - protein, 235 aa, Homo sapiens
ATLNYTLRDLPQVLPGHRSLPHGWLMREDTEGLGGSPDATWACCVHCLYGYWSYPTARAPYRTMKSFPAAVDPYNILTIAWTGRTVVHVEPLEHEMSLASSSKGTGYACAARKPPKSYSLRGGLRNAHGRREQSQALARTKLPDKPWALILDRTIVPRFVGPLDSLGARPRDLTLDGPSGPGGNHGMVLDLSLEDLGHSGATPTDSYGNRFCRHLEPIPKGPPGSFLGNRWFTDI

SEQ ID NO: 980882 - protein, 266 aa, Homo sapiens
MRIGFSYVGAYVSFLHRIRSPQEPLSEFYCALGLPQRYVRTEAYRATIASILEEWNILRIDVLRHDDGASQVYTVTPSNIEECLRHLPECSCVCRGRIPGPPACSEKAPDMSSSRGISQLLGLRWLTQEPSPWGPIYDNDHTRYRTLSSLLTRTLTNTMVCLNLDPTAWTLRKFLTLFPLPEVPLGSSSAWLSSCWPLLTGLAVARLRTCIHCFNTKPKVMSIRAKITDSSSWYHPAMSVSTLPFITRYPQPWLGFHFSSMASESH

SEQ ID NO: 980883 - protein, 265 aa, Homo sapiens
PRPLGSSKVPRPRTRSHIPMTSGLAGIRHCKRAVRSSWGKAAQKPMHPFEEPESIECSGGERARVVRRHSAQSHSQHRKKSLRKDIESLGNEDADRNWPRVRQQQHKHSAFSSWYEIEQLKKPHVYGMQTRTTENCSRATTKAFLGSCGAPTVRQPQHIPTRVTFQTNKGLAPSPVPQYIPCPLPNAKCLHALGPPKCLPLTQSINVSKSIINRCLYLDLNLPGPQPTPPMSADFQSVPNSLISSLAPCFDTIFPQPPVTHRGVR

SEQ ID NO: 980884 - protein, 423 aa, Homo sapiens
LLCGVGAGLFALAVGGGAVFASGRSLGLAGYWLCLVVRRFGVSSGVSVARVGAGSCSVLPGRFGGPSFVLVGPCPVLVARFRLFVRRRAVWCVAWGLRATFLGGGCVRFFVACGAWALFVGVLGMAALFGVLVVALLGLGWVVGWLLSCRAVVCVASVRVGSCCPWLCRVLGRGALPVGPACLVLRAAARDAFWAFPVGCFPWLSLLCVRPVVCCAGRPLGRRGEGRAVTCSECLLRLRAPLGRTCLVPSGTVVSSELDGLPLDGEVYVVPDVVFGMLVDVSVLGMAVCLRPCFPAHVSARLGNRMCGTGARSGVTLRLSQGERDQVLGGPEGAPSVTESTGCRELRTLGWRNSWQLDQDATECYMNREEERYNDSMLYRAGLTDQGPGVKTGAIWSTREMPVIRFQEERRLSELAIGKGALG

SEQ ID NO: 980885 - protein, 33 aa, Homo sapiens
MPTAVHHLVPRPPTTLPPPRPPPLNTVRLGIYA

SEQ ID NO: 980886 - protein, 269 aa, Homo sapiens
SNKDEGNLSQARDIGGTSKTTGTSRTRTRRPLRVGTHEKVNPEAQETRRGSMGASGNHSRARYNISRVETTARGRRIPEHGGPKPAQINVLRKGTYRFAKGPPAWYGTATRKAGEETSPLDCVQYRYASFSVTLNIVQGIESAEILHGSMPLPAEGDATLSMTVSLRKAVCPRKPAWRSHRPGCQPPAQRCASCATQPSLPAGSAPDTEGWPRGHTASMCLVADTNSLVSGPAPQRYHAWIKKQALGRFPLICWGIFAALLMSCGPCIS

SEQ ID NO: 980887 - protein, 104 aa, Homo sapiens
MGGDSGLSCLLVRVVCVCNIGNRFPNRLVCAPREYPRLVSWAWVSAGECCEGILLGLVRLRERVELVRGSVCDGVKSLLQPLGWSLRFGGVSSVWVTVLVGLFG

SEQ ID NO: 980888 - protein, 107 aa, Homo sapiens
MQYSVSRRSSFLNAVLAAWCMSRSEMYPKLIVVDIRKRWWSGVLLASGDLPRSPKFCCCGHPECQYDSLSLQPQFMFAPESVAVTYNTSFSHMSFISQVLKSSSYHR

SEQ ID NO: 980889 - protein, 341 aa, Homo sapiens
SGETNEYRPDGPRPGLRTNRAFEHGQAPGRLRQGEDPRRLPCPPPKKGNLPACSDRLRTRRPEADKPLARGHQGSPRLARRDQYAPSSEQLRTPPKYQPCPRRGRRIVRKYRQLECHRMREELTSQRDLIGRRQVPSEEDERRHTGGSGDEAPNAFLRGNPRAIHKPTQARWSTSSPQKPPTPEESKAAVTSAPGRYIHCRGYSQKDRTMGRKILPDTEYELEYGEDTYTGSQISSRASTSFSIGEFPVDERRKLIRYVTAFYGELEDYMSDRVQFVITAQEWDPSFEEGLMDNPSLAFVRPRWIYSCNVKQKYFLTSSMWCATGLKMWLTHTRHTHTQTH

SEQ ID NO: 980890 - protein, 78 aa, Homo sapiens
MGLLVPCISRYIGADIYEARLLSYPSCHIAAVTGSVYPASSALVQIGENKAPSSVGSRSEYSHMMLQIFLELTTHRYI

SEQ ID NO: 980891 - protein, 84 aa, Homo sapiens
GPKKSDHRESLRNSAAPVYKRAPCDNQASRERVFAQDFTASAVPIRVQVATRTAAYPVSVHPPDLKEESLLYGPSPLVYARGNS

SEQ ID NO: 980892 - protein, 152 aa, Homo sapiens
MSHSADYQSSLQSMSPTLQEALGRSHCQPSLLVVYSALPASDFLTCDPRLSLKFLCRAYWRPIHTLWISFLPVMTVVDCKVVYCPWWTHYSRHLSICPPSSCIATKRLSLGVGSTPEKDSDRVRPTKTVDCTTLVFTKKPTLCVSESDCIQF

SEQ ID NO: 980893 - protein, 287 aa, Homo sapiens
FRTAATIQSVAFFSLLFSLPSSSVLSSLILFISLPSCCTSRSTSLSVFLMSSIVGLPRILLRAAPICLVFFPPVPLVPPLPRCTPSLLSCAQPAFEGPCQYLAAIFPTTVSVRPHVFQEGLPFPRGSCWTASPYPARTSSKSIGADEHPGSVRSLLQPRVRDELSFREGESVTVLRSDGPEETDCCCSALHGQEGYVPQELLRCCSHRVKPQEEYNVLRRIEGVFLEADRYQALPAGPSQTVCPLCFVTACVSCTPHACLSVWSVATGSSVLLRKLHGNEESGPQTF

SEQ ID NO: 980894 - protein, 128 aa, Homo sapiens
MVWGIAQIAYRCLGRYWPSYVGTEEAVHLITFRCVCIADSFSRPSKPSLDKSDYNMVDISRMSIREKHAGKLYTRNLSRDYRGHQENVHPHVKLVQPRVELIQSVMDHIAGDEDHTEWSHSALSLRRY

SEQ ID NO: 980895 - protein, 477 aa, Homo sapiens
QRSGVCAGCRLSWCVLVGPLSLVVSSGCALGGLCSRLVDVALVRVSVVSVCPLRGVWISRRWFFRRWVCSCMVRSLWGPSSVERGVVRWLWPRVAGGVLVCGGCMSVGRAGLSMVAFACVALGCHCASCPGGASLSAAHAPLLVGGLLAGVPDVIRGCTPGRPPADVDASRRVWGDLSAGLCMGVLLSGHDASGNVDCLWGELGLVAAWGIGEPGFCPVLRHGGESCARLGGGLDPLRCLPGVRCMETVRRAVPSEGRVAALRPMDSTPRGRPAYVVADKVVPWSRRVLEVRVGSGEGAKCHWRLVGVARVVGECLVQGGRGPWRGHLTGWRGWCLSLVLGGPSGIVRGWQKGAGRPVVARVRSDALCIRRVMAPRGMCRLKGKDPHGYSAHACCDEECLAVTGLCAVVHGNTAPLGLAPVATRASMCHGLAFVSGAQCASSVPALLAPRSSSVRVLGPSPPGNHRMRAWHRGTVGS

SEQ ID NO: 980896 - protein, 253 aa, Homo sapiens
MPDLRDQAVEAHTEPLVSGTGAAAGVGEELRTFVLGPLGAVSAQGVISPDRRFMVSGGFIADWQHMPAGRGCPVVRDTLRRSSASPLPASVVEEPQGEDREAERASRGPQTGECMRDSPWERQQKRPCPEVHLLRPRRGTSRDEQDGDCQLRQNPGQRQSPPEWVPYIVPAGHVQSQRKVYPQPPLSDAYLSGMPAKRRKTMQGEGPQLLLSEAVSRAVKAARSSAPDEPARALSRDLEGTRGSGELQAAAPV

SEQ ID NO: 980897 - protein, 98 aa, Homo sapiens
MSHSSNGPFVKTKLWLYVDVLQWASDGRKLICLVFVHFTKMAAESCVSANCDANAGVLSGTKMTSLDLCCVHKISGKVKNNPFYGLHSLRVYCLCKRA

SEQ ID NO: 980898 - protein, 279 aa, Homo sapiens
MSGVYVCVGVYDINRLPQCSIDYVVICAYLAPVDECPRAALVMVQVWRPGASMMSGKGNPRYRISCNCRVSGASFRPPTMGSVDLARRPSHSAISSLMRGQGWKSRSLLPAIQAVEMPLHVKTGNPVMPLSRHMTAILFDREVRCGHACAVVSHACDGLAFCCPVSLCTGFRVACKPAQERHRRCVTPRIRECRLIAAAFAIRLAQVSEHSTLLKDVSTKAVNSPEHAIQHRCCSSLLAAAARVQHRMQRKVLYRLKGVAPPALDVMDSAHCLRPAPAS

SEQ ID NO: 980899 - protein, 105 aa, Homo sapiens
MRVEVIFAFRGPWDRRHARLKTPGPPRILCRCHVRCLLADLHGSFGIIGRLVRVCRSEPFYITRSGMCPRTPRSLSLPDARALHLLVRSPISCVGSGSAPSLHPG

SEQ ID NO: 980900 - protein, 277 aa, Homo sapiens
MAEESKSLCVSPMCNDMVLLYSPLVWNGTSHPQGLVHKWIEVHTDGALPAESDYQVLAPESSCKTKSQESFVRFAPTNLIARIVPILENSTSAYFSARSGRASLRAYHVALSEMAPHSVDLQCAQGCTCLPAHACGLVPLAGVSHPALPGLAASAPRYLRECGSGTIQPHTSDLSAPDDTTSLPVVSDPSVIMPGQEARAIGPGSADRGHLAGSFDGLLVLASLIYRTQLYEARLLSYPSCHIAAVTGCVYPASSARVPLVRMSPVLSGQQVLSTLI

SEQ ID NO: 980901 - protein, 265 aa, Homo sapiens
SVFFDPLVSLTLGSLRVVCLFLHAGGNAPGKTAPCIPKMVRPIGSGLFVRFALPYRFLPPLVHSWPQLPSPASPLDLLDTSVPGGARGPPPGFLDFQGVQATAQPQTTSSQSLRLHPHQVDGHTHVQPVAKLSVRVPTERPQVACTASERPFACEVYVKAFCHISMRLAEHRRIPHRRTTLTSCPDCGKSIPLRSSNPSGSTARPISSKHQAAVQASQLAEAEARTGGLGRHREDMRVGGATPLVVSPLRSYPLAEADGGPDQLV

SEQ ID NO: 980902 - protein, 127 aa, Homo sapiens
PLFGVVLCRCCGYAYAPQVVVPEVLQFCSGVVVRVVGLCMLIACSFRMRLRIALGVYARSGRLLAMGALTGELCMIRVPLLVGGGACELWDATVAICVAYCCVVTLPRCVVFCMGVFSVLCRLAGES

SEQ ID NO: 980903 - protein, 97 aa, Homo sapiens
VLLVFSVGGRCDVEGYGPFLGVVISWGVPWFSACLVGGSFVLPLLVAGYGLGCIVEGVVGLAFSYGRCCQGAVLQFGLGRSYAWVVCRLLGRACAGC

SEQ ID NO: 980904 - protein, 66 aa, Homo sapiens
TSECAPGRVAKLVPVADLRPRAVCLFPLSPPIVHFTRSGDHRRLIGCVPPVRPKVRMDKTASRSVD

SEQ ID NO: 980905 - protein, 244 aa, Homo sapiens
LFPSVMVDLFSLFSFFSWYVCFLVLVVVRLWFVFFYCVFSLLSWFFLSSSVLAFGSCIADFVCFVVVSFVVCVMAFFSRELGSRIACGVLPSGPPNRVLQTRVVSPVFSRLSLVVVYEILRVLDIELNDALDRMRCFESVFRLGPPQRASWATLSTRWSHSDFLQRHPLLHLRRWGLALPSTTTLSSSFPGMTTGIFGLEGGGPHGPEGLQGVRPWTTSPSKSTRGRERPSLLGSTATLSPPPH

SEQ ID NO: 980906 - protein, 106 aa, Homo sapiens
MRGAFHPRTYLSGNGGQPLSWDLLEEATHAKPVPLGPWDLYPPSAPCGLWGGPLLPKSLSSLLDVSTPKGGRPNSSKGWPHFPAYPWGTLFRGSIESTRMITPRAT

SEQ ID NO: 980907 - protein, 147 aa, Homo sapiens
MLTGRQLATRCELQKVQIANLGCDLLSLAIEDSQRYKKGRVIQERALVRESEGFEEHVPSDNSVKIPREIIVFTRSSFSENKNLLTLHCSPEHQRSDNELRTDVANLTMDLCLTASKVWFHHTGVSEYFDRGYPLTFAEGLRMCVST

SEQ ID NO: 980908 - protein, 68 aa, Homo sapiens
MLGAIRQHNNLTRQDASTQVVAASSYESTVICCVTVLAARHDNKRTPCMSQTTHADTSIEDTSNDSIR

SEQ ID NO: 980909 - protein, 191 aa, Homo sapiens
ALAEQRQALGVEVLEFHNEPDERLIYYTICVTTPKRTCDPRTRLLTDVFNQTDYGLGNGQRLDPDKTNVLIVDVDIITTFWSLLTTDYHGNTHSRQPYDNPRLLSGSVNLLRPYPYNPGHTGHTRPHYLLRDHDTLFIRDDTTVGLTRREDNLTSLITHYICNSDSTKDTRPDARDTLSTRSFLLTAGTLY

SEQ ID NO: 980910 - protein, 284 aa, Homo sapiens
MNDFGKSPPNKSYGTSRMEPSERTSNNGMMLRQRDMGSNHLCTEVTAGDHTVATGIVAILAPTPVGRRTNPANSFKGLPYTPSMSNISDNYCSCDAVLNESAPQVTPTIEDQVNNIGVQRHYQCQTNSLCTGQAPLCDRSKRLVCAPDQPNWEEDTMVKRTNVPHKGKYEHRNETKAHTTKEWERQRTSQTRPDRNNREQEGKKHQQQHAEELEHQRHTTAARNQCEKTKSDRTRTAVNEGRARGRRTHKTNAGTTQDEKTQQGDADQACNKGEAESKKMSRKQ

SEQ ID NO: 980911 - protein, 269 aa, Homo sapiens
MALLADVDTLLFDATGAGGAGRLPCLALPEALRAACDALCKVGLGFITNNSSKTQADYAEKLRRLAFRGPRGGPEPAWRVYGTGLIEHGDSNCAQVLARRPPVTEVHTFAGKAQAMCREHEGQGGFSKRCALSPTHLLARGPLENAVQERDETRKLAPDDSWTMTRERKKDEQKQGRGDLQNADAGQRAQDDNRNPVKKANKRDTEAGPPGEAQRRRIWNPGQRLGRNEYRALQGTRETAGACNHAPGHRAAPVGKQLLRPCQWVGTKK

SEQ ID NO: 980912 - protein, 102 aa, Homo sapiens
MAYRGSEEEPMRGTPRVNNTLGEDMSLGKCTVPSNSVYHDRIAYKGGSKPLLAVGEPYNCLKFKAVLRSGSYRGGDGIQDIIGKRPRCISPIGYMAFLNYNS

SEQ ID NO: 980913 - protein, 111 aa, Homo sapiens
VTTCWMPSANMPWLQGDGNVTRKDGNASGYQRCLSALDWVLPGNLDQHDKALGSLPTPGCLTRSFWRYWYCTCWAGVDDWCTQTRYGGSPLCSSQIVSNETRYPLMSKMHA

SEQ ID NO: 980914 - protein, 102 aa, Homo sapiens
MTVTHVSNHFWSQSCSEVPHDDQAYWPFRHTQQNRTETHGHFAVQPLDSPARYSWANPVSTGCLHESHNFDSTAVATGSLHASRGRLQHAFPLTVWPAEHLS

SEQ ID NO: 980915 - protein, 38 aa, Homo sapiens
KTKKEKTRKDTRRRKEKEERSKKPRETGVKRHMWASRV

SEQ ID NO: 980916 - protein, 214 aa, Homo sapiens
ADTDLQRLGPAPWRPPGSSRRGKLEMNGRKQESGGAHRHSERGQGAGRHRGGCVLPLIALYRFRRGKKLDPKEWLWLLQKFVTRVTNGALTGENQPVALIKDCGANCVVGSWDTLRKKKGQCVYGGEVQIDAGWAKKVCQCASGPRGGTRRDNFGLDLGEKKRIRLNRERAVAIHVGKQGVVLRTAKTKGSPLGQELQRLKGQLERARGPVRGH

SEQ ID NO: 980917 - protein, 104 aa, Homo sapiens
MRGYSLEEEVVSELDNGSSLVVSCKGLEQGRPVPMMPVWAILVLGKTEDTNKARMYTTEAPEDGEVPKSRDADGLKSTRYTYGGLCDWGTLKELDRQTDVDGTM

SEQ ID NO: 980918 - protein, 274 aa, Homo sapiens
MGLQGDLNTVTMKLGLCPHGLGPLPFPWCALGGPACYWLPVLRRCSVRDLSALMESSCHTEDDLTDAREAGFQVKAYTFSEAFQPDCVLWLADPPRSSPSQFVEGDLMVLHCQAWQDWTTDRHVSVLAEMAQLWVPPGLTGNSRDRPWYKQADSGQQHCRWHLPEPVVLGIPEMGSVVANHSEEAVSSADPQSCNLSETQAGSPLTLKWSDEVGPAEVRMALSFLLQGWPVVQSKGDHASRICKIRPGVQKSHHGCHTGLEEALRPSTFGNEAP

SEQ ID NO: 980919 - protein, 291 aa, Homo sapiens
DELVEEMEHFGQWSLWQAIKDNRIQVGYENVPHIDIHMNQIGFEREWYKFLLEYIAPMTEKLYPGYYSQAQFDLVLGRPLQACMSSPHCMPQHDASTFTINIALNRVGVDYEGGGCQVPALLDCSIRAPKEGACDPSCVLVLDSPHYHEGLPITGAPDTSQSPSSIPNWPGLSLWTFLLCRKHCKQALGPRCSRNQCSLLAVDFPVALEPASQRDATEILAGDGGPHLMVGSGVFGPALGRIPACFGWPGLHLGLNGAFPLLRGGLATRVHFQNVWDRRSAVQLLGSQHRA

SEQ ID NO: 980920 - protein, 250 aa, Homo sapiens
MAKSQPHRNLPPPGFKRFSCLSLPSSWDYRRLPSMPGYIVVLLRRTETGFLTCSGRAASSNFLNLVHPPAFDLAKRCCDYSALCQPCPSTKDQTGAIYDYSPFVSIMVTWSILSSSTKTLPLHTMCCYNILALTHNILTGVENRVCATQHRARTSATDGKGGPRPLKSRRALSTHPKYMPRTEAERAQVTAPHDGGMEQRGPKWNARRTKNAGQEPDAQPEAATNHIARPGKSPWTPETHPRGERHENPE

SEQ ID NO: 980921 - protein, 285 aa, Homo sapiens
MSSYFVNPLYSKYKAAVRRGAGGGHQSHLLRLSLRARGRRPSRRRRSKPCSSMATAPPVPARAPEAHAHPNPSPRLRDWVAGVGKAGARSTSTPAGQPGVATRAPPFSSYPQLRGNSPLGGYCCHRGAAKFYGYINLQRQPIYDPRRGRADPISDCQSSSGNMARTKTINQESSPSIGCPDETKRSYRRKTQKDPKVGLHIYVDKKLFNPNCQERQNGLPRPYLRPRSTRLPTRAATAHRPLRPQSRTGNINQGDSAAQPKNTDSCHGNVHENLREHSAPCSALG

SEQ ID NO: 980922 - protein, 309 aa, Homo sapiens
GLATLCTGCDAYCRRFDVQMVLLTYTMFVYSCLCYWMILTLCCSGVDEERGNCLLYLVPCTLITASVCRLRRKEMPQRSGQGEQYQLMDHLDCEQMKKTCDSGEQMVPANTILWTCLYHVSSISLTQIDFAFLTWTFLDWDTSGQELFNDLLANPYIVIEPAYLTVHSHNLTSQLVLNVTVVPSPFTEPTMGLCTPPRTYYLPDIFSPTQWLAPHAPGQFPLFIRSHETVRPRQPLGSSHLIAGFHPHGTLCRGATSLGTPGHSFHSYPNNRMHGPRPVSSDSASDNLPGPQKLTAVRLPYTVTPITSP

SEQ ID NO: 980923 - protein, 113 aa, Homo sapiens
RARSTSSEQKMAVPPTYADLGNLPGCLTKGYGFGLIKLEFENKNLRMGWNLQAQAQAKHLRPPKVTASLETKYTDGLSYALHVYHRETGIPTNYTNAPGDTCGKISLPVHPER

SEQ ID NO: 980924 - protein, 123 aa, Homo sapiens
MRHIGANRGPQENPGPAQRGVVSPKKTSARGDPSRLDTPKERISGHTGSPGEQRHRIIAAAGEKPNPATNADNKHEESNLHSHTSAVTELRQYHPQRTNRTRHLNHNSQIPHHDNTHSTASTA

SEQ ID NO: 980925 - protein, 224 aa, Homo sapiens
SIQSTTLHSCPHDSFPTSIRLLMLSSSPGDISDLSPATTWIMTRARRSLGAHCAYPEYVKGTPDTHQAHIALHHPRHITPNIDNVTTTHLSSTTRHQHRTKQQTGITSRNAHSVATSGPTPTETPAQTAKQADHRPDGETRHRTQPRTRTPDTEARNEPNCSPASDHRPHRGRKTKTKPRATSTKHDDTAPHDKTNDDTPGHHRPTPNAHTRNSGARTTKQDTE

SEQ ID NO: 980926 - protein, 258 aa, Homo sapiens
MGGTPSTKCLGYFSLVGLLLAALPVEGDYYQAINVLENIELNKKSMYSRVPECQVNHIYNVGLAYLMIASCTRMPSGSSPNILLYIQGTKSMFQRTTYKYEMINKQNEQMHALVALPSRCTPCVLDESIQPPDCGSKIWGQRCCGMQEMVTHKSMENFSGNILTQVPVAGSCPNYDYVQPNYGKKSLSWTQLKVFLLSNSKRPAFNHPQVPEALTACFGKLGAPGPPEQSTEPVCLKRDENSLNTRIQPDGNTRSSDH

SEQ ID NO: 980927 - protein, 319 aa, Homo sapiens
RQYTSSIILKLHINPDYENFYVRNWVLSNTALLLTYRGEGGFLEVKFLSQTFDHFVVNFRFPWILLFDYLMCLPHIHPWLAKDLHNLRQTVISTHLQLDVTIASTLPHGTPCAPVYNQSFALHTVVHCQRKTLDISGPSSVGPARNPFGCVYLTTQVTFWTDTYFLPLIKRYSQVPCGRTLRRCAATLLKYFPEPNDTNAVGQNFHFTRYCYTQLQSDTGDYEKPAMIYTWRLKVTHTESELSLTDIGLPTRNTHACRDQCVTFPRNMHRCNSFHITRPPTFDTLRASEHRCKSPITAVLHTHRLTATRSSTRLNTSKP

SEQ ID NO: 980928 - protein, 149 aa, Homo sapiens
MVPQTTCGFKWTTIQSSGDQRGKSLEDHRLTQKILAITRCYGPPILPSVTQQFTPIMAPAVAPLPRPTTTLCQQHYATIVAGKIMLPPANTIHVPTFGTRHTAAQPFPTKHKWLRAAPYSAPVSAPINNPPCCAQAAPSHVLRGNTTDV

SEQ ID NO: 980929 - protein, 90 aa, Homo sapiens
VGNPDVLQNGVHRFGGWRELWWMRVPYVDQGYECPWVCGKRLQRWCRRKLACSDLLRTTVSYLTAPDYSAFETDIMRQMILIRLACPKHN

SEQ ID NO: 980930 - protein, 207 aa, Homo sapiens
QRKELNKSINPDEAVAYGAAVQAVILIGDKSENVQDLLLTRRDPVVLGIEDSWRCHDPTHQEEHHDPHHSKTQTFTTYSDNQSSVLVQVIEGERAMTKDNNLLGKFDLTGPPCARGGPPKFEVYFSTCDRHMASFIVTARREGRTGRKTISPFTRTKGRLSKDEIDRMLQEAGRVPSRKMRRIATESRQKGLSPIPSKLKQTVEDEN

SEQ ID NO: 980931 - protein, 208 aa, Homo sapiens
MLFMFLDSTSLLRPPSNAKNLHSFLQISEHPALILLSTAFDRVLVSFFFLSLLRHAVPSVLTRCCIPRRHFSCGQHTGDSKITFSQVGDVLRALGTNPTNMQRSGNVLGTPQHMKEWMPQNNAWHNSAYDASHFQQLGQATYARLVAGPGVLTTAPLAPVMLADTPHVYAPWVTPVATRTKWKSDWQVQKIQWCVNTTFVVRISYWWV

SEQ ID NO: 980932 - protein, 222 aa, Homo sapiens
PQLRSCGRPGGLCSCAVCSPALFPSVPALLTPGVTVTTPGGRHYREPSSGASATKEEAQRADRRITCGEEPAAQAPSLKGGRQEGTRRKPGAVVVLLLAPVCARAPDEGKRQIAEQPDLGGACCPFPLGREHSVSPQGGWSCPTGVSSDACLERRFARPVCSTTSPCVKTNALVGKKGLKRRSLDQKKNFHRVARAFRSAPRYPLPVLAALPCGANSLCTPR

SEQ ID NO: 980933 - protein, 294 aa, Homo sapiens
RHDGASVLNTVLRGSYAISLPRFSQSSGSPPDLAPKAPSEEASCPQFPFLLIRMSPGNLWNQKHTRRDMVLAPSGLTTAAPQGWCTPTADSEAHVFVGLQLCESLPICRDPTSHVDFRNVKLCGAIVWPKGYHLLCSIHRRLCAAAHAVDQGHPERQAHGLLIYQIPRLPTATLIQYLSWGCACYSATPHLLSVDPCTMYPLTSTAETTGRFRGFKRFFHMSGPLCMPVPYKQDCFHATAPMAETACNAGGSSDPVDDGVCRWHWRTLHRTTLAHLTGRKSTYDTGPCHTATHI

SEQ ID NO: 980934 - protein, 113 aa, Homo sapiens
VRGGCGVELLGREPGARRRGGGGARAQVWWAAGKAWRGEPERGPAVAPDQKPGDPKAPRARPEARRMTGAQGNNPPGWVPHKAPGRGHIPVRDLLLGRSHSESNFDRQRRSPT

SEQ ID NO: 980935 - protein, 216 aa, Homo sapiens
MVWTDYPYLLIWRAQQSMISELHFPGLIVWYWDSLKDINTTSVSLTRLHPGPQPTHETDPDTDLAVPRHPNAFPSYHSPSDLADLRLSRLGTVPTRLQAHPHYHPTHVTITRFPLLTHGRLTHTNSSGRRAPQTTLSHMLHQWTQPLAAHADTSLYGKLSRTPPRPHTLPSHILRLPLPSCLSHIPFHILLLHLTAPTTPLSVYPTSAPPDAPGRL

SEQ ID NO: 980936 - protein, 230 aa, Homo sapiens
SQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRKELTSSGGPTKFEIHIVAQFDNHNSQVWRVSWNITGTVLASSGDDGCVRLWKANYMDNWKCTGILKGNGSPVMGVLSRNSNLPSHYPVSEFLNGSLLEKAQLSQLLEYFAVCAVLGPMEASLSFQA

SEQ ID NO: 980937 - protein, 95 aa, Homo sapiens
HYMNLTRNNLARRAKAKTPENQTSYLRTATNEHTRLLYAKLRGTDFYTDDGDQNSIRCLGDYAWVCPRTTNSYVQLFKFCPQEPISNPLCKISTG

SEQ ID NO: 980938 - protein, 110 aa, Homo sapiens
SPGREPGRAAPSPPRAAGGALLSATSASAPLAATPGQGPGEGDSRAPELAPSWVPTVAALSPDPHATAPGLAVRVAPPGDPLPGCPLGPPELVIVMTDGRADVETVPRPN

SEQ ID NO: 980939 - protein, 108 aa, Homo sapiens
MEESLREPRCAQGTQDCEPEWTPSKTTNYRRNPGWKVVVLTTQHTQPQWCWQPAPCLKRYGRQGPRIPTWTQGHHSRTERTGTFTQGGVTRAVTKPAEASPTMSECRG

SEQ ID NO: 980940 - protein, 115 aa, Homo sapiens
PFPLAGSAEAARCLAVHCTKHVNAGSSVQQLGSASSKKFPGTPPRHRLHTRNNGEIGELSTGSQNGLGGPTMAQPKQREGPFVAFPPLRLRTGSTRELLPQRGTCTSGVALGLAP

SEQ ID NO: 980941 - protein, 100 aa, Homo sapiens
MKRRLWDSLAHVRRAYRAEIHPWSPEAPQGWEDGETPAGHPLQTGGVAQPRPSTRLPRHVRRRQARAEFKERRENGLRRLGQPGETYTKGEGRAQPQGHG

SEQ ID NO: 980942 - protein, 68 aa, Homo sapiens
MWTWAHSVFPKENPGSWHLVAGFLPQLKNARGAPEAFLNNSQWGSRKAIKGSPFHGGPGSSIIILPAV

SEQ ID NO: 980943 - protein, 101 aa, Homo sapiens
EDGGGFYRDVGCQGVLFRVRFCFSAPSAARSILVQNRLSLSAQKFPGAMAEYSYVTVYQARAQGNQDEEVRRKKSKDNEHEQRRPKMKKPSLIWVGNSGGQ

SEQ ID NO: 980944 - protein, 106 aa, Homo sapiens
MGKGIGGGNGAEDSNGSLGYNFMVFFKIYWKVQHGLEIKKMVFSTGTINIGYLKQFSESINISSTFFKKSSVKGTLIYSSVLKYSHESWSIITRCSYNVRIQETHF

SEQ ID NO: 980945 - protein, 240 aa, Homo sapiens
MWAITSDERTTHDRQFDNLKPSGGYITGDQARNIFPTTQVCRPLFSLHLWAESDLNKDWDRLAQQEFSIAYDTSSTLKLQGQQLPVSTHSYHEANPYDISMIISARYRNAERTAQYCPSLQPLPPAAPHNIIVLLRLQGPTFLPLTDANPLSAFWQQIIITTWNRQSHSSLYPFFILTHTLGLHGVILKRRNDAHDSVTLLSFRRKARFCIALYKLNKTNHSSKGFTIIGPFHHSWHLIM

SEQ ID NO: 980946 - protein, 44 aa, Homo sapiens
MRRFWKMIGTLSRAEGRMLRDRNGVPKSKRFKYLKSWDKNPKKA

SEQ ID NO: 980947 - protein, 123 aa, Homo sapiens
MSFNILAPPPGEVLFRAYSTSSSTRRPVSFPRTNIPGHATNAQAINRQHQQRVAQHQDKLIKTDKRHNPDSNVRPAHTNCKTNKTMNLHYDTELHNVAAHITANRTPDSSQTTRHLQPPNTNT

SEQ ID NO: 980948 - protein, 132 aa, Homo sapiens
MIPICPVVSFTYVPSRLGKMPKWRRQLLWIHPQRAGRRVGAAQYSQQPASGVAYSHPTTVASYMSIRLSSCSTQLLCLCNQKRATVAAAGQGPPLPKKAPFQNKQVKPKRLQNTRDSLWVDVVRSVCWTTDL

SEQ ID NO: 980949 - protein, 302 aa, Homo sapiens
RFLLPTCEERRVCFPFHHDCKINKEGDEHSSVKVYRPTEQNRGLRNNSTIYNHLIFDKPDKNKKWGNDSLFNKWCWENWLAIGRKLKLDPFLTPYIKINSRWIKDLNVRPKTIKALEENLGNTIQDIGMGKDFMIKTPKAMATKAKIDKGDLIKLKSFCTAKETTIRVTGNLQNGRNFAIYPSDKGLYQNLQITQKIYKKRNKRPMKKVGNDMNDTLKEDSMGTDLKIVLSGLRDAINHGFLLAEMALHSDTVWGCGQASRGEQFPTGNGAAENIAPLVHEAKLSGQQSPFTHSLGSAHEYT

SEQ ID NO: 980950 - protein, 175 aa, Homo sapiens
MAEDTYRQQTEDLNKQKQESSYYNMLKLKAKINTYQRWHTGHAITKKHMRRFPYLESIQNARVVQPSPGSQSNARILGVCSDNQSPQHRRNSRCQEGSTMFSSSDRTKIRHDNTDVLQSSRDHYAIQNQGGAHATKVTAGIVVPKEKKKEVCGDSWIAPEQSNFPDFKVEHQITI

SEQ ID NO: 980951 - protein, 189 aa, Homo sapiens
GARGLRAAPSQPGLRSASTLEVCLPRWLCLPRGRRQPLRPGGTYRLRRGFGSSALLVDEELPSPSIAMLARKRLCPVSHAGVTIVAKHPTCDPPELTPGLPQARDQRDVKPPMSEPVLREDNRTHRDSPAGQNITHGWQTTPSDNKAEHYARPTQEHGATGITHGEQQEHRRDTQSRYQIINKTRETSR

SEQ ID NO: 980952 - protein, 80 aa, Homo sapiens
SFFLSAVERWVPQGRYRLYATSSSSTAGAAGNGKGTGAREISRERNVQIDGLVVYQILKRLSRQKDKEPEVVKECFGVWL

SEQ ID NO: 980953 - protein, 173 aa, Homo sapiens
SIAHITRDVNYGCIIRYLHAKWRLNILYLPLPTHEGGLYTGSFLYSETSETSALSSCWQTIATAFIGYCPPVSAKYHSEGATVNSNITIRIPYMGTDLSPNESEEATQVEQVPPFNRIHLPFEFICAFHYGSLEESTSYSGNENGIKTAPRNHLPSDKNHPSTLITQLKDALG

SEQ ID NO: 980954 - protein, 111 aa, Homo sapiens
MRFPGPPPQPWGVQVRGVLINVCGCEVHGRVSLFFYAIVPGSYTHLDEAEDLITDDSYRPCVIIPEVVLCRSQSTSIRRGSAVSCFFVAGRVRYTWVSICPSVDIILEVYE

SEQ ID NO: 980955 - protein, 384 aa, Homo sapiens
LVKDRLGGPDAEDYTFVDNTRHDSDYVHRTRQDCDLTLTRPTTFDYTTLSLDHVTLTVYGLGMTVSTCSLWLVDHLAKHLRRHDVWLADSLTERKHDARRHTANSDTLASLWHAYTSHRAFMVLTRITGHLAGILAHTINDYSPDNGASPPLWDLLNALRTCTHDSRHTTMIPRGPLWTSRILSDYTAPHASLKTCIGELIFILTRHMTTDATVLTAARMHLLLVSSLLAPLLLDYLDSCTRQTTPFISAQYIHAASGQHPHTQNDKDAPLAGGTERWQPHPCTLQHRDGAHAAGRDPEQGTRHQTHATHDTLEPGHTGALNMNKGPHHHSPGEPPNGTRPTGTGRTQATPTTRRNKHRHRTDTKHPEQNYSTPSMTTTLAHHT

SEQ ID NO: 980956 - protein, 138 aa, Homo sapiens
MSFFVEVITPMDKTEKCPTHRQFQIIAGGRTVILMVLSIDGCSNDGSQASKPEGGPLRSVRRLVGSGGALRREIGGDSQVDLSGSRLRHFKPPRTCRRAGQNVDPGAHVALERQAQSRNGPGVAPPGHNLERDETRAA

SEQ ID NO: 980957 - protein, 73 aa, Homo sapiens
EEKVAGCRVRFEKIKVRKMDSEVQRDGRILDVIDDAVREDKLPYEDVAIPLNELPEPEQDQCVAPQNLSENKT

SEQ ID NO: 980958 - protein, 264 aa, Homo sapiens
VRSFGLSELVCYSCVWRSLRKPFSASLFLAVERFPPVRVQQCRAARCADEHYVLRTLSSIVPSSLLCTALLAEGITWVPGFPGRDQVTSRLPGPASGKPPEYNKWDTSKHGNHITRAPGWRRKNQHNRQQQQQTQHADTCKQEPTAASHSKWSRNWNIPKVRIIWPPWVSHCPLNAALVPLSPYFAWVTVDSATPSFLTPSYLRTPTGNVALKSATVLPVRSHGNPTRKTGSLIEPLDYFSGSLISKSPTHTFRHAILGLGPFQ

SEQ ID NO: 980959 - protein, 138 aa, Homo sapiens
GLVPLGGAPWCRLAGSFCVVSALQGRRAGACGSGALQRSLTAGRPPSGQPHYSPLEGAYRWGATLTIRLALGLLATNIDTVIPECVVGPQTMVSPGMARFRRRRWGSLLTPWAHNNRPWGAQNFVGPSKSKEVGSGIG

SEQ ID NO: 980960 - protein, 362 aa, Homo sapiens
HKWDDISKFLNRTTNTISVKTLPMHTQTNSITNITVRNYASHNAGSLPSNSRVFYGLLTARRHYLAGQDVHRSRLGHAPVTIPVSTKHNKQFSPGHECAGFLVNPQVLQSRLQARQQLPLNLEQHGGLPADDNKLDATAPPGPGETLDDGRIHVLTQQTTHNHHEHTPPTHHGPHTKSSTNHQPKTPTHPHKRQQNSPPLESETHANHPKKRTKECTPPHVKRHKAPQHPLRRRQSRKRQIWAPKTDRRKNQNSTHNAHKTDKHNAQSQPQANRPPAQSPHTTAHTTGRHPPQQESEDKATPPSKQTYPQHATPYQPTRPLRPTTTQPTTHNREHPDHQNDTSHTKLKPTSTQPHTTPTTHQ

SEQ ID NO: 980961 - protein, 221 aa, Homo sapiens
EEKMATVWDEAEQDENGEEVLKMSTEEIIQRTRLLEQLKIKIMKEWSVEITHELQAMKDNDTTENSETNQSETRTCRTLSPNVIELLDVDPNDQEEDGANIGLDPRGRARCAVIKTLRTEVLPSCDGLVDAEKAKARRPGGCEPKNSYLILETAATEYDRGVKAIGGRRRGPTEDNTVTFGGWHKAASRELLEGHCLANEHKEKFENLGSNLKRGAVEWAP

SEQ ID NO: 980962 - protein, 372 aa, Homo sapiens
MTRRHLHANTVFTGQNDGTYTLTVCCAARGASTSLSVQRFVYGGTAVTLRLFLHHDAGDTADRGYTRTDLDGSAVPTDTGPMLTSLLKSWTGICTIDDQHLSGGLTLWGHTHTLFIPIFIGSVLYTQWTNLASYITRAKARLTRAILCHFLSWDCALLGFTRRLVTKFLGPVHSLTWTPPHRSISVGMRTLNLYSNVSDMSLPLRPVVEHHNVYPEFLPRQLLTPQLDTWVLDHLSNQLHICCLYSYEKHGLLQLSGQSGTVYLLQHTMPPLDSTHPIPLHLLNSWSRHRGSPPIVPTTVPPSKGKEQLGRPQTTGQKLDTARTRRKERGTREHGDRTPSSGTKAPVGVPHKPLRQRRQDRHKTVGDPATRS

SEQ ID NO: 980963 - protein, 253 aa, Homo sapiens
MRITPNTGAAPMTKGDLEREVGLALESPLRLGSFPIQWTSQSILTASVTLAPCAREPQQPERKIIPFGGPQHNIIIHMAEPAHMRGMTQTETNTGSPCKPDTSIHHGTQADSCPGAEMHTPDHYKQTGHIPMRTPPRNHTATNHNNNDDGTKPNASQAQRVRRTIETDEREQQKARSRSRKRTQKQEGQNITNPKHNTDERTTNNGAKRASSTQRHRHATTHRRANPPNDSEKKQTPSNGKTTTNDNKDEPID

SEQ ID NO: 980964 - protein, 248 aa, Homo sapiens
TLTFSASVSAMAPSRKFFVGGNWKDEPGGSRVWGSSSGTLNAAKVPGDPECCWVLPLVPISIRPGRKLDPKDLLVVAQKRVTNGGLTGALTTGESITPCIVESNELRNATVLCVVSVGDTSRKEEGELSLGEVRLTVCWGHETVAQCSGKKEDLGREIRLGMEGDKGKDRKGKRLAIHLKRGVLSRGRNKGHRQITCDDDGAQGSSWDPMTPCGGAWVPVHRFEQRQRGPRDVYPKNVRGLARRPKGH

SEQ ID NO: 980965 - protein, 149 aa, Homo sapiens
VELKGKRQDIDLQREGDIRRAEHVDTAEQEGQSLNASGRVIVTASPAQEERLKVDMQAMWIPQREAPQGRDAGMWPITKRRGFQRGTVGHVLIDKTERYNIKQGRATCQLEEAGPYEEGAGSGGTLLSINSHNPRANRAVLIILFPPSM

SEQ ID NO: 980966 - protein, 343 aa, Homo sapiens
KYGALVNNFAAWDHVSAKLGAAEYAKDYCRIEAISHWELQSEGGQSSSPIPCLPGPAVRTFDAYTICQRGYQYASLLPDLADLGVMEYYLMDAASYAACTGPTAMQAMGDISALTICAAPGGKTLAELQTGMSAAHLAANDLYPVPRKPDYRRSFTDMCLDEIRDRNIRLRRTPPLRLARKLADKHGGETPYATGCQDGCALNPQTATTFHDEDNTIHNRREQRHSTGAETDQWHESMPKRTRTRRPRQTPMQHHTTRQGTGEKQQPTHTHTRARNNKSAPGALGHPVKKTYRHPEPGWQKRSTASRQTTHEDRQQQVQTHTPTGLEAHQQQKTTDTTADKTI

SEQ ID NO: 980967 - protein, 130 aa, Homo sapiens
MCDLHGGHYTLASKRHTTATTSGTQQRHDLDALLTHTNTIWDTHTRVGHHDDETLTRLYSTHPCGATRDTTHRTHDTHHATTCLTHPTDPFNYALIGPLCYTTGGPGNYCHKGANNALEQRPLGDLFLLN

SEQ ID NO: 980968 - protein, 101 aa, Homo sapiens
VTRVRGKSVSKSRTAGAASSPDSRPLALLGAEKGAGSSPFVSSFFSLNLLDFQLFQKFCSCCKARKAGKTGPGEGPSFGFRASGGEGIKGHDQGFANFGER

SEQ ID NO: 980969 - protein, 174 aa, Homo sapiens
YLTGQQRQQRPTHSNSRTYTVTLSTQNFRTKTYPLFYCFPDTSDTTTHDVMARISTRLLPIKPDCHLDPARHCSCRYILTPLDHLDFETELIDTYSITDGGALHHTLAYYCLLDLRPWDDGNHLQFHIGRLYTVWIGYYRFSDSSDYLYGHHHYYYYTANYYTTDYFYSGYVRH

SEQ ID NO: 980970 - protein, 486 aa, Homo sapiens
LQSTVTHRTVHTLSKCTTDSFDVTRSSWGPTVGFNFNDTVSCHTDCLARGQPLLVTTHTQLTPPTLERSCAIPMASRVTYSLTPTPGPTLHAAVLTRPPETFGLRAHHPCLHQLWPRQKIYGLTDWTGTTRLRTPPDPLRYTIHGLGQTQLGHPHTPLSTMETWSMEIGTALAPHKDEDIHWCSPIAEQAQQVDCRLMKTGTDIPPTLNATPNGQLQAPQGMAHPVAFLAETTNTGPAADGPPGPTQQQATTADHTRTADKDMANRHWGHARRQPRKRDTMNPNATTTATPAHKRAPPPRATTTVSLPPINHIPARTQQQQHHANTTIHRPERGEPRHHTGASYPEKTWGTGAHTPPPAAPPIQTHSLPPATDAHTSGPRGASHVDDHTTRDALRSTHNTRPSPHNHAPPPGNDKPGFTQAARTHHVTTHTHTYKHTPQIQPRHDRHNATHHRPPPPSHPTRSAPRATHTSDPPIVALGHAPQDEN

SEQ ID NO: 980971 - protein, 325 aa, Homo sapiens
THRGLRKDGLYVGHGIHASCSLLCGTRMGRKATITALQHQPSKLSYSIGQWLTLIKDGPAASRTMPPLHYDLSDKSINPLGWLGPHMVKVTNDIRHCCHGCVVGITRREVLNLRQDPCWMQTEAAGSGRRLDPSDSLTTMLQDEAMADFQTMDGADKHSWDHCRHRPHWHRHTTGGLTARQHASGQLGEEVLTYTRLLTPPHNHTPTTPHTRRTQTIHAAAPTAPPHNRLNTNHDAKETRAPQHGTTETTGDPTAGHHHRNRSRRANAQHATTKLLHQPNHRRRRADTHQTRDHTHDRRRAQDTKADLKRRAKRTSRMNTPPARE

SEQ ID NO: 980972 - protein, 213 aa, Homo sapiens
MARGPKKHLKRVAAPKHWMLDKLTGVLAPPSIHRVPNKFDESVSPSIIFLTEQHFKYARDRSIEVTASICMQRVHSKSMAQVRTGYNLARVGFQWTVTQHLTQTGTRHFASRSTDHHRAPLVAVTIGTYHPDGRPQYNVVATRDEQTLRVRQQQGNSRRSWMTSTDCHDTHSRVTPESLSFTGDMTSHSDLILETWPRLRDFTQVRHLVTWCM

SEQ ID NO: 980973 - protein, 199 aa, Homo sapiens
QFKLLSISANQGSQVPSTHNTDQTHNITITNLQCTSSSTMVNNGTSFHCVNSAQHILFQGPFFIKRPPVLHQSLILFSSISHFVFYHPNPAITSSTHTCQPQPITSLHIFGALLVSIVFTPHMAKVHSTLGHVCVFIGPHLGAPFSVKNNQHSTQVKRHTRHPIRAPSPSHCNQIFLAILLKPNKQQPSFGKTPVPRSL

SEQ ID NO: 980974 - protein, 290 aa, Homo sapiens
MCETTSSFMGSRCRESSSRRRPLFDVCGACKDSLGADVHDARMGATSHNATQTVGMFEDDSGRTDAKNHGPVITRKEENADLQWIIWVHKRPVTCKERRINALVVSKGELKVRHCTKGLNQLLPIVQTWLKVFFIYFLCLDYGVGRSGIILITCTLITNCLIVTEQRNVLFYALPGAVCVLARIVHDDCVATFWTAKATDLTDPLIEGPPLTGHSSNCDRRQFCPVHGRRVACKVGGRAEDGRHGLTVATIKQDEKSMKCVSPNGAIHGTPHRQHLDAGTHKRRGRQRTH

SEQ ID NO: 980975 - protein, 315 aa, Homo sapiens
TRAPAASAGLGAAVREHPGRGPHIPRPALTPEGPPPGFLSEVLCAGPRRLQRLCRVRPSVISSGSPCLGPGAQAQSPGSARRGPSKESETANWAKQCFRTYYWLMPTSSEMNCSFTKKHFSCCPDQPRSFSLKEHILARADARTKGGAFQRNQGQQVDPEKHEEKRTDGALAAVWIPAKTAFQEGPHPGLSPVKGCPQARRHTDRWRRRLGPANNPKRAYTFVSAKSWKEQPGHMTGRVTRAGTRPGWPAQRNPRPAHNAEGAPGRSPQDGAPRTRSDTTHDDNQQAPANTRQHTHTSTPEEKTETARTRKYKGT

SEQ ID NO: 980976 - protein, 173 aa, Homo sapiens
RGSGPQGDPVGGANPTAMDQSNKSLQAPRKKKKQNNRKNLLEEHATSLRKKPLTNTYDEDQLAHETEKNTVAPADGSDYEDKAGNEKRGGATTHRIIIKHPGGETRTTGLQQHKLHQRKEWMRTTNQCEIKHNERGAQTRGWTCNSIMHIPALHLEVDRSEVLTSNTNAHLHS

SEQ ID NO: 980977 - protein, 92 aa, Homo sapiens
SYDTAQTWSQEENIRVPSVAPGRSSKGELVSLQTLKYICVCLWRLGKFNMHIVSRTSVYYYTAVVHQKSGDQDSSLTSKTSTAVSCSLDGTN

SEQ ID NO: 980978 - protein, 141 aa, Homo sapiens
GWTVSRKDGNASGTTLLEVWTASYHQTRPMTSPWPALQDVYKIGGIGTCSCLASGDCVLKPGMVVTFAPVTRYNGSNICRNMHMNALSDALPGDHVGFTCHRMCLVKDVRRGKRCLVEEKMSQQWRQWFTCQVIYHEHPGK

SEQ ID NO: 980979 - protein, 155 aa, Homo sapiens
MSFSADQIAEFNGGKFVLFDRTGDAKYHLKARSVMSFELCGTNPTNAEVRKFWEDPSNEELTCQKKTEFEQFSAYDASHFQQQGPGTYEDFVEGLRVFDTWKAIGTVMGAELRHVLATLVKQITEEEVEALMAGQEDSNGSAYKYEALVQHIMSI

SEQ ID NO: 980980 - protein, 91 aa, Homo sapiens
CNALKVVRKPVLAEDAPLGEHLVVGSICLLMSLHFLILYVEPLQLIFQITPLNVTQLLMVLKISLPLILMDETLKFVARNTWNLQYWSNRS

SEQ ID NO: 980981 - protein, 367 aa, Homo sapiens
PGVITVLRRLFSGAAYFYLRSDFSSYHKCVPTPEEDSMDMDMSPHEAPELLFSVVTLHTAENTDLLTIYTVDKLTDTTDRNHVTPLHDTRITIIRGTGCNTADDCNTMIERTQATDITEQADPQLQRNTHWKHLDTKCHGTRPPRGYTHIWAETYLNKLQRHNTRMRSYNGILTRWWVYKRDSIVAKLFTIGHHDKHIKIRHGIETGHTELDTERINKNRHMDKDRDRNRNIGLQNTYHCHRDSHFHGGNYRTRIHRITHCEIGWRSRHQRFPQTRTTNHVKTHIVMNDLCHALDNDRTRHRNGTARDQHMTRHSHDRAQDPDRTTGHRRDRNRETRTTKTQTHVPNTNSNNETDDESDMTQNNGTK

SEQ ID NO: 980982 - protein, 190 aa, Homo sapiens
DAGSRLRCRSCGRMEPLKVEKFQPANRGNGLRASDPAAAPESYSYRYGSLMAYTVCNGDVVASSDERMPYSGTETADCDALTCRYAKVLIDAKCQTESLSQTTQRDCKCLKKLQTPDILQTPYRPSWQSCLTHFWHGAPYRPSAEQLTLHYLDTGRPHPLTTTAPAQHRNSRPQATIVIDHIQHFMKKRK

SEQ ID NO: 980983 - protein, 206 aa, Homo sapiens
MRQQQMTEGQVHCDTWMEGNWFTCRNGTGKRPHLLRELMEWKTHPDTHPGNCSWALAFLRKRHDLTALLLTTTLPIGTPRFRHIAQFFLCICTIQEFSWVRCPDRNQSQDEWGMWLYFKKVTIGGPEAPKGSKAPVLLLGPTNHNEKIWGAAPKSLNLGGGKEREDVRDRERGSQKSAEVEQGRLGNRTHPSRAEQRKKPRQYTSR

SEQ ID NO: 980984 - protein, 214 aa, Homo sapiens
ALSHLARWRVTHNVDERHDYYNDDTTTPTRHTTRLTAGGNGDKQRVTLNTTTTPPKTRGSPIAAATLYLVRRTLAGIPDLPCTSRQRTMYQRRKYLQPHNIQRLTHTTHTTGQTRFSTNVTKPTLVSDQERREPEVAINFEHNASASLSLHRQHVPRNSLYSSHRTKQNPYQIRTVTKTLRAKTINPRSNNHNILNHIHQLGNCTNKEANKGVR

SEQ ID NO: 980985 - protein, 122 aa, Homo sapiens
FLSKFPQSDLLFLTFDIFMVQHCHQHQQATLHNHCYLHYHATSLHSAITSHFTVCHFHITQHFKHPTPLHFTHSQVQVHPWHPLYHSSYVRSSANSHTGNPTSIPSMHFTHFTQQQFMTYKI

SEQ ID NO: 980986 - protein, 288 aa, Homo sapiens
ADSLRQNLGHSYYTNIISYRDCVTTYTKMVSTGRHVCQPNFQTLDSDTDEAFLLDLQTIVNAQSSAGQSLMYVHIPPYIRHILRSLQDTQPYWKRSQYNMSDTVWEHSIDLLFQVLRRHMILHSGKSSLLNVRYCGTTLYISQYQLTRTSENSQHGDKTPIKCTHMWIKHSIVFRLLSKYMHELTLKRKAVRHVTVMWAHPSDYTMILIRRHDQDITNGDKNLINCTQLIIQIFHMLPIFLCIHTLYISIQITGKAISLCSMYYTRGTPKTSSLAIDSRYTLQGRANT

SEQ ID NO: 980987 - protein, 265 aa, Homo sapiens
MADLLGSIRELHGEDHPASVTRRTRAEARCDMASPPCIETTKKPLDDTNDDKLAAFRYRGCDAMPALYDFHFKPEWVNRLKETKVSYAKGTARVRAGSLHAMIVLGKLCMGGKTVPSSLSRGAQDLTGLCVHIGPCSPSQRGRLGLASSMADTMIRKPVKCATRRLGTPTRKVCMRCSLEGRARHGLALQWLVPDDRASPPRERPVVGATCHFAGDLIEWQRRLQLQSEQVHRSSMHDSLNATGANKNLPDALARTQTGANYGAH

SEQ ID NO: 980988 - protein, 195 aa, Homo sapiens
KEIPVTVYNANYEKIHQNHLTGRACGNNLNKRDHEKNRITYQVLKLKTTTYGLSTWTAGRKHERHTLTDNWLPTTRRYTNGYTKLSVDTRWLNWVTIYFMTRLDRTNFNNGPWLSAGSVHNQSPECKRNKYVAEGHKKTNTQGSPKGASYKQPDTGPVHRGKQEIRFSFRGVATKTVPPNDDKRRGHTTSTTLGF

SEQ ID NO: 980989 - protein, 205 aa, Homo sapiens
TWFLTVKMCVEQLPRLPWSRPTDHAVVAECSRSRPGQASCWAACMGQWPLLCSLPVGTAGHHEWASLTRTVGRSGFACSACGNTYHLGLMCRGTELIQKAKVSTGFMNWPHNLANWTSWGITQIGVAEVSLSRGDETEGCPLPIHAYDGNETLLSPEKSVQDPECSWGSDIIMQDGRSGLAVLVMGHVCTEALYKVNSRVGWTGM

SEQ ID NO: 980990 - protein, 185 aa, Homo sapiens
MSLTSRALTYYLPTNTWTITILDHFPLIRLHTIPYTYLHHLVHNLYTNLSTPSHVHWIGTWPLTDRHALNQRDHSAVLWYSTESPTDALTLTLGFGGSNHILRCNVCLSIGNLYLQDGDIWHGRTTTTHLANPRHSHVHRQAPTRPNVRYQQRNLNTNNIQRSLTTAGAHTTNVQHMSDLTTRLQ

SEQ ID NO: 980991 - protein, 319 aa, Homo sapiens
RQRNAKLSNMDVEYRPTPLLGRFTSRVRDRLCPDDYRDMSKVDTTAVVEQAALITETKTYLVGWSGIDELAHLWGFQSPFDMILERNRGVCWMFTTVVCVGDPPTKDVFRADEESAKPTTAGNGGHVELSYFHLSPSVDRSHGLCVLGITFSFCSWLLIHASLQTFGNLYRITTWSNKTLDRTRRLDRGHPMACVLGCPRTQQDRWAFDQTHLELIIQSTVKVVKQYINGAYGLQEETAVAVWAIVKNLITGGVEKQGVPVPPIIKGRSGQAKHISWFDEPGPRNPLDVVIPVDTVRATLGTTQVRRFEHVAKRTYRHD

SEQ ID NO: 980992 - protein, 285 aa, Homo sapiens
AFNPCSDRCVRTTLESLKLLTMSRPLSRDFYFPHKLPPKVKATAAPAGAPDTTSVTLQLTHVTKMACVDFAILLETLLLLVSSNSASLHYTLQSKIDYDGTSSTSQRTHHICLRSNNSQLLTDHTQCTPSLVFQDYNPGAQFDSQLAVAPLHTVLTGIPQTGNTPLALYEQDGTFALDQRLAYVRLSPKLVKLPSPPTVHQQRTPMYIIADPDQRERVQAIEPLSRPFPGFRYDFRTSTALMAPLYQQIPGHAPYIGHLRRQKSSEFGTAIGFTPRATWAPVGTK

SEQ ID NO: 980993 - protein, 47 aa, Homo sapiens
MLPVNLLPLGPSSYRGTNIPIGSSSAQSSENPTGIGPPIDLNYRARS

SEQ ID NO: 980994 - protein, 173 aa, Homo sapiens
GIFEEVRGTTASFSKSKLRSMTNERSFDRQRKPQFITSTNLHVLSIMTFTFLAIRSMLFTNVHTLSHSHSITLGSQTTDELYLYTVSDNRNTIGHSAGRMHSSSIASLPARLYGHKGTAHLTEPIPCTTMFTKATYNTSFITLTTPTLGPPTKHNDEIEEKPLGPTNSQKPYA

SEQ ID NO: 980995 - protein, 166 aa, Homo sapiens
MTDRGTDRVGTRRLTQETGNVTSQFQTRDGLLNDTHHDDDNTFPGHKYPDKGKGTEHASLKVYYKERPVHFEQTTWHTRTFVDRNWTGPKDKVSKFQRKKLPLQGFPQRNRIGSPPKNLFPGNSTAHTGQQRFIWHGGQSLPSVCAIYPSDDWVQFPRKATKCSFA

SEQ ID NO: 980996 - protein, 330 aa, Homo sapiens
DTHGMLSHLDVQCDRAPSTQCQKSTTKVAESTAGSLAWVLIARTDILQRFLNVMSFTQAKRGTYLSRTLLLRPEMGKTPFDHRALNKLAPDQGYYPNGPEGSPGYSTLTDKTTNAHNCDIGHFSKTIIPVETLPRHQATHYVGDRDKDYSKQFATLLNQGPRTQRWHSPTSNDGCPSAGYPLAPNRITACNPTMKANYTTWDGGYIQWAYTVGLSQTGQPPHINYPTKTIHQGHLITSEAYLEQQEHPQYPLVRHTVSQRNTLWRNSGIPPIPDKTVLETNMSSLTKMYLPFGMNNATPKVFITGRKIINGDTGRTYEHAFGPPNHNHVL

SEQ ID NO: 980997 - protein, 243 aa, Homo sapiens
KKSWQKVWQSSLYCGICKKPTQILIPTLDSVSRSHMDDHGQNVDCDAVKTFPELRWTRSPEIADQILQYRFQKTIRFYSRSMHVVSQPVRDHTFALVLTSRKTTLTLYYLASDVARGDRTLSPDPCICFQDLVTEYFTQQPRSPGASCQSMLLPTDHNWFTNLPDTPWTLNHGAWPRHSHISPAYSELLDPTSACRDKLDAHLILRPHGAKFHALAHSATPMPTTWLTRPIGFTDFRGHCMEL

SEQ ID NO: 980998 - protein, 126 aa, Homo sapiens
DSGTVTVLNSLFRCPCGVAAQPVHHVPFKWRGPRLLNSMGAFRPCLTDTGCIPGSTFNAQCRSMSFRSSGGTGILELIVTHASRCHHALVGHSPNYFVLMLTCPQDHALRSGLSTSAGPSVNCHRT

SEQ ID NO: 980999 - protein, 164 aa, Homo sapiens
MRHYNEHRHIRMWIASSVITDRCFLIEHREGWINLRTQINKGKGHQHISNVDIYAPSYITARATNNTHMNTQKPITATKRIANLYTRYSEYLPVQGQFQDVLKTVFTFSPDENDTYILRETLIPGNIGHPRQRDTPSGNSKPTEVGRHNTQNGHNTSISQSMEG

SEQ ID NO: 981000 - protein, 226 aa, Homo sapiens
NRYSTARETDEQIITKHNIARTNPIYLLHNELTRNNLARSSQQLQTPEHQTSYLRTAETEHTRSYVAKKMGTDSYGPQAAQNLTAACVITSSCPNDSNLTLPTLTITAPQENPNLTIPLSTQLQHHDRRHQTRRPTKPLHGNTQPDTHTLRTNETKNHTQHTLYTTPPLTLTQPLTNPQPQIKESTSNNARSPQAHPTTTLTITTSNNKITQNTPTYYKTLNTPTQ

SEQ ID NO: 981001 - protein, 129 aa, Homo sapiens
MDFKPTKENTDEGVQERRQNDNTSLMVLDSTCWIIGGDEKQELPGVINTWTRYLHGFKRMAFPRRQVITEGSAKNENFPETYYEDNSLPRAYNAMNALDRHEQKTHTVSRDVITTGSQGRKRHNNVGMA

SEQ ID NO: 981002 - protein, 387 aa, Homo sapiens
MPRHSEVSISINIDRHYCVSQFFNKPEHCDLLGFRNFSTNSYLGTNTTYDLTLYVHFSGHVSQLLTIKHNSLKLQFHLYNSWYTNRLLAALLLVDAGTRATLRHHNQSWAFCRRIGQFPHATWLGRKVAGHSNRQLAPGSGARWPLLTKFPGSTNIVPQGTNLLTDNTPEVPWKLGPTALLVRRKNNLRLNRRPFGNSVPKVHHYYINNAITLTPPFFAYQPTHRSHYLFDPIMHNSGGITANVRHSTPSALGCTHRARLNGQQQARRAYHGNGPSICVTGGYKPLCQNKWAGDQAQAGTRPLICPKHYVTRSAQTEHVEPPRVKSEIATACPDKLDPQGEHGPLRTRRHRRRAYEPPKKHGTASDMTIPPHEEGTKRRKANGHNKK

SEQ ID NO: 981003 - protein, 198 aa, Homo sapiens
MAVWREKTYSTLQSFGAIPIDQSWSDQPWKVTEKSSIGTMLTSILFIFQCLKRAMEKCKDAGLAKSIGVSNFNHRLLEKILNKPGSSTKPVLQPRWNVILTSTREKLLDFCQVKRHVLVAYSGLESPSKKEPWLDPNSPGALWEGQSFVPVKKHMEPRPYCLATAARGVLVRGQAQMCSDKTQGGLDPTVSGENQCHK

SEQ ID NO: 981004 - protein, 100 aa, Homo sapiens
MAIRHRGGHTPRMQSSSLQQQGPKAPTSRDRKHTANRTTRMRAKDDRARQTAQKQSTRATKRQARQHKKADNRNNTQTSGIGTDTTRASKATEQKGDRHN

SEQ ID NO: 981005 - protein, 225 aa, Homo sapiens
MSQHRTFILYTYWRALKEVFQRRGARQELHREDISVAPKISQNDQRSEAKDIFALCSLLPWGFPVRSKRVADTVIYLGLGRSGGAMQKKILVRRGGLGKKVVEDRFIACLLRLVGQTALAFPRKPWWFTNRSKSHLREGVQFRWDSVTGNARERGRLVLGGSSPSQTGAVRINLGPFPTVRMCSIWGPPGPCVGPTCLFGGVLLDLMIPIGAHLGARSPGGWPPA

SEQ ID NO: 981006 - protein, 461 aa, Homo sapiens
GSSKPVSHSKQQCRHFASIGSCSLWTAQTASANAHGTHCNSGTHPGTQGNEHSTEKPLHNSTQTASLQQTQQQGSRQFQHQCALPGILANSHSWPLLGYKGHAQSIHNRQSGISFGRHTRQSATHNPQTALGIIVWHSSFQLTFGGHIITPKTLAQHNLQFTCIGRNRFTLGPTSRPIRQDKDFQRTVTVVHEQAAELMCDNWRDTQVNFPGMRQHNTPLYYEGRNDVNPTQGQLQGQLEHVTHTGVLHWSDTGSNDFSATHNVVSQLQPQALGPFYDTPRTINYTWSTTTSVSSATHLGFRIRKTTLHRGILIRQQSNYTRKKRIHNTLGGKTTPPYKWSEHIIGNVVSVRNNSRDNQHEEGHNKRAGDNNKQQIGQIDTNKKNRNRRHKKATQRGKDPEANIVQKQTGEKNKDTQYSEPYNTDDGDSSKKRHTRHTEEQQAPEEYNGARTQLSQDKIET

SEQ ID NO: 981007 - protein, 112 aa, Homo sapiens
MWRSWTTLVLLELTQLINEAIHAWYWGLGWTRGSFQKFPQEFLFFNLTRATHLVVLTQKVPGRLTQWNANYQYCGGEDPLSCGPFTFNPKDPILQGWPLLGPFQLIPRNINL

SEQ ID NO: 981008 - protein, 430 aa, Homo sapiens
MDVTTPCFEVANARMTLLTNHYAHTDTYHGRFGKTMKRPRSTFTADPNTPRRTKTDIPTHSECGQLRKVNNTNTNDLLTQRHTHGHKHDYYLVALPGLHEEPQPAFTRHAWTRATPAQMAPKRCTTTYYDRAQHATATTAPTDGQRTPLTHLHLPQHTPPTISKASEYTGLSRQANISKTTLALNATNHYTGFPVTILTTRTHSPGGTIHMVTGQALSAGNSQMNTISTNLAQWAPRSTQRVQKKHGELHHTPTQIDKDIYGTGTGTRQVPKRGYHFPHSSTQFILSTAHLLAGAKQSKENARKYRSVTRNATSLTHRTQNPSTITQRAHVTPAERIKPGKPAVTRIAGGSEHSPHRANTPQHTLGHRTRNTYAKPPTRPTACTSPHRGTKSPPEHTGAKHEPRLTNTQRQGQTYKHPASKTNSKEQPHS

SEQ ID NO: 981009 - protein, 76 aa, Homo sapiens
ACSDTVLRRAVLWMHPLLKYCRPHFLSKLSACRQPRWKDSDGHGTLSPSWGPHELSFLVGEAKRADQDDYNQLLKV

SEQ ID NO: 981010 - protein, 282 aa, Homo sapiens
IRKGVCDANDEAAVICWCWLYLLSLTQRKEPGFRLPNHLLNRYAVKGRDLTLQLQHLQCRPQVLHYDVALSDDSFPPEDFAPSVWNCSTVHMGPDMPLLSNCTSHHCNTMTPLFNGCVNFNLSHIRHTTFTLTWPQERECVPQSAASGLLTKMHLENHATDIHVHTPAKLIDQGRLLPPPTCTWELCAITLSEGPTHPIFHVQNTSQYTPLPNSVEIQSKRLAGILIEHSHQNTIRTTLPSRALYDKQTHNQSIPKESTPKDSHIHKAQHQGRHYQRTPKEG

SEQ ID NO: 981011 - protein, 79 aa, Homo sapiens
AAEKRKRQDKCNEEEEREKEREEESKRRKRKRERKEREEGRRGKQEREGEREKEEKETQQRKEREENEREKQNTTNTQK

SEQ ID NO: 981012 - protein, 99 aa, Homo sapiens
IKFAAHQIQNRIIDVNQNRHSKVEQDIDSRYIYTDGEEHKIHEKALLYMQSVREPVNGTIAMKTYATTTGIVVGCSSNKSEHVIALFSYTGAVFQWTDE

SEQ ID NO: 981013 - protein, 450 aa, Homo sapiens
GRVIAAGESSAPTPPRPALPRRFICSFPDCSANYSKSLEGFDAHLCKHTGEETIVFVTYEGCGKGLHQGLPSEPPHSDSHREKSRLLVQPMAVIKISHKIKLEEPFGPATLNSQNHIYAVWTECKKTLRNISSCKSISASIPMILYVYPGGMWEPLGITQQAETNARPHEAMYVTRDCPLGGTNWRLLNCCENPEGDFLCEVCGKINARLLDHENLPKGCAVTGGGTSPVFHISSEALLYGDTKQCVITPPFGLMLMSGVRCVYTLSVTESSRVYEDSGECMSTTSRTYSEACELTDVWRRAAAWACVAHDESHEYDEGVSILHTKGESARKVRQRNDERGASGRDDDRQRTNGGRKENRSASSRSRRRVAQIGDRVQERVAGEAGGRLSERCAWGEEKVTCERRLRLVVRRHPKRTNKHEQRQRYTQKRKDEQDKTNDTEKAAEERHSK

SEQ ID NO: 981014 - protein, 337 aa, Homo sapiens
MTCVWQASRSISIVYWVHCDALEDVALRVIERSVPCVRPLTLTDPCVLMGMTQEDKSSTGLRYLFAISPCYWDQKQVMDIQLVHHCLVCASRQSPNNTIHLRVFYGRLKTWSEIHWSVRDKDFTNSLAQILEGAIYFSEISIRSNRWCRIQYRYRSLRFGKAVIEGHCKFDIKATRTMFRTQATAPPIVLSLDKGLRKRGPEERFAYGALQRFGSLRVRDCSPVSLLGVACLFASAVSWILVDLAMITKILGRQAERVPSTMRRARRPERCERRTTWCSPRRYGRGAHLEHLKRPWTNAAPRRSAFEHPAQERDRDNQVHLTSRAPQCTPRGPDRGP

SEQ ID NO: 981015 - protein, 336 aa, Homo sapiens
DACQWAGPDRCVGGGLHYFPLGPRSRKEGARHVPSQPRTGALLALAGGDPGRGPRRRALEPPGPVARANSPGGAFSPTASVAPWVLTLFLSFSLPPSGASPGRGCLREKPPRSFLLGGARGGPQAGDAPRGAGPKFGTFIPGNGTPREGGEPWGRAVAPGIGQGEGPHMEERHDRGATTGTKPEDKAKREDKASGTGEQRGPWGAEHPGHYAEKHTILDVVDAAPQDAEVTGVHSGEEITWGHTLCRRTTGAENGTKNARGAPRRAVKGAHREQDGPRGPGASAPTYGDGPGHADLGGRPLEQADVQRTKETRGKGHLGTRQKAEQALGRGPKTLG

SEQ ID NO: 981016 - protein, 87 aa, Homo sapiens
MCTVMAGYLDIYFEKKCHNEGRVLYGPSEHQNTLETIQYFYWKNHLQLKQVKPLKGKVTVHEEERKDPRSLTVTLTLNNSTQTYGLQ

SEQ ID NO: 981017 - protein, 96 aa, Homo sapiens
RNADGASSEGMSAVAVPKEVELKGFELQWSDLLISQHFLRNELSQIWCGKMHAHILVTEPPFWLQGCIVSTGRSERVVSVLHPWVCIPGAYLNPCV

SEQ ID NO: 981018 - protein, 121 aa, Homo sapiens
MDSSFGRAIFVQAVYAAKGAWLTRASMVSYLARHFASVSLARVVNPESLSRLQDHQVRHESQVACSMLPDISLSETRVGLDESYGTLVYAPQIETVSELPWRNHTVGDCRPSDGHCLHETE

SEQ ID NO: 981019 - protein, 242 aa, Homo sapiens
PTGCSEKPSLHCSSSASLLAAAASAARSSAARTPEFIARVPELSLLFNPLHRITGVPHHVRRSRDTSSEITTKDLYGEDGSCGTRQNNGREPPLLTGMLLRKVGEQEADNEVDEEEEKVGRKRTRATNKVMAEDRGWMSEDEEAEVSYVQIGQLKMMRMTMSGSEEAEDRREMTRQQKRTRNLRKKGRGTYTLQFPSQKLKVVLSIGECASTVVVSPQMKGLSQPPTVIATGGIDQVPARFF

SEQ ID NO: 981020 - protein, 69 aa, Homo sapiens
SLLSEISSLVNSDTYSPLLSSCCTWSGTKPDRFQASNRIVVVSVEPPRNVLCAIHRLPSISDIEGSSSQ

SEQ ID NO: 981021 - protein, 275 aa, Homo sapiens
QQMRHPMSAYFLQFDHLDSAVAGDATACLSPRCLFAPAEHALNSIYAASRCARPHSPAHRRAAALRTSGPCLLSTAPVSPPLRALPSSPLLPSTSACSWPSPPAFSPHWHPVSYRSLAALPLARCPRPRAPALPYCALYYNHPTNASATATRKLTHPSAKTDPAPNQRDTHPDPTHRPANTPPNTHEQNNRTTTAPDTTITCRTARTQPLHTQPKYTLRDTAYTKSPYTPTEQKASHNHNAPDKTPVTDQHPSNCPTTIGPCPHTCQHHPPAHHQ

SEQ ID NO: 981022 - protein, 77 aa, Homo sapiens
KQKWRLPRVVYNLCHGNASCAVSSPTLPYHVFYICLVFSLFLQDLMFQGTPFIHKHVAHNGISRAMLHPSPITPVVL

SEQ ID NO: 981023 - protein, 69 aa, Homo sapiens
EYHCCWKSYYKIKPACMIKAEESSKQEECTTTSTAPVPTTEIPTTMSTMAAAEAAAAVVAAAAAAEQSS

SEQ ID NO: 981024 - protein, 87 aa, Homo sapiens
LSVFADYHLPCNSEGWNLMHHHVEQQEQMTKINEAPSGCNIQVCRHYVDSVHSITSGMFNRGLQHDLIRYRDGFIIDKGRIGMDLVA

SEQ ID NO: 981025 - protein, 524 aa, Homo sapiens
MQPKEEPPFRTFFLLTDSEVIRPQTWIPKGEAVRWGLVPNRVQGAGKKNWGRRTRRNTKHGDVRMHRGTGAPWTNERGGGKLGNGNTHYATKGTLGPAGESEALERAIGPEIGRRKHSGRIAQRGANTGVSKTSRQHGGAAGAEEEKKSDTTRAGASNKQDTPPDNARCQINNARRDERTNCERKRTHPLETPAHTQTMSAPRTRVGRHRGEQQKVTGTRVRHTDSSERGDGTVKSRISSCGIYILLLVIFSFVSLAPSPRAYRAEKHAKMTQTQTRHAQTTTYRSSERIPPTESTDTSRNTKNTREERPHMSAYTQAKKEERGADERGEQELKCRGERAPSEGERSGRSKKKNRERGSESRGVEQEETEQESSRERGETTSRHQQRKQQTKKAAEPPDDEMLEEVQNERGGEASVGEVDVRECRSRKDGRRGWRGEREERNEKRQGAGAKIVQKRHTRTLRGHARGRYETDTDHRRQLHSEANAHSRATQATNDSSATAATTHTPARMPEHNTAQNSRTTQQS

SEQ ID NO: 981026 - protein, 363 aa, Homo sapiens
MCHKRGHCDCRRCPEDGLSAVSLKLSTYINKWGCKWAIAPMKEVQPGMVRLAGSLFALCGFGLHTLGSLAIWAPGVPHYGRVRNFNKKRARVGGEQIGAREFGGTDKLCRSVDGTNRRRGREGTILVQRHNITVSPVFRLFICRLVYAPHHDHETNTDITDAIYDSKTPTHRRNNEPMREKGGPGSSETAAPREDGEQRERRRAGHRRQDDGGPTSRGRRARTRTADRAEARAEAAGRETRKDGAQRKRPEPTNDQEQHRRRSKRRNTEHPARPGDVERHANNNARGRGQHDNQKNRKHQTSTEEDTITTRQQASTSTRQNTKDKTGQNTKEEKRRGRRQRKRDKKTKRTKNEQKDKKQPETA

SEQ ID NO: 981027 - protein, 270 aa, Homo sapiens
MTTCVINHYATEYLTSKISPRTHSYGPERRLQFSLFSHDRDRNKKRANTHTTQRVIETRTRNPITPPHRNQHNNHTSGGTENTPRRRGPTRRHNQADHTRTDDRDNTDRRRRRPEGTNEREERSCASRRAEKRDSERKGEREQRGGKRAKAAGERTREEKPGAETQQRRTEGEADTPGAGQARGERTRAAGEQHGKKRRRREERTTTRRNTRTQTQGKRTTREQQTKRRRDTQENRGRRDREPGGPTKRNRTANASNTPADRARPAADNT

SEQ ID NO: 981028 - protein, 605 aa, Homo sapiens
MLERNRNTALTVTVMLHDHDLLVYSDTCAKMTSLAHMCTTGILSNVLSHCRDLPQLLESGLQKSIWSPCFVLKSRGVGRVADDSEMSATCCVILQLSAALKSSSALRGNVFPSDNWEQRVLAGELSEGVTRDLGEVPCYCPFLTRLSKASDHEGFTNLMFLRPGPGVFRVADTEGPKSAVWGGPLKKCGYGALPQVGLPHRILHEENSDTGQSDDRRPRRVQEEKMTPHKQRGHLLIQAVFYLGFSLSTSHITLHTNTTPRHDHTQESTHVHTITHTTHTHQQSHHHNQHTAKHTPHRQATVPTYNTPPPPRYTQTTPTHTRQQHHPTRKRGRAQPRQAHTDKEETEGEKRNRRCTMQQDTTRQEDDPRATTDDEREKRNDGQPDHDRADNDETEREEQNRDNNTGAKEEKEKRDRKTREKQDKEQSAERTRRKETDTTNQTDTHTATQRKTQTKRRRRRAHVATHCRAQPKRTQNDGELTREQTTEQSMTSTKHAPGAGTTHTRRQSKPERRRKTQRNGGSRATQNAEQSPGTGRGREHKRHESTMQDRESQRATERERGGEQREDTRRQAETDRKREDTSTEAASTTARSKDHDQTSTHAQPQ

SEQ ID NO: 981029 - protein, 286 aa, Homo sapiens
MQVSNDSGEHWRPKATGRTHKDKLGARPQTPPKGHTGRTWVSQAGIRDQHGPRNSGGTNRPTTGNSGHISPQKGRATHARVVHTRASMRHCLSQCARDSVSHTHAHTTQTTTHKERGGEEGRGRRTGRQGGEQRAAGRVGGGRPQQREQRGQAARGERQGKKQSKRPDGAGDESAGGDKRRERRGAREGAGNARTERGGGRGRTERARNGGGRDAGGRAERDKEVGGGRGEGEGTEGGGRRGGEGEGGGPSSGSGEATARRGRARERGREGQEREARGGQAGDEEE

SEQ ID NO: 981030 - protein, 184 aa, Homo sapiens
MECVCVCVCCVYIKVQYVEIPTWVVRRYTQKLKKITRLDPIVHEDAQESQANSERYSPSSHTRKMSPANRYIQRALNATSSRGNPPTGQHQRRRIPATGTTGPPPTRDQRTTTANRTGPPRVTQTTSRQLPHHLTNTSHDHTNPPRAPQHADPSKAQKANETQYIKTYRNATHTEIAQTIQPEW

SEQ ID NO: 981031 - protein, 281 aa, Homo sapiens
FEGTEDWIVANKDLIDKRKCTITGLPTDAKILCVEGCEVLAWCQLSSQDTILSRILVKEISREPPEIRIPRQPEKQIYIRKRWEEAVNLVIPFPGKTKTRIHLEEGWCQKLSEESRLPLFANSESCCNHIILRKAERSHLWEDMICQVKVDKFRGRPRSLDIQIIELRVHPKLGKIEDVRGDNVRVTWDSPWLWHAGSRLYHQRVAGDLEGRLGLSVNRAHGGGLGGFSGFWTGGPGGRLRVGRGEPNGGGRGFPVPLGAPRGTSKCVQGVPAPLSVLLLG

SEQ ID NO: 981032 - protein, 228 aa, Homo sapiens
FQILLDALHKIKTKGKVGALQSKVGPDFLPVPGMPGTPDSTRAHSPRRPSENMPCVRLADEMSSPSVTCAAPDSALARLRTLRLLPDACINLTHLECLFVAAFWGPSTWLFSYRVMTSVPCKTGCGWDSWPLYRTVLPDRLIELRSCALLCWGSSSSTSIAFPSAQALLECQMSIVVPTDVGDFVGQEFAFDESSASRLRLISLPISVVIPSSLYTLTFWAMFHKDHD

SEQ ID NO: 981033 - protein, 285 aa, Homo sapiens
PHSIPTSYADFSVTLEVIFLSYQALADNLPYCNLLLRRKQEPFEYIGMVCAMISIGFLRVYRVSRTIYLLGRNRRKHTSIFHTPLPYIIAIPYPDVEQYLADSSSGLHVKSVMKHELCCSARSPRIPLSLHRRWSGWHCISRLIDVDFVLPRHVLRVAHFHYVLSIGAVFAIMGGYIHWFCPFSGYDLDPNYAKIHFTIIFIGVIYVSSPQLSRLSGVPRRFSGYPVLPRGNILSLEAILSYAKIVMSDVRACSSAAIVKPPTGVLAPLALNAYCQGDAPVPSSL

SEQ ID NO: 981034 - protein, 133 aa, Homo sapiens
GGLGSLHSDLKLVLCHKPKISLNEIVHLPCRDAPYIFLVFLFICPQHFRVAPCPIVFSVCNSAWVSCGWKVDFCAMLVSRSVPCRALVCRFDMMYLDRALVGAHCFWWKYYFRCLLLICWCLVCSPTFPNPTI

SEQ ID NO: 981035 - protein, 155 aa, Homo sapiens
QVCTRCGEEGVWPEKLKKRHVQYACRLCCSFPCPCNPDGVEQEGALFCAQASELLSCGLLCLVFTRFKLRGHTVAVPGKVYSLPRMGASYNPSSATQHLIVSCAVFLICLLLLATKPLFRFQLSHGDRCQQLTTPDYIGVTRHTKLARFTKSDNC

SEQ ID NO: 981036 - protein, 121 aa, Homo sapiens
AWWDSLIVWQKLCGMRCSPTDVFAALYWNMAARLLRKGDKSLVPWRHTEARGRPSPWVPRRYPVSVHAPATPNDSSGISRCRVAYPLYPVSTSLNVLREDSALEGLIQNEITVRCKSDLAC

SEQ ID NO: 981037 - protein, 179 aa, Homo sapiens
SSFTVISEGDAAIPPALRRRKRSRYTLHMVSLQVATAFESAPDNCTSARMPCLPVDAPMNKKIVNYANKLVTKSFGIFNPIILYNYNVLERIVQMCLKNMTKNTEGLFAGWNCVQWTFLGCSTFTPPKQVLCCAQENWKRIACGDKSVSVDQDNASFRTKTLLLTFCSAIFIVGRMGPS

SEQ ID NO: 981038 - protein, 116 aa, Homo sapiens
WLRLWGGDPAGVLAVCRRNSATEENGCSIIHPPQLVVVWCASSDQWILAFGRSQSLPPLIWKAPFSRILHNRMLVEHCDSIECASERIPSWRFVFPSVLNVCILRCDARVKTLIRR

SEQ ID NO: 981039 - protein, 107 aa, Homo sapiens
RASRRGGRGVALDPRPLQNMALQSGAERVRALLCTLRRGPCYPACALPARGPGSWGVGAVRTLPHWDPLCLSVRKFTEKPRVGKQPESGIGTVGISNLAQGRRGRCG

SEQ ID NO: 981040 - protein, 311 aa, Homo sapiens
RVRIATALRAYVLVLRPLRVSLGAARDQFEEVLGHDLFSPPDLSFQAVRLWTEEWLLTMERGIEYFHRHQANYRDNAYEFCIIVSSPSYKYPGLSVYAEAWILVTWVNVYLNEKDLQEVCVLILPWAVNNRLLLYCMIIYRSVVSEPSTYWMTPTDLEKAFIIQNIVWLSCFDCSQLMAVCVCNANMEGEQPLSDLLKNAIKREIFSSSHYLQLFDFGEGVTDLPTKELAPGACGLHVYSGRSDHYTLGGGLSLVDFWAAWFDFGHACDPTRGDGVPAGISRPFGKAPSLFSEADLRALPAPFVDFASSPC

SEQ ID NO: 981041 - protein, 273 aa, Homo sapiens
MVNKNNMKTTTTMNAGVAHSVGSVWQNTEAEIEAHGYCSRRRYMERHIRDEIDHGGQQAPAESIWKSFREDGSLRAHNTHGREKMYDLLSARTPPEITQFTPCRLQLYTAETNKKDVSNWGNLCQRSKFRFTQESLHWRENPEMPRMWESLFLSVIPYETYETSHWRETRMNVANVGKPLDNSFTPLINHYEKACVPEEALQNVKKLGQSFGESPKYTIIEPHWEKPHMLPFATDLAAADLKPLDSKLTRDKKGHSNLRTPVRTFGHGRNTPV

SEQ ID NO: 981042 - protein, 314 aa, Homo sapiens
MTQKMLSETKSIEQKNKFPLPHQQKPTLLRDISTLNLSQSLNSVTDFTNQHNRLTPNQLYKTFGTHYSYTSGLGTSNTNWRKRICSLHLTTTNLAIHHQPCNTLRTLYCELTYITRYTIRARANSLLERTHYNGHKIPILALIERVYHILRVQYHNNSPLTLYTFPHLGHTQNFPYHYPARKPKRQAKRKYLPHLTPLSGPYLSRIITLCYAIHVAQEPTCNRAPNESTDAHSNVFSTSITVFSPLLSTPRKSRGLSNNINPLLVAQTELNKITTEREYYRKRHVFAKRNFLIVGKTESLYIHTHCWSPQLRRF

SEQ ID NO: 981043 - protein, 141 aa, Homo sapiens
GLHHLTPLFFLVQLTLPCQRNQNWQQIALHSLSADRVSTTLRYHSMAHTLNAGPPRKPLMKPTDLLTLHPHSPRAHPLKHNLSSTLTLHYLTPILYQYRRLHFAPLALPPTLYTHIKHCLEPTTQQSNPLSSTPLKVSSTT

SEQ ID NO: 981044 - protein, 286 aa, Homo sapiens
MATKPTHENRRHGAPTRNKQLTPNTGDHGQFQNTNSKQTLQEARTDRRIPLDPYLPGTHGRETSIQKKDHKPQSDALTRNRTHGPTTQPPRAYTTTHNTHPQLCTKTLPSPGTPGNSPQHQYQEHNKHGPHTENTDPQSTWKATIPLPTTTQETVQARQHDPHQTIRPTALDQNRNTQRDKTETHTQDKNASNRHMGPNPAHKPHKADQTQYYKNLAQQVNSNHKPHRLETDDSNDTQLQGHSNRAHKHKRHRQQHTVPASTPPHSKTHTHNHDGGEPTEEQAAAA

SEQ ID NO: 981045 - protein, 522 aa, Homo sapiens
TKRPLYRLIRPNHSSPTSPYLSQLLAAGIANTLTDRNLKHQPLFDPCLATKHNPQSLLHKHHIPRTPTPAINPLTVTIIPLSLTKRPHRKLKSSPIYSATTSTIHIPKRSQHRLPTFVPQTTYALLTPLSHTVTNSQHSAPTPYRRLHTSRRLASPPNPTTSLFHKDKRHTYSTLHYQPTTFQPNLTTTPTYTQNLTQISTPNSDYYSPLQPGQAPHSTPSQRTMAAIHPQQTSQQRQTNTHCNHQENQRHRPQTDLPAKHPKNPPTHNQHSIPTPPPTQQHKKKNKNKKNRQQTSPAPANLSIHHHDTQKPPHTQHNKHHNTKTRPIRKPTQRNDQNDASHETPANAYRQHKPNRQTKPREYTHYTNNKSRTYVTLLPPTHNSKNPQSIVIAYNTTRQHTAIPTQIQPFYASRTNIYSDTSTITRRYHTLLNLSTTHYTTSSLAQIYNSPDLHHHIRDNHTHIHASRHTNVILHHHYSPSSNYSNSRPNSLQQHHTTQHSYTPTPHSTIPHISLHTDQITH

SEQ ID NO: 981046 - protein, 69 aa, Homo sapiens
SGGSGGDGSNSGSYSGDASRAVTVWEVVSLLGKNCWPTVVALKVGSVPCSRVCLAMAWKSGGRPRPLGG

SEQ ID NO: 981047 - protein, 173 aa, Homo sapiens
DVSPFHNLFLSWKKLNMLCAIEEYSFSQATLDQVLVELTKEQRGGPIHSGGPLNSTLGWERTQEDRVVFGHWYGPVCLLGLLSFFHLILTCGLTTVSLSGHGNWENQERTLKFFLLLNLETAVVAVLWLFFNTKTYVSFKEAACLYRQYIELYSSYVIFFTIQQHSASEFVIY

SEQ ID NO: 981048 - protein, 62 aa, Homo sapiens
MICDVTEDYKKIKKVFLMDSSEAHSINIPLVDQSMSCTSLALNGTITFELKCCGNTRVANHT

SEQ ID NO: 981049 - protein, 98 aa, Homo sapiens
MFPGDVKREVHNFDARQAVKEGKRGRTRPGGHHTRNPFQGRNQPYYGVISGRGDWRTPGERIYWLERNPHRAKGGHYGNRLGITGGHDGKRDPNSQEK

SEQ ID NO: 981050 - protein, 73 aa, Homo sapiens
ERRRRPAEVKVWRKGKYSGKMQSWSRVYCSLAKRGHFNRISHGLQGLSAVPLRTYQISRCDADVTVIGSGPGG

SEQ ID NO: 981051 - protein, 94 aa, Homo sapiens
DSGTGDMSSTHSSASLLVLKSSRSIMSCSADQIAEFKEAFLLLTETGDSNESSYCLSVSEMLRSSSWGLQKLPTKCHEVSESFMSKNSSKCKEL

SEQ ID NO: 981052 - protein, 168 aa, Homo sapiens
MPTLITEQLSSLLLLSSPPARSWVSSADRLAVVIHGLGWIRMYYALRSHSSSRECDRMRRLLSDVVPFKVPGKDTVTKDNGIRPSSLEQMAKLKPAFIKPYGTVTAANSSFLTDGASAMLIMAEEKALAMGYKPKAYLRDLCMCLRIQKINYYLDQHMLLQKVLERQD

SEQ ID NO: 981053 - protein, 123 aa, Homo sapiens
HPSKKMQTKISLSTLSAIATPRIIELAHPRIKLEGLCYERQRSELPIRPVPPAAMIAKPSPRTIALAKSKSVHQDYLPDRDAHWPVSYATTHSKASPRIQELANPNKRGVIPHSSFELEFGIR

SEQ ID NO: 981054 - protein, 137 aa, Homo sapiens
VALGTRGRSPGAYLTESAPQQASTTPGPPHVMARLRSEWACVGAAPWPLPTRPSHYAIRVPTQHLFLPGAKLLPQALERGGEAAHLDPKKPQDKGGRGGGPGALLLWDSLVCVFTPISVLCTWNQLSILVIYHYLYI

SEQ ID NO: 981055 - protein, 245 aa, Homo sapiens
KISVQSWVGKTCKVHPMHNNPSPDPKRVLTVVGSGPPDYRRTSARGAQVRRMNWVVSGYKLPSSKNPEELFDFHLSVRGSLEKVPNAVILEQGPHRGFLPPLCVLVTREQKGELEQHKAKLPCKLHFTNTGLKKRGRGNSGGGIHVPLGKVHHTDKFRARLADFERGGEYGFPTHGTGSPEEKRLTEGIPKALWIPNTKREIKNAPHYTSLSLNNKKFKPDKLYRGRADKHTALGASKGPMGKES

SEQ ID NO: 981056 - protein, 210 aa, Homo sapiens
GRFQTSLLACDSSQCKFPTSACASPLPATSQPGMAPTSLPFGTKSCGHEVVSCLDVSESGTFLGLGTVTGSVCQFYIAFSLQCLYYVREGPWHVWCRMWPFYLRRVVVQSSCGSHETALSLWARGQSLPAASVCLTGGGVPVWLLLPAVCRAYYGDHPWCSRVPFQVSFSFRVPGTSGRLDMASLRAEWGPLDLPWSTPLRFPAEVALTR

SEQ ID NO: 981057 - protein, 90 aa, Homo sapiens
TREGRCGVVSASLVALGCDSSSSSSAAGLGAVDPQLQYFFEVETQKQRFQQLVHQMTELVWGDSAWTSLGQKCGPVGLRPVCVNCVERFM

SEQ ID NO: 981058 - protein, 119 aa, Homo sapiens
MRRCYSTGMTVDRSRFCWQWKSPVHVHRLDTGVVTELALRYGMSYLAETIILHAETGLSVHLFIESPSTWIVPSLPRNFRVVFRYHYTGGIVREVSQIGTFMFRNREGDGEFRIQGDFG

SEQ ID NO: 981059 - protein, 190 aa, Homo sapiens
MVIRGVLHRGPSLLLFSGTPTTRAFPRGGGSPRGIISGTRWCWAPSFGTVFGHFLVALTRPTLVVGRPCCLATRGGIGTHKDDPGLAKEWTVPQGRAPKLEEVGKRLVQWRAPRRNGFGPGYFPKNLITPKRWRVGRSLANQRVYCAPCDLKVQFVEKHRHGWERTYVFSLVNGATGNTPRRCPLEEGLT

SEQ ID NO: 981060 - protein, 102 aa, Homo sapiens
MLSGLGLGAPLCSLPLSLWLPIVGPGRVPWLKRGQATISSWHALLHCPGRQAGVANGGGWCPQDSPSQTVFVTTWGSLSSFTKFSSHVLGGQPLRLQDGRRG

SEQ ID NO: 981061 - protein, 293 aa, Homo sapiens
FFRASPLAAAREEGEMADEMAKVRSLGWWRHDLGEASSAGKYQPKSFGRMTVPCFPMNIPPQSTNTSSRGDHPKNTYIPRFRVGTKMNDEQSSGAQPPLDLVGQRPLVLADSGALKLTGVNPDMCVVYHMKRSQIGLRTSPVLITGPSPVSCGTCRQNCIGASRGYSHGSRAIISSFFSGNVDLNVQGHFPRVMFHAVHPTTFIFGAVVVTLATTDSPHTNKLQFSNNPATSSYFTHRTTGSAVGLFTTQHSTSHHTHTPHTSCFRRHPGPPEESTSLTQTLRTGGDHHTRSS

SEQ ID NO: 981062 - protein, 355 aa, Homo sapiens
TEALAELIRSHPAYQQISRERTVEALGLHSSPPVGTARPSRRSRRMAPVQPEGWQSRRQPRQPQDTGEGTAQQCRLLAQSSTGKQHERTFFQRWSPTSELTEAFLLSRCCVYGLWTSKAHQSTKDPDELAKILGASRHRGVRHMTRRAMGRAQCLSKLLSQKRLALIQPLQGRQVPRLHSKSKPPHLEPPGIQRSWARPPTGTEQDKVSVISGLAHDDRSKQVGIHSGPTISQTSQSDVGHTGRDNRPTRGTKRAMGYNTPPRCHCVPQRTLPYLCNMDKRTAEPKHRWCTVGPNCKRHTRKIQDGSHGLAKATHQATHRDVRGQPPCAPTQRKTDGRQHSHTLFSLPVVLLCER

SEQ ID NO: 981063 - protein, 70 aa, Homo sapiens
AVLAAGITILLTDRNLNTTFFDPAGGGDPILYQHLSDFGHPEVTYSYPTRLRNNLPYVTYYSGKKEPFDP

SEQ ID NO: 981064 - protein, 229 aa, Homo sapiens
LFPFGVPLKILVSPWAPPPVVPVCKNKRYPKSRFCRGVPDAKIRILTWGENGKSDEFRLVATWCQMNMSSCPLKPWRLPELCANKYMVKTCVAKMASISGCGSTLSNVIGINKMLSCAGVDRLQTGMRGAFEKPQGTVARFKCAKLSCSIRTMLQNKGACDWRPCGGPSSQFPGPPRRSTSQRSGGFHQVPIVDDFERPGVSEKRSSKMVWGQVHPQVVASGQVGGLES

SEQ ID NO: 981065 - protein, 129 aa, Homo sapiens
MGLWAIEFFFKKITKLTGTVIQEVSIHSEGIISSTHSVKKQRWIILDFLKGCWGDVVKEDILERKCVGHNFLHELVVAETSSHILGGQKLKGAPKRRFYITENIVVDTKGGLDKEGETKRTQQTRERKC

SEQ ID NO: 981066 - protein, 135 aa, Homo sapiens
SPGWSDSAVVVAVTVCLWEALAAGRPAGFAERRGRPSPVAPQAARADTGEARRPAAEAGGSICCPGPPPWGAPCPPGGTCWRIWDSPHGGRGGPGGHNKEPRGTGGNWDQRIGGREGKPVTEFGLGFDQELACDL

SEQ ID NO: 981067 - protein, 334 aa, Homo sapiens
PTIRLVFSRYPPGCSGASVGISRWLHGLVFSHPLFVSEFATRDLVSPVLNRHGHPELPFAMDARTAQSGINRCADWEVIEHACRLIGPVSCIGELIPAHGTSFPKGLGLCPLNGVMRTLMLPDYADRVLVDRTYEAGALVRYHEAAARQGFMKCVLMSRSSGTRGIARVVTIGTDVYTHSIGTVLEFQMETLPAVEGGAQNSYRTPLIPRVPIATRALDEVKKGFPGQLLEAPRAGTLANDRRMSGGKPREQRDILSTRDRRLRNSQCARSDHGARPPVRTAPERRSDAQHVARNPGACVGPPAHAPMSKRRAHTKEARPLKSAQHPTPSNTVE

SEQ ID NO: 981068 - protein, 229 aa, Homo sapiens
MQEVRVVGEDSPWERRFQEERYVANILDLCNRNGGRESLSIGAQSMKYLHKIEWNESLASLNVTSRLVWGISLGARFIAHAGVSSNIWTMLAATTVQILGAEKAVVESPQFLDWDALGMVQFVQCFTPWSEHVPQTKGSNARLLEAYALGIENGAGRIRSAWSCERAVRPVDLAPGSTLARAFYRISRVGFLWGVPLHTVRVFTPLLEGGSKRALAASSPLSALSSPGG

SEQ ID NO: 981069 - protein, 105 aa, Homo sapiens
RWLTPCNPSNLGGQAVWIMRQEFDVAADQCGESPSLLLVRKEELPACPALLRGHMGVKKGSQTARMEGEGTSLKPSGCGCIGPLANLGSNIGGESISANIKIPGG

SEQ ID NO: 981070 - protein, 114 aa, Homo sapiens
ADSLFGLSPLHPGEINSLLLTQSLFGGLFTQTRMKFGAMTRIGVPPLGESIPSPPALCSVRKIYLVTSGPQIDQPKEHLTQFQIWTPMENRTCSTHLGSQLPEPLETLAQASLD

SEQ ID NO: 981071 - protein, 104 aa, Homo sapiens
MVYGYGCLGWITWEAMWVDACKIRELIRNRLSFGVEGMPESPKNWGVLFERLIDGLGNMDLSTVVFSEVSKEQLRGVAKSRSVSQVECRQNRRKTRLDSLHGVS

SEQ ID NO: 981072 - protein, 171 aa, Homo sapiens
MAPLGALGFCIRVVAVVDSPKKALHLCSTHTENVLSEIPDLVTSGPKYGGDHQEVNQNKLLFTKRKGGSQIDPNDGIKAGVPNAFKGGIAGLTHSGERSNQPTPANGKTVGLARYTFRKSGFPQQTGTATEQFPSMCGENTLQVMDLFGHNPLTVDRLGGAPPLRIELFEA

SEQ ID NO: 981073 - protein, 197 aa, Homo sapiens
AVAGDGDGAGPGPGRPPSGGRAWEDGAAAGERLSAGCAAAPPRGGSGSLFPVGESAGAGALWGNPGANGKSREKEALDCAVAHSPPGYCTSSRRKVTPKILGANLLAKTRMCLTNFRAQGVSQERFEEGQRHHGGGTGHPGDNTQWGGTPHRPGCVDLQETWTTATGGGQRLTFARNATNAGTARAERRNPSSKPRN

SEQ ID NO: 981074 - protein, 283 aa, Homo sapiens
KQIAAKAVQGHSWTALSIPKDQGVLSFWRGNLAKVIRYFPYQALKFAFKDKYKQIFLGGWWTSTTAVLGGTWRATWPPKVRRTDLPSVRVTLRVISTRNPALSSGQVSQSKCTSKRDVQDAVVTTVLGETFTKVRKEHSGELIPTGIPGGLPSQRQSSHLPSSTHYIPRGDTDTGAQGPNAHPDPKRDQKATTRAADAWRTDPANNRLTGLRGHRPSERTPTPLRNTRVAPPPTMNNRHTTGEPKRSRDITMTRAAPRQLTDENHPHHNDRATPPLPKRAADP

SEQ ID NO: 981075 - protein, 128 aa, Homo sapiens
RTHKGSQQKTAPNVHGLYGREYRSRPLGNIIETAANKTQSGLIVGRGVLLDGRYLHESQVEYLPGTRRRSFVGMTDDGQNGGAQSRGSSQKTLLLTIPTLGPLAYLTAQHENLVLSDFIWNVLHIAVQ

SEQ ID NO: 981076 - protein, 123 aa, Homo sapiens
INPLAQPVIYSTIFAGTLITAANARQLIFYLQVGLEINTASFDSSLYTKTNKPSFQHESCHREYFRLRKATGVHKVSFYSSYPSSTRYSVYADRVKPSNRIANRIIYSSIRVIDIGVLGKIKN

SEQ ID NO: 981077 - protein, 104 aa, Homo sapiens
MYPQVVPLFTSEPLNTARTTSQWNRCGARLGRLLLPAQPILEVTLTRGGTLNLAGNAFKRLKGKAYYPSFTVQLVLSVEMKNWDPLIKATIVLVVVSFHTSTNL

SEQ ID NO: 981078 - protein, 193 aa, Homo sapiens
MLASSPCIGGTVIPLQASLFSLFSPREHPLQLRNLLSKSGSSWVPRHAFSLVRWHGPIRSAETDRPPSRHQRAAPVETSFNASTHAERRLVAHGQQHSWAAKLLITNILGFRSWPYHKTVICALGIISSSTWTHCTSTHVITLHRNFAASLSSAVFIKCSVAKELQTTPIQFTSPQNTRKPAPTLKSFTLQFS

SEQ ID NO: 981079 - protein, 321 aa, Homo sapiens
LSPGVLDEVISCFKACVEIPERTDVMPMEDMRGPGQVVSETTVAFKIIAKLIVSDGCRKHVVICGEVQTILWASNAKMQGDPACPFACVKVGVVLYGQRMTDDVQGRTPEGSLVRTMPGSGSNVWCHSILRGQIVGYSLYTKGVSVYSSSRDYVGLGQMGSPADGLCWCQLPDCECPLVPGQNNVVSGPEKDLLLSMALGINTKGLHGAPLIMPECSCMLESRLREHRGTPAMARLMKVSILPPFSLEVAFSRWSASGGILDLKCLDPEGIWFASWGSEVPVWLDSGASVSPLYKRQETAAGGCHLRGGSGTPGAGASCSP

SEQ ID NO: 981080 - protein, 85 aa, Homo sapiens
EPSANYALASKGMGKSAVKDGQVPGGTTLLEAHGLRSLPPNLVSEPDRGPCALPLQDVYKYLGGISVLVPVGRVARTWCSYQYRV

SEQ ID NO: 981081 - protein, 95 aa, Homo sapiens
GLAGWFMVESQYFRMARVWGFMMTVVQEAFCRGAWFLDSPQACLWDRGRAVTFSSFHGVCLPWANSAMDRPGWGQSVTLSIPPAPFTRPSSSVCV

SEQ ID NO: 981082 - protein, 264 aa, Homo sapiens
MSSRLYASQPSQPLNQFRRCCALLHVLDVLLGLSTLAKWHEEPLTASISRGHWDTSSLTHVQVPHGIKQQVIFWRLAGSRLTNSHSRARFAFTVSTSVFNLNLQATRNPSHTNTIRQGTPRCNFSLVDPGNSHTTPVNAVNPEHFPHRVHTWHNYTHTHTFLTPFILAAFGHTRAPVYTLYTLGKRRAKEPSGPRAGLIGVSQLITLLYHRVEAHNDKRRVGSIKQSRGSMTYTYERPSLNTYARRSRILGPRKSPFAADSSHT

SEQ ID NO: 981083 - protein, 103 aa, Homo sapiens
MDIAVAHERWKDANIGTMRGSSGPDGSQHNIRMLKTWWECGERCGMVEPSWFVDVVVTCSVAIYTGVPVTSCLKGQGHVRLFGGFSIFRFRVPLGFDYFSFLP

SEQ ID NO: 981084 - protein, 87 aa, Homo sapiens
VSTGESVVGGPHLVAKAVWSGEPEPKECGASPERGPHFPVPCHNELVHIRDTLVMTLDMGVLIYSNTKKWAPKEMQCTWFPKWMEEL

SEQ ID NO: 981085 - protein, 142 aa, Homo sapiens
MQIFVKHPLPARGAITLEVGSPSDTSLDNVKAQDPEIREGILPLVPRERLYLCRQSAGGWANFCLIIISENESIACAMVSCVLRKVVCMIYVKNLNGWIITWNVEPRDLICVCEGYDSDTEWYHFLDQKSAYLCGNEVEYGG

SEQ ID NO: 981086 - protein, 69 aa, Homo sapiens
ATGVLWSRGAPPPPRRPDSLSLLSSVGCPASSIKLNPRLRGASSAVIKGPRVDEFYLCFCQLWEVSKGQ

SEQ ID NO: 981087 - protein, 111 aa, Homo sapiens
MRHLYSTYPWTLTQEGFNREWVLGHLDQSWLYLLDCIIGLKLLTSPHSIKSVYLKYFLPHILGSVTAVASLTSCNNLDASIGLRKESVSLNPTLRLKLPTYCIFPSITHRE

SEQ ID NO: 981088 - protein, 148 aa, Homo sapiens
MVKPSGGTNRYCKKTDSDTISRELRGNLFARRRNRDNTSGQKAKDCGRDCKEHKQKAWPGNSKFRLIPREIQHQISGCLITLHIYLFLNNLPRETTAMMASRVTSARLKKSRYQGGGPRLASFNVAACSQVFRIRARLFGNLPKNRDV

SEQ ID NO: 981089 - protein, 192 aa, Homo sapiens
MAAIRKKLVMVVMEPVDKTMLVFIVFSEYQFPEVYVPTSVLRTMWQISRWDGKQRRVGFVGHSWAAKHYDRLRASPIQIPMCILMCVAIDRPDSLEKHPRESGPRSHAFLSLRCPSSWFGNRKDLRTDEHTRGELAMMKREAGDPEEGGVYGKRGLCAFGYMACSATTKDGVRQVFDTWVPKSWSGEYDCWD

SEQ ID NO: 981090 - protein, 40 aa, Homo sapiens
MLTDKGIIIQYIARCAILRTGCSAQVLHFAHTDDTRVFES

SEQ ID NO: 981091 - protein, 489 aa, Homo sapiens
MKGEERHERREDKEETRPRTDTDSQRGSTTNQQARRTKQKQRRKQRKRQRRAEERDEKTRNERRREKKGGKSKKREERERAPAEREEERREREKRGERQAEEREGAKEEKTQEEERKKRRKKQAGEERRRGSTSDKKRREAHRRGERRRRQREQNNGKRRQKETREKVKGHQKERGRRRRTEAAGGNRRRDSDEREKGERGTGRERTEKSKRTKRRTQTREKHRTANGERRATARKRSQRTRAEREPATKDEKERDEREERDKKKKRKNNAEQHNANTPEKEQGKRRDEETHEDRRERTRDRHKREKRAVRKERARRRRRGGPEDKTEGRDGNARARRRRDRRRQKTSKEKKRKEERGRERAQGERHESTKDGRKARHEDGPDAQKRQKQEETGQHEAEEREEESQERKSNEGKTRTTKERDTERTTTRRKSERKTTREGMEDSESTPKNKPEQEGTDDETEKENERTNNTDENRQNARHRKSRHTDSA

SEQ ID NO: 981092 - protein, 91 aa, Homo sapiens
GPREVKKRELVFLQFRLNKSSEDFSAIDYLLFSSFQEFLQSPNRVGLHAGLGECLFQSGKFSGGFRTWVKMSLVKTNGGGWAWKQSVVPCR

SEQ ID NO: 981093 - protein, 103 aa, Homo sapiens
MHKSGSINMINENGHISFKRRSTKKFIKIWCILDEIFQKEQTICTHRRLKNIFLINKDVKNPEKIKEFIARGESVMKELEAVYFLRKYRAMKQGYYSDTIKTN

SEQ ID NO: 981094 - protein, 70 aa, Homo sapiens
SPPACGPRSNGGAGSQHGCLCRSRARICVHFSMCTSIWHIRDSDDHSACAEMEPPWGNMKRPARTKGTTS

SEQ ID NO: 981095 - protein, 288 aa, Homo sapiens
MVQPAPCSSTFAVDRRALVARSPLSLVCSTSVPKDQLAKFAVLLSTGSSKGIGSHKGILRFNEQSIPRGSMCTGMVTFIAPYMCTVCAQSHHMGENICTDAEPSSKHTVCILSCNAGPDKWSQFSSAWQDWWWMARLCCCKVKQDEYLEAWTLGSGMQASKSHMLTVDNSIVAVFLNTRYPSVAQEAPFNPLCSEYPRIFVLSVKTLWVQYALVLHAYVDGRDSYGYRPQQHNTKSVARARNYKPLGRPKATVPRQEQATGGTKNAGALNPVGEGKARHPRERTPRKP

SEQ ID NO: 981096 - protein, 174 aa, Homo sapiens
MRIEKCISVRGPIYPGTRSLMFVREAIARCSDFATSKCHKNFTTEKRNPRKVRWTKAFRKAAGKELTVDNTFEFEKRREVNLSNTSEELCEIRLLMRRRRVDSKSTQKRQAKFIMNRLQNNRELQKVQDIKRSQAKHSSYPSPSCGKGKHVDSENGTAVNDEAVDLGRCSLKSL

SEQ ID NO: 981097 - protein, 177 aa, Homo sapiens
MTQVVHVLVVGRSQSSSLILVGQDSFGLLVLAEKVVGTIRIVNGTLEIWGEERRDELKSVEKRWCNVALEEKGWRGTSSPASLWGPSGPNISAVDTVTVSSTKVGRVASVPLVDPRLLYGGPQFRVVLDKLSGRIGPHKMGPQGGEVGNGEGKASHEGEWYMGTLGEVSKELAGRAT

SEQ ID NO: 981098 - protein, 106 aa, Homo sapiens
MAANATTNPSQLLPSELVDNMSRIKNSHRDEGVIRKLLVLYLGFDDCCQKYGYWKDVIELESHIQVRNEGLLKLDQILLNGNKYNNAVSWRTRGPEDVNELSLSYY

SEQ ID NO: 981099 - protein, 110 aa, Homo sapiens
MTRCSTIMLIPQAYPHDRSCSIYLVLRWTGIHSVLYDLEESQWTYRMTFTELIFNYVQAEAENSTVRGGVLDPSMRRSSSRVTSDEKVTDSLKIIKHKSRLREFSLHFDN

SEQ ID NO: 981100 - protein, 181 aa, Homo sapiens
MASIITGAEVRTDSPDYKTEPGDYQQVSWLRFATCKTGEEGRLRSNRLGAYECKVGENVAMYQETVPPNGIAIRLEGSLLSNFGRKSNTENSFYSPLKRGLPGFGYSQFCACMAPSAEPGLPPRLDRKQLFQGTLSNFIHTTAWHGNIPEHMCLLEQFSGGPSENIKKKKGGRGLGRNHHL

SEQ ID NO: 981101 - protein, 209 aa, Homo sapiens
EEAQKLWEQYKEERKRGSASRKETEHWLKERAIKIRVEEPVSSEVVAIEEVKDSIMRGEITEEEPLKIVGIYKEGQKCNREVVEDGGSGGIGYTIALVTHDIPGRGKLTQAEGNRKEVEDARTDGERTNAGTLSAGTGGTQIVCYKYTPIFRATHTDASDAVQNLGASEQPMGVTGLITEGLYRHTPNKTEKVYHIAPQTLHKEVAGLL

SEQ ID NO: 981102 - protein, 31 aa, Homo sapiens
DLSRGGVRHLTLSSCEPGQDSKTVPALTLLN

SEQ ID NO: 981103 - protein, 270 aa, Homo sapiens
MDMSPHVGLKKIIFVGCVELKWPDIRFIDLSGGDIGMKIEARQFILYLQTVTLLAGAGFLTVNGFGSIVRNARGSGITEGRPFKVPLGELIDLVCTSRTGFLISGAFEYNFSDKSVIQSFESVGFYGSKSPYLGWDSPFSHARRVGKMAVRLEDERMRQVCETPSVMYLVSGLPPVRCVRAVPCLEQSSLLLVLIDDCFGVEETLPLSIFDRREFAGIGHSDKTFPEGVLDYTLRQLGEFIRMGKSHVFNPKWRAFTDNSFPTRCFHPYP

SEQ ID NO: 981104 - protein, 308 aa, Homo sapiens
ALGFGSEEARCNSFGRPESGFIRHQPLHHAAEVRPQEIICRIPEVHLEVQVGCHFCPGPKNRTPGSGLQKKWVMTCQGKGVAWKGLRITVKLTIQNRQAKIEVVLLLCPDPSKAPQRNPTKRERDREPEQIFTTQAVTFFIFGMRMCQHIVLRTRCGPDSVKAENSLDPTLHEDAWGLAQPAGFALLIGGHSLLTLHWMTAQPVGAWGTGPDQVSHREDPSLTRYVEQWGTRHKNATTQPVGTSAEQSSNQPEGRAKKKKEHWRRQNCHYGEASNKHRARATPRPAPDNEDANALETETTKTADHGTS

SEQ ID NO: 981105 - protein, 146 aa, Homo sapiens
GQRKAASFAKVSGAEPGPERFPEHPERSPRHDAKRKVSSAEGAAKERSGDIGAVSAKRSCESESEPKTGRSGRITSPAPKTCAHHNGANRGSTRGNTTRREWVNHKTLQGRLTVRAKRGESEDLEGRVHRPSGLNAGEMKEGKVLD

SEQ ID NO: 981106 - protein, 112 aa, Homo sapiens
MTVVVLLVVVSYFLITRRNSLWMVIVEPPKCRFYDWMNMGIQRPVAFLAYRVSWTYICLEGLASSIPIHQMGGLGLIIPEAIDCTKYPMNSIDSFFWFIGIRLCSYGVLING

SEQ ID NO: 981107 - protein, 81 aa, Homo sapiens
GVPKHGGGRKVHGVESRYIDQQAEPVPEMVVSDITCSCHCKTSECPTDIGCMRANKVLQREDEKKVRIMNEDSSMRERQMK

SEQ ID NO: 981108 - protein, 313 aa, Homo sapiens
MTNIDFRLLLHAVRGKRISLGIDRGEYVCQAKDTVIHFNDPKVPGISGELKRLVTITGHAETKQLRDMLPSILNQLGADSLTRFTETVRRCPKTCVTAEKHHLPTAEGCEWLEVPQSVGHTLQAGGPTNYEAPVLSTLWRNKPGRRSGAATYIMPRAQRVLDCNKPLLYHPGGAYRFTQLGLPTARDNPIREKQALRFVCLTYSTLLFIIISTRSTSIHTRPTHTSHILTHITPSIHNDRTTTRYVYPTHTPTSTPDDYQHFSTPHSRGGMTEDTSTRREHPARRPGSRPPHSTRNNQTQTNHNTRREPTHNS

SEQ ID NO: 981109 - protein, 114 aa, Homo sapiens
MTSIANLIEGGSHAKLQETRLLVVLNQKIIALLRVIPFTYEEERCLFRPPKSDGPILGDGVETPRERPLVSQILEGDAWVGGAFGGPFLKKPFFLDLFFPPHRARVFKKRCGGY

SEQ ID NO: 981110 - protein, 74 aa, Homo sapiens
TQACRDVHCVVKLRWVPGRAVGVLGGGLPQLAIDYKQIAEIPMDEFVELYRYLMNRKRKMWVPEGRFGREVDEV

SEQ ID NO: 981111 - protein, 79 aa, Homo sapiens
AQPGARSEATGNWIGYAGQAEMRLRPHYYKRSSSRCITGSSEYAFPASRYHRTGCLRLSPKERSLEVWLQNMLMEHGTE

SEQ ID NO: 981112 - protein, 105 aa, Homo sapiens
MESMCGELWQRSDWDLGTYCGAAADERSTSVLRKPFSKEKEEENVCTLNMGDKKYEDFGRVKEKGGIILFPCSVCTGEVTDANMSEWSIRKGSVVFQKAVIMSSV

SEQ ID NO: 981113 - protein, 181 aa, Homo sapiens
MTGRRSKRERGKGRQGDAGSRARERGPGGAARRTSGVGESGDHRTRPEHQRRRAAGDTTATHREGAGTPTARPKGRRSRPGAGRPSGRAQRGAPARRAPGPAHARRARPRPTTQDRRPGRRRRERRPPASQGRAGGPTAREQNAADTEARPASAHARQRRQTQPTRPGAGAARRAARQNQP

SEQ ID NO: 981114 - protein, 92 aa, Homo sapiens
MVDRYKSWACVFEGTSFLTEGVQVYILGKVIFVFNYIFTFFKERSQGGVGTPLVVCATYDEKRRLLNEKPYVRENNIGTSASKIGSLGAVKK

SEQ ID NO: 981115 - protein, 116 aa, Homo sapiens
GAEPPKMAGCNRGDGQENYPLYIRRHPYAENELKFHYMGHTSLEVVDEKIAAGGKALGDQRELDLGLRYPNGGLQGIRYVQANVQRLTWVRGVDSSKTALRDNEMRSMFPEAITDS

SEQ ID NO: 981116 - protein, 99 aa, Homo sapiens
ASGEMAPSGSVAVPLEILVLLLWGAPWRHGRGGRCGVITDEKWSRTAWKDDVDDRILCSIVVALFVKRSSTGMGKVVLNGEEDLGVNMAKVDVERAAED

SEQ ID NO: 981117 - protein, 101 aa, Homo sapiens
APEWTEDGGCCRTGGSESSVARHVSAISLAAFLPLKSSRPAACGMNELDKLYACSGCQSKQRLFTLTSCLYAHVTVLSPEHAPYFRGYKRVVNGEFRDLSL

SEQ ID NO: 981118 - protein, 308 aa, Homo sapiens
APASAGLPGAGRGVPASEPFLPWARRRKLEGRGEELRVRVNARLRARSLRDRAREPRVPTAAAAGGGEGERGGGGGSPRRGKQLTAKWRRPWLTPGVDHQAGELNDAYGPPRKLLEIGIVKQPAKRWGVGRGRFPRLRKSGVQDKSSLFSKAEAKFSLLEEDTRGTFGWAAEVNYDRESRVRSPPGSLGNRRFGRQLPSQRTLLPFLLTLLEDRQPGLDRLEPVSGYPRGQNERCFTCFDVTFLISVPLIRMLTWRGAPALLVEPGKVLCGPTVMLVQPSLCGGQLLNPLYTGGAPPSDGGGVIYTSH

SEQ ID NO: 981119 - protein, 73 aa, Homo sapiens
GLAPSAHPVRRTAMIKAILIFNNQGSRVSKFYQPQVYNWEYKWPNHMSEDTQSKSSGRLSIVVSKRDENVVIS

SEQ ID NO: 981120 - protein, 565 aa, Homo sapiens
AVVSTPECPITAGTSRGRGGADNVDVNDVDTMLVSQRDELLRHTSKQREDTVTHSRKKSTGPPHSKQQPRTRIAHPGRRPRAQPTRALTSPQGRTQHRTPRHTPRDNCNPDTPAHTSAQQFTATNGTRGPQPEGEPREQQLNTESDTRATDAQPNTHMSVRRRSSANAQAPQTPADADNNKTRERAKGTTTKKRRRARPRKEERRTEQEEQRTRPRRSPRRRQKSKRAHDDGRTRRGTRRGGRREGRRAQNRGRREAGQASPTAGENDAPATRQQINAAPRRTREMRVQKKRYKRKRRVAAANQDTRRAGAQDRPTQQPEGRQGGTDDPQRRAETQSDPHTTEHDQRQNEEAEDSTDNERTHSKRNAERPKQEERTAAADKTRLETHSKREEAKRDGLRTERQRQAEGGQAQKQIGRHRRHERDHEATPQEETREHTAKQRRRRWYIYKQYIMRDQTRQSRESTDTPGGAHNIELRTEPGVAARTARIATLQEMAAPAQHAETDRTHNRGTDKQKNTERRQQQEQPEQCAEKHENRIENNEPNVTSSRRQSSNDGAAARTGELQQ

SEQ ID NO: 981121 - protein, 118 aa, Homo sapiens
VAASGRSPPTGGWALGLCALTWGRRGQAGIWRRGRDFGAPPGRVAGRRREGAPHGGSALLAAAEPRAGAAMSSCRGARMRGLGARGGRGAVDQELPGAREQKRGDDAPEVQQLSAWRS

SEQ ID NO: 981122 - protein, 109 aa, Homo sapiens
MGPIFGYKRRGSTYCIARSVVLDPFVSDVSLTFMKRDKLEREFSLLRGIISPSGFTGPIRALQLKYRRKRLTQGRITRYPIGGEYRAISYPTLITSYAIKFTNAGFSPI

SEQ ID NO: 981123 - protein, 77 aa, Homo sapiens
PKLVRVGVCARLEGSVRAFLYLSSARVQFGDFGLTKTPWLQKSYRKRSKKKRVKVVVGLEKGYVEKRRYVECAFTCV

SEQ ID NO: 981124 - protein, 329 aa, Homo sapiens
MKGLLLNIGGQITGVGLFLCLGESPACWERDFYQGTMSGRLWSKAILAGYKRVSGTKGSTQLFLKSDRWYTPEMNNRHSTWAQEMALTVLYKQQTQHTSLLGGKPNQQPESSGDTSNLGPSGNRGKWFGAKLRSNSPAKGHGHPESECCCTPQGFKTNEKSLTSLWTRALVITKWIHEHVTSQHQTQNTHQQTHARAPPAHPRRKAKRHHAPGRPGGHRRNQNKEHYAEHTKENRRHDTQRAGHINHKKNNTGDNNKSENKPKDLQETKGKYERGHKGAHINLRRRATKPQHPSRRTPDDATRRAATHQQHNPPHPRSRTHHYETSTTA

SEQ ID NO: 981125 - protein, 330 aa, Homo sapiens
MSKSESPKEPEQAEEALHRTGLALKQLSESLRSHLEQGGTLTVTVWYMRDPNTKRSRGYRRLSHMPLWQEVDAASECTGHHKVRWEDVVDTKRAVSREDSQRPGAHLPVKKILVARHSRNDTATTHHRKQHHPDTVMATTSHVIAPHDWTDGRGKQKGAQVTRPTYRTSLPSDASHTGIQETTIQGHWPPTGHRTQNSPGQTATKNGHTRVTSRPQKNGQKARSGKTLCWKTRHNVRDPRGTNTTHNLTAETNYHGTTIGYANPHDVVSTHTADPQDRTQNGNRPTHEHKSQESTNNSSLTEPSHHNNQRATHKHNPPTQAHKNSRQAKQ

SEQ ID NO: 981126 - protein, 137 aa, Homo sapiens
MWSYKCTLITEACCGAKTLVEEMAIVLQFDCTPVTDRWYRVPYMRVPLWGLNEGMPKLSSLRKISIFIDKKRILTEISDRNMSDHVNIRIAKNEQSFWGSRFQNGQVLEVIRFKGQGQLWPRKNGYVHRVERVGVII

SEQ ID NO: 981127 - protein, 376 aa, Homo sapiens
VADAPRCRGLLLSSRPTSSHYGEPLAAGCWYSMVANMGSDLGPLASKRPKPARTGTLGGSRIPRAQAKPWHGTPLTQPQAARMAWAANASTGSGGTGSDNALNWSGTGTMAEHKPTNREGLRMGKQRPIHRAGWNTRASNGPTLRTPDPLPQWRTHHARTHKHPANTPNHMAPHHGANRRGPGTDTPAATRMGTGSEPTTGRTEYHVPADENVLPTGRPQAPNSITHYTRDGTNLLNETPAYPHRQRTHPHGHPGTTPPHPKRRLPHKGAPPSRKERSKGKHPHNNNYPARQRRRPRHTIITQTHAADSQRTTHTPPTKRGRRHLPHVTPRHHRLMHGHPHADSHPPTWYDPPTPTLSATSHGAQLTTNDNTHHGP

SEQ ID NO: 981128 - protein, 80 aa, Homo sapiens
MGNWTISRTGGNRVPVDQQKESGQQQREQQAYPLCDHRWDNFQTSLKPMVDVSCTRQRLTRHTPCREKPGNNTSTASQLP

SEQ ID NO: 981129 - protein, 188 aa, Homo sapiens
DGARSFPDGRSRLVARFPNTIPRAAGAVPVPHQCRAGHATFRGRARGEGEPGADRAGNAWRNVSGANKTNGAGEQRAQIFGCLLIPASGSTHAGSFPEGWFQQSTSGRRGCTRPKGHTDASGSKCLQANLIFRTGQRGTVGTRGNTEPARGTLTGGLYAKTKWATAQHTDTVFPVFVARLLFTQTDRI

SEQ ID NO: 981130 - protein, 95 aa, Homo sapiens
TSVAEQMATVLEGKDVGVLLLGKLKARKRQTKLLVSVFTQCNNRVFISGLGFPKKKAKHTTHKHKQNTPWWRRDGLFERHQREANALHQTPPIMT

SEQ ID NO: 981131 - protein, 177 aa, Homo sapiens
SETGEECRCVHLDLIKEMRQFLPVPCFPVVAYALLAIHPHLPQRPDRVFMLCSKEPEHELPGAGCSRGHKQQVAQMQAEVLQLRRATGGVGAARVLPGKALELIVERLSPMVAIQCDCQPRGPRTLVKAWRECLGPLPGAPGGTSWLEIHRHTSRQGVTKPQEMLAGPCPMMGGGRA

SEQ ID NO: 981132 - protein, 118 aa, Homo sapiens
RSSHVWAEVVEEKLEGSWGIVSRDVEGGWYSSDLAQGCLEDNDCVGGSCELVRYPNQIRWEPVRALCESELLTRNVLIRSVWYWRQVALHALTLGRCGLVSQSVGRGVMRPFVPRSSV

SEQ ID NO: 981133 - protein, 67 aa, Homo sapiens
EVQTAKEFIKMYEAAENEYQTAISENYQTMSDTTFKALRRQLPVTRTKIDGNKILSYKMWQREMQNA

SEQ ID NO: 981134 - protein, 34 aa, Homo sapiens
REGVRPKGDVKKPDKDEMHKRPARRRARNLRRRN

SEQ ID NO: 981135 - protein, 76 aa, Homo sapiens
GLFLFSSFALTLLLVALWVAWLWNDPVLRKKYPGVIYVPEPWAFYTLHVSSRALTLPWHQVSGALLLVRVGHGGGF

SEQ ID NO: 981136 - protein, 233 aa, Homo sapiens
MVVNRFAEVRDKTIASTVLGRTRGTSGLGIQESRWNLLLLFRDAGCGEYTRGSRTSLKDSWIGVSRDQVSDDYYGSWRCNGRRMAPVTALARDSNGEMWSAERRHGRLPSPSGSGLTRCPMSRRRWLGAARRARRASLENCEQRASCVCRGSQIGGLIFLLPWVPASHQVFHPGGPALLKSASGRVSGPFGAGSAGPVWALARTALACSKGRPGAREGAHSRGGGAHRGAGPG

SEQ ID NO: 981137 - protein, 114 aa, Homo sapiens
QFGGPAGLSLASTDSLDSEQIRGLSSSLRPPSGLSSPAVLASGYHSILVPVSLLRGTLADTSCWWLWAPVCAQANRHELPGFCHDVIRTRRLECACLDHACVECCSRAGPLLLH

SEQ ID NO: 981138 - protein, 140 aa, Homo sapiens
MRWNGLDHDLLTEEAIDIVQGGKYHACQSEEVLVLTLGTQCYLRGHFFWHLLISVTPYLGQIDEIQVGYLDKDGWPPELNQPVSSRAVAMEQGKGEKETRVKCLIIQREKPLIITRKRIEELLKETIEIGIPSPGEIARV

SEQ ID NO: 981139 - protein, 68 aa, Homo sapiens
QWYQRRVPSYGQARALHDEARRKSFVASEDRPQVGGETIEGVYQLKSHMYQHNLWEDWNRAEEMCVNL

SEQ ID NO: 981140 - protein, 132 aa, Homo sapiens
MPQSSNYGPTWNVHHNSQYTLKSDLGTRLVLRKFEVNCCSWGESCWYAERVIIAPGNTWGTSGMLAVKICLPVHVGADFPNVLVAFDCRGSSHYTADPRQPFRWAHRHSMQDADPQGLESNEPAAREALVNV

SEQ ID NO: 981141 - protein, 103 aa, Homo sapiens
MERPRAGTVSQSSTLGALRLPGPCLCRVSELWSRAAMVIVAIPAGTCRPISQYGTNTRSSRRRPLLVTSGHVPVVGRPFTVTKLKGGIHLIEEGPNIALKRKA

SEQ ID NO: 981142 - protein, 165 aa, Homo sapiens
VLHLVPLAMRACGGPVWIDTFTACEDSCAEIGSVRLTSRRNGGPLCSMLVSRAMWGPSIKGKVVVVKCFDISISVVESGYTNGAGRTDSRLRRYFIDPINRYIQHLGPASEICNPSAVTSEPLVVHSNVLGVPCQVLLGPSATMGRPVVCMEPGVTRVDGNSVVL

SEQ ID NO: 981143 - protein, 140 aa, Homo sapiens
GDISGWLTERAGPRLRGAGSLEALVRACCKVTLTSVLLSVLLKRWAGSVLYGARCVFAVSAGVHAAVVLVCVPAPLALLASPGEPGIDPGACDAPELAVALSASSFRASPGVYIERVWYIQSEDLNLEVAQVRTHRLLGN

SEQ ID NO: 981144 - protein, 97 aa, Homo sapiens
GSMVCSRKRMSECAGQEEYLLVAQSLCNGGTVTLPTILECSESSNRAYRTQVGPDQTDFEVNLHWDEQRMLVSNVRLSECGGGSVDAMENRNDMWVT

SEQ ID NO: 981145 - protein, 128 aa, Homo sapiens
DIGASLPTAATQDPETDLRDESMDEPDPSCSAWSACSRIVTLVSESHESVESYELNPCINRRDANTFVSLSAEYGELSVPERIRERSKPVHELSRDACDDYRLLERYAVVYGYNAAYNRYFRKRRGAK

SEQ ID NO: 981146 - protein, 293 aa, Homo sapiens
NSLSHLARWRVMKWRWPDTKREEAEAEKVDAGGEVKKGNLKAKKAQCRGSPIAAANLCLSEELAGSSRVCHVIPEKAMYKRKYSAAKSKVEEKKKEKVLANVTKPVGGDKIGGTRVVTTSQNAVDIIHVKMCLRKLLSQGRKPFSQHVRERVSSITRREHLIILNVPHRGERLVLHEAGGYWLITCDLTLVLNRVSSEEPQKFALQYIKIDVGCHNPETSSDADVKKKKCGRKTPEVNFDLKEIAKRGEMTKVGPVANQELADRTGRKYTQGVDTRHKKKGGGNGAKNTRHRK

SEQ ID NO: 981147 - protein, 94 aa, Homo sapiens
TPLWLRSVQCKRVRSVGVPGSWRCSSPGSPGYPPGRVGRKVCGRELLLIRDRHSIVISDVGLFAILKSLLPTYVAAHYRIHSLLCVPTDSLTLQ

SEQ ID NO: 981148 - protein, 80 aa, Homo sapiens
DCGQAARIEQDFALSQLIVLNTTDCRLSSIHHGFFCSIQVNRTERKGRAIRARVVMELDFSMPLGQKNLFQENSPRFFLQ

SEQ ID NO: 981149 - protein, 279 aa, Homo sapiens
VTEERSTSLYVISLQMSLIITFRAMELIRSNVCFETALIPTLGMSHPDEANQPERPEAQAPYRPNSTPLVGSAYPVTCIRHSDIQDSQTPLRAAVTRLLHNYNSRTAPMNYLIAPEANELNYDKSYTNSCEIVKDTVLYGSRSYELPTSPCRSPHRMGQKSSLGELSRIEGLGGYGIIRLTLITRSPEEKHIAYPFLCDYPVCGIIDNRARSAYDKIDLKALMDNIVNQADSPRSDSHLMQSPLKLNGQVLLDNRHGLHSHYNLLGDQYEARRGKTPSG

SEQ ID NO: 981150 - protein, 87 aa, Homo sapiens
KDNGKSIGSLRMPGRCGDLIMTAFTSYVPRTRSTVPFMVLVPCFNTWLWCEWEEAPEDIAVEVVDGLILRGYGRSSSFEYGYSLGDT

SEQ ID NO: 981151 - protein, 79 aa, Homo sapiens
GTCSASRSTRCYFPYHRRAYHRLHDHALHNAVFLICFLVLYALFLNSSARKLTNTNISDAQGNRDRSVNMIRARANSNP

SEQ ID NO: 981152 - protein, 50 aa, Homo sapiens
MTSDRRKLENAFRVFDRDGQGYIRAAELRHVMKTVGEKLTDGEVDGVDQG

SEQ ID NO: 981153 - protein, 114 aa, Homo sapiens
VDHWSGSRARIEHDDCRSSTYRILVVTSVSVLTCRNTLRRQRVRYLICSVHDGRFWADTLTWDLCVDHGRIRYGSSSGTAPQFNCSEASAKIAKISSRHLYTVLLMGRTKYEKH

SEQ ID NO: 981154 - protein, 102 aa, Homo sapiens
MRIEISVNLFVRPISSWITGYLMYALQLTEFVERLVSSILCKILDMSIEDTCNQEKAHIAAKVQCGIQSIPERAAGSRSLQWDNSFEDLIDRRNECYQSYQR

SEQ ID NO: 981155 - protein, 118 aa, Homo sapiens
MAGVKTVGVEYTMRIKLGTGLLCTGACKKMRFVLPPKSYGSGRLRTQNGGSDYERLREGVDVANDFIRQVSGQLLPLIPQVMDIGTSFSAKLTMHPRIGRIELAHLKNACTNCTDGIP

SEQ ID NO: 981156 - protein, 192 aa, Homo sapiens
SPHEMFRSSILMLRTSFRSLITVDSRQQLNQYCISLSSKSATLSIQPVSHLYTPECSVILVSMALRLQGDDDFTIAYDRLVVTTTYPLDHQRLNVNFISEATTESSLKRCLQLTSSLAQRTESNSSMEAKQGVKNDVRRYIEVMTLKEVRGIPSFYGRPTVGDVPIGCPECRKGTPSRMEVMIDTFARSKLV

SEQ ID NO: 981157 - protein, 245 aa, Homo sapiens
KETSSAPPNPHYCSCTDELNHLRIQTAKMVAADAIFAFINARFFISRKFQGVSSSRYLCGGSPHSTLREFPCVSDVHTHRRRTRRVELSPECCQSSPPDFCSARPVNVAKQQHDKVPESFGRKRDEVQSSFGPRSGKTFWETTEWVSRRSISLDRGNPQFDVSDTVMYLRRGKTLAVRNLMRSLTRSDTLLLRTKDISRNGEIEKPSALKKLRLMLPENTFNTLSSSPRDSDLASERMILCSSLC

SEQ ID NO: 981158 - protein, 180 aa, Homo sapiens
MSMSAIGGRKVITKSLTTIARGRLSVSTLRGHRGSERASFRVSASAVLAIVVKRVPMGGQPCRQSSTIALWVVVGLGTFRHGYWARGSADLVVTTSLRPRAHPHRLVPFDTHYLLQSCVMGPSVVPPKRVNGGLVLQSIGGAIRREIFVRRPEGTPCRGMLHGFRNSHLTGGTPALAEVE

SEQ ID NO: 981159 - protein, 122 aa, Homo sapiens
MSMVRTKGRQMSPWHMYEENRWVWHASQLRTSRYGCYGFPVPTLLVTNRNSEHSRFLFSMRRADDTIIMQPRSNPRFAVAATIAHQGVHKGTGHEIILLVVCPPIRILEHTRMTLIDPLNGA

SEQ ID NO: 981160 - protein, 120 aa, Homo sapiens
DRFADATAMEKRVLLYMVKPTVFFEIAVDGRCPWIWVSFELCADQVPQTADNFRALITGAKGCGRHGFLLFSTILTSMRYTGAHARLTVLHLYHNGHLGGQESTLLWADNFDMSDDTFES

SEQ ID NO: 981161 - protein, 104 aa, Homo sapiens
MIPGPLIFSPRMVAYYQVDLCSMGKSIVPMATRYLSLGNFLGKMMGVVRIAYHEVRTLLTPTMTLLWSRKSFIFLENIISYKSNERLMAYARCCVKRHNCTVVS

SEQ ID NO: 981162 - protein, 162 aa, Homo sapiens
MRSIKTTRDRVPTYQYNMNFEKLGKCIIINNKNFDKVTGMGVETETDQDAEGSSSSAFRSPGFDVIVYNDCSCAKMQDLLKKASEEDHTNAAWFAVIPLKPWENEMYFWGTDGGPPNKGFDTATLGGIDANPFKRNPKSLSAAEGPRACDWIHAESGHYARC

SEQ ID NO: 981163 - protein, 156 aa, Homo sapiens
DGRCSAAVPVVIASHNLLRQQLRRSGGKVLLWGLQTRSDNVQPYRYNIAPFCFSVDGHVEDAARSEKWFELVAKAKRVACEREITTTVTLPCLSEQHAGTACQKKTQTLGGKLLARISRGRNGGLLLAHAIGRDLTVENPAVNIAEMDLKHRATPD

SEQ ID NO: 981164 - protein, 111 aa, Homo sapiens
MAEREDAAGVRALLSWTLSRVLWLSGLSETGSCPEAPDHGQRKRLEVYDLIRTIRDPEKPNTFRRTWKLVLGQVVVGSSGELNEEDISGIISRFHANSTSLLLATSYWAVA

SEQ ID NO: 981165 - protein, 156 aa, Homo sapiens
GYKFQPTVNNPYLQLPQEDEEDVHDGRQVHDKLQDGSIKMKPLMGVIYVPLTDIMKSMWSRCTRDFIFCSSFFHTCKGMHCKMQHQLDQYKTPLVDCSVSVLKSFLKNQHHHSLFWTLFDTVHFSRMNMCCPTLGLLILQEEAHEAKIGRVKDATV

SEQ ID NO: 981166 - protein, 69 aa, Homo sapiens
ITPLGQAVIYSTIFAGTLITARKLALIFYLSRPRNKHASFYCQLQPKKNETARSTEAAIKYFLTQASDP

SEQ ID NO: 981167 - protein, 105 aa, Homo sapiens
MTGYTPDEKLRLQQLRELKKAMAEGPGAEPSGSRVLPPTRKMGPMEKIRGNKILENKIPLGGKKWAQWGYTKRSILVFTHCTVYPVWDYPLLHESISVFLKNHMA

SEQ ID NO: 981168 - protein, 173 aa, Homo sapiens
MFNAPRYPNRAKVSIIDLFLNLGYLYEWSPTRVQLSLTFNQLIIEPAREDMAGLDTAKTEKTLMELVISIECKQIPNKHHGVLKLPKAALKNFELEATILEQEPNAPKQYMRIDFTQCKANCYTQCDPLICDQWKQVTLGITAASPILESISTNRVYDTRCGMQDVLQMVQPY

SEQ ID NO: 981169 - protein, 114 aa, Homo sapiens
MLTKGEKILLMKCSQCHTVEWGGRVTDRLGPDLHGSLCAGRTGQCPLVYSYTVRPCREQRHHSGERLHCMEYSENPKEVHPWYTRQVIFVGHLNERNGKERADLIGCICKDIRY

SEQ ID NO: 981170 - protein, 66 aa, Homo sapiens
MVILALDTGRLDTGYWRVWSAAFGGLARRAGPPYKGRREQPLVAAPQFLGPWAPRPLWSGPGAWTS

SEQ ID NO: 981171 - protein, 91 aa, Homo sapiens
SHYDASLPTVATAREPEIDLQDEHHDRDLYPSCALRGRLESASNFVFSKYTSEDAWDLMNLIPFISMGRVATSAFHIPLHDQEECDDARVQ

SEQ ID NO: 981172 - protein, 206 aa, Homo sapiens
MCVHDDFERRNRLVSRFYSHPVLAVVAIVRHRDESSWVPGYMRSCKPIDGKLCMTVRKLTLGPSSMPAVTHAVMKSSVITIRPESKWLVLMPCCYVYMRVFMYLCGYSQFKAALMEPYVFIEGGVAMIPFFCYRLLDFVSQVRRGLLLSSRHLFCLEIKMCLGINYLIVRYQDDPPWPWCSQLASCSLACVFGLIHHFTDCLITVV

SEQ ID NO: 981173 - protein, 216 aa, Homo sapiens
MLTLLFLSLWLRKERLGCQSHEAAVIGGCWLYLAVYVKHAEKEPGFGLQITAEQIRRAKGQRPEACSTDESSNVGSSAALDVRTYLMIPSLQKYFGLVSVMLNVIMGTGIASCYQVSSQHPVVLRRLSWLVSFTRSPRQPLVTLAHAGCARCDGFYQCTCSCDGDPGSTGTLPRRFSPHCSGLRQAFWGHVAFPSIRAPPCYLLVPPTAAGPIDVP

SEQ ID NO: 981174 - protein, 221 aa, Homo sapiens
DTQHGMCAECLSELHEPAWVLYTFDPARGNERQQRVRDGPHRSMRRSRPSSCAAVYPLHHGTSGGSVHCFRSRTLSLQGVVLVSGSGRRALWRSHRLAGDPEGFIVAHFASCLRSDTKRFWSVFVPWADAHSTPNVLLLGIRGGRLRLLAGFIGSGLQYSRCIVPRSVTGNSGVSAGYARRKMRSLLAFELVAASEAPVGPTPVCVVWRIDSCCTGALLAW

SEQ ID NO: 981175 - protein, 141 aa, Homo sapiens
MSPLHHFRRHLRLNIFVATGFHGLHVMIGSTFLTICLHPPTNIFTLSSKTSLRFEAAACYWHFVDVGSDYFCMSPSIAEGLYTKQPPITEKTLPLFWGVLPLPKKPFFNHISWAAAAPMVSYHLRKQGSSETRGLNPGGGT

SEQ ID NO: 981176 - protein, 198 aa, Homo sapiens
DFMLGAKSDGETILRRPPVHLPGAGEWLESVALPWQDHGVFSKLQQNNERRAMSSFEKFSHMDWWLLDLQSYDGDAQGREEIDSIFEQSRGKNCNRSDVMDRYWCGVKPNYQPQCEEEPSTDTGPPPTGAWLNIDIDEVVYDEDSPYQNIKFYTRSSLEIFSSLVGMSLAESDLAYTRAIMGSGKEDYTGKDVLILGG

SEQ ID NO: 981177 - protein, 145 aa, Homo sapiens
MTTASTSQVRLEFSHQDSKAAIIRLINPVDALRLRTVLRVSNALTMFAHRVWIVVFEADLCRDIRSFTNSSMRRGNNCCEIDWKLQDPHDVAEVFLSGYHSSPQTVMDCEKRVRNASEDVPLPFVDYICESGPLLGYCSELGNCQ

SEQ ID NO: 981178 - protein, 115 aa, Homo sapiens
EDLTREDRRPPLWILARPCSTVAVRACFPYHAVRLLCQLFPALASQPCSALYGLYCTSWIMGLATFLRVLCAPSMRALSSRNIETTDLVNFVVSESIMEFYLWLGFPVIWRAGYE

SEQ ID NO: 981179 - protein, 194 aa, Homo sapiens
MTTNAGPLHPILASAPKMTTLYLMTAPQLAYTGRGRFYVTGVFSRDHMAVVRSVLLVVPIVDLAASVPDAGLQCVGSFTWLIEGLVLVSTTNDLLGGTHAFVISTLKRVCQWVDRRYILGDNFTVCMKPITAAMLGDHSVLWDGDSPFSGRSPPFITTVVDAEGTETIGEDVRLTSVDRATAKEFQYGELEQPL

SEQ ID NO: 981180 - protein, 307 aa, Homo sapiens
MVRPRDTDHLVASRYARPREYVLSVIVATGYKDTGHGRQSVVCGLAEARVREVGCGLITEWNKIQEDEINAGPKPCESQDGPLTAQRNVYNNDVYGSRAPPFGHVLSKSCKASLTLCASSVLMWETIRDLIILRNALDLLFAKGLPEVISRLADLRKETEQSTHIRFTHFQLVTVDPQLGKTSLSWHSGSGVHLQNLEAVRNDLELRGSKEYNVHSGQVREGHRGGSPKGRTADTPGGTRRIKKGSLPAGAVTRMGIEAWLAGSRGLSAKMTDNPLRHKERGPRHEGQRAQQTVQRVAHMCAHTLAS

SEQ ID NO: 981181 - protein, 79 aa, Homo sapiens
MGLKCHLLRFQDDFVSKEITGQPKGSGAEKGQIGELKACAREYIGSFWVRRYTSQGDIRGVPCYFVSPRTNACIKADKS

SEQ ID NO: 981182 - protein, 120 aa, Homo sapiens
CSFSSRPLRATRVPTAAAAWGRAERGGGGGSPGAAAATAKWRTNVLTPGVDHQAEEPEMTLRTPPALSSKIDVSNPAKRCGGLRAGPVFHHIHETFGAQGNFFPNFKAESTLRCRQKGYG

SEQ ID NO: 981183 - protein, 120 aa, Homo sapiens
MICMHEDVPHVPSNPLDKRRLLRNDWPQYISPWRIVWSGSTWWMATCEYFITTCTSNYNLWISNLDVKRIPYVMSSHLASIPQKVHSYDIEMIFVRHLRRRAEMGMHIHITSYSREEHGT

SEQ ID NO: 981184 - protein, 319 aa, Homo sapiens
LLSPGVLVEVTSSLDPACESLTHRRDAQGRQGDLEVQLSFLKIIHLLDDYPTCVIVGADNVGSKQMQQIRMSLRGKGCGADGRRTCMHALRPSEGNLENNPAAGETAASYPGAWWAWCAPGGGPPLRIRALCLLGAIKVPACWPCVVPFAPCEVTGASSGSLALGPVCRSPLSWLWYQPVNISRGCHCIILSDVLAGSRHGVYVAAGSEAGACWMMFSLFPFYLGVVLPEVFDGGVALDPWVLISRGNSGSLLPKCCELCLLLGWDHFDRRRFNEGTGVGWGGGTSRGGGGDAWGPPGPLVAWRNARFCPPWLTPRGVG

SEQ ID NO: 981185 - protein, 305 aa, Homo sapiens
MRAGRARTAGGGGADLAPGWLCPHLVASVKREPPPPSVGDSGLEAAVTPCPICLGGSITGPWPFGQFGAHNVSWGEVVSKPCLGGLPHSPVCAQFVPCLAFLNPNRGWTGPTPCWDGRAPHLRKGRPCRRLQTKKGVPSWGKIMRGDNLGSVPERVQGARMANGPPLLRPRVCPTLRGLIPEKYPQRSHHERVAVWVPHVDRRKPGKHLGAKPRKRPKLGVVPICRMAWGDPDTGDQVPALCHETFPRPFVTQFAEASRCWLLWTEEATPAWVGPLADWWLRGSSYVRRARIAAEASELSTLGFR

SEQ ID NO: 981186 - protein, 88 aa, Homo sapiens
VPTAGSSGGGGEREGAEGARGGEKYSEMAEDRWLTPRRVIHQSRRNPGIERAKRTPPGKTSLEDLMVKQPAQTGVGVQARGAAVYTTL

SEQ ID NO: 981187 - protein, 164 aa, Homo sapiens
MPYSVAVNPKPNWVSHSSEVISIEIISVNLAPMIHPYMVLLSVSNSAGPVPSDSSLASGGPGPISGHIHSCFCTWTYAPLRRPASWSPASFTFLRYPLRPSINSVPSPQFCTPTEFFFWGRSLPRQGICPKKGSPGEEAGDQLRVSVASLCVAFCAERRSAPPG

SEQ ID NO: 981188 - protein, 104 aa, Homo sapiens
SKMAPQSVSVHNQKSLHVDSLRDGMYETSCVSIHENREGSQWWRQQRRELEGTYPSVSTFYESPAELYNSHRDDLQSRWESYVKEGLDRLFLVLGRTSPWKIVV

SEQ ID NO: 981189 - protein, 489 aa, Homo sapiens
TGSAAGAAARTRSSGPPPPAAPASRVYPRALEGGPPALTSPRGPGAMAQRKIAKEQRNSSSRGFRQGGSTSAAASKPRGPEEETKHWEDTRLGGKARLSGHFIPSTVGNGGMGSGLAVWTSVAVVDKIWWTYEEVLGKPGIYDADGDENWMWMMPKFYRTYREIYFRARSPARKRLSTHGAREQVPVGGRSQISKMKQEPSGPLQEGYATCGGNWPEWPGTPEVASRQGKHRPNGFKRVTEDQTKIATYGLSVPVVVQPSISGRIAERSRTRQYSHTRRNETRATRTRPVALPVNTQPERTSHETKQAPSAQLYTNDTCQTTEKKDREETNGTTKGGEDHKETRTRRKGNTTRQTTNEPTREERAGRQERADGREGDEKGTTARGAPTNTQGERRQTGRSKNQKRRDKGKKKKRKKSTQKNTTEPKEKPTRKASQHRHPEKQKHKRTDRRRTTQEEEKKRNERRRTQKREAGDEGHNEQNRKNTEKNKQ

SEQ ID NO: 981190 - protein, 218 aa, Homo sapiens
MGMERVTSRSRAHLRNLGCRSGMSTLNMHLTHKAKTPSPRRCMSLATSEHTTPETNSPRTPGKRTWYSCCLRSRLVTQHLTRRRTHPVDCSLSWSAHVARGVGQHHALGQEDSYSDGHVSDVSENLTERLFWIQAGTSVRDEELALIGVRGDLGLDRADDVELLQRAEAVAIAECVERVTECLRSMTDKSMAEEEAEDTVECGGSRTVGYIDANTLTI

SEQ ID NO: 981191 - protein, 63 aa, Homo sapiens
AKSMLNVSVLSDAEDDVLMDVLACKQLITRNMRLSVDKCLEQIIRLVNVSQMLAIGLYNVLGA

SEQ ID NO: 981192 - protein, 102 aa, Homo sapiens
LVRKRVCLSEHRCRENYPVKAKHGTTEEDSISTIVGRSETAVDFWGKVSPAYWCIVQSNTTGAWPSEQQGYQFETTLLHEQDALAWRLRTHGLPFQCYALAS

SEQ ID NO: 981193 - protein, 85 aa, Homo sapiens
ASPLVHRWRLLLLPLLVLFVCSSVRDLDTSFVKRHAWGDSVRFAMELMSSPMEGVSLSENKTTLVLYSEGGGTGMDACVCTSYPF

SEQ ID NO: 981194 - protein, 109 aa, Homo sapiens
MRAHVLVWGVYHPDVFPGDIHENSALEYRGHHYKCANANVAYEYQYRALVFTLCVPILSGVGRGWSKHPEEKLYIYFVFRRCGDLLYTSALFVRSCRLHEEGSPLGKKE

SEQ ID NO: 981195 - protein, 108 aa, Homo sapiens
MRIEKVLFLFGAIYPWTRMMFVRKDCRGVQIMQTLNVIYNFTKKRNPRKVRWTRAFRKAAGKELTVDTIHLKFEKRQKVNLSTYQRELGITSIDASERELKNSNEKAP

SEQ ID NO: 981196 - protein, 316 aa, Homo sapiens
GGSRPERTNVSAGAREQRRGGRRRHREPPSELGRKRAKTQAPEQVSVSHGGGATGMPRTERAGARSVATGIYEKRELRKTFTTTHGGIRQRRNARKQTTEGGHNMQVQLEKHQWAEEKEEGIKRGNKRGSSTEEFHAGTKRQKSGTEAEKTMEPYACKVLEQRRSESAEQQRVGGTSRNTKDSTGETTNGADYTTCERERTEHTLFETPRYWASEVTNDSARGIGRIRESKQQTRKLWVHAPNRRYIIHRVNPNQGRTVVDGRRKYKVEMSERRPRRHQWIDRQAALRNTHTTWVDNSGGGHLRSETRIWKAPLKH

SEQ ID NO: 981197 - protein, 95 aa, Homo sapiens
SFCLLPWDDTARSPLLDVRALDLGLLSLAELGAIEEYCCPIPEGAKRIETDILTHVTIQHHLKPLLSSWVFPGTHHTSRTDGGLVHLLVLVCLEL

SEQ ID NO: 981198 - protein, 172 aa, Homo sapiens
MQDTKANTNHLSKDRPSIRDNPIYYLRSVGLFAGFAEPFYRLQCQLPTPPIRRSTGRPTGHSPRCNPSRSPTPKSLPYDSHQEYHAPELHHSLIENWRNPNSSGIGFMYKFVRGLYLDPAYKASESPSSLPFTILLTAIYGLNIPGTPRGPPDGTSRIDWAQLPHESCFIRK

SEQ ID NO: 981199 - protein, 103 aa, Homo sapiens
MYTTRKATVPYGTSQHPRWSNKGPSMTGSNALWYRPAEVNSIPRACIAEHYCHSPRTSHLTAHYGGPLEPPDQGFHTADTDLEYGDVDHCLTFVRGIYNRQSE

SEQ ID NO: 981200 - protein, 95 aa, Homo sapiens
GLVSRRRVRAGVLCVAVAGAWDSGHYELVVSTEERAAPFSLRVPEVFLRNEKGQYISPFHDIPIYAEIRMCSHGQLKYHAWSRCEKVGIANKVTL

SEQ ID NO: 981201 - protein, 112 aa, Homo sapiens
MTSAYGELHQPNCRPIITSDGRMIVGTLKGFDQTITRYRMKAMNEYTALHREVEQVVLGLYMYAGDNVASHWTNIDEETEFCAWLGRNIRAEPLKFCSTHMRHNNYHTLDIC

SEQ ID NO: 981202 - protein, 95 aa, Homo sapiens
IPNGESELTDCVFALANRYARIMYDHIELKEQNELNSIEAFLTTLDQKMVMDTNKQNIGGHCAYPVSDCISVRARSPSTNAVVIKRQCINERYDA

SEQ ID NO: 981203 - protein, 120 aa, Homo sapiens
MTYTLSEYAKDNKELFMRIIDPIIVRATIDKQYHSQLKAPMIGRIKYRKRSLEIPFHDTPQNGVIAGQYETDRKVSISSRLPAGCDVVIRIVGKTWLYEIHEYATLLNLSRRKRALLFLE

SEQ ID NO: 981204 - protein, 262 aa, Homo sapiens
VAWLVVVPLLGVLGWRGRRWLAGHGLRRRRISRDGYFLPLLAPWEHRPAPCRDIYSCPRIASSCVKYRERLPGQRPRETTENLCSAPLPKVSQQTQEARCPHGLGGGHTQERQCNGALESPTKGTTHHHIHSPPSKLVGNQANLYNNAIAGRRRHNSETRIGARHRAQVATRHGNKGLPRNTPQGVIPIPHGGTYKSVTVTGQRGNPLAGSPVAMQKKNQNSRVPRGTPGIHETTIGKKDREWAPGQLQPHAQEQRRTNRGS

SEQ ID NO: 981205 - protein, 253 aa, Homo sapiens
GLLFQVPCRELSGPVICERFTDVSKSGHDVPVLPGSYGRVVSLYQLHRSDKRAWYHVSDSLIALWDGTWPARVEPFGEVRSRPYFTCRDISIRSIKPDRIEGPSYVQFISRCVPALTDNSTYGARHLHSKPSVIRFMKHELCEDAFDKNLERAPSREPRLWERVEEAHGGVSDLGAQGRPKFPYSNVGTSLCNLPITIARKLRGVPFHNNYTRKDTLGGTSDILWTLHLRLVGLCAQAIVLSVDPNLLAGYLA

SEQ ID NO: 981206 - protein, 206 aa, Homo sapiens
ALFARNRHLPVIRQNDEHNGNEERHPIYVSEALYAKHGRVPLITYMRIYYRNGDMVHIKANGYCQKGMPQQVLPWLELEQSTMLPSMLWALLLTIKLRARFLPRELSVRIEHITHSKSRDSFLKRVDGTMISNKEKNAKRERYLGFILKRQACSDLRRLRTFVKPTGKEPELWNPILYEFMAFFGCSRNLITASGLRNLNGNFLWV

SEQ ID NO: 981207 - protein, 102 aa, Homo sapiens
MRVYRLRMCKSIPLSGFSLLVLLVQRVRSSGRREPQEQDVPPKNCSRGQNRDLLTRASKLDAEEPRIGAGLDCPTSGHFFIPLPESTRLGDVATIQKPSHDV

SEQ ID NO: 981208 - protein, 146 aa, Homo sapiens
GREMRVCSWHDYRLGKLGAEIDDRKPRLTELLADLYLRCQKEALAEKEHKVGKEYIKRKLAYGVSLVLLIEAQVPDPEPARVISICPMSLVSHVHLAFAGDIYSEEIDGSDLFPGPRTLREMDDRLGGLVLIGVYLGSYGREPKID

SEQ ID NO: 981209 - protein, 60 aa, Homo sapiens
MGRYCSYGEPGDWLNWPQECTESYLKRQPSPVATYQGVLSVLTYFIATKFGPGEGGMAPG

SEQ ID NO: 981210 - protein, 37 aa, Homo sapiens
MCTPISSSCHENLELDTERYSGPIPYVPGDAKHVVNA

SEQ ID NO: 981211 - protein, 163 aa, Homo sapiens
MVQRHQEEQSRVVTDRNEDGDRPVSRTRSEKSLTELFFSSRKAVGDRYDDAQSSLGGRAELNRAFVLRISTASTCHAYGPFAFPRPFALLSPVCLYLLYAVYPGSLERPVAFLNLVLLRGNFTGSESQGSVEYSDLTKHKSSAFSPRRLKAPCRCWSKVDLQP

SEQ ID NO: 981212 - protein, 113 aa, Homo sapiens
MAYWMDSGRHSLNVPRDASLSPVSPGSPDVTSKAINLPSPCPPGAESLVFRPFIASQRFAYNVGISLKGARCGLVAHDTTAALPKNNYVQEGGGHMLKLWTRRLMEARRKAMN

SEQ ID NO: 981213 - protein, 145 aa, Homo sapiens
MASLREDDLMFMVPGFFQPAALHSNHRTIESLLLFSHAFLALPCKSRGLLLKHLVVPSQCGTMSFMVAEEDIVLALLQVTPVAQLCQQEVLTPWKTLWTFTMVPADWLKLPLLWKNARYLGGEGLFGKKKKGAPKLGGKSCVNRT

SEQ ID NO: 981214 - protein, 114 aa, Homo sapiens
DRRYQIDAAISDIHEDEKDSWSIIVLVPDIYYNQHAKTFQVTAWRFDKENSESLIDRDYMERAQRLIRVSTYLRGLTTILLASVAPFMQHHRSNVPSEDRKATALLSLSGWTLN

SEQ ID NO: 981215 - protein, 44 aa, Homo sapiens
MNCRVPKRLVWSTNGIIVTRLISPLLRPTGVTDYPYNPCVGSYL

SEQ ID NO: 981216 - protein, 308 aa, Homo sapiens
GRARWLTPVIPALREAKRREDSLSPGVRDLPGQYSETPFSRKRKKKTKDKKNKHKNKNKKLVGAPRWAPKKSFLNPLRVGRARGRPSYGNVTHLSLKRRWSPQRNPPAPTAAQRVGGFFPPKKKKPRRGGNTRVFLGTTPERWGGERPKRGLLSYTRGGVSKRQAPGSIKKITPRRGGRRRHHRIRHTNNNTRDKNTRENQEMRKPHTQRSAHHHQEQKTHTKPDRQEETTHRDTNPRPPETTTTHNSTEHTNTKQKKASHISQRDRTKNRDDPRQQRTGQTARIKQHIDTSQITRRSSNTRHDTTKH

SEQ ID NO: 981217 - protein, 70 aa, Homo sapiens
LCCQGECQCLSLDLIKEMRQFCQSLCPVCAMPTETSIPRLYPSLAQYQASCLCSQVTRARNFQVVLVHAE

SEQ ID NO: 981218 - protein, 112 aa, Homo sapiens
MPGPPERQSDGAMKDRGTTDAKDGIVMETKQEEGVSSVSTRKEVNKYIPLSAEVWTICNVFLLNRGDPFTIFGHKGRGANIFVTLGEEYIFPRYKENLVELEVYTEGLTQPG

SEQ ID NO: 981219 - protein, 110 aa, Homo sapiens
MLTKMVNGTSRQIEKEVGAVDEISWVENPHQKHEYTDMINEVDADDNGTIDFPEFLDNDGRKMRTQTVKKKLEKAFRVFDKDGNGILVLENFCHVMTNLGEKFTDDEVMN

SEQ ID NO: 981220 - protein, 178 aa, Homo sapiens
TADNAVRTNMQLKEEWKIKRLNQQTDVSEHVFSIFKGILRKIASRDSQVGDLVLIIQMNAMTISVLYYCVVLLYDCCLHSDVSYLPWIWPNSKLQGASKKTLGHLEKYMDRRIAVKPIRGKTDLKFLGGLVDGVKPYHANRNVSVMDEINTFYDSKPIRPDGSFINPETAASFHAEVR

SEQ ID NO: 981221 - protein, 123 aa, Homo sapiens
DEVHRRGKSGCYVVHASTPSVFCLPFGSVVGADGSCGQRSSFELVAARLWVPGYLLEPFAGSWRVGRCLDAVIGVPAFARQVVPGFQSRQRLLRFNTVAITWACASSNAPILIECRPSVSIRD

SEQ ID NO: 981222 - protein, 57 aa, Homo sapiens
MAGYGITTVVKISVRASTLRGLSQGVPGNPAVLLGWGPCLLVILCVAAFRLVAVVGP

SEQ ID NO: 981223 - protein, 101 aa, Homo sapiens
SRSGRRASPALPGSCARYPGSGSRLWKLPWRRDGPRGVGRVLENAVLRVLLSHGVLLMTGYILLHFLPQGYREISGSYKARDLIPNTQSTEPSTRGLEMNR

SEQ ID NO: 981224 - protein, 226 aa, Homo sapiens
MGPSRPKSAPYTGKATTGQQERRRQQSRAQVHKYVTEGRNEPRVTRGRRSQGAEIPGPRDRGQYATRHGHPAQCSQHEGGTPNDEQPGTRCDNRWDHVETDWQGQQQAAGNTEGVICGSPDVAPTKRSRRRPHDRRMSDNEAGERPHMDRDGQRGTRSNETSGDGQTITLMLHLERRHKMWATRHVLPAAPNAARVVEEDEKHHWAERMLTHVVAHHLKEITESTE

SEQ ID NO: 981225 - protein, 68 aa, Homo sapiens
AWGDSVLRGCSLEQRLVISARAWLSYAKCVPHPMEDPMDMDMSPLRPENYLLGCELQADKDYHFKVDH

SEQ ID NO: 981226 - protein, 215 aa, Homo sapiens
MRSALPTSEMLTGGIGQCVYSWWAARNLASRDLHPVYPILGAYTLLCSDLCSLSVLCCGTTLCMIPLCLPVASLAFALLREVEVTGGRVADVVGGPVYYCLPSTSVRLIHFWGPLDPGGGLHACDISSAVTRSPSGLVPSLCPYRLILVTGHRLHGPSDGVVLVSCVFPMIIILHYDVPSDLGPYSAWYALRCRTWIPPFVLQVPTSSAWSQDLC

SEQ ID NO: 981227 - protein, 86 aa, Homo sapiens
MVCFRRCLPRSLSYAYGQRTVGCGFLTLTDVRLASQFWVDTGGSIRHRSQTLRVAPCAWTVSVRFFAESLCTWDGAPQIVLLYVTL

SEQ ID NO: 981228 - protein, 233 aa, Homo sapiens
MGKRTDRMERVRQLEVGSRLYAYWSWTRVLDRRVDEWDKWAIFPEVQGNLQDADNNFWEAVNKVEHGPGSRWHALVYTSQEQLAVETSMVLQENLESDTLNLIDYGTIKRGKKKHACMTKTKRTWPQVLGILTAILIVCHRRQRGELPGLGNRQRVHSMPALTAELGGCREAAHTMLVLLRLCPSAAYGRRDYVAPSLRPEGDPSASVALVAMSPPRPFPLGPLGSRGPTAPG

SEQ ID NO: 981229 - protein, 498 aa, Homo sapiens
LLNVSRNSTSTPYSLSLTQLLHRPKLLKLSDWPLTHLTANTSCSDYTSCLLSSTTHWHTLLQAARPAQPLLLLPSTCSSPSHQATRFPLSAPLSPPHTRHQLNTHCCLPAPLLPNCTRFSKRLPATTRTRTLALKPPSAHLHTATLATVFRILPLSALHAHINTLVHAYLPETPRCTKPLSLCRRSTHFLPTHYTYTLASLKGPKPLNQPVDLLSAHPKTRRGTPNSKTGTLSNAERLPHHKLLQLLTSTDLNTFLVGPRHTTASNRSTPLTLVHGGPHPWHPFFSPPAPRQSLSQPTATLSATPNTRNEKISAAKPWGSPCQLGAPDLGAPPRTLATRGSSHLAHANIARHPPWRHNLRLHTVDPPPGFIYAFKAPTRLLPYVDRKGSTPRNVGAFHAATQPPWARLDLRPACGAPPARFAVSFPHSWAPPTSLPRTAPLAATGCVLIVLLPALVPALPTLLRRRRRVLLPTLPSSTTLICAVTARTSSPAPSIARP

SEQ ID NO: 981230 - protein, 242 aa, Homo sapiens
GPTERKSERPYGRRGPGPEMLSGKKAAAGWGLVQGSNRDGGGPWDRGWLRKNGSRGACANTRGSCRARAEAGTGVRMGERQKPWKKRSLSGVHSPPGGSVVGKPGMRTTGGTHSARALMLNEALGSVEDPCGERGKLRRDTPKGRWDTRAGRKQEARVKGQEKKSNESWDPKLLQKGIRPHVRQKRQKWPKTRRKGKERLPPKERRESPERSKKQETESLEKPGDQAGEAQRKDWSGELHKA

SEQ ID NO: 981231 - protein, 266 aa, Homo sapiens
LIVRLTLRSLEGGFGSDSGAPAEADPRLIMEQVKCIACTELLHEAMTDKGVPGRVYRQKTLGAPVDKLRAEKVYRHLCMDRLHGCLGTTLCLAAYNLCGQCSRGNVAQHVDAGERRGHTNPCTIYPLRRGFEPNTRVTNWYKYLPCPQAIASRLTTGELRTTRELDVRQQTPPGLTNNDQDQSHDWDTYSDVVGPLVPSLRNCCAAKVPPHEEHYEGNSPLVVPQGNAMILLARNGLYWNSGVDVWPQTQELVHSAGLSTYIGGGK

SEQ ID NO: 981232 - protein, 82 aa, Homo sapiens
DRLFERYCEDGERGLAMIKSESSEEAHASGVRCLDLSECIVKLLRMTVSIEMQMSLLACLISDDCAQGSASSSIIRGSRVRI

SEQ ID NO: 981233 - protein, 299 aa, Homo sapiens
MIMRRLKKIQARKMGLNPNCIISEYLCLQRISCSILIGTEDLLVLSGFGQRRFDGENFGCMLVSDLGASESRVNMIGRFLSRFENSVVVALIFLPVIVPSDLQNKPKSNQEKGPQALDIEEPPKSHVKTHQHQLAKAGPNKFKNLAPCEIVGLGLRSLVLKKGAGHSNLGSTGMKPPKILLVTFHWRTNCSRDSKPTKARNFQDADWTLSFKYWVQLLRRRQGYVVVAPGIQPVPFTVPSGLGEQARAQQAAVIVAALIVVLDSRVQAGGSAEVRRRWPESEARQLCSPPAEVPREWAH

SEQ ID NO: 981234 - protein, 118 aa, Homo sapiens
VPSQQLRTQTICGKSSRIGGPIQGISVVALSQEDADKHYKQYLLTPGPAQDPGSTTVQSSLARQPEEICANIIREKLLEHLPQEVPYTVHEKTAVREEGHGGSWISTELLVAKNLCEI

SEQ ID NO: 981235 - protein, 243 aa, Homo sapiens
MFTLQCFLLISLNGIRVPVYAIIIYGTCTVRHVLDAMANIQAKLSLDVMRISVNENALCIAEEFIFNRGYSSDYTGGGSAPERTLDVARAGVHQIRRDDLYLYAIARVVEEYCTCLDATVFIILMYLYTLLMYGSYASIISFCYLRALVDIPNLSLLTFACRLVLSGILEACRDVGSSHESKTKPFYYMSAGGVPPHLVRVFRMTVCCPHLPYTSLESGFAMYRVWAYGRITANAIIFVFCHT

SEQ ID NO: 981236 - protein, 316 aa, Homo sapiens
MVGVRRTCVVGAREIQGAVKPMQIDVDPLGKTRRFAPDVNYVLGETPAMDLEQVLRSAYGGLNAHRIGCGSFADLLPTRCRVEGPCKMVLLLWCGRTFDVSHCSREIRLKLTEATKGRLRDPRNLMPISLKERRWKPFKHSGGEVLGGMADRGKRRVLLEIQEECLNEQEPEGNLHGPRPFNKRDFGVRLRQAGVRPLILGCGVTSCKLTPAGGYCPGPRELLRLAATLCINIVPSLVVQRAALTCRDGRHVLSYVRTGESPRRLAGLEGDGDTRPGAPPRSSVRCFWLAPGTRGIPLMALDWVLSVRPASGRRLR

SEQ ID NO: 981237 - protein, 151 aa, Homo sapiens
ERTKKITVRDAERNRGPATTSEQQEVNILSTSQSYPVQPPWVIQYTLRPCIFRQAPAYTDAPPAYSELYRPSVCAPRCCHSPHNPHGLLSSRSHLCHLVSTVLDGRRVMMQVPRLGAGATAGDNSSSISWMLSPKCWLSFAVHCRVAKRSS

SEQ ID NO: 981238 - protein, 85 aa, Homo sapiens
YMLYPWCYIMPHWFYRDGTMSPAKVLANASALARLLEALEWMLPPTRPCDNALVLGFSRMSTKLVRIVYGLLIGSSGGLVFLMTR

SEQ ID NO: 981239 - protein, 98 aa, Homo sapiens
AGVKAGAASGGAIMGGDKTPAKASDTNKPLDPLVPSALRAAMWYLEDYSGIDWSSSLVDSAGPLSGKVREMWTCQVQMLQGFTYNKESAEIFSDLQEK

SEQ ID NO: 981240 - protein, 146 aa, Homo sapiens
MAVRVMTMSAYLEVLALVHAQGFDDRYTKDATAFYLPNDIRLMRRDAICHLCLLILSSLLGVSALGGIYCLVLVVFCLNSSDRVRPSEIIGEIYTPQKSINSLYGHLVLTNLWQYMFMMITHLPDYVKMVESTDFGSSMAVRTVVL

SEQ ID NO: 981241 - protein, 65 aa, Homo sapiens
RRERRGRKKREKDAKEEDEGKRREMRGMDKGDKSAPTKVRELLGKDRKGDEEKRKTTVVKNKLQK

SEQ ID NO: 981242 - protein, 110 aa, Homo sapiens
MIDKMHNCLISYRRVVYPVRSQILDSYGLEGVNTYRVCPLYTLTLSVSAGFRLNYLNYTSQNGGAQLTIPSCFDRCAERIEGRGPSSPYLPITYRNQYYGPETRVHRVYP

SEQ ID NO: 981243 - protein, 138 aa, Homo sapiens
MNKSKSSKSQRYQASVLKLEKEMKKRGLTAYSVSRLYLIAGLNLKPDTDWEAVEAKLSVMLRGAKTFDLAVRYARNDSCDILVAGGMLARGGTRGQMTVMRTECLRVCSAKEDLESMQAFCSGFGTSKSGATNSWRKV

SEQ ID NO: 981244 - protein, 106 aa, Homo sapiens
MGFHHVGQADLKLFDLVMHPTSASQKCVGSTLTMQPTEHRALADANRDTLTTKNPLNLLAGNTNSSVNAVRSTTGPQKGRDQDPLTHGLNQIAAHHTHTPLATLPQ

SEQ ID NO: 981245 - protein, 109 aa, Homo sapiens
MTGTKLEHQGGCSVWEVWQSFQGYGTCRVCSRRQDEPAVVSPRDAYRGLVCAGAAACRKLCVSFQRRSRWKLCSLRVAQRGWGVCPSDEIPGSGGHGTDMTLQDEGFPF

SEQ ID NO: 981246 - protein, 99 aa, Homo sapiens
TYRVGTSGFGSGSARVPATKKRITIWVMLRKARRFVYMNVSQCHTALDKGGKHYMTWANISIGLFCRGRQVRPLVTLTQPPITIKGIICGRGYTDGVFG

SEQ ID NO: 981247 - protein, 73 aa, Homo sapiens
GRPVWRTHCCAPTSLRSCVAALCCYELPQKFPAAGPIGGAPGGEKPRQLRLVLTGKGLGIPLPFTSLRSRLSG

SEQ ID NO: 981248 - protein, 69 aa, Homo sapiens
LGLRISRIVMFYSEYSQNPALLPLALCQPDSDRVQVCRDSIVPEEAHDIVFDELCSGHPPVYALFLVSH

SEQ ID NO: 981249 - protein, 42 aa, Homo sapiens
MLTCNDKYLMRGGLTELTIAMTITGVCPGSWLYKEVREPLAD

SEQ ID NO: 981250 - protein, 271 aa, Homo sapiens
GGRGRAVGRAEAPESRFPGPFHPEPDSARGTWPRPVGRRPEPSACEPVPLAGLGSWAPGRQRRCSTLAASGLQSPLGTEAARPLLGLGPGDGGFPGRAVPGRHFSAAREGEGGALKTPGRGDWHPAPRGPDTKTPGEGLPDGGLLEPPGKRGKDSRGAGKRPQGIRLGKNGAVGPGRRKGSEEHPAFGKGSLGEAGTQSKGQRSDDEHPMKNRILHVEKGVLVNIAGAVSMIATGLSISGEATSFLGEARGETPISIRHTSIHSETQGLFR

SEQ ID NO: 981251 - protein, 303 aa, Homo sapiens
MRQRMTDHYKEYVRIMQRTRILEKVRRPRKVPELTIKNRCPCTQQNLCSILKAGKRYGGKRRSLSLNITDTMLILRYLKGTVLEVWPNRANKKVKMLTQVALPSPDSAKELLYTRYSPDELRIVCPLIEQWPVVSPPSGSCSSLRLDMDGDSDDGEEMVEADEKRNTHNRHFWIRLLWRCSLKGYMPLPEVEEELSSRVRNRCIEDRSKAAQSYEDRLVPKRVLRVHVECLRYNAIGLSNAYMVGICRERYGVQQGKEGLITYTVPDVRIVAILLAGLGWRVFLIRPTRGVDVPRILDRRKNG

SEQ ID NO: 981252 - protein, 270 aa, Homo sapiens
MRGWLDELEKQDAESEGRCMRVVHRPRRQSDYPSFVGFRGTSEIIFTRRIVLASYFVDRVWMSSDNNLAYLEAMHKFVEGLKLSISTMSVNVDLVFNFYKVYTVVDEMFLAGESPREQPDEGAETAADATVPGVRAGGAASGPGPPGLACRYPLLRPWQAEQPSLSCLGGRDPVASGPQGRGRPIALVPGVACGHGVSEYRAMRVQPNRCPRIPERGGKKRGKKGAPSPIVEQLAARKKRASQRGTRGPQTAARDTGTVSRNPEGKCRKQ

SEQ ID NO: 981253 - protein, 181 aa, Homo sapiens
GETSGRGGAGSVLNGFVKRWGAMIDAKGLYRRRLSPLRQVFAWIHVTESYGIPFYGLHYTSALLASSITLVPRHLGGESVGYIMGKAEGSGAREDWHGQVAALSVAPEFRRLWWAAKTYGVLARNDFQTGPRVDSRGSLCKEYLTKLQLTCGKQLGYSVYRTVIEYYSASNVVSLMRTLMI

SEQ ID NO: 981254 - protein, 84 aa, Homo sapiens
ACSLWNTTMCVAGSVIHMSLIEMCIFRGKTYYRGVEECMISVAELGLTMAVSPSPGKLFYDRQMHAILYRRMSANSLRFSKCPT

SEQ ID NO: 981255 - protein, 118 aa, Homo sapiens
MGDADEHGKKTRFAIYASVPSAIIRSKEWMAGTNTGPDLRDWSSLGATEAGQAPGYSYTGRLGISRQVASSGEEDTRMAYLANPDKYIPEHKVILVGIKERGEERARIKEVIANNMLS

SEQ ID NO: 981256 - protein, 217 aa, Homo sapiens
QGEEIDSILNKVEEDEEGGQDSTVRCKITTHRCEEEAIDGDTGPPTEGRLVGNMTYDEVVYDEEFTIIKTYKTFYHSKEVWNILILSGNVIWQQSDLEYTRAVMGQAAQEDYRVATRCTQSRGWSTGRHIVVTKGKLKPTDDTIGTDGPTWGIDAGKHILRTTCGEGLNNPKETARRVKESTAHGREDTQEGSIWTCGRVDKRITRPTKTPRIHGRP

SEQ ID NO: 981257 - protein, 260 aa, Homo sapiens
MIGYHLLGEADAAKSLRQDDLCWHHHGLLRIFASWVALSCMVGNTSVLRQGLSQGGLMKYQRDLWNNADLMSRGESGAKVYPTSGERFTFYSWDQSFAWSQLKELTELVRISYRSPRLKHPICSPEPHLCGLGANGGSMKMVAAVYSDGCGLCEGCSLNPLVDSSFLFCTCEQCPLCIRGHWLMYSAPSTPGPSIVGGASSRVFCLVGIYLLFRMFRGRTGSQVVSLSGGSALVDLEVALAPDGLWAARFCPGKGPRVFD

SEQ ID NO: 981258 - protein, 73 aa, Homo sapiens
ANKREDTDSDVACLLQPLLEPPPRLQRPEGRKQWIKNRLERQWSALLTHCKSRKNEIMGCCGIENEKFMWNGK

SEQ ID NO: 981259 - protein, 180 aa, Homo sapiens
MESLLCCGPKLAACGIVLSAWGVIMDNARNIFQMSIPSVLIEDRPVHGEHDIREWTPEHIQTFTEQVELHTCRHRCSAFTSSSAGFSFLPRLAQYSSKEYMVALRALVQPVPRSSRLLYLQQNCLHPAFTQCRVPTLCTGPSVGNWVSRPRHWVPSSHLWDPDQWTGLGWRHVALSDLLV

SEQ ID NO: 981260 - protein, 136 aa, Homo sapiens
VYYPVKGSNGRLSVKVLYLYPDGQRHYDLDYSLTIPVLFDAYCICTREDGLLLINHAAGLIVVFQAANGGRSLHSSIVVDSWKSPIQHRGLERHWVVESTFMHAVKITLASYRLLRTDQVGLNALLQRPDDDSMSL

SEQ ID NO: 981261 - protein, 77 aa, Homo sapiens
ELTPYVSCSSARVCGEPGVIVGRLEGNRAERRPKSQPGDSGSVRDRSSRGWGHDARIEHAMGKNQNNKSEERAKDDC

SEQ ID NO: 981262 - protein, 75 aa, Homo sapiens
VATLLVTAKVTHHWKQHGFTAQVDYPEPSRPRLTRRVCTCIGLPERLTLHATFAELKDNRTRYARTGYNSWLDGP

SEQ ID NO: 981263 - protein, 104 aa, Homo sapiens
GPPETEGPEVLFTEPRGAGAQIGSLGRLGCRCGTRSGEGFGGSGQAQMASRAGPRAAGRRSDFQHRERVAIDYQMSVTLKYEIKKLIYVHLVIWCCGCKMSVGT

SEQ ID NO: 981264 - protein, 105 aa, Homo sapiens
MGTTDRLARVNVYPPSYADCGKAAEIFSTKDSGFGLVKLDVKHKVLQWREFSTSGPSNTRTVVKLWDLWRPNTSGVSMADFHTKSEHDNTLEQNSQLKTRFCPRF

SEQ ID NO: 981265 - protein, 124 aa, Homo sapiens
RAIRRETARTKSHRPETRGNLFPVKGLAPGMAVSLILSPKFSGRGLTRGRPSRTAVGQGVCGSRPKVTGEDVHGQGRYPKIAPPLLACTEGAREFETNGCGPKLLSPAEGSCWETRLICTNSFG

SEQ ID NO: 981266 - protein, 165 aa, Homo sapiens
MNDADTLWWIIDCRLYALDQDCSEDLIAKTPECRKHFYQSEVDQLEALREAVGLITESYYSKKYLGCAHLGNHALRKVSFVLADNMNDRCWTISPTYMIKSFYYCKGLQIECHNEVFGELTEGKLCNTKVGLPDVKARYIHKRGSQTWGDSSRRPLLQLAETYAL

SEQ ID NO: 981267 - protein, 151 aa, Homo sapiens
MSPFHSQKRRDGNMLWQGLSGPAGPGAEHSGALGTRTLACVKGNSKREPTGIHYAVTKGQALFKPNLEIDASGHTVNKSPECLRDKDAREGELDELGDKCDSKVFQKKKGGTEQVHKLSAEWRSLRKSYRWPVRDSGWDRVMGRSVVNRGP

SEQ ID NO: 981268 - protein, 151 aa, Homo sapiens
SRPGPRQPPSSRPSVSSAGGRCGGPEDRGWGCCCVRRRGGAGKAEEVALPVGERGGEYDRGGAGWGVHRTDVAGLLYNSGQQKEAAKKDCRRIIDEKSTGGTHSVVASTGSGLGVPGDARRGPVETHLVGYGRKSNPRVLGAHSSSHTAGG

SEQ ID NO: 981269 - protein, 254 aa, Homo sapiens
MHRDPVHCGCKVDVGNLVDPIGTKRELEGGRFGMMEPSRKCVGLLEIRGVWPSVEVGRSLRCSDAVRELDGKKHYVVSVMSGTVAWWKLRSTKSLAQPPSGGCVALEMISYGGVPPSSYANLQEGGGFLSSRGQVPSLGDRRKREDRCLGRETHKAAGALVLRCRSRSQANEVTQQDVAATWCTAQYFLTKMVRKSRLGGLISGDSQTRSGNMEALTGAQGILVKEHRVHPSIQSYTIAALPRKHTPGLKTTRN

SEQ ID NO: 981270 - protein, 287 aa, Homo sapiens
RQAHAVGRADPSSGLRQPTKPRPRRGPARAVRTPLNGGRPTVGGFQARAVGSPARPESWAGAKPPPGAGPPGDPSFGAPRALLRGKEIPGIGTQREVWTGKGSPTGRRSTGGGRTPGTNRRGLPGTPEKGQEGYHPEGGRYYPTRKNQKSPGKYTPRGGGGGDTIGQDSGGPPREKGEPPKGVTKGLPIPRTFAEDRKGNPAKKRPPSGKTPRGELERDTRHDPPAQRETNHQTTEDTFTQGREPISTRGRGEEGPTYHSGDRRRRRDTRLVMENTPGPLIGGTTNK

SEQ ID NO: 981271 - protein, 113 aa, Homo sapiens
ISLVRGLLEVVCEFLSVAVLSLFLIMAVVADRMCNVSMKLASGESKISVVTRRMETDSGMIRQVIRIVSFGTETEMDNPFDSVFLIAKRISVAGTNGLRNGVKSHNRSNIWLI

SEQ ID NO: 981272 - protein, 152 aa, Homo sapiens
GGRAGRFRAVGSARASEREAAGPRAPVCMPSLPGGAAITAEEPRAGWMWLGGVEEAAKMPSPSPEDRDPGHTGLWGNPHVRFIVLTAIVWTPTINHRKHFYKVRSRYLDKIIISNFVDTAGSDDYSIFPQNIHRYNGYIWVYLYINQKFGSD

SEQ ID NO: 981273 - protein, 105 aa, Homo sapiens
ISVRGHSHPWTRMMYVRDDCKVCRFAQILNVIKTLKRSAKSSHESYGGTYKHFGKSMLCRELQSGYIHLKFDNKVGNEPDGKYHDERYGSRSNDADEEMLNENSK

SEQ ID NO: 981274 - protein, 149 aa, Homo sapiens
MWVVKPQGGAHFFLLFSFPREYREKGAPRGVAPLKRGLIFSAGAGGEEGPVKTPSTFGGERLWKTQRGDIPREVPRRCKRNTSLETNAGGQPSGFSINKRGAKNKTRGGRRGNGPLGGSPRHTTTRKRHRGTRKKSFGIPMKRGRLARG

SEQ ID NO: 981275 - protein, 133 aa, Homo sapiens
MKKVAGLDVELTVEERNSYAVAYKNVMELKSLLENNQQIEPERRKRGGEDKLKMMREYRQMVEDLELKLTLVVTIVDCSDKTPHSSSNNGSPRVSIYTNERGDYHEGIRGRICATGKDREGGLRKNSLVAISV

SEQ ID NO: 981276 - protein, 184 aa, Homo sapiens
MIYTNSKIKQSNGPGVECQIPFIICEKRSRMRKSEERRGLALPRRAAASWHRSRRLGPVHIWRRRGAPIGGFGTERAKDVTSSRMGGEAVLFLLWEGVWVEKRFRHTTGDQSGEKTESSAEALVFLSSNLAFPNSPCFLGPSVGVGSHKAWGGRNPTPPPMLPSDSLESGGEQDEAKATERGDN

SEQ ID NO: 981277 - protein, 78 aa, Homo sapiens
PLKLGVVGGVTLRGFNMRIAKSVFLSRDPSILDTAGCSCRNDEEVFRFANLNVIINLNKEAQSSSRVRWTKVFRKAGW

SEQ ID NO: 981278 - protein, 111 aa, Homo sapiens
MPTSGYEGGCIVREHSRVDATTCQLLPELDPVCDCVDDNMHVLDPQFVNRALEDIWKWGLPQFTMAGGQNQVNHLAAGGGTNLGGPEEAGHKSSGKKAGDNIIARQVPAHY

SEQ ID NO: 981279 - protein, 101 aa, Homo sapiens
ASFPGETGIEGTGACVRLFTDASWSGGLGPRKPWHDMIPRLRISCQGSIIGFFRNNFGVREPYQILLDGTFCAERRCQGPDPAAEQCCPVPHGGDAKFGAS

SEQ ID NO: 981280 - protein, 114 aa, Homo sapiens
VGGVMLVSQMFVNNESRVVIHREWRMIVDVLLNLQEWPDIIMRLPDLSCGTARVRMPVIRTHLGPGFKGFKTLSDKGLLSRYLDKMRPLLVLCLPPQRCTRRLSDSGVGTEMPL

SEQ ID NO: 981281 - protein, 77 aa, Homo sapiens
VTSCEEERREHVAIHMKNDGRLEMEQVFEMKVKRKEFKILNGSLKTESPEAPSANDERIGKDSTIVIGGKTSSVSEA

SEQ ID NO: 981282 - protein, 69 aa, Homo sapiens
LVCRVMISFRLALIQLAEFLPSDQITSLALVCFIREAVTQGANNSSSCRNCFHILHYGTRNICSPELCR

SEQ ID NO: 981283 - protein, 97 aa, Homo sapiens
EERVGTSGFGAGVYVVPATNIREMETMGDRGEKARRLSDYRSGSQLPHPLKWEASTETGAYTCSTGALVWQEDRSGPWILLTLCAILRYNRHLLGET

SEQ ID NO: 981284 - protein, 59 aa, Homo sapiens
MATGPFGFSEPKVVLSLIWFNPGGRFLQLALINLAGIPRLIWQVLQHSFTGAERNNLTR

SEQ ID NO: 981285 - protein, 366 aa, Homo sapiens
MSCQALSLQCTTVRMHQFHTIRMEAVFPTFTWSKTLFYFNIIMKFPTRPRLLIQEESPTVHVPCCSGYNLEFPPMGDCDPIPRSVHSNLPIRSYFSYNRFLRSLNPITPIWQPRWVHHEGISSPSCPLIVGTICAQYPNWHIKQTGKLFNFNGGGIKTSWSGNKAIGLSREKQAYSERAKLAELCHANIFSPVSETHPPTVGARAQYGRWNYWNHLLERERVPWAHRYRTHKNTTAMSCLFSIKETAPKPTGPPNFPRAGNSWQVTHDPRKAPRGSPNTRWVCNTVSQAANNSSVTLWAAHQQTTPGRRRRPIHSPQNQLRTDPLPAPTRRRSPHDSTSQSRTSATHSRPHTHTDNINIARRRNHN

SEQ ID NO: 981286 - protein, 173 aa, Homo sapiens
MSSWEVALSLLNTNRSRVGNAYAGSRYYSAQGSSRIGMIAMEIEAEGRVENALRWGVIAKKRRGVTGSNALGVDHQTVPRVDPVLDEEGLLSEPGMNCTALFYYVDSFLERGVSRVLANGLEEGRPGNSIKADQVFGLILEPGKVPFELQHQGPPCGSGPNVMKGSFRQAFFD

SEQ ID NO: 981287 - protein, 68 aa, Homo sapiens
SHSQRRRDTHAADWYFSVRLLKESPEFSLCLCKYVHPLEEKDSHGNQGSAKYTRDVVSNVRLGIEGAP

SEQ ID NO: 981288 - protein, 84 aa, Homo sapiens
STLLMSSSSSSQVRKSLSLLMVMTSGRLSQGKYLNLGLPQRSDEDTCGCPSFRGYMATTLLCSGNQVWRYDDTTPYYGSRAIRD

SEQ ID NO: 981289 - protein, 137 aa, Homo sapiens
VCLIPLKLGVLYGVVTGGFTDAYRYSVIMFGTIYPWHTGNDGTVPLSECIGCSRVLPGLKCHRYILKERNAPSSQHAYVLRSTRSSRTELLWYKRLDGRINSVLKFRENVGSGTIVINTSAQAYGKLNIFDVMMESR

SEQ ID NO: 981290 - protein, 130 aa, Homo sapiens
GQEHELIESMPLSEWSATDYKKFGSYGGKRHRYITRRVSVCETDLIGIGGILRYLSKNFQDIAITMDGPTDDIFETLIDYYSSQYMGPAKTVPRPFQYPNPRKHTRLGVESDKMIRCSLQGGTLSRTYIH

SEQ ID NO: 981291 - protein, 92 aa, Homo sapiens
VLSPEITSVVNVQFVALPLLLFLFDPVADLCTECTDVDYGKSVQFVHNHTHEKVAFDSLQTLVQVNLDNATVFAFDEDADGIMTTGRQVIPR

SEQ ID NO: 981292 - protein, 230 aa, Homo sapiens
DSPAAVAVVGLRSGCEAVDRAAGIQKDGGKMEVTGVSDPSVTGLHRGSSLKHLTTSEKRYSQILTIGEFKVNTEVGWLGRPVSCGWKLGAVCSLDDKFYSKLAQEDALLGSYPENDGCGIESLTKCGARLGEYEDVSGVENVHDLTRCYDAEARHGPSFLKPQKLGGDNGGGAGSAEEDECYQRHGEENGPGQSIPVGSAVRCGRRDNSPRGARLFVVPTNSRWDWMVVV

SEQ ID NO: 981293 - protein, 388 aa, Homo sapiens
DPDRRHAGGRLRSGMAAVLQRVRAAVQLESCVCRAVTRVPCTLTRHQHLPSGDRAPGALLIDTGDTSSFQNTSGCLKQALTLQLTHSNPRHHCSDSLAPEIIWRHSADIPSQHHTTDHYLLHHKPPTDSSETHDPHYATLETQHYCTSDTTGDSGLTDLREPLYQSSSIPLGHTVLAHHGSYFLDTTGTSAHSYLRDLHTKRAHGTTGTLAQNLYAYTDTSLQHARIIAHTPSLTILSSQDLGPRLLQLADSSTFHTTSLAYRHISRKSNYLPSTSLNTIHALTHGKGATLCQTPSHSNSPSNLHFNSRTTNNIIHSATPPTCTATHFPHSTKHHSDTQILTTPNPVIAIQTPQQHTPHHTIKQHPHQRTRNASPTATIQPYPPYVRL

SEQ ID NO: 981294 - protein, 97 aa, Homo sapiens
ALKIAAAVGTVWSELSLARDVMLYPGMAVLACTIMAVAWCKNELDKVYGVSDPVSTRECYISAAMCLMACSLVSTKDAAGNVRGKRRRGYYSGECKS

SEQ ID NO: 981295 - protein, 271 aa, Homo sapiens
MDMSPLRPRELSFVGVLRLKAEKDYHFAVGTDENEHQVIFQERSDLGAVHRDAVDIVEAEAMSHDGRPINCNTVELLKMSRYNANCLNPWGAFEDKHHQVPLHRCEVWFHGPGAILLRQHFTLACWRIACQTSEEGSRQEECETSFPLFWKAGQPLEVVMHRFPSEESHQCAALNHGDGVWCRGLTHERGWLLEHLADEARAKKGRGSKRSAIFLRVPTRSWMGTFPHSSGGNLKRKSLTPAGFHFRIAKKRGRETKCPDHSIRGNTSPNK

SEQ ID NO: 981296 - protein, 110 aa, Homo sapiens
GLLIASVVLPTRCRRRRHYDGTERSPAFWEQLQTMVITVTNLPYRKSISRTIFSSGDGQWCLVAVGPEHGEPISPGFGSWVKRVVMSQSLFDCGITQVRSESSLWLLLTS

SEQ ID NO: 981297 - protein, 112 aa, Homo sapiens
AAYCNSLRPLGVAATRRIPAARPCSNPARMTVARPSVPAVAAPPRGAAPVLLLVLLCLPAVWGDLWPFPQMYLMPQPSLGKADKFSRGYCITYNCEESFVKIPGEKDSGDLP

SEQ ID NO: 981298 - protein, 177 aa, Homo sapiens
MALWKALRPRSSPGSSFQWSRLVFAVLEIVLPRFCLVALTRERSPRLSRPGPVVEEAALEGLAVILFPHDNIRLLRWDRDDQEGLTRAWVLVDDLQAIRCLASQCFDTDAVRSCATLYEGGLEVFALPVVTGGNLSVRSVGAQGSESVLISHVRHETLSGFVRARGVKLCFRVLAHI

SEQ ID NO: 981299 - protein, 295 aa, Homo sapiens
MGCSLDAMVLLSYYERLTPSPWVRSSMLVQVPYPCNRPQSVDHARTEDTCHDNIVSDYIGRTEKYVIDISKDVFTNTGCDVLYRTDILATCKEIAQRGMVVIGPSNRAPLTLRLMLGESVNKKFGDKSDAFPAFSQRSTQCGALQVSRLSQVLLSFSHILLTRYLTARTERQHHEEIWKYMSHGVGRKMRIELSCQLSVLSSLFRISWDYVWQRGWCDGSRLLLSVCRVASSYSSKGSPIYYTKGLGLQVNGFTQWSYGPRGSLLPPNIWPPSPDREHKLSGAGSELALTKTGQR

SEQ ID NO: 981300 - protein, 256 aa, Homo sapiens
AGVSTAECPLRPGQTLSFRLPRLQRHGALQEVASLGGIPEDERSGTHESGGSSFGYVSNRLGKGAASDNARLVYVASRPYCLISPIFRPGARPPKIHQDCCVVGQELAHKSCLNVGCYTWGKISPGVECKDGRSQVGGPGGQIERERHVVWCESDDRDWAITGAHWPLEEGLGVLACIGEKLSMKREAGITEKVVFQQTKVIADYTGKDWSKVGPGYEPVVGPLGYWHGVEHPNRARDVKRESRGWVKSTVSDAGV

SEQ ID NO: 981301 - protein, 72 aa, Homo sapiens
AAGLMCRAAVMACRSVLASFPSCLLLLYLGDVHEPSRGARCCCLSGSWEGEWVSGIGVSASRGLRGVQLFEG

SEQ ID NO: 981302 - protein, 133 aa, Homo sapiens
ALDCILPPIRSTEKPLRTALLQDVSSKIGGIGTVSAVGRVETGCSQGPVLVLTFAPVLRQQTVCGESVRKCIHWKAFEMGVSSLGDIVGFYTVRACVLCQGHCSSWLIISLVDGWDLSHASGGLLGFIWRQVN

SEQ ID NO: 981303 - protein, 89 aa, Homo sapiens
GSTRTRVLAECPWVGETRCKKVGTAKSDLRSNDFRHDGSLARDFELSNDDCYGRPIEVNNGVGKSQAKNNKKAPPVEICYSNSSKANDL

SEQ ID NO: 981304 - protein, 98 aa, Homo sapiens
GPDRFSYRGREVRSDGYLDGFVDHAVPGGTFRRATVGPSLNECRRIPLGPGAVYAKGIQGTLFIITGVCNYSFVPVTPRSLAELTDGRKSFVDGRRVR

SEQ ID NO: 981305 - protein, 110 aa, Homo sapiens
EEEEQEADNDRLDRKNEDTNGGDENEDGRNERTVDWLTRNEGTGTNWTRTEGTRGRFQSLTQNAVWQPETTRLTEETIVRITPRKARQEPRETGRRNWEPLKETPKAKKN

SEQ ID NO: 981306 - protein, 263 aa, Homo sapiens
MTLNPRRTMMADSLVRLKWRVWCPRRGRKLWLPFGNPSLCSSTRVSVSRGALTFTRPDAYPKNWCRESQAHYRLLLTSDARTISASKMACLLFTTWESSCRGRVWVRVVMGSNGVIACPGMHMIVDIRELIAYGTYVAIGLQAAIDSSPMVHMRVPSETTCIVYLEHHGSIGEMAICKISFAQRCKPCVTCLCCVRLLPGALGELTHRSHPTSSANHRDKLFDQKLVEMLWTVYLDFSISWIELDVYSPLFAILHFRLCPINA

SEQ ID NO: 981307 - protein, 42 aa, Homo sapiens
RRLQDDSRIVKQQHSKQLLLRRLATKHHWRSSEVVKDLLDLL

SEQ ID NO: 981308 - protein, 58 aa, Homo sapiens
EEGGEEEEEEEEGDGEEEDGDEDEEAEAGSGHTGKLKMIKIDDVDYQEAESPTRMTRQ

SEQ ID NO: 981309 - protein, 114 aa, Homo sapiens
ISHHKSIHGVAFKMRAPRALKKLRKCAMKEIGAPDVRIAIRLIKAVWAEGVSNVPLQIRVRLSRRRNEDDGSANKVKSLVTYVPEITFKALRTVTVDSIYSLIVASNKVINLRS

SEQ ID NO: 981310 - protein, 96 aa, Homo sapiens
MSTASQLNLGSSIYKLSRRMHACVSMHPLYRPPASYSIRLRESGRRERTCWMKKSPSLSNTCILTISQPSSSYVSRVSVRACVRESVPRLNTESGY

SEQ ID NO: 981311 - protein, 110 aa, Homo sapiens
SGGIKRSRLELRDTRLSARTRKSLNILGLRLVEVALSCLFLFSTWLMRITASVLLCVQAGFFMSRRCGTALIDITSAGEIGMLCNRIKVGVSMVLLDRPLYTAVRWIEFS

SEQ ID NO: 981312 - protein, 60 aa, Homo sapiens
MRASVSMVYIDRLLLLSVCEKAAEGSVSYSPDSKCLKGMRQASMRDLSFIVIKVGSDRPY

SEQ ID NO: 981313 - protein, 111 aa, Homo sapiens
PFDIFKDRPGNLVLGRYKRAYTLQGRVIKLESLRRATFYYYRVRRGAQKDRLARGIFGGLSQLFMPVETWPFPKVPLFRKALVKPFPLLTPFKPLRFQFEIVDHHGKFPAY

SEQ ID NO: 981314 - protein, 69 aa, Homo sapiens
CGCMNRCECMDVRRASVASVVRCIKLIRIIVHVDVYEPYSRGIGESDGDKRTGIVIHVIGVVRLVYVCG

SEQ ID NO: 981315 - protein, 28 aa, Homo sapiens
MLNEYPNGKPTVNCFSCIWGAVREFARG

SEQ ID NO: 981316 - protein, 163 aa, Homo sapiens
SLLANNWYVLATISCCPHFTELNSLRYAFGCLRLSYLKCQSNSLSSAVRGLSGSVAMIASIFFLGWWGTLALARSPFRVQGWADAQAGVSGGSNVSRRMEMDIEFSLSGGRFLDEDSFEDSVFSLPRYLPHVEDFSTAQEETVVYQQQHIIEKLNYAGLRTGG

SEQ ID NO: 981317 - protein, 113 aa, Homo sapiens
FGNFAARDGSLWRYRAGLAASLAGPHSMVGRAVVFHAGEDDLRRGGNQASVDNGNAVRRLACCVAGECGPGLWEHQAREHYKRKKRWRESECKAAERGLYPAAARDLLGPSLP

SEQ ID NO: 981318 - protein, 32 aa, Homo sapiens
GSSYMLCVLRCRLCRLCRNDSLAFTSSMVDTP

SEQ ID NO: 981319 - protein, 102 aa, Homo sapiens
GAPRFANSSSQRKGPGSGVLGFKGFVIGWKKTAGEETGSFCIPSTEHLKKGSIYIYKYIYKYIYILLFGGTLGKSPLVPVKMNCDPIPSRMSPVSPSRYQPP

SEQ ID NO: 981320 - protein, 55 aa, Homo sapiens
PAQYTIMSEPIRVLVTGAPGQSAYSLLHSMGNGSDFGEDQPKFYVLLDITPMMGV

SEQ ID NO: 981321 - protein, 55 aa, Homo sapiens
IRKYDRGHTFSPSKSALASNAKHQDTIYGPKFYMKTRQFRASAKAILSTTSYQTI

SEQ ID NO: 981322 - protein, 34 aa, Homo sapiens
SQPNYAQARIQPCCSDNTRSLTHWHTPFTNLIYS

SEQ ID NO: 981323 - protein, 147 aa, Homo sapiens
TKLFFFYSLEFFGLTGPGPIQMGAGFTQVTGGGKRGKPPTASKAPPLEITPHALLRAEPLLTGGPGDALHLEGRGMKAPLPEMFVVPGMGIAFQHILKSSVARKLGANPVGKEKRQTVPFQRPQLGDQHRGKGIYAHPHNSSHPGLF

SEQ ID NO: 981324 - protein, 34 aa, Homo sapiens
MGLRSLPSISGLRIWRCGELWCRLQTRLGSRVAV

SEQ ID NO: 981325 - protein, 84 aa, Homo sapiens
MPAGWLLYMYRGRVHVLGSEGIHVISDLRQLTLEVLLILPRPPGSSYGPLPDQYSVSCCRTNHPKRSSFRRQQLSISQTVPAQP

SEQ ID NO: 981326 - protein, 42 aa, Homo sapiens
LQDSMSRNLENTVQHWACSAQETFGDTDAQALDVGQPLLPRP

SEQ ID NO: 981327 - protein, 38 aa, Homo sapiens
DNIPPEYKHILVDSEHDKPVNPPAYISKDLKKPEHDQD

SEQ ID NO: 981328 - protein, 66 aa, Homo sapiens
SGSAPENRQKYMLLIHEGAESVRTFQIEQSWTQSPSLSVSAAPLVPGRRSRIPSGDKDQRGTSRCD

SEQ ID NO: 981329 - protein, 54 aa, Homo sapiens
GRMYKSPSSNHVLVFAVTSPYLGAHQELPHQEFPLWLSSNNPNYVSMRMQVRSL

SEQ ID NO: 981330 - protein, 102 aa, Homo sapiens
MRIGSYFQSYFSTSVVDTVMIYCNTNESAVDSAAPAGPQPSPAPSRWRRSRCSFLGARISPQEPAQIRRPRCAALRCAALSGRAVPAPLKGHRFTTRRVDRD

SEQ ID NO: 981331 - protein, 63 aa, Homo sapiens
SPPCQISYTASVVVGSLRVLASLTSPGGVSQEKHVDGIPYEAAIGKLDPTDGFFFTNQQTGLT

SEQ ID NO: 981332 - protein, 51 aa, Homo sapiens
MSTTAELDQLIMRIAYELEQLNEKDQQIARIIIPYLITKLNCDYRRRALTR

SEQ ID NO: 981333 - protein, 29 aa, Homo sapiens
MRGGCRVLVAEQFLAAWVLSTPSPPPTLH

SEQ ID NO: 981334 - protein, 66 aa, Homo sapiens
LEDPGKSGYYLNTWKHEEKGQSAKEDTIVYEVEPLNINNIEEFPKCHVTFLTPHCVSWILSRLNRE

SEQ ID NO: 981335 - protein, 54 aa, Homo sapiens
PPAKSGLLRELCVWVADVAQIPSCRGCGIGQAATALIRPLAWEPPYTAGAALKK

SEQ ID NO: 981336 - protein, 59 aa, Homo sapiens
MAAQAKGTTRTVAAGYAIATARSSRVCALHHSSWQRRILNPLRKARDRTHNLMVPEYSG

SEQ ID NO: 981337 - protein, 72 aa, Homo sapiens
RSCTALLQEQLTTIEKRFGLSSSSSGLISSLNEISNAILIILVSYFGSRVHRPRLIGIGGLFLAAGAFILTH

SEQ ID NO: 981338 - protein, 57 aa, Homo sapiens
SADDTQSASDEMNSICHQGNAEPKCHVYPNVRPRAKTSVQVCTGEDGVGDRPPIHCP

SEQ ID NO: 981339 - protein, 124 aa, Homo sapiens
YERVVYTVKTGVCHSAPVPANGWQICANCGASCARRALAADSCSQLVALARSIMANIEITEQFGIRLKLLGQGAGTFAIVDQLVIIEYSVECLGQHDFTDKRPQLGYRLLNRLGYYGCTSDQRE

SEQ ID NO: 981340 - protein, 82 aa, Homo sapiens
LEDPQRWVYCIFSFEYSASANNSLNDWPVGTVLYSTDNSTQWSVYAGRNLKENGCGYMYNWVTLLCSRNDHNLVNQLYPSAL

SEQ ID NO: 981341 - protein, 69 aa, Homo sapiens
QGGVLVLHGVLDTILVTEPLLAACPVALTSRGLGQPKLGERYFLGIDRVMQPTGVIMYMCTDCFTEWVV

SEQ ID NO: 981342 - protein, 37 aa, Homo sapiens
NLEDPPVSNTADRMENLLLVHRANALEEQLKEQELRA

SEQ ID NO: 981343 - protein, 44 aa, Homo sapiens
GSRAVLGSLHCPPVQNLILKLLSSSAALDRYTEFFQLFLICHYY

SEQ ID NO: 981344 - protein, 40 aa, Homo sapiens
GLRLRFFTVAMDFVVQGGPSFQKSLSCCAFGSQVGFILSR

SEQ ID NO: 981345 - protein, 36 aa, Homo sapiens
YEDPRKLVMVHLAVGMDSREKEETVHLDNPLEEFLL

SEQ ID NO: 981346 - protein, 42 aa, Homo sapiens
YEARNNRILRIYNPAPVSFISYSASYTIKVYHNHHPIILFHP

SEQ ID NO: 981347 - protein, 45 aa, Homo sapiens
MGTPYMEFCDMEKKKLLRAKPTIKERSFQTVFFIIVLSYLGATRH

SEQ ID NO: 981348 - protein, 69 aa, Homo sapiens
MVDLPRHYQTLPPTQLEVNLEDIPGEGLLISWAFTDRPDLTLTVLPQLQTRERGEEQVELSTIEELIKD

SEQ ID NO: 981349 - protein, 89 aa, Homo sapiens
MILNGEKLKAFSLQSGTRQGCPLSPLLFNIVWEVLATAIRQTKEIKGIHIGREEIKLSLYAEDMILYIENPKDSTPKLLELISELSKQQ

SEQ ID NO: 981350 - protein, 47 aa, Homo sapiens
MCKYCAMLYQVLEHLQVPVSRRGSWNQYPEDTMEQLVVHVSSMYCSA

SEQ ID NO: 981351 - protein, 72 aa, Homo sapiens
VESYTFFIDILLEKISAEISGCLENAYEKILFSEATRILFFNTPEKVTDYAKKRGWVLGPNNYYSISSALEP

SEQ ID NO: 981352 - protein, 64 aa, Homo sapiens
RGIQADPSEKRDLVGLLDAARDLIPDSVEQDVNEEGVTTRRGCYPCARNTYVVAALHTGICYSA

SEQ ID NO: 981353 - protein, 35 aa, Homo sapiens
MAESRGSRNLITECSIPYLTQSGRCGGGSQRGSCL

SEQ ID NO: 981354 - protein, 85 aa, Homo sapiens
PTYGTRKYKEEQEKLEHSFAEMPTELGAVKTRMNNAEERISDMEDRLMEITQSGQQTENRIKKTGKAISRDLMEINHNSRPNLTL

SEQ ID NO: 981355 - protein, 124 aa, Homo sapiens
YFCRAGSASIGSPPWGPNSVAVRPDLLHLGEDSLRRHLVAPVRNLQTPQLMGAPAIFIDVLLVSWRPELLCIRPLSVVYVLSNSGAIAVAGVGISIDGGLCANIMESCRYLVRIQLCQNTDALT

SEQ ID NO: 981356 - protein, 56 aa, Homo sapiens
GGVDVVCSNERCPRKSHITGRTVLTLITGPILSFVAGQSFHPTECRFMIAVDTFGD

SEQ ID NO: 981357 - protein, 116 aa, Homo sapiens
SSGVAYSPATWNTVRTLRDALTSAAVNPLHSVMLHGMHYLQSRCFGPCCIKSTAFNRDALGHAPWNQLHSIKLHGIHCIQSGCILPRCMGYTVFNHAAWNSLHSIRIHCAKMHGIH

SEQ ID NO: 981358 - protein, 48 aa, Homo sapiens
MKELVDKPDFITLKTSVLHKVMSKEGKQPTDQEKIFAKDTSDKGDRSY

SEQ ID NO: 981359 - protein, 51 aa, Homo sapiens
RAVYDLDTAIYLDSVYTNDKGFSYTLICYNTHIARKHLFGPFSLLYNEIQC

SEQ ID NO: 981360 - protein, 47 aa, Homo sapiens
PNYAAATYAKCNYAAAAAVQIFSRSAPGQDLGHTSTVTQATGQILNP

SEQ ID NO: 981361 - protein, 89 aa, Homo sapiens
PNYGIDEADLDYSKKVQDEVENMISRYAQNSLKLEDLSKVGYVIKMMGFQSHSIPRCRPQRIEIRMNRHGGFIRNSPAMATTQMTITAQ

SEQ ID NO: 981362 - protein, 64 aa, Homo sapiens
LILHYLNHYNNSYAQPLPTLYRMRRRRNHIIPANRMMTRTNRRQHSCTTQSIYNAHRETFGICP

SEQ ID NO: 981363 - protein, 65 aa, Homo sapiens
DTNLATAILIMLGKSMRKVYNGLGGQGKATGNALASAVMRGELRYNMKDGALCNPTHHRVSSRYS

SEQ ID NO: 981364 - protein, 41 aa, Homo sapiens
EKYLTALDLQTPLSDVQQRAHQQAVTSARTTLMPDLWAILR

SEQ ID NO: 981365 - protein, 63 aa, Homo sapiens
ERHAIDAVEDLLDSCHALMNEGVDRYKRPYPISAEEERLRQKEREEHLQKQINDLWRTIPKRA

SEQ ID NO: 981366 - protein, 70 aa, Homo sapiens
MKGFDICCGSVLSVYVGSGPPQATGLHRYVWLVYVLDWPLMCDVPILCYRSGDHRGIFMVASFRKKYVLR

SEQ ID NO: 981367 - protein, 59 aa, Homo sapiens
LVVLEDLCMGGLFVLLGSLHVLVVPLYGFLLFLILVCLLLFDGALLIFCRLFVLHGVCP

SEQ ID NO: 981368 - protein, 103 aa, Homo sapiens
SEAVVPSPGAPVWSGPCWVPGLVGVRCAFLSGMLVFACGLGWCGPGPLRVASLSCLAVSPPFFSIPSSEPWAWGLWAALSLVLGWPVPLRLSLCPFPSLFPAL

SEQ ID NO: 981369 - protein, 64 aa, Homo sapiens
FIWVIPRLPALGMALAVPVCVARVLPRTSQGISDLLLLNLGWLYASCPSKMLGDADRSGVALLV

SEQ ID NO: 981370 - protein, 50 aa, Homo sapiens
GHLRIRWRVFCAVHGWLGGLWFLGLVAGSPVETLVWKALGGPFRGLTPCP

SEQ ID NO: 981371 - protein, 85 aa, Homo sapiens
CAENDVSTLGYDLTFSTEVQELEFVKFVTSNPNGGPHSWYTEENKKGVCTPGYAKMRIDREAIPARQVWAGYSFKESGSPNGRNP

SEQ ID NO: 981372 - protein, 54 aa, Homo sapiens
VDTCKALAPEYAAAGKLKAEGSEIRLAKVDATEESELGQQYGVREYPTNKFFRN

SEQ ID NO: 981373 - protein, 94 aa, Homo sapiens
DPNEIVLVLKRDIPYWRSRASSRSNEHLRRQFASQANVVGPWYQTNDGRRSGRTLHMMLNWDPGRTSMSHLEAVRTAASVDYNAQAWTLLEQQH

SEQ ID NO: 981374 - protein, 49 aa, Homo sapiens
AADDFSSEDETELAMRQSEENDIHGLRKVIDRHQYHTTAAGGIAAGGMP

SEQ ID NO: 981375 - protein, 37 aa, Homo sapiens
IQMLLGMVPSRSLKLKKPYVAARVGIGEPVSRRVPEK

SEQ ID NO: 981376 - protein, 59 aa, Homo sapiens
MSWLHLPVLRIQFGGYKQPFHAAGVAVLGIKVKKTSHDLFATLMIYEFFQVADNGQRAR

SEQ ID NO: 981377 - protein, 52 aa, Homo sapiens
QELSRICDLHHSSRQRGILNPLSKGRHRTRNLMLPSWIRYPIAPRQELLLTL

SEQ ID NO: 981378 - protein, 61 aa, Homo sapiens
DRSGKSGLAYTTVHSIAEIRATSVTYTTADGNDRSFTHIEARDPTSILMDTNQACYHVSHN

SEQ ID NO: 981379 - protein, 48 aa, Homo sapiens
MQTWSSHHGSVVNDPLVPEDTGLIPGLALWVKDTMLLGSGIAAADRPY

SEQ ID NO: 981380 - protein, 46 aa, Homo sapiens
MGRVVRTAEDRLLSLTLCVGPAMVSEKQTISKGTGFETTRFMRNSG

SEQ ID NO: 981381 - protein, 59 aa, Homo sapiens
DCGLESDYLWSDNLGITQMMSRVPEDSRVHEVESELQSKSREVIPCAIKDTCMTDALLP

SEQ ID NO: 981382 - protein, 43 aa, Homo sapiens
SVAAGVIEDPREDGLRAGLTSEWALDLHRWGKGILGQRHSESK

SEQ ID NO: 981383 - protein, 74 aa, Homo sapiens
RDRGSPVRRGLYLAVVSATFVSQHLGGEAALNQEVSVEVVSGEIPNRAGLGIYKANFSGPRKVGRWSSACIRLA

SEQ ID NO: 981384 - protein, 92 aa, Homo sapiens
VWTTESQETDENQPSSFHVALFTYILMCYGKPFKQGIDMIGVQQLKQKQSSKKCQYYGKPATLCHRYPRLGNYNSSHMAHMILSTKQKRIVD

SEQ ID NO: 981385 - protein, 31 aa, Homo sapiens
MTAYYETNKKVGQRRLQAHCDWASRTVIVCM

SEQ ID NO: 981386 - protein, 36 aa, Homo sapiens
MLLGIYEQCGIGTNSENSLRAGRLMNTFQCGTDRST

SEQ ID NO: 981387 - protein, 79 aa, Homo sapiens
VYCCIITLHGIHCIQLASLATQHGVHCIQSGSIGPIVHAIHVHSLWDAFHTCCMDSSAFNHTAWNPLHSIGINGKSALT

SEQ ID NO: 981388 - protein, 43 aa, Homo sapiens
MGHAPWNQLHSIKLDGIHCINRDAFTTLRVIYCIQSRCMEFTA

SEQ ID NO: 981389 - protein, 115 aa, Homo sapiens
VWYIYMLMEYTASIGMHFTMLHGIALHSVMLHGMALPSIEMLWAMLHKIHCIESGMHWATLHGINCIQSSCMESTAFNRDAFYHAVWGILYSITLHGIHCIQFGSIVPKCMESTE

SEQ ID NO: 981390 - protein, 52 aa, Homo sapiens
MEYCIAFVEDEFCFVLPFAFSRAVPAAYGGSQARGRIGAIAAGLCQSHSNAG

SEQ ID NO: 981391 - protein, 53 aa, Homo sapiens
HGFGELLDWEARVKEDKDKFWISPSTIFRKECWGYIWNRANHYNVYELLTGAD

SEQ ID NO: 981392 - protein, 99 aa, Homo sapiens
ILTGGEVPAALLFGQSVGSVVYACFEAALGSEVRIWSHRFPEENVTVDVNSSEKLQLQECLGADSLGPLKDDVLLSETRGPQDNRSLCVFGTQWLYFTT

SEQ ID NO: 981393 - protein, 46 aa, Homo sapiens
MSPIANGYKYYRQKLEEFRKAKASSTGSFTAPDPGLKRKSPPEALS

SEQ ID NO: 981394 - protein, 104 aa, Homo sapiens
GDDYMTMQMSCPRLSYVDTSPAAPVSYADMLNRHMLQQEVSLPRDTMACLLLILSSLCFPDLGLNGGSMSCAFHSSLLRGPQGPGGHERLTPGEPTVLNRNQSA

SEQ ID NO: 981395 - protein, 58 aa, Homo sapiens
LEGRITFRDTELIHRTTVGVEPVADGKGVVVVIKRRYGQRKPGTSYGADHHHTRNATR

SEQ ID NO: 981396 - protein, 62 aa, Homo sapiens
ADPVESSCCFLHKPVGISTVVPIILGHCRGDPNWFMKKAQEHMREFTAEPAAGGKACHWPSD

SEQ ID NO: 981397 - protein, 74 aa, Homo sapiens
MGYERKFLRHRKNGVVILLMWGRLRRDIFEDLSEDSILAMVCLTCPLDSQLEKSTRLLIIGNSSQRERCGPDVY

SEQ ID NO: 981398 - protein, 39 aa, Homo sapiens
GPCGILLLLSYPLSFPYSTSQLPGGSVCACTTPTTQLNG

SEQ ID NO: 981399 - protein, 57 aa, Homo sapiens
MPAVHGTCFLAAGPGAMYFYALVEKPEVYFLSLVTNCENTGNGLPDDSDLRELGGHD

SEQ ID NO: 981400 - protein, 69 aa, Homo sapiens
SADGDRSKSPESLNSRYFLLPCIEITGVPHHVRRSRRHQLRNHHKDLQEQKEVVGKRQQNVKSTPLLNW

SEQ ID NO: 981401 - protein, 69 aa, Homo sapiens
SGAICILRLKTREEQDHNGSGPNPQGCLETCTYSEPQQRNRSKVAPAADRTLSGNISVRPNSLSDRVSS

SEQ ID NO: 981402 - protein, 67 aa, Homo sapiens
MAEGWGSFAGEETKGSSSLTPSDDCPHVSYMGVNHETYDNSLKIISNCLLHHQLLRTKHQHDIPWGF

SEQ ID NO: 981403 - protein, 76 aa, Homo sapiens
HALGVDSGGGADADAVSVLVHLPQEEYLWRTYLPLSYWCCPLLFRGAEPASSSSRMSSGYRRFSYFADDGDQHQHE

SEQ ID NO: 981404 - protein, 40 aa, Homo sapiens
GSGQCNQNLPQHVMATTTDAAQHESLSTSTNSLSTSTNSL

SEQ ID NO: 981405 - protein, 34 aa, Homo sapiens
LIVLVLVAMEYEATAAQALITAERVDAVLLAAAV

SEQ ID NO: 981406 - protein, 59 aa, Homo sapiens
EDPVESLLLRIPGPVRIRKACSQKCFRERLTVMRGGRLTACSVAGYMAMSAVICCDPVL

SEQ ID NO: 981407 - protein, 34 aa, Homo sapiens
MALYLDSLSNHGFLTLQRNTPSRQCGSTLSCDCH

SEQ ID NO: 981408 - protein, 59 aa, Homo sapiens
AGHLDGTSSEGLLAAYATESKECMDGAGAVSAHAMLQELALCHWESRLANDAGPAVPRP

SEQ ID NO: 981409 - protein, 33 aa, Homo sapiens
MSSNYKPYMSVKHKKHYSGELLPNSISKEEEEF

SEQ ID NO: 981410 - protein, 109 aa, Homo sapiens
MANLLLLTIWGALTTVVTPEKPIPIFIERCIEYNVSKDFWRGTDLPGEGGTISEPEAAAMMHRRELVDYAASRRKIPQGDQSSRIHQRLQVLMLGCLSYAASGARRASG

SEQ ID NO: 981411 - protein, 101 aa, Homo sapiens
RNSPPPRWDGGGKRRSSLPRWDGGGERRSSLSRLAARQRGSSRPRRWADRQRRSSLPRQGGGRAEAANLGTLGGQGKAGGEVEVVASRDHATALNLGTIEH

SEQ ID NO: 981412 - protein, 37 aa, Homo sapiens
VFLLLLRKNITGIQRGKIMAELGVVSREASETNTELR

SEQ ID NO: 981413 - protein, 75 aa, Homo sapiens
LGDCWSACPAGKDGRTGHLVQLDLLAFEALRITKALLAPLVPLALLALQCERGGGYDFRLRLETSTGTDQTSPQP

SEQ ID NO: 981414 - protein, 64 aa, Homo sapiens
STKVFTTQLEKAGAHIAAREPQGSSYSVPSVEAPMFVMGVNHEKYENSLKIISNVSCATKCVAP

SEQ ID NO: 981415 - protein, 60 aa, Homo sapiens
DRWTGGQAYGGTNRTSITSATARTRRPNGATETVESILARSTSTNSLSTSTNPLAPARIP

SEQ ID NO: 981416 - protein, 53 aa, Homo sapiens
MPTEERDRYRDRTWRAWIGRFPGPTRTALGCGTDGSVDAQVYQDHLDPLDQKD

SEQ ID NO: 981417 - protein, 51 aa, Homo sapiens
QLLVICESRCHKSKSLVGLEDDAVDLQSPQARTGFWGELVMTVHNGGSHVL

SEQ ID NO: 981418 - protein, 52 aa, Homo sapiens
DPVLVLRSFSWKVCGQGTSIFPSLSMATTTDAAQHESLSTSTNSLSTSTNSL

SEQ ID NO: 981419 - protein, 40 aa, Homo sapiens
GDLEDPRLVYSSWCSGAREFVLVLPLRPESLPAQSCRSCS

SEQ ID NO: 981420 - protein, 34 aa, Homo sapiens
MEFVLVLREFVLVLREFVGAVLCAKWNSCVVLSG

SEQ ID NO: 981421 - protein, 39 aa, Homo sapiens
MCWCCVSLFCMGYTRPHTGQGKELSLGVGSGLFFRSRLC

SEQ ID NO: 981422 - protein, 44 aa, Homo sapiens
MVEAEVEKSSGFRFKRLSVPFHSFIVVASVNVLRYPSRVHAHNA

SEQ ID NO: 981423 - protein, 69 aa, Homo sapiens
MDFMSEMRTYKKLLSPSNDKLTISNGPKNHSVNEEEQEEQGEGSEDEWEQVVPREQDFRHPPGGSSSDS

SEQ ID NO: 981424 - protein, 60 aa, Homo sapiens
MNDVDAGLPVSAMMNMAEATSDRCSDSCTRSIAHAATDITVLRDFVAMLQNLANHHYELP

SEQ ID NO: 981425 - protein, 52 aa, Homo sapiens
MRMAHCWWLLHTWADDANVVSVTCDLEVDTTLNEPRARQIDEHPVSPDGQPA

SEQ ID NO: 981426 - protein, 59 aa, Homo sapiens
MSGWQRVPELAGINPVLLQVGQAGVPTGLAIVLAAPPVLDSQVLGIKTNHVQVLQLFPG

SEQ ID NO: 981427 - protein, 71 aa, Homo sapiens
RVSTTLDEVQAVPRAAGGWQMNDAAGRRWRTMLQATDRCQCCGMDGQPCMASDRPMFCSVDPACGRGRCMT

SEQ ID NO: 981428 - protein, 55 aa, Homo sapiens
MLFLCNPACEIPFMMCKSVMSMEKSSGPRAEVEEMNEQLEELEDELQATDRCQDC

SEQ ID NO: 981429 - protein, 54 aa, Homo sapiens
HKFWRRCGLAQEVRGPLILNPHGGNVWQAACAWEGPGAARGTYPWVGFSGRLTV

SEQ ID NO: 981430 - protein, 58 aa, Homo sapiens
DTFGLLMPYIPKLLANSNLYGVGGLEEYSGWELADAMRPKSLGKITMPSARVLRYRGI

SEQ ID NO: 981431 - protein, 44 aa, Homo sapiens
VRLVLRIRNLITNSALFSHNFSSSSSLSPSPSSSIILGSSFSPS

SEQ ID NO: 981432 - protein, 117 aa, Homo sapiens
RNYAVTRIHSGCISHCCMESSALNHTAWNPLHSIGINYTKLHGIHLIQLRYTAALCIESTAFNRASWNSLHSIGINCAMLHGSHCIQSGSIVLRCMDSNAFNQDSIGPSCLKSTPFT

SEQ ID NO: 981433 - protein, 113 aa, Homo sapiens
MLSSSCSACGFLFSSREPSLSVVCPYIGRVSANFLAYNWAIFSQQFHFAQDSPELGLVIAGEEPAVGIGTQAGGKKGLEPAYRAHNRVQTICECQANVTRSPTIKVLVFKSAS

SEQ ID NO: 981434 - protein, 57 aa, Homo sapiens
IPNTEGGTPVGGGCGVLTEKSKRGGLKSVLQAVAEQVTEESQLPGTGGPEDVLQTVQ

SEQ ID NO: 981435 - protein, 126 aa, Homo sapiens
TLSNSCVTERRYRVDNFANARYILLKMCSKAVSHGNKPFSHHVRKLRASITPGTILIILTGRHIVKRVVYLKQLASGLLLVTGPLVLNRVPLRRTHQKFVIATSTKIDIMHVPIPEHLTDAYFKTK

SEQ ID NO: 981436 - protein, 61 aa, Homo sapiens
TVRQFLLGYQPRGKPRIEYGNVLTPEGFWYRAQVFPTVNGLFRWFTDHYQDPVPGITPSSI

SEQ ID NO: 981437 - protein, 82 aa, Homo sapiens
MSCNLCVCDLTRGTPRDDLWAYQGCAECGFSSDNREKPSGSRDKTIKLWNTLGVCEYTVQDASHSECVSSVRFSRFSSKRAA

SEQ ID NO: 981438 - protein, 64 aa, Homo sapiens
QSVQSQPEEEDEAEEEEAEELGTQETYADYVPSKSKIGKQTQTGGDDSTCQRPPQNHYTWPASD

SEQ ID NO: 981439 - protein, 124 aa, Homo sapiens
GNREKHDLNELLGEGASGLRWSYVTEQMQSPSLHKLVLGKYGALVICETSEQKTKLEDFGRRLGQHVVGMAPLSVGSLDDEPGGEAETTMLSQPYLLESSITLGQYVQPQGVSAVDHVRTECGE

SEQ ID NO: 981440 - protein, 44 aa, Homo sapiens
VRNTRQLPASIGSHCTDSQIVQKEAELGERAKEREKRRKEQEEE

SEQ ID NO: 981441 - protein, 38 aa, Homo sapiens
RFIADDFRASMLQSWHAQSVENDIMGSEVLMNNITKSR

SEQ ID NO: 981442 - protein, 46 aa, Homo sapiens
SLVSSFHSINAHFCKHMARFQQSNQTGKQYVPAAILFSAQCMHIAF

SEQ ID NO: 981443 - protein, 66 aa, Homo sapiens
CWSWVYGDGTARKANQSSAKQVISQWSFDNECHTVEKMAVFLYFEATAGVIVNNKGELQGSAIPGP

SEQ ID NO: 981444 - protein, 66 aa, Homo sapiens
SWELRRTRHTSAAAPEGSFGVSEQQAVEAWEKLTREEEDTLTLYYSHWRKLGDREIQLISGKEQQE

SEQ ID NO: 981445 - protein, 153 aa, Homo sapiens
MAAAKSWGRAGSGLALSALTDDLPRSSVACHAGLGPSVAAHLKANDMLSLLQLALCEFPLMLLRFLHKPVGISTVVPIILGHCQAAQSHQGPLHCCHVFASKEVNSLEHVSLDDPIVLSRLQELSHLLHLLEDHGGWVLGHLHGLGASGYRLS

SEQ ID NO: 981446 - protein, 45 aa, Homo sapiens
WYQYCSAEEEDEDEEDGNERLTFLVGLIQKHRRRQRKIARGTCTH

SEQ ID NO: 981447 - protein, 103 aa, Homo sapiens
CAGPAVVWPFAPWPRTDRDVKNIYWRLEQEELKEAAGTAPGQGFEKAYNRDRESRESKEEEVRCVTRVEGHEGHSEGQGKPWVSKVPNQNDLKKVGAKTTALL

SEQ ID NO: 981448 - protein, 64 aa, Homo sapiens
TTVRQNMFADIDTIRRASSPRQLERLNKKINENQGDETQGQHAPQRRYRRNFNYRRRRPEKPKP

SEQ ID NO: 981449 - protein, 69 aa, Homo sapiens
VGTCYQAEWYDYVPGLFEQLSGKLRVSFGDLNCPGGPKPCSPVQCCMYNRFLLFLPPLAWVRPDQSDGS

SEQ ID NO: 981450 - protein, 107 aa, Homo sapiens
HTEALIFTKNTKSSQVWWFTPVIPATRRLRHENCLNPGSGGCSEPRSHGCSPACATEQDAISKKKKRKGKENQPAWAKWQNLVFTKNTHKKKIYLAMGPAPCSPTLL

SEQ ID NO: 981451 - protein, 49 aa, Homo sapiens
FCVRVFHFSSEDHLLSGVSMLSISSLQTEIRCHSKMSTFASECSSSGAW

SEQ ID NO: 981452 - protein, 36 aa, Homo sapiens
MTTHTYIPALWEAKVGRSLEIQEFETSLDNMAKPHL

SEQ ID NO: 981453 - protein, 85 aa, Homo sapiens
MYMRLEAPAKRLRIDSTCLLAEDICAEGAYYIGTFNQSIEKHRSCFKSPADEACTFLTMGKLWTIQSHVMRPSEVNAVLEELAIP

SEQ ID NO: 981454 - protein, 63 aa, Homo sapiens
YPHKMHRVTEDVAALESRFPVPFANYISGTQKGSFTYFIEDLVSKALFRKVCICLTGTVHVVS

SEQ ID NO: 981455 - protein, 46 aa, Homo sapiens
RIPAVLPDLLEGLGFLYIKKSMLTKIPKNTIQVGRHPVTALPFLEV

SEQ ID NO: 981456 - protein, 48 aa, Homo sapiens
VTLDGSQLSLMVSRGEHKIAKLYKQLDDKDEEINQQSQLVEKLKTQML

SEQ ID NO: 981457 - protein, 36 aa, Homo sapiens
EYWAAPALVTIYHHSGGKSPSFRAGGQGGEPGPQVG

SEQ ID NO: 981458 - protein, 42 aa, Homo sapiens
MESVLLVLYDKEARDSYYYWGLKNTRAGECASYQMRPVRGSQ

SEQ ID NO: 981459 - protein, 43 aa, Homo sapiens
ETLRSLPDDDEAPQLLTASTWGRLSLLGVTLASLQERMKGQEE

SEQ ID NO: 981460 - protein, 87 aa, Homo sapiens
HLCPLSSHSALNEIKLQVNCSAGIRRVEAEHDYQFVLVSKGSYCISCYLVANSEEEKTGSGQNAAYAYVHKALILYTYQHFSDVTSS

SEQ ID NO: 981461 - protein, 88 aa, Homo sapiens
MSGSFLALGFVEGYNWNLTLRRKGMRERTFLALGFMEWPNWNQRYTEHGYARADLPIQDVEDVSFGVLEVLLHVIGQVAEDRNQVAAQ

SEQ ID NO: 981462 - protein, 37 aa, Homo sapiens
LDDPVIKATWLTHGSLSYSVRGVTTLSCHAVRKMTRS

SEQ ID NO: 981463 - protein, 80 aa, Homo sapiens
ELLAPFMMPYVSSCYVRHGPYCGRWCSRIALAYDYLHLHRTLSGMESYCVRAFADAMEVIPSTLAENAGLNPISTVSRPS

SEQ ID NO: 981464 - protein, 45 aa, Homo sapiens
HRLMSGKVTVWGHVITVVWADPVKEPDPEVMAQVKVIVCETLGYY

SEQ ID NO: 981465 - protein, 38 aa, Homo sapiens
SVSYYYCVVLTHLTAPVVSKRVLVTTISRILFAEVKTV

SEQ ID NO: 981466 - protein, 39 aa, Homo sapiens
LEDPTLTSRERWTVGARPQAAGLCVRVCVCYQRLPSSVL

SEQ ID NO: 981467 - protein, 87 aa, Homo sapiens
CVYSWFENAEEDLTDPVAETPWKNQSFARAHDAFCSSLSSAQDDFNQLGELNLQIKSFRVASNPYTWFTMDGLGEDLDEPYRKSSRR

SEQ ID NO: 981468 - protein, 34 aa, Homo sapiens
PDQCGGGFLLRDLICQILSDMRRQYEVMAEQNRK

SEQ ID NO: 981469 - protein, 129 aa, Homo sapiens
YRLAASEPKIEQDLSSLGRSYLTLELQHCCFCLGLRSMTLKVEQQHQVLPGLPAPVTLRLQRQQRVQPLGSSSNTLRSEQRQPLLLSGSTVPRSLSETSSHIFTRGLQLHETQARIAAPAPLGSTAPGP

SEQ ID NO: 981470 - protein, 96 aa, Homo sapiens
MGGDKFDPPVEIPLSLIARANHTGYKKVVSHLNYFGFVHQLGALLTLMSVYKKGESCSDIRCLFGVYPSYVPLLVILVHSWFLVRNWGMPPKADFP

SEQ ID NO: 981471 - protein, 52 aa, Homo sapiens
MDPPTVFTPKTLQTTSINQFITNINNKSNNDSHFFCVIHCAKCLRLPRCQTV

SEQ ID NO: 981472 - protein, 40 aa, Homo sapiens
MHWDFRNYLFTDKTEGRRLYEVSPISETLCCYSFLNAPLS

SEQ ID NO: 981473 - protein, 35 aa, Homo sapiens
VGLPDRSLPTQYGGFDETFSTPFFVLYTLRSCFVF

SEQ ID NO: 981474 - protein, 187 aa, Homo sapiens
KTLHPILSQIIILDIMIVHIENMHAQKWGSSRCTPFPVTGTRRDSNRRLTANLISFTLGRSLIPRFIFIKRLIMESQLSPCLISILVEKWPLDGWGFTRETDTPGSILKTLSGFPGQQSSLILSSASEANLTSMCSSSSELVRETIFSISTAFSSNSNCKSRIRGPIFSRFSLIMATNGMTFFMYFF

SEQ ID NO: 981475 - protein, 48 aa, Homo sapiens
YDWKMPLIVQFRVQGRQFHTVIPKNPQGPYANLSFYATVLYQRISGIT

SEQ ID NO: 981476 - protein, 138 aa, Homo sapiens
MYELQLTMHLQDSATLHVVHSNALLTPCKGTYIINHHFFKILGTGCVILVQKFSDFEKVIACIYQILPSTILGVSGARCYNQTRKHFSHKKQKYEHFEDEIKTYKQFYSTVCQILLPNEFTLVHILLLHKLPKNPLHI

SEQ ID NO: 981477 - protein, 150 aa, Homo sapiens
SPCPKRPSVDKYNVSGTNGTCLLASIVVLQLNLTYERNDNIDRVTMLLNIKPNKNSCQRELWCPPGDSGACTVRAPPALLFQFGMNASSSRFFLQGIQLNTILPDAREPCFKACKGSLRALEATVVQFLQVATRSEHVRVTKCVFSQYIP

SEQ ID NO: 981478 - protein, 52 aa, Homo sapiens
YPVSDALPVYALVLLILTESLAQWMKPALCSPCGNLLDSTSWFGCLDDCLPC

SEQ ID NO: 981479 - protein, 41 aa, Homo sapiens
AVRGGVSSPAWSFSCNTVFACMNPFLGPVSSSGPFCLRLAC

SEQ ID NO: 981480 - protein, 167 aa, Homo sapiens
GSTRDTNGTLSKDEAAVHQDGTANRYSYAILIIYAINSSPGQEDDPQRDFTLRLCDNFPYDQNAGIGWKNSIRHNLSLNKCFRKVPDLGMTLGRVPIGPIDTCPDISRKRREPPDDDLSQDSPEQEASTSPRGGVAGSGEASLPPEGNPEMLLQSPTSIASYSQGTG

SEQ ID NO: 981481 - protein, 35 aa, Homo sapiens
MRAEDEGGKDMDPLPLKSHLGLQGTSKDTEWYRPY

SEQ ID NO: 981482 - protein, 113 aa, Homo sapiens
MNNKDWLRSRACPGMVDHRRSVVQDQPGQHGETPPLLKIVYIFVCLPVYVCQGSIFTKFKTATIIRDGANQCHPVFMQMKCCKGKQILYMLVTTHQEHMGSEEGKKEKENTGR

SEQ ID NO: 981483 - protein, 74 aa, Homo sapiens
QYPSMLAWLVKVDVYSATCVCMSPWTKFRRDVSTVADLQISYKLEPGRRVFTTAVHASLYKFRRHVSTVLTSKY

SEQ ID NO: 981484 - protein, 87 aa, Homo sapiens
SSHACAGSLYISYCSTPSLRESPARVLMAAPSSWSLQPGSKPILVLNKVQQFLLTQSPYNHPIYHKTDFLGEASLTPLRDTKQQQSS

SEQ ID NO: 981485 - protein, 140 aa, Homo sapiens
RIIRWPGVSVQPGHDSKTQSLLKKKTQTSIGSAKATTAGPHGSILRSDRKSRKVVGATKPTARESKRQAGPVSTGEVRKSHGAPLGPLSIHPSALGGGLEAATKRDLFENRSPAVYFPAVSLPPSLSGREPKRESISLLP

SEQ ID NO: 981486 - protein, 43 aa, Homo sapiens
LTIALSSSENSQQLYYVLYLRMINFTDGIHISRTEESPLHGPL

SEQ ID NO: 981487 - protein, 51 aa, Homo sapiens
FRSFHMWCLPLSSLQTPAQAELACATHLTHARGCGGPIPPFNTSNSQTSSK

SEQ ID NO: 981488 - protein, 142 aa, Homo sapiens
LANETLRPQIMELTVLKAERLQVEIDQKKDADNLVMPSSRTVALTPQGSRILRKHEEEDDKDSLKTEAKPRLRVRPSQLPLDPYPVGSWDLAVLFCVNFRLKGKDMVVDIQRRHLRVGLKGQPAIIDGELYNEVNVEESSWL

SEQ ID NO: 981489 - protein, 41 aa, Homo sapiens
SCEAFNMIDQNRDGFIDKEDLHDIACFYYGKNPTRCIPMMP

SEQ ID NO: 981490 - protein, 74 aa, Homo sapiens
RYFLQEHGRLYHVRHSSVHSAILCKRRAGYCSVCYLLQVKERRDCNIPWGMDRELINVCHSCHYQGEISNIVSY

SEQ ID NO: 981491 - protein, 173 aa, Homo sapiens
TSDASLLICRDMIPQDGPLYTLPLSQRLVDLPCRTGAPRVNAIPAASGDPLYLPMTPLIGGRHLAIGLDPPCCVRGEPDVVEAEGFGKPPFVILCFPSWPGSWPTSWGDSRPCLCAPRQPPPSCKQAHRAPRGGHLWVNHPHIPPATAHLEISFPKLPHVCPPPLSTADTCTG

SEQ ID NO: 981492 - protein, 70 aa, Homo sapiens
LQESLRKPSRCSHLEDHGIPILSEDYSISFWFQDAQLKDHMLAVPLLNLQVILLKSLRVYLYSSQRNRQQ

SEQ ID NO: 981493 - protein, 100 aa, Homo sapiens
CSIVYFIMGKIIRPGVNGLGSLDVGEGTCSGTLVRCLTSEARWTHAACGNSGGTAAQLPPPPSHIRYSRWGSTSPDQLAMIFSDQDLGKSVNALLGSRPF

SEQ ID NO: 981494 - protein, 121 aa, Homo sapiens
SDGLDAQCGQPQSSIDAIRKHLMLKTVLFVAHQLQYLVDCDEVIFIERGLYYGKRCPLGPDYLYGDYATIFNNLLLGRYYLTVEINSKKETSGSQKKSQDKGPKTGSVKKEKAVKPEEGQL

SEQ ID NO: 981495 - protein, 166 aa, Homo sapiens
LWLSDPQLWLHPYLVLLSHLESAGPLGPTANHARDSPGDWEGIRRSSPSHPRPASTTTQRQRGDCTHHSSREAVVAHFQHSEEDHLRPLVARSDAASSALPVVCVKLVTPVSPGHFLKAAVGSGQTVEKEVKWRMFPAKGMSWIPGAWSAWLAAPFTDTTDRKTWC

SEQ ID NO: 981496 - protein, 82 aa, Homo sapiens
MRPEMPTSHHMLSQVAQFPVQLPSLRCEEPDLQSLEAHDRGGVVQQFTCKMCQYRSSTKATLLRKMRGTQLPSSSSSRKQQL

SEQ ID NO: 981497 - protein, 133 aa, Homo sapiens
LGSVISKMSEMIKGYLSPFFLLKKYVFVLFEVESRSVVRLECSGTISAHCNLRLPGSSDSPASASRVAGIIGACHHARLIFVFSVETGFHHIGQAGLELLTSNDPLASAVRSAGITGVSQLYLAMKLLKENRG

SEQ ID NO: 981498 - protein, 82 aa, Homo sapiens
CLWDRHLTNLEVCIRGKTKLLDFRSWMRSPTDSPQLCRSNRLTKIDGLQNLRETCGEPVPIAYNWHSRFIRGASETQLTILH

SEQ ID NO: 981499 - protein, 173 aa, Homo sapiens
EDPPQVILNAVGLDEVVVFVISEKRLGQLSEEGLEQAADHIEVLPALILQVDVTRPAVELLLQAGHHCIVAGHSVNACGLQPSCLHNATACSHDEGDALVLRGWLALLQPDPKRPRSGLLIFLDDVDAPGGLGGCSTVILAPCGQVLSPEATCRTLLEELRLEAPQYLMALAS

SEQ ID NO: 981500 - protein, 38 aa, Homo sapiens
AGITTCEPPHLAWKEPLKISLRLVSRSVMQDTGESCYA

SEQ ID NO: 981501 - protein, 102 aa, Homo sapiens
MSTAYFVCVCVCVCVCDGVYALALLEYNGTILAHCNFASQVQADSPASASRVAGITGMRHHAQLIFSIFIRDEFHYVVQAGLELLTSGDPSASASQSAGLQV

SEQ ID NO: 981502 - protein, 66 aa, Homo sapiens
QSVLVAWGTGMAACGKVGVAGGRRAPCQEIETRVSSRLTAHFPPSFKIFHHIDKTVKNKSKRTFKI

SEQ ID NO: 981503 - protein, 47 aa, Homo sapiens
SGNNRTLVYRMNTRDSTHSRIQDGPKRDTIDNGHNRQVNVRLPGLRG

SEQ ID NO: 981504 - protein, 136 aa, Homo sapiens
GLSDRCAYYKKDGSDFAKWRRVLYDWGTLLLSASPSCENANVLARYASDLPGKMALMPIDGACKSSLIGTDALEALPLMLTKKVLAAVYKALKDHHIYLEGTLLKPNMVTPGHACTQKFSHEEIAMATVTALRRTV

SEQ ID NO: 981505 - protein, 36 aa, Homo sapiens
QAEKLELYIELHKYSLIKGNSCVYRMTEEIVETSVS

SEQ ID NO: 981506 - protein, 71 aa, Homo sapiens
MQSLANFSINEMTENTLTGRAVQLLRSYMSSLTHYTSEKPIHGPVTTNAVLTFQAPLCIQHNLSSGLPLGH

SEQ ID NO: 981507 - protein, 151 aa, Homo sapiens
CCGARASEFVDDSAIRILAVKPPELGSSITKQYDVVIGINTSPAPPIWNACGVRFFFQPGSNGIWHCEYIGLYDLLLGSLKSLGPVYSATEAREDAADAVSQSSVCAPALGYGSVWAGFHRFHSLRRCAPERRSRLLSSRRGHGQVGLTES

SEQ ID NO: 981508 - protein, 60 aa, Homo sapiens
IGYPGPKGDRRPVAPPGHPVSHLALEDTREKKETKVTKSMLFGEGRRSIAVKRVSSQWQD

SEQ ID NO: 981509 - protein, 45 aa, Homo sapiens
LEEPHSFSAPERSIATFLYYPYEDNYTSSICYENRIKFVNCNSLN

SEQ ID NO: 981510 - protein, 45 aa, Homo sapiens
MSSRSHFQALPSIPECPLDQDPTFSRDAGSPPLGSGSSPNSAAGR

SEQ ID NO: 981511 - protein, 32 aa, Homo sapiens
GKSNSILLTDTVSRYYAYSPIITENDTLKDSG

SEQ ID NO: 981512 - protein, 59 aa, Homo sapiens
QARSQVPPWIATTLRPGQSDLTCSRASSVLRVFFICLRDARRRKFLGCPHSIFQVLELD

SEQ ID NO: 981513 - protein, 99 aa, Homo sapiens
LKCIVECDVLWDVDIPVGSQGDWGLAGRRMLLSPPGGWANTMCLFLAQLETDTAFSVMKRWALRGRLVGVARYILTTSSKRALSQSRGKGTEVWLFSLQ

SEQ ID NO: 981514 - protein, 47 aa, Homo sapiens
WWVDLLVPSGSKCTRSAGQALEGGVTSTSRVTNQIGIISPGSSGHHG

SEQ ID NO: 981515 - protein, 115 aa, Homo sapiens
MVEVGPFQLMRSDCISCIRTACSCLLFMSLMYQATQGHGVNGILHHLKKPSSSSSKCMGTFLEQQVVLEDALELASAGEEAQGQQALVAAPAGPEKKFGLAACPRMQFHRWGPGT

SEQ ID NO: 981516 - protein, 44 aa, Homo sapiens
MPSPKITLTHSLVEANVGVARPGDFSQLHGWGEVSSHVELSQLL

SEQ ID NO: 981517 - protein, 101 aa, Homo sapiens
PCAHLACCGAAAPCVSPSPTSQDSKLSQCCKTPSIALNLHLVGWQGTFWGQIDQPFLLSPKPHQHLAGPAAFTGRYPLSPCTWISSGPCSENPVHPGPAFA

SEQ ID NO: 981518 - protein, 44 aa, Homo sapiens
EGTLISKQQRTPRSDSLLTITTTSTSTPCDQQHRDRQRRLPISP

SEQ ID NO: 981519 - protein, 76 aa, Homo sapiens
LPTRMRLYDGTLTKSYGASGGYMELQTALSETTGEAHSHSAEYGTSLSPPVGEQIITSMKCIMGQDGTSLGKSFFS

SEQ ID NO: 981520 - protein, 102 aa, Homo sapiens
MIRVTDRDICQIAYRRIEGDMIVCAAVSHELAQYSVMCCADKLCCSIFVLVCCQARRLLNRFGMDKIYDGQVEVLVHEFIVESIDVQPGAFTCYLDAGLAKN

SEQ ID NO: 981521 - protein, 112 aa, Homo sapiens
IEDLPRSWCCCVLSRHPGGYVTNHIYTWVDRRPQHFPPLGCPAHGGALRQQEGDRRSTLHLLQGGDETKVSGVGKGGQPLRHRYSPSEPRTAELLWRPQEEAGSVQALSSLK

SEQ ID NO: 981522 - protein, 102 aa, Homo sapiens
MTHQQQHQGAVRQQLAEAEAAVGLAVMETCCGGATPGWKPLVIYPSVPRAEGGPRSSWADSCPDFPTFGTFHFSLLLNGPRSIPVKHLVHTCVPSLFPIPTA

SEQ ID NO: 981523 - protein, 88 aa, Homo sapiens
MHEGPAYLYSWEVAADCAYVTGGLCLTSTHVPVGIRTVDVTKSQFLINGKPFYFHGVNKHEDADIRGKGFDWPSLKTGVQAATGARGQ

SEQ ID NO: 981524 - protein, 98 aa, Homo sapiens
IPLIVGYLLLSVLDTAELIVCEHVYKLVPSGSSDHAHMHQNDVYMARTRATTVSETHADLINDVLFLLSRVLLLVRNTQLVNENGSTLDLSDLEAEKL

SEQ ID NO: 981525 - protein, 117 aa, Homo sapiens
PPIYRGRQRDKCASGSSAINDVDSHHLRVASSSYNIGSSAEDNQTNRLQEALEPLQEHLGTTDGYAPSTSRTCTYNKQDTSYAEKVLAREIEDRGLTIPEFAPYTNYLRMLLPEPGE

SEQ ID NO: 981526 - protein, 44 aa, Homo sapiens
MIRSAPTRCSVLLLVLLLVFWASLRSRQPCEQDEIQRLPGLAKQ

SEQ ID NO: 981527 - protein, 46 aa, Homo sapiens
AGPGEALSEALPGDIEPTLTPVKSFTQSFMVHFDRFYFLFPESLEF

SEQ ID NO: 981528 - protein, 50 aa, Homo sapiens
MMSWYPTAGYWLVSGCSAAPTGPQNGHFRPPVDTRAKVVLPPSLPESLEF

SEQ ID NO: 981529 - protein, 50 aa, Homo sapiens
SRGSLGLTSGEQTHPVKAHRPPPPSSCRPCFSPDSNPRKNVLLREESIPS

SEQ ID NO: 981530 - protein, 51 aa, Homo sapiens
GQAQVRGVMWRTVESLPGGGTCVEWLRRYLEDGKETLQRRDAPQKAYDYTT

SEQ ID NO: 981531 - protein, 33 aa, Homo sapiens
MRNQNSTKRKVRWQDCRHGSPDPFLRGNIPYRE

SEQ ID NO: 981532 - protein, 47 aa, Homo sapiens
VPEFGSLGATAVYVMQNAKPSRHIAPCCSSEGQAGPRAGLFALVTPR

SEQ ID NO: 981533 - protein, 146 aa, Homo sapiens
QDLNRQHTRMYSSQQGPVARPDAHDPRIKNLSASGRGPAAGVRFPHHSLKVCNDLSSKFLYLPKPNFYNVPPESSGGPSTCKSLTGVRGAPAPQGGRVEPHTVTFSITLSATWTSSAWTVTAAWLAAYVLVILPVLALAEGGAVVD

SEQ ID NO: 981534 - protein, 125 aa, Homo sapiens
RVKQCPSSQLLLASPTTGVSSLFVCLRWSLTVLPRLECNGAILAHCDLCLPGSSDYPASVSQVAGITSTRHHTQLIFVFLVETQFHHVVQAGLELLTSGDPPILASKSAGITGVSHHAQPWCCVY

SEQ ID NO: 981535 - protein, 128 aa, Homo sapiens
SRQACGRRTLMIQDKNCRDGRGLAGECAPRHRLKCVNDLSASFFTFPHPSSQRPPRVLRGAFDLQKPHMSARGPSSQGGRWSLTRSPSPSAFSHVDFVCLDGDSCCLAAYVLVIYPVLALAEGGAVVD

SEQ ID NO: 981536 - protein, 49 aa, Homo sapiens
RGVSGINDAEMRYTEKQRVDFLGEAGIMGQFRHHNIIRLEGVISKYKLS

SEQ ID NO: 981537 - protein, 168 aa, Homo sapiens
MRVGRERPGASGEGTSRRRVGRECPGAKTGAWACTRSTGGGRRQLQNRRSDRERSPPQLCKETHKSQASHPAKELWTLPLPELFFANCRLHLKRSHHNEATARETDGSRDEATSNRQRHTTSKKFSHRKLKEQIQDFREGIPEKKVAHELGELRRRKDDPEERLPRGA

SEQ ID NO: 981538 - protein, 73 aa, Homo sapiens
FSGTSRELNTSALPDFSGGDLEEQPSPHAGKALTRSGTYVDKATASTPQKDPSHEGSPGRPLSNRRADLTPGM

SEQ ID NO: 981539 - protein, 55 aa, Homo sapiens
MARLPLPVVHQGNEKKVPVLQTIQPHLASSEEEREIPLPESPEKDEAAVPQIGYL

SEQ ID NO: 981540 - protein, 99 aa, Homo sapiens
DPDLVERQSGTRAPHVNSGTTPCTCSRLNSYWGMFAAFTSAPAPHFPKSSINPGKYQIYVLQLGKGRQGTGRERRKERSESPTSFQNVHENLEHIWSLR

SEQ ID NO: 981541 - protein, 187 aa, Homo sapiens
RGSYETRLSLLSCTVCWTVPVPHLPGTAGGHMHTQPSCPQGALLALLGLPFPQVNRAPVQPAHSVLFPAVFSFYFSQTFCLFSVSNMIVDMRLKPLGCGGEIGSEMDNLATVSPCFPTPASWNMQQLLYPSPRCSGSRDTWANGPSGPKVGCGALDGSSGPDMNYSCSSSLYYCFTRAVLAQICCVS

SEQ ID NO: 981542 - protein, 49 aa, Homo sapiens
THTPVLASRTRALIGDRPEPGGAEPQQNTVFDAKRLIGRKFGDPVVQSD

SEQ ID NO: 981543 - protein, 54 aa, Homo sapiens
IGVEDPDRTTPSYVLYGHERSSGIRQNKLAEPEKRVCREAVIGREFGNRLWRRT

SEQ ID NO: 981544 - protein, 81 aa, Homo sapiens
GRVRTKNVKKAGRVIIRYTYYTRLGDDIPHWNKSVCKDDRTLSPVKKLREQSVSGLCHYILMKLNSEEASVSGISMHAARS

SEQ ID NO: 981545 - protein, 103 aa, Homo sapiens
MSDWYTELEKGVIVLVENFYKYVSKYSLVKNKISKSSFREMLQKELNHMLSDTGNRKAADKLIQNLDANHDGRISFDEYWTLIGGITGPIAKLIHEQEQQSSS

SEQ ID NO: 981546 - protein, 68 aa, Homo sapiens
VVLELLVGIWAVPLTLYGSSGHGHISRKQKMMKSVLTTATHVSQRVSCGEQTPSPNVMATDHSWDSHY

SEQ ID NO: 981547 - protein, 128 aa, Homo sapiens
MDSGSLESAARSLIVHSLSLCDKETQVITNLRIDSPALPFHKQTPTPSDITLMLVRITKQMPLSYVSNRPSGVAHNNRLNTPSGVHNRTLPVTTASKDSRLLKNPSDRRTIHPLHILKDIVRKTTGKR

SEQ ID NO: 981548 - protein, 50 aa, Homo sapiens
SSTTVVTVITWRVDCDVPQQHCNRLAFCMLLSTGPHDTISEFPPHKTRAA

SEQ ID NO: 981549 - protein, 87 aa, Homo sapiens
GGSTHVLRPPDMKVSASALMFSRHFYVHSSRPNGLMLLLACDIVHNFTDAVIQERCRTLTSQGVDDFLQARGKSTTLDFLDVLLLAQ

SEQ ID NO: 981550 - protein, 39 aa, Homo sapiens
SSGTEYGSLGDSPSCYVAVAATDPCQPGTDVVPQSTSAM

SEQ ID NO: 981551 - protein, 44 aa, Homo sapiens
SIWDQYAHMQSRVNYGCIIRYLQRQLAPQVFLICLFLHIGRGHI

SEQ ID NO: 981552 - protein, 119 aa, Homo sapiens
MRNCDVCCGTMLTASLLEVCIELSWRLRLVVSSLMVAEDKVVQIPVDCLDQIQSAEAYIIDGLVVNAKCLISILYQLMDGEGGIVGLTTVSDTLGEGTTLKVFMMRSGYSSRILLIRRV

SEQ ID NO: 981553 - protein, 35 aa, Homo sapiens
PVRVDWNDMLRSSPVVIDASTAIGAPSNLRFLATT

SEQ ID NO: 981554 - protein, 30 aa, Homo sapiens
MTTRLSGVTLTTLRGNVLPRSYTCMCETGT

SEQ ID NO: 981555 - protein, 79 aa, Homo sapiens
GQDSTMLLAVESGSSCQQAFLLDAQAATSAKGDAGSPETIMMPSLPVRLSQAARSGFPLTVPGCQFTSWPLLNCLSTGP

SEQ ID NO: 981556 - protein, 38 aa, Homo sapiens
ANSEILRMVVCKWLHPARTLMSRRHMFSWGNSLGPSTL

SEQ ID NO: 981557 - protein, 130 aa, Homo sapiens
VCSERGRTSSLGVTWGHEAGKEAVQFGLGSSPYPGTGLGRKQTKRAKVFHTGVHQAGKEAEKLGQGVNHAADQAGKEVEKLGQGAHHAAGQAGKELQNAHNGVNQASKEANQLLNGNHQSGSSSHQGGAT

SEQ ID NO: 981558 - protein, 108 aa, Homo sapiens
SERRRRELVEIPGPSGSSLVNIVPLELLLHKVSYHLLLELCLGISNEYAFYSDFVLADFSAPCYLRIFSSLNLKIETVVGMLLHFHMTFMLYWNITCYEVILHTTSKP

SEQ ID NO: 981559 - protein, 182 aa, Homo sapiens
METRLREGCAEDEGQHQCSWQQNQILQARTVAPLSLGKKGGLCLARLRFQICCHHGPFRVLGNSWLLLNQGELGLQDQVWSRPKYSPGSAWIRCQCLSLGSRSTPDPRLDLAPFEFCFPLELGSGPWASIYPCVASVLSSDWVSLHSECSLLGHQGGAVQSCQVLNPPVPRSQTGAPWVQSS

SEQ ID NO: 981560 - protein, 57 aa, Homo sapiens
SLLIRQPNRGADPGVRRAKKGHGRKTTNLVGGASKLEAGITFRTTQGDVGPQESTGE

SEQ ID NO: 981561 - protein, 110 aa, Homo sapiens
MESRSVALKSSGTISAHRNLHLPGSSSSPASASQVARITGMAQLIFVFLVETGILHVGQAGLKLLTSGDLPTSASPSAGITGVAQQYLVSKHFLFNSYITFLMLGLCWWV

SEQ ID NO: 981562 - protein, 138 aa, Homo sapiens
LESSLVYGMCPKRMGQVTHGPEICFLKPQPWPSPQTCVNFIFSSFFYFFFFGEGVRLLWPRLDVNGAIWAHRNLVPPEVKRISGLNLPNSWDNGHAPPHCGKFGISSGGSGSPCRSGGSRTPDLRVICQLCTAGEPEL

SEQ ID NO: 981563 - protein, 87 aa, Homo sapiens
VHRESSHFPDEVTEYRLTAIGAKADANRKGSCHQATNNTTASPGAQNACPGDTFSGNPLSTRDCCQSRHPARRAQGIAFGKPMYSPQ

SEQ ID NO: 981564 - protein, 52 aa, Homo sapiens
DQDPKKTLWVSGCQTRWAGFNRSSPTEQLVPMRCWWFGAFCFFFYLGVITVV

SEQ ID NO: 981565 - protein, 35 aa, Homo sapiens
RRHSGTVILRGEPEKLGQALTEVYAKANSFTVSSV

SEQ ID NO: 981566 - protein, 47 aa, Homo sapiens
LGAALESAGKLAELEEALKKAKQDMALAAVSEVPVSSGHTNAGPVTW

SEQ ID NO: 981567 - protein, 48 aa, Homo sapiens
SHEDTLGSLDTRLLARILELRMAHCVLNSVAGTVWHPLVALNNGNSKG

SEQ ID NO: 981568 - protein, 117 aa, Homo sapiens
EHSTAGSAGLQQSTRDHHCQRWPSVSSLAGTVSLYFLLPTFQGFQKETDPVSPKDWICDSTRLKRTPVLKAGTWGWVSHTPYVCPLDRVRLKHQGENMCFFSPYLLSHPRLSLSQGL

SEQ ID NO: 981569 - protein, 45 aa, Homo sapiens
RSAGGMGLYGFWMLLKDKHNMMMMKMTEQIQGTRENCLQLLINQR

SEQ ID NO: 981570 - protein, 40 aa, Homo sapiens
PTDIWLWSWELRIVRSLGRAITQSSGWLLDYSCAQKRLML

SEQ ID NO: 981571 - protein, 35 aa, Homo sapiens
MQMVKNVPQQRAAGSSIPACPASRLVLSPCCSLAR

SEQ ID NO: 981572 - protein, 134 aa, Homo sapiens
MSESVVDSGCAGRGRKMGMSTGLAGASSKRCMGLSLGMRPLCRLMPKQQGSYTRGLLRRVPPLETKPLTKAPTHRLLPSPGRLSPRLTLLGITWLIPNPRNSWCSAPPTDWSQPLRVAVAKAFGPWGLDVSSEV

SEQ ID NO: 981573 - protein, 53 aa, Homo sapiens
VTDKELIAYSAPGCRGRGPLDPADCRVLTSESGQVAGVRAESGSFCLSVNSLL

SEQ ID NO: 981574 - protein, 74 aa, Homo sapiens
PDCEQVETEEESFSGSMCNQMTDYKHGFRISMKTLFYGNSFLKLWHLEKTDVERFLTLPVDESLRFKKYTLGRV

SEQ ID NO: 981575 - protein, 45 aa, Homo sapiens
SVALASPPSSTQKGIIKLYFLSFFFSSSSLSCLYACISGNMTGLP

SEQ ID NO: 981576 - protein, 137 aa, Homo sapiens
TLIISPPALAVATHTVLSAFSWLRNEVLRAEASFLFPSQPALCWPPTLMNGRLCAGRRSCCPPDLPVPCEVGLCGPPSDAPDLSQMVGRRGGAVTSLSAAPSVPSSAPRLALWEYALLRGSGVLSLLDVQWLPIGSG

SEQ ID NO: 981577 - protein, 106 aa, Homo sapiens
GLLFSYTGLQASSIKVGLCVEHLVDAAMIKTDYINCPFKEEPSFLVCEIDSMQDELVLESTTFVSLRIKPAKEDVECPLVVAREGLPEMVAVAAAASQNLLSCILL

SEQ ID NO: 981578 - protein, 112 aa, Homo sapiens
KVSRARIGDWTKDILVSSDLTVGQCYVLDLEANHLRAEDALSRSVENVIPPSSATMGQVYQEHHEEDFFLYIAYSDESVYGSVKLLPLSWRGVSFYKERGGPPFLTSSSFKL

SEQ ID NO: 981579 - protein, 75 aa, Homo sapiens
MLTLLSTQRILEPDDFLDDLDDEEYEDDTLKRRGQGKFKGRGVGSVRKKLAASILEDRDKPYACDSECLTSGVGR

SEQ ID NO: 981580 - protein, 84 aa, Homo sapiens
MWAEVSGASAIHSRFLTAALRGRGSDTFVVQLDASKVPSWLYCTTPTRVPVSDLGSLAMAPSLLTTLMTGDFSSVKLVYPMLSE

SEQ ID NO: 981581 - protein, 41 aa, Homo sapiens
GQGVWPSMSSPPRMTQTELGWARLTTNGRRSQTYEVCYATG

SEQ ID NO: 981582 - protein, 39 aa, Homo sapiens
EPALKNSPVGISPTAKAHPKHITIAQQQLVFLEGRKKQL

SEQ ID NO: 981583 - protein, 81 aa, Homo sapiens
RCVSERVNNLPTVTQSPHDRVKRGVASRGCLSTALCHWTAPSMPSESHASVLGPPGFTFVAVEHHVVIPGSRGAQGLEFEY

SEQ ID NO: 981584 - protein, 64 aa, Homo sapiens
MQMLTYHGRLHQKRSPSPCDQIVTYKPCLKAAIHDFCPLKAYPMAVDLCVMPGIPSKHSLRPGY

SEQ ID NO: 981585 - protein, 63 aa, Homo sapiens
LLKRLADLIERDRTYLAGYYAGWADKYHGRTIPIDGDFFSIHTHMTPVGRVRAASFLEFPDSC

SEQ ID NO: 981586 - protein, 71 aa, Homo sapiens
MAGVGDGAEREDSAALASKTDVQLLDSRQTSGGESTPDVFLPQSPLGTAKHPCSTGPPMSERPVQVVRNTS

SEQ ID NO: 981587 - protein, 47 aa, Homo sapiens
SLHMETGESCVYPTQPSVAQQELVHQEEPQGQGGMSGYGEQHDLMDS

SEQ ID NO: 981588 - protein, 56 aa, Homo sapiens
KLQNCHCAKDGGATCLTKPTFTFCVECSSRELAWTAYACCSSCTGPRTALQIVHGS

SEQ ID NO: 981589 - protein, 103 aa, Homo sapiens
RYSQIRYTRRCTRRGSDWRSSVMAGIHKKVARNIGISSEIQRRRNKSTVVSAWLNVHVRLIHEYRVHNSSSFPREALVPPIKGDRFCCDELEYWPTQLTGTGH

SEQ ID NO: 981590 - protein, 33 aa, Homo sapiens
DPDFPLLIGPLLPLAVFHIVDPAVIPVHSEAQQ

SEQ ID NO: 981591 - protein, 110 aa, Homo sapiens
SRTSLLQIRVGINSVVMKEKERVKPGVVAHACNPSTLGGGGGGGRIMRSGDGDHSKTPSLLKIQKISRVRWQVPVVPATREAEAGEWHEPRRWSLQRAKIAPLHSSLGDT

SEQ ID NO: 981592 - protein, 76 aa, Homo sapiens
LKIIINAQSLRIAEYSFKLGARQRAQRKKTGVHNANIMKLGDGLFLQCCTEVADRYPQITFENMIVDETTMQLVSR

SEQ ID NO: 981593 - protein, 80 aa, Homo sapiens
MPDIGGPFETVWFEDNVPCVVVHTLPPPLAMPGIESPSRSRSKCGTAKGFRFTLFAPKYKSRSSIGALGGCPVVQGQMPR

SEQ ID NO: 981594 - protein, 138 aa, Homo sapiens
LRVSRDPDQAEQKEDLCYLGPSLRPRANDYAAPRTHQEKLTGIKHELQNWLQRGQGRCTLAEKLGGSAVISLEGKPLEPLLAPCLEHLAAPHLPLGVAGWPLPAREGLGGSQQGEGNPFTPVAKQTPHPLDFPSPSIP

SEQ ID NO: 981595 - protein, 182 aa, Homo sapiens
SWYLRIHETRLRSEIDSQKQCATAGRIADAEQVEEMALKDGKNKLERLEDGLEKGKEGPGRLLKEYEELMNVKLALDVEIATYRKLLEGEECRLNGEGVGQVNISVVQSTVSSGYGGASGVGSGLGLGGGSSYSYGSGLGFGGGFSSSSGRAIGGGLSSVGGGSSTIKYSTTSSSSRKSYKH

SEQ ID NO: 981596 - protein, 54 aa, Homo sapiens
LEDPMETRLSGRLCTGGLGSMLRSLVGWDSEASMTPPKSRSCLELLVHRFIPWS

SEQ ID NO: 981597 - protein, 134 aa, Homo sapiens
STGSVSLHRFFIGLAFKKTTFAELCPKVGQSDTPSTMRKKLVWRECCGKKPTIPKRSWNGQSGNQRPWVGIGGKRKSGLAGCSSRPPGSFLSRVMLTGTLSDRQPGELQLFRNYDAPETVREPRFNQNVNLRPP

SEQ ID NO: 981598 - protein, 75 aa, Homo sapiens
DAEHGECPRINFGPLMAGGPTGSGGPLACLEATAYMATICAQAWLLSPSNLVLFQGGGNSKNNYWNGKWACAPES

SEQ ID NO: 981599 - protein, 41 aa, Homo sapiens
GLLRYSTGSYGDQAEPLPTRCTQEPLETVDCTTEMFDLSKR

SEQ ID NO: 981600 - protein, 69 aa, Homo sapiens
VHCPIETKFCGFGHWRRLQEHQETQCSECRGGEDPHSFYFPGQFAFSKCLARSEASTEMRGAPGPLRVV

SEQ ID NO: 981601 - protein, 81 aa, Homo sapiens
LYGLNAGMPYAPVLQRELSVDGLHRPHGLGEDVHAGAHFTVFIFVRAASVICLLHAVVALQVLCSSEKQQQQQPACSSDRR

SEQ ID NO: 981602 - protein, 75 aa, Homo sapiens
SLIRPGNYKRTRYRLSFEATLQPATFALLLFFTKLNHQPARNNAGLCSISWQCTPTIANSTYTSFDLCYAKTHKL

SEQ ID NO: 981603 - protein, 119 aa, Homo sapiens
VDTTNVCLTLRREARLCQAWQASRMTANASERVAIRSPVTVLGDVWTKGRRCRSYELVARECGERRTGTNQKYCSGRGWALREAACHVPWWTAKLHGGGRKEGPYLSPYLSIGTILSAA

SEQ ID NO: 981604 - protein, 56 aa, Homo sapiens
VNISVAQSMSPVMVVQWCRQWLRLGGGSSYILWQWSWLLECGFSFQLYAVAGVTEA

SEQ ID NO: 981605 - protein, 85 aa, Homo sapiens
THQAGHASRGHVSHACLKYLKAQELARLEICGGRIVRHLEESVFVGSNFELHSTTASTAGELSPTTNRAGTAGFTVWVPGIGRSI

SEQ ID NO: 981606 - protein, 53 aa, Homo sapiens
MLMARVGQVNISVVQSNVSSDYGVCQLVSGSGLGLGGVSSYSYGSGLGFEVAS

SEQ ID NO: 981607 - protein, 97 aa, Homo sapiens
AYVRKLEQRCVYDQGVMLAEACIPCPELKYLKASASLRWLEICGRPPQSAILRRVVFVGSNFELHSTTASTAGELSPTTNRAGHCRVTVWGPGIGPS

SEQ ID NO: 981608 - protein, 77 aa, Homo sapiens
RSRSQNRDDNKPRLRIMASTHSADAGLLQGTLLSVCTECGGPPGGGSHLASYLHSRLRPPARAGTAHWGSSGGFQMT

SEQ ID NO: 981609 - protein, 76 aa, Homo sapiens
YRCLGMGSVDTTCGTSPLQPFSCVLPPVCRTMTTSIRQFTSSSSIKGSSGLGGGSSRTSCRLSGGLGAGSCRLGSA

SEQ ID NO: 981610 - protein, 36 aa, Homo sapiens
MYGGGSAAFLVWPEGLPRPQHLRGRAVVSSSRFSSG

SEQ ID NO: 981611 - protein, 136 aa, Homo sapiens
MIWFILIRTGGNALGKWYMAFDDDEKQKLIEEVVGVVTVRDAKHTNFVEFRNFKIIYRRYGGLYFCILVWIVHDNNLAYLEGIHNFVEVLNEYFHNVCELDLVFNFYKVYTVVDEMFLAGEIRETSQTKVLKQLLM

SEQ ID NO: 981612 - protein, 118 aa, Homo sapiens
GHGSVVRVSSRGHLSREGLCSHCFSVSFSRACWPSGAPSGLCPPWCGLAFSRHWAGGGTWSWWSLCTREIWLVDLVQVLLQLLAQLGALPRCQASGGSRVKGGPGARTARRAPALWGL

SEQ ID NO: 981613 - protein, 73 aa, Homo sapiens
MGLYRGRLSRSPPSWRRSARPSTTGRLSVSSSRFSSGGAYELGGGYGGGFSSSSSSFGSGFAGGYGGGLGCWL

SEQ ID NO: 981614 - protein, 35 aa, Homo sapiens
LEDRGAVGIAVWALRRGVCPELNPGLMSQALYDPM

SEQ ID NO: 981615 - protein, 84 aa, Homo sapiens
MGSVGVGSIPVDGLAPPPYRQQALGAGPVGDTCHPPPLHTHTVNIMVGRSAQTEQKPCTQPHAQKSKHGGTHPGFQAYMTPLPP

SEQ ID NO: 981616 - protein, 129 aa, Homo sapiens
CLGDSEDPVGWVCRRWCQQAGFEFMLRYIYYGRSHAADDSLHSHSPVNSQVPTKVSWHPPQVALRPALLPQLGDLGPAPPSRGFAGAWGWAWCSLKQLAAGKEGFAARRNQWVPDPHNCPEDGVGHCFV

SEQ ID NO: 981617 - protein, 38 aa, Homo sapiens
EAHEELAYLKTNHEEEINAMRGQVGGDVNVEMDAARGV

SEQ ID NO: 981618 - protein, 42 aa, Homo sapiens
GSSRGHEVTSLIDAIQRRLGGGEGGVLALQQAAVGGEYSWSQ

SEQ ID NO: 981619 - protein, 55 aa, Homo sapiens
DLYYVAIGTTRGRERLLLREQFGEEVEPKTRALDCLLYHPTSIPSGWEHWSWPSD

SEQ ID NO: 981620 - protein, 65 aa, Homo sapiens
MLLLAACAFVSSSYTKDPSERSHFTPNIRHQRDIGGKYAVGPEQYGGHPTMRVSRRGPQISLMPL

SEQ ID NO: 981621 - protein, 109 aa, Homo sapiens
MDVVTDLLHTLLQSGQVRRAQNEGLAAPKQSSKSMSFILSIISMVSPNSSSCSVFTLWIRDPAHPAWNSDPTGPSTQHTFVYSLKSLLGLNACRWTFLEVVAWIALPLC

SEQ ID NO: 981622 - protein, 61 aa, Homo sapiens
MSVWPGEVQLTSALLPEEEDELLCLFGESPAHPCRVEGEAGQSWQLPQWRISRSHRQAKDH

SEQ ID NO: 981623 - protein, 54 aa, Homo sapiens
IVNLQKDIGIVDCGCENLSSGPQCLEVGTVVFDLSRALALVPVTDLHFQTRPGW

SEQ ID NO: 981624 - protein, 36 aa, Homo sapiens
IWMAGRGQPSPWHRDKELHGIAVPMKHSWAWAMEQQ

SEQ ID NO: 981625 - protein, 121 aa, Homo sapiens
GGMGEAGGGEAGSLEAVQSLSWVRVWLSLRVEMGTRDWKTRGHGHAHDGAGVMWARDRKKRKPLKLLGYKGEAGSWSWAGKFKGTWGEHMRNLKSTSPRPTNSSGHCPSHGPICTPRPWEQ

SEQ ID NO: 981626 - protein, 43 aa, Homo sapiens
GERSRQEYRHARSDVSWGFTPSPQRLPGRIRGAPHHVNEHLLP

SEQ ID NO: 981627 - protein, 71 aa, Homo sapiens
RLLASSASTVCCFLLCSSICCSRSRERLSRSSCSCRSCSIRSCSNLSLSSRAFFRSSSFRRSSSFLALLPT

SEQ ID NO: 981628 - protein, 65 aa, Homo sapiens
PIVQVLGRLRAANGVNLGGGACRELRSRDCTPAWCDRAILYVKKINRYPTIVHRSSTKPHPDPAL

SEQ ID NO: 981629 - protein, 43 aa, Homo sapiens
MSIRKLQARADYEGPAESRSFLNFNLLCSFRARTCGLSEPISP

SEQ ID NO: 981630 - protein, 46 aa, Homo sapiens
MDETGFSYFLLTTLPRDTVLLLSLLPCTVTGSVPGPLYPQAYPAQL

SEQ ID NO: 981631 - protein, 66 aa, Homo sapiens
TFVSCAGRRLVYRGCWRQCRELFKLSSSVNAVVCVKLGVLHAVVMSLSYSVPNSRAITVGSPTSAS

SEQ ID NO: 981632 - protein, 70 aa, Homo sapiens
RSGPRHACGNGAQLGLLPSPHLLPAGLRQLYTCPIRPCRPGQTNGEYGPSSMGQMSAFQLSADTSSGSLS

SEQ ID NO: 981633 - protein, 38 aa, Homo sapiens
ADVVGVALLVLALFYGTTLFYVTVTVYGRRRGHCFGLW

SEQ ID NO: 981634 - protein, 34 aa, Homo sapiens
ARSRTRSGGRLEGLPPRWGAGFWQQSRMSHKCPS

SEQ ID NO: 981635 - protein, 89 aa, Homo sapiens
EGRVCRLCVCAAGLSLLLRRMAPGCLLQVPVTSLTPRAAILHMICSKAVQQCGGGCPCPGPPELLSSSLLLFTYAPPHARGISRVTEHS

SEQ ID NO: 981636 - protein, 52 aa, Homo sapiens
NRASVPDEQLNVDGGRSGSTKLISHVLGRFSSFMSFWIRSCAADASCCSPWC

SEQ ID NO: 981637 - protein, 48 aa, Homo sapiens
MSKQVKRCSCITVPSTCARRGASDIWTNARDTLEDLIVFAALSPYLPP

SEQ ID NO: 981638 - protein, 71 aa, Homo sapiens
MLTYHGVLHQKTIANSCEQLVTYKPCGEAAYMDFCPCKSFPLDEWPSVVCLEIHSNALTIAQDSTIRPVYG

SEQ ID NO: 981639 - protein, 81 aa, Homo sapiens
MNVFVSSFSDGGLLGKQLHWHGFPPSGPHPFPWPLALQELSPGDHPEKGQNTPGLKAIKTRGEGAAKQKEGGFLEDPSGSA

SEQ ID NO: 981640 - protein, 137 aa, Homo sapiens
YRAVVGLVGRHDGSGGPGAGVGCVSRQWRSVGVFGEGDPGWDIFWYASTSGSSGMLQRTFNMYKLLNLLANHRHNINSSKDMLGRQAFSGDTISKGLSPVLPPAHYKCRMRRETYALNSFSDLPRMSLTSHWVVKAS

SEQ ID NO: 981641 - protein, 44 aa, Homo sapiens
SRPHHDEVDVYCFFFSITKVITITCRVLQHRPPHASCTTTASMQ

SEQ ID NO: 981642 - protein, 57 aa, Homo sapiens
CGRRLLSGSGVLVSILAGCLLNRRRVARCLRKCVRQDPPLIFSPTVKSAAPSALGSG

SEQ ID NO: 981643 - protein, 59 aa, Homo sapiens
AVAGAESSSSSTCMGCLYLPNSSAPPCPAYGPFCVLCPQPEAEGKHSVPAQHSGAAREE

SEQ ID NO: 981644 - protein, 33 aa, Homo sapiens
MVRRSCAAFGKWAGCTVHSRARELSNAADAVVV

SEQ ID NO: 981645 - protein, 33 aa, Homo sapiens
CTPRFVGRLWVIFIHMRVCHIGLLGSSHTNMPR

SEQ ID NO: 981646 - protein, 72 aa, Homo sapiens
QCGAPAVMGVSAHRSTGSQGRRIFLSTEQNEKSPMSTSFYTDTATIRFLNLFPTFPPFLFHKTAIVIMAHSQ

SEQ ID NO: 981647 - protein, 37 aa, Homo sapiens
LLGPLTAPLRAPGVFLPQGFPDSVSADYLPYQLWYSV

SEQ ID NO: 981648 - protein, 71 aa, Homo sapiens
RRGRVWVVTALSSASGSFFGDHCPLLGGAARPLTWVTSSVTLALLGGDALSSGLGYFLDDVGVAGENVPFP

SEQ ID NO: 981649 - protein, 81 aa, Homo sapiens
GAGTEEVTCSVIISYVHHVGEGLMFRKKSVSPYHTIYPSETPFLSLKAPSLAQMDAYSPVYCHECGYGCMWGVTDVPTGMH

SEQ ID NO: 981650 - protein, 56 aa, Homo sapiens
YPRLYWMQVGCRLVTVSGLTLTYSTRMSSMECRQRHQRFMLNGQWARPIMIHGGHD

SEQ ID NO: 981651 - protein, 94 aa, Homo sapiens
RSYPFSADSVLLLSEQTTREKRSPMTMCLTLVSRRTEPWSNHLAVVAEGPAMKEATSDEARGGAIHEFWFNTEAANGDLSYESVLVTVPNQGTL

SEQ ID NO: 981652 - protein, 81 aa, Homo sapiens
STCQEAGGLCGRHALAAHWRSGQQCTRWLFLLLTLPTMVMANPAPDKVLVRRRDCVEGTGPRGSPNFTVAPSPGEVPTPER

SEQ ID NO: 981653 - protein, 60 aa, Homo sapiens
SRVLEDPLDRQCSRKPDIMEVSTVLTVSTALCTGRHAPRWVNTRRPGSRITIYGGQHGAH

SEQ ID NO: 981654 - protein, 77 aa, Homo sapiens
QEARGECSQIVTALQWGTRVGVGPHGSGFPMSSCGYTDVVVGPQNHQISEVVAKAEHPEAHHWVVSTNMCLLSDHMA

SEQ ID NO: 981655 - protein, 63 aa, Homo sapiens
MDWLPLTVKRNMPSLQEPTQHFLIPGQSVSIKQRLGGYNIGHRIMILGQEPGYNWRLGPYDFA

SEQ ID NO: 981656 - protein, 42 aa, Homo sapiens
VKQPPRQPADSELPQEKRHMKKMALGKRHGGQITFQAHGKRC

SEQ ID NO: 981657 - protein, 97 aa, Homo sapiens
VALDDPLSRVRIIVSPLLASFTSNSINAPSLSIAPTLVTMIIMHENQPQRTPLKGQGSRYYESATYRRAPSLQSAGCGKEYAPHAVLLVDYPANDYG

SEQ ID NO: 981658 - protein, 46 aa, Homo sapiens
MVGDLLTPLRAARYKDSSAECMFWQAFGSHSLVSNINTRCDLSNGA

SEQ ID NO: 981659 - protein, 46 aa, Homo sapiens
FDDRCGRPLTAKYGTGWSSQEMAKMSGSLVLVLCSSLATCAQDALG

SEQ ID NO: 981660 - protein, 35 aa, Homo sapiens
YVGGYFCLLPSRYELQEDRHSCQVSEQEAVHGGIR

SEQ ID NO: 981661 - protein, 67 aa, Homo sapiens
MHMDIDETTHRHYSDGSGPYPLRPHAGWWLAQCGSHLRGSPCRRWGKTENVLSWGTPGCNFSAATLR

SEQ ID NO: 981662 - protein, 30 aa, Homo sapiens
MGKQCRFLKCQETRTTLPEPHIQRCGRGVP

SEQ ID NO: 981663 - protein, 81 aa, Homo sapiens
CDDRLDATNGWTSSADTGHAAVREPVPPASALAECRLGVPEGEWSWTAYEAAVCDYLEQQVCRGNQLGDFGAPWVTTYTCQ

SEQ ID NO: 981664 - protein, 47 aa, Homo sapiens
TKGGPRFLASENCLWSIPPEYCAPLLLSAGPEIQSLCLTLSYPSWDS

SEQ ID NO: 981665 - protein, 72 aa, Homo sapiens
HTGRWKARLKTVAVPDLAADAYLPRRLHQKTIARSCDQLVTYKPLFKSCLHGLLSFNSFPSVVGRSVYAWDP

SEQ ID NO: 981666 - protein, 55 aa, Homo sapiens
GKLLKDTKSLLRGVGPRLEVHKADRRVGDGFLVETAVVGKHLQLIWNTTVLRTCF

SEQ ID NO: 981667 - protein, 38 aa, Homo sapiens
MLTYHGRLHQKTIANVRATQLVNLQYLCLKSCFTWTVC

SEQ ID NO: 981668 - protein, 79 aa, Homo sapiens
LAHYSFDVTGSGVGFFILYCTQIYALQKGKPLRVTRRTHDRSLVVADMLTHYNSREGTLLRQRTLHDDACLARFSSARG

SEQ ID NO: 981669 - protein, 67 aa, Homo sapiens
NEDGYEDSGLERSVLMEEQPLHKIARCATERECRFVESPSQDQRLQAQRLRNPDVRGSLQTPQFRPG

SEQ ID NO: 981670 - protein, 76 aa, Homo sapiens
CSKRILRLNCSQWLFRPASSCSRRLPKPRFDFWWLCRLERPASCLPKPDMPKPLAQQRTLHAPVALASLRFLGPEL

SEQ ID NO: 981671 - protein, 63 aa, Homo sapiens
SRRIPPGLNLTARSEPETLKLNDTRDDDETTNCHDPDDHGHGPTTVCTNDDTRDDATLDDTRY

SEQ ID NO: 981672 - protein, 60 aa, Homo sapiens
EGGVQVCAHKHGSFGAVLSLALVGCLLTGTVPGWTLWQPFGAFRAWAEVVTFCWWMPESH

SEQ ID NO: 981673 - protein, 161 aa, Homo sapiens
QEQTLWVVDLRGFHSPLYQGSECTGGSQSPPSLHPSPRALSIRVRDMLGLVPVLRLGVCGIIDLGPLIPVFRFGSIRILYLLGWQEVPFVFQGAELHLVVVNLHLIGVVWPHNQCVQVCKLIILARDVLVDQHVLALVVDDDMTLLGASATDVGTKHDVVS

SEQ ID NO: 981674 - protein, 36 aa, Homo sapiens
ELELQQQQQQQQQQQYPEYQVLVREKLPGELPFEAS

SEQ ID NO: 981675 - protein, 59 aa, Homo sapiens
RASIHAGPGSIPAPSWLNHGAQPGTLTQTNHHTHIFSLGHGGPVCLSVRQLLKEGMQAR

SEQ ID NO: 981676 - protein, 55 aa, Homo sapiens
LYRSASWSGELYLLGSSGAFEVQVIFPDLKNSEAAYVHCRIPPLSAVASISQVVS

SEQ ID NO: 981677 - protein, 50 aa, Homo sapiens
MTSVTLVQNLLIVRLADLALEPLMLHGALHVEGSRNSSAYLADTLSRCTL

SEQ ID NO: 981678 - protein, 33 aa, Homo sapiens
KEVHEGCLLGGRWMDLLRMATYESTRLRMVSTC

SEQ ID NO: 981679 - protein, 102 aa, Homo sapiens
RPFIQGFITQPREPARAAVFRRDRAGGQKCLSNTMRRGEGRGRPCSQRDQDSLSLSLRSNRGTGGEVRGLRETQWGTNRSLCPATIWSVRARSTPPSWEWWL

SEQ ID NO: 981680 - protein, 127 aa, Homo sapiens
GGAAPCPAERMGLGEHHVRLKGRAGGSIMQAKTQHLSYSSQQELAEDCRSSRRGARADTGLTNAQDLKICTTALRSTLLLSLFKTPRTTIRNEAPVTAVPRASPTPPQVLTPGHTAPARPERDHWLQ

SEQ ID NO: 981681 - protein, 145 aa, Homo sapiens
LSYGPILPQLPLLHPIYPSITSRPHRRSSLQLSSVTSSSPPAQQFPLREVARAEGIVRVHVPFSLSDLSQISQRLGPFSSDPTKYIQEFQYLTLSYNLTWSDLNVILISTLSPDEQERVFSLAQSHADNRWLQEPDLQEGIRAVP

SEQ ID NO: 981682 - protein, 33 aa, Homo sapiens
VLILPNSRAYHLKTEKNRRATKVLRNETTPFLA

SEQ ID NO: 981683 - protein, 45 aa, Homo sapiens
MFNYQIIHHHMPPTGQRENRHQNLGGGHYQNDTGQYQTAAWVPSS

SEQ ID NO: 981684 - protein, 61 aa, Homo sapiens
MFSDGLSGRLWRLDCGSEALVSSTIPVLTATSERQVILDISNNTPQKVKQQTAVSETFSES

SEQ ID NO: 981685 - protein, 59 aa, Homo sapiens
MVLSLGFGIFAPRAVQEACVGLDASLNSVPALDSAIRERFPKVTTPWMAHERTPKQIAL

SEQ ID NO: 981686 - protein, 46 aa, Homo sapiens
KACCSLCSYRDTNSWLLKERSETSDKRKFLKERLARLTQARGLVAQ

SEQ ID NO: 981687 - protein, 123 aa, Homo sapiens
AVLCVALGMHWLCGGIPALLPHGQVCRRCTWDHGRRAGTQGGWCECGPRNGELLRSLLVNWTSSSESCIRFFKGGGYYGLLLTCADAFSHREPASVVTCEAGLLTGQVALLRFSSIATVCVRV

SEQ ID NO: 981688 - protein, 75 aa, Homo sapiens
IQKALYTHGSNAEVMCVFSLDPATGGIVTYHLAHQMFDVIPSLSYPVFAYKRHCHKVSVAQHLGDIFLGPAIWGS

SEQ ID NO: 981689 - protein, 42 aa, Homo sapiens
QQAAYRTEPVSQEEHSRGVEVKTALPGVRRRRRKGPRIGVDR

SEQ ID NO: 981690 - protein, 50 aa, Homo sapiens
ARHVRGGVARVQLDLHAHSQLGKGWPPGKHKTWKVEQNRGGVACPTDSLL

SEQ ID NO: 981691 - protein, 82 aa, Homo sapiens
ERKRFVGRYGTYGWGDSQSRMDGKEEQVMSVHGLAEQAKQFVREKLPLFNNHQYSCDDPNSSIYAEHAWVKTHPHAFNHLPP

SEQ ID NO: 981692 - protein, 101 aa, Homo sapiens
AQVSESKIAHCFQPGWQSKTPVSQQEQGWCTVADACHPSTLGGRGGRIMRSRDRDHPGQHGETPSLLKIQKLAGLGGAPVVPGSREAEAGESLEPGRWKLQ

SEQ ID NO: 981693 - protein, 132 aa, Homo sapiens
YYTDSGVVASLPSWAILFASVHFTPSVFLLHHHLVQHMGISQSSTLAVILMGHQPVSDPLDPVLPELLPPAGSTRPSHVGAQALCMRSSSYACPACGPPHQSHHVCCCHKVSAMVSMACLAPCIAGLGLYYP

SEQ ID NO: 981694 - protein, 153 aa, Homo sapiens
LEDPGTSDPEMSDFLRPTVRMVVSKDLGRTGKGSHCFMGTEFQFENRLLKVLDLNGDDGLHDNVNVLNVTIAAHLKMVTMVNFHMYGHCNFQQPNIKFSRSHHYLIPFIHILGTHILSSCQQNRAVVAYGWAWQVAGWAAGGGPNTLRGQMWP

SEQ ID NO: 981695 - protein, 80 aa, Homo sapiens
PLTTPRHTLTPRQANADDAWPDLLLSDPGMPLLTTAPVDDTGYWTLSVLTDAHTLALTYAYYLTPVVGLCHDGGAVDGLL

SEQ ID NO: 981696 - protein, 48 aa, Homo sapiens
LEDPGTLTQSPVPYGRFGIQEFEILRKPKQQLGFWKGLRRQGDLVELP

SEQ ID NO: 981697 - protein, 53 aa, Homo sapiens
LERRQSRGLQSEAGSSLGHLSVFSLGRLCLLSGSSLLVLSGSSLCLLSGGYRA

SEQ ID NO: 981698 - protein, 119 aa, Homo sapiens
KDPLGSEALDVGGQSSLSSPSLRVTAASPVAFCPFHSKISGLTFISPFHPPQEVGTRLGAAFADPENEYCPAYTAQWPREADEDTEGHRGPEAGPGLEPPSLQARLYHWAAPFRPPGRK

SEQ ID NO: 981699 - protein, 38 aa, Homo sapiens
SPFFSQGGCTCAQLPGRAERRGLKSLVPELGEREKSAI

SEQ ID NO: 981700 - protein, 57 aa, Homo sapiens
SYRTRQWWARRLAGWLTQKHIDRLVGKATHVSVSVVMVEVDGTCYSEPGRLSLAMPR

SEQ ID NO: 981701 - protein, 51 aa, Homo sapiens
LVILGLPEASDSLTVNVWVWGLDILGNALEELLEAGFLVSSEAGPPTSASC

SEQ ID NO: 981702 - protein, 46 aa, Homo sapiens
MRRLQLLPLDPHCLVHTVAAAVTCCRCTVTGSVPGPPLPSGIPRPR

SEQ ID NO: 981703 - protein, 40 aa, Homo sapiens
ETKESTGQGAAQHRHSCMRQGAEHGKGCRVGGAAVGVTGT

SEQ ID NO: 981704 - protein, 77 aa, Homo sapiens
TSSGGQEYTERAPWLPIDGLVVPMDGLLCMKYVQKGYDRQSNLLPWSQIPIENGCKLLSWGKGQGVLMVPGTLRNSV

SEQ ID NO: 981705 - protein, 115 aa, Homo sapiens
QSSGGARAVGGSWGTVWHLNGVRHTWALSEAPCVLAEILRTCAVEGARITAGEAEDVWLTVLGLVALLMLRVAQVLALGRKAPGHPESVALHVSQVRWGPWVVLARDIRSHKCLV

SEQ ID NO: 981706 - protein, 101 aa, Homo sapiens
ESRFGAIVSSSALMSSESGLLCCVLLNNSIQRGVQWQVDTPSNLGNSQESVLAGQQASTYRLSSTLTLSKADYRYYKVYACEVTHQGLSSPVTKSFNRGEC

SEQ ID NO: 981707 - protein, 32 aa, Homo sapiens
RRRASQPCCLTLVDVCRVVHGLEYIASDRDHS

SEQ ID NO: 981708 - protein, 60 aa, Homo sapiens
MRPGSQFGGVCATFICTVSCAPSSPFHGPQQVLVLSKLPGKKTACFHGQVLVVSSVRLSS

SEQ ID NO: 981709 - protein, 38 aa, Homo sapiens
EKLGKITQGLTCFSNNQWRNAIFQVVPERVDQVDGVGL

SEQ ID NO: 981710 - protein, 57 aa, Homo sapiens
CPGDRGTVNRRHPTDWLLPFMGLPQVTQPAGGSWFTAKKSQLRLEKYPGPLLLHGLP

SEQ ID NO: 981711 - protein, 33 aa, Homo sapiens
MWEDSLSVDNYESSLGQRKRYRIYYDKIYNKYS

SEQ ID NO: 981712 - protein, 34 aa, Homo sapiens
QATSGSNDEPFICCGQCFAHKLCAITGQVSAAVE

SEQ ID NO: 981713 - protein, 86 aa, Homo sapiens
AIQAGHGGFMPVIPCTLSRHDLGWITSCQEFKTSLANMVKSRLYYKPKNYPDLVAEPVHSQLLRHSDDGISLVPVRRRAVSRSWLT

SEQ ID NO: 981714 - protein, 45 aa, Homo sapiens
PSWQRTKQQFVKLKEMFSNSTGRLPVPTDEKKYGNIKSWFTLRNE

SEQ ID NO: 981715 - protein, 116 aa, Homo sapiens
VYRKRSMKKLTSMIMKVNISSMIMETGKSTICMLGWTGWRTGEKTMLQLKSKGHQAEGPQEELMLQVESARTVSWRICLLFRELSLLLYSGLRLTGRSLPRLWKAICFTEGPAISM

SEQ ID NO: 981716 - protein, 102 aa, Homo sapiens
KLSVTVHVCTRYFSSSYIYAVVTYDNTVAPAAGGAICILGLLIFRSIRSRLTLTTGTSRTIASMRKFKALISIARRSVMMIIAIGSIYRARVIITSGRRPMA

SEQ ID NO: 981717 - protein, 40 aa, Homo sapiens
SRGSLMSLLVCLIVGDDGICQTIVPDFDLPEVQALARQSY

SEQ ID NO: 981718 - protein, 77 aa, Homo sapiens
CCFLLDDGRAGRWRSSPSQYGAWRGRMRCPTFQIEWRRAEVLLIIPDWAGVSEALLTSHTMVGHAEMFLTSYMVVAA

SEQ ID NO: 981719 - protein, 52 aa, Homo sapiens
FIDGSRAVYDLTKQYKARCLLCLKPRVGFPAGLGFSTVAVFHEVQGSPPGYR

SEQ ID NO: 981720 - protein, 130 aa, Homo sapiens
SDLYRIRCCFSSSLNADFCSIERSRKVCRSCVSGMSFTSSLLLLALCFPDSCVPFILGHANFRISLHHSRLGLAQRAPIVHFVIHVLDAVQDLNGHTAILKVCHLPHQLVAAAPGPVICSTVRLPRRKSS

SEQ ID NO: 981721 - protein, 50 aa, Homo sapiens
LQQHFSLFREMSGNMTLRSRCSVGLLARSPPAGLKVLMLLLLLLTSPSAG

SEQ ID NO: 981722 - protein, 116 aa, Homo sapiens
DLAGSRPVGGDTSFMPEWELCGLTPSLDGSVYADYSEPSWVQGSHCEWWSWAISHVLFGQRRTLGPAGPAHAVVNHAPQAPGLLSGCPVQALEDRLGSISSRCAPAHGCTIVSLPQ

SEQ ID NO: 981723 - protein, 39 aa, Homo sapiens
VSVIMLIHFGASVPFLFTPVSSDSESFWSLIVTGYRARF

SEQ ID NO: 981724 - protein, 39 aa, Homo sapiens
DPRTVGAGPSRGSGCSALAVAGAYALQVRSGAHVVVRGY

SEQ ID NO: 981725 - protein, 71 aa, Homo sapiens
SCCSWSTRRASSAACLLGKSDLISGNSHHLSLTICLKLISNFSIVSGYINRCAKFYKHSITPTIDEEDKQQ

SEQ ID NO: 981726 - protein, 50 aa, Homo sapiens
LVTKYGLQAQYQSETLKGQIALDLKFFRRSEPTGGSCLLLSCPMPKLGIP

SEQ ID NO: 981727 - protein, 76 aa, Homo sapiens
LSPCDAHFHFHQIRLQSFPGHSGAVKCVDPYSSEDFFLSGSQDRTVRLWPLYNYGDGTSETGPRLCLQPQHRKEPS

SEQ ID NO: 981728 - protein, 80 aa, Homo sapiens
MLDGLLSNWKPGYDPKISQSPKDLFVPACLEIRRVCQAAGIGGWHLVLWTLHQEKSCRLARAAVPSAQASAMCSIVESSP

SEQ ID NO: 981729 - protein, 71 aa, Homo sapiens
VADPVFSRNSDISSMCPVSPELNGDGLACGGPHVLFPNMKSLGIHFHCCSARRLLSSSSSAVPCFVLFLAS

SEQ ID NO: 981730 - protein, 73 aa, Homo sapiens
MIIVPGLIRHDEMFVRHLLDPGDRGRVVLEVAGRMVSRTEGHIDDSLIGGNASAEGPEGEGTESTVITGVDIV

SEQ ID NO: 981731 - protein, 142 aa, Homo sapiens
IEPLEPSLVTMQILECVPVYTSLSAAEIKTVFQPARMDSVQGQRNMLHILHVLKTNLVVKHGLLDDGILLSLQAMEGVSLVKTLLDQSLYTASLSFFIKSTDDVDKHIMDKKRLEYGIVNGIAAIAPVVMALLLECLYIFSL

SEQ ID NO: 981732 - protein, 43 aa, Homo sapiens
SVSYEVPHLMPPDLELWQRDQQTQCDETGLSVGSLLSVDHTLS

SEQ ID NO: 981733 - protein, 105 aa, Homo sapiens
MIPLLRLSVSGKSGRTGPMVVITQPDSLESIQEYYSPRVNRMNCWNLETMFCVGITAYCSTRSFASSQEPGHVGSLLGSDRIPSSSWPASSTHQQFRRSKCAKGV

SEQ ID NO: 981734 - protein, 67 aa, Homo sapiens
TEPLDAIEPLDATYMKEDFKQYNQLHKIVQGGVMLWILSFPHIMFFFDCSSNIIIDFHGQNLVCQQC

SEQ ID NO: 981735 - protein, 227 aa, Homo sapiens
LLCYRGSLYSRVRTGTWVHRGWETLTSCQAHALSLHAGASTPGSALCCKEEMPWEWGQSMQGSMGWPSRHPLVQSAQAKLIKGPMSVYRLASLQEQLGPGIRPRVGGSAVCHPAWSCAGGRRSQPTTPERGGFPHGGGEGTWLAFGQNPVPGLATADSVVLVSLHMCASTVHPGTMAGSCLPLPRGSVDSALDRTGFTAEGCYNLVCYYRRTSRVVQDRSDDRSKDE

SEQ ID NO: 981736 - protein, 33 aa, Homo sapiens
MLSDVYHHCGASLPSTVRRHVSTVLTPNIVKLE

SEQ ID NO: 981737 - protein, 78 aa, Homo sapiens
MHACLQVDVYTALGCMHALNKFRRHVSHVLSSKYGKLEPGRRVFTTGGALPPLVQFRRHVSTVLDLQISVQAGAWSDS

SEQ ID NO: 981738 - protein, 38 aa, Homo sapiens
VCKHVYIPTTEFKHIDHRNEMRNKQIHNCKFGDFNTLL

SEQ ID NO: 981739 - protein, 33 aa, Homo sapiens
MEPWAVMERVYKFCAAHELLIDFGPFGKGGIWQ

SEQ ID NO: 981740 - protein, 107 aa, Homo sapiens
MWHSGPFTYVGVPLPLMWEEFIPFKQYAGQYVLLVNVDRYGGLTGQYIELNALYEELAPFGLVILGFVLQATLENRNQERTHRSLLTSSMCHQVEALFLIFQLFEKG

SEQ ID NO: 981741 - protein, 116 aa, Homo sapiens
MPAAGLSPVSRQDETEQVLEELGFLGALACLHLDSRPLVRDYSQVVWALWNLQSAVHVKCARDEPSYLIYTPAVPKSQRVLHSAPNFQPPSNCGIVRGPDATGRLLQPSRPGPQRR

SEQ ID NO: 981742 - protein, 70 aa, Homo sapiens
NRKLMIRNYWEFSRAWGILASPIPIMTWRSPGLPASCRRNGLRHADPVCVSRVLTRTFSGHYRPIIARSR

SEQ ID NO: 981743 - protein, 69 aa, Homo sapiens
IPQLKKAQAAANKKQTPRRWVPPSGQTSPAPRDSPKLDSFSESTLQGQGAVATHCNPSHFEAQSRARST

SEQ ID NO: 981744 - protein, 71 aa, Homo sapiens
RGGDKRSRRWTATGGIGGTIYEYGDPHPLMWEEYIPFQSSMLAKYVLSCQRGQSTDGLTVQYIVTECTTGK

SEQ ID NO: 981745 - protein, 61 aa, Homo sapiens
RELSIFSLHLDRCLLYLRVAINFSHNHLVNIEPLCQEANRQTLLFVLIRPNARHSYFSYLS

SEQ ID NO: 981746 - protein, 42 aa, Homo sapiens
MSYHQNGAGSWNQCECIILVELTTARLHQCTRLSKSPGSAIT

SEQ ID NO: 981747 - protein, 71 aa, Homo sapiens
PAGGDQTQDTELVDTRPAGDGTFQKWAAVVVPSGEEQRYTCHVQHEGLPDAPHPVDGGKGGMLLSVLAVHA

SEQ ID NO: 981748 - protein, 138 aa, Homo sapiens
YRQGLAVPRRGLETPGVHATHTRTELPKSGDNQHEPLRSGNVPRDLSTETVKSYLCVILCRSIVDIYYTLDRYQKERRSEVTPVLTGGDISVAEGGPRDLYAHTLPRLSVQNPTLFQLSSARVWAKVLAELACLSVQY

SEQ ID NO: 981749 - protein, 86 aa, Homo sapiens
FYFGGFSPVHYQAQGSCWCVMDSGEEVPGTRVTGGQPACESALRCPLRIQLRRTVVGWNNPRVRQSLGPTWLGHAAANVLVRAMGS

SEQ ID NO: 981750 - protein, 32 aa, Homo sapiens
GVIPGLPAMYCALQRVSGTVVHAFNTKPSPCK

SEQ ID NO: 981751 - protein, 74 aa, Homo sapiens
RLQLNDIWMSARCSRVDANLYWEACTVVVYTRRPGSMFTCLGRPHGSHVSTELVQGGMPRRGEYPSSWSHACML

SEQ ID NO: 981752 - protein, 36 aa, Homo sapiens
YWRISRVDQALRYLEVSTVLTCRRNLSRTACTAVVN

SEQ ID NO: 981753 - protein, 59 aa, Homo sapiens
MYELMLISNELCDKSSTHSTLTFWGTVCGSHRKELEIPLGLSTTLEAQNCRDWGSHWFG

SEQ ID NO: 981754 - protein, 44 aa, Homo sapiens
VTGSFRDKQLLRSSSQSGSGPSSPDSVLRPRRYPQVPDEKDLMT

SEQ ID NO: 981755 - protein, 157 aa, Homo sapiens
MPIHRLALVQTAHSRMLAEEDNCRKWVRWFQTPDDAQAVISVFLVCNMMELGGKFIIEVPCVDLGRDLRFEGWQELLLDHVLPVDAEEEPVLHDLLGIAGPPTKPLLGVLLKQPSKQGLGLGAERAREADLFHEDELEEALVVLVVEGQAGAHHLVH

SEQ ID NO: 981756 - protein, 69 aa, Homo sapiens
IEPLMLSSLVFAIKQDLPKAMNAAVDHRQAGAALTYAIGTDDIQASCATSGYGLYEGLDWLSNQFRNHT

SEQ ID NO: 981757 - protein, 54 aa, Homo sapiens
MVRFGLRPGRGLALLLLALLGLAVLVHKHYCPRLKCCSGKAPVSAQDVRTVAGD

SEQ ID NO: 981758 - protein, 86 aa, Homo sapiens
MAVHPQLNSHSWDPVTAGTGPRMPTAGAGPHSHGWAPLSMHRVGPLPSGPRVSVYPGGLDIRQGGGLVGTWELPGDRGALLDGRGS

SEQ ID NO: 981759 - protein, 42 aa, Homo sapiens
SKQLQCYSISHEFPSHEIFPEAELRAAHPVTHFAVKEKWPDV

SEQ ID NO: 981760 - protein, 75 aa, Homo sapiens
EANVLTAICDMVAWLGYTPYKVTYASDYFDQLYAWAVEPSAWLIQWQRHPRVRGTRDDRRHPGGRRHRGRGTREV

SEQ ID NO: 981761 - protein, 38 aa, Homo sapiens
PYSSYDSPLLDPPPIQTPLRGLSSCMDTPLPGLSSIRT

SEQ ID NO: 981762 - protein, 38 aa, Homo sapiens
MQARLWVRAILLLSLLSSWGYRHPDVEAPASRRHPRDR

SEQ ID NO: 981763 - protein, 136 aa, Homo sapiens
MVTALVCSVVASAPSTFSLDGDPGPALPSPAVLITEMGAKGLRHQRCVPRPTRHLARLPETSTKHEAGRGRHRNSRRGGAEEAPVPAASENGSRGSPCWGRGRAVPRKPVHLRVVLGTPDTYWKYPEFGKRAGQAP

SEQ ID NO: 981764 - protein, 57 aa, Homo sapiens
VSWSSNPRRPHFSKEDMLPFLLFTIAILIGVKWYLIVGFRSAPPRMISDADVFIHSD

SEQ ID NO: 981765 - protein, 49 aa, Homo sapiens
YWRISSHQAPAITDIWDGHTRLLICVCTRILYKGRHCNRLGEMKYYLVW

SEQ ID NO: 981766 - protein, 78 aa, Homo sapiens
NTVLYSRCWLGAGWSHFIPALSEVTVGGSLEVGRLRSAWTTWCNPVSTKNTKISRTWWRVPVIPAAREAEVGESLEFR

SEQ ID NO: 981767 - protein, 33 aa, Homo sapiens
QLPMPGSLLVQNIICGAGDCRVCLQQWGDPLKV

SEQ ID NO: 981768 - protein, 35 aa, Homo sapiens
PHSNLGFPEIAKPGAFPKDYQGLWWSQTEATGYVP

SEQ ID NO: 981769 - protein, 54 aa, Homo sapiens
MALCSRSTCPFKFGDVAATAWFCVREAAATITCSKPSHRGYDRYLLGEHIAPMG

SEQ ID NO: 981770 - protein, 80 aa, Homo sapiens
HVWITFNSDVYPSPQQDRFCFRASSPAELRFLKVVETGGAAEMNHCHSVSHVGVNLKDLRERATGGSPLEVGGGTVGLAW

SEQ ID NO: 981771 - protein, 81 aa, Homo sapiens
MVVLVALQCEYTYATQLYSKWLRCVLIVPATLESVQETVGKSRKEKGEVSGRQAIQIGKFRGSENRIGGSRAENKALRHDK

SEQ ID NO: 981772 - protein, 134 aa, Homo sapiens
RLLASQSFYHLFLPPSTRVPSCSYSASPAPDPFPQYPLPASLINPSVAAHHDPIRIQLKDSSKFPNVPQYPISLTHQKGLQPIVNKLCSCSLLRPTHSPYNTPILPVKKSDGSYRLVHNLRAISQAVLPIHPIV

SEQ ID NO: 981773 - protein, 55 aa, Homo sapiens
SPVHCTDVTEELYRVLPPKSWCRPLTMLLQHEKQTEVGKFHIGKIGNVSGEYTDT

SEQ ID NO: 981774 - protein, 45 aa, Homo sapiens
MSRCLAAAARPYGLLASQEPVQFKGSWMPGKRLSARGRRQTIWKL

SEQ ID NO: 981775 - protein, 47 aa, Homo sapiens
LTLLLRYSMSIQGSDGKDEGVRAVLQNATNEIPADMTVAQYIPGTRS

SEQ ID NO: 981776 - protein, 71 aa, Homo sapiens
SSIFPKPSDNVPANLAAEFDYSVCYISDEAPYISIFYQSSNPFRNFIQKQEKRIFTNFHRQLFCWIDKWID

SEQ ID NO: 981777 - protein, 110 aa, Homo sapiens
QLPRTERRYSKTTVPTITVRKIFVGSIKSRHCKNITYRYYIEQYGTLQVIKIMTDRGSGEKRGFAFVTFDDHHSVHQIVIAEIPYCESPPLLILTRPVVARDGSCFIQPK

SEQ ID NO: 981778 - protein, 172 aa, Homo sapiens
HLPLTAAAWALLSSALTTPRLHQGHTGSQAGPLQEGGPGHADVGTQAVCRQTDNWGEEEGPKWEECTGSANLGEGQDCTRPPHTLTVLVLPSRAFLLSSVLLLPCSYRQTASSYFHTSSLADAPVPLPPPAPFSAPTCEAFLGGAPTLPLHRILGSDGNLVIYLGATDEKEF

SEQ ID NO: 981779 - protein, 35 aa, Homo sapiens
VYPYWMGVFGFLSSGSGEVSGNWVAAGPGGSALTW

SEQ ID NO: 981780 - protein, 127 aa, Homo sapiens
MREEEQEEDAGGRGSGISGRDDWFALMSCPEKRYEFEEKIEKEPEEAGQDTPSTLPMLAVPQIPSYRLNKICSGLSFQRKNQFMQRLHNYWLLKRQARNGVPLIRRLHSHLQSQRNAEQREQDEKTS

SEQ ID NO: 981781 - protein, 62 aa, Homo sapiens
MRCMPSLDKSRRHVSTVLTSKYRSTPGALVARCIHHCARMPPCTSFRQHVSTRADLQISFSW

SEQ ID NO: 981782 - protein, 32 aa, Homo sapiens
MPASVHPGIHHRYLLLLRTPRVQLDTPRLLCG

SEQ ID NO: 981783 - protein, 34 aa, Homo sapiens
MQYFFHFSQIMKIPISLMSSHGKYPDLQAPGLTL

SEQ ID NO: 981784 - protein, 71 aa, Homo sapiens
GRIITKGSVGIVAKWEEVSSLINVVTKETLAKIEETPARCKEKMVKSRKSSRDEEEFPDSREGVTLIQPDT

SEQ ID NO: 981785 - protein, 83 aa, Homo sapiens
AWMPFLETMCYLILIWFGYVPTQNLILNWNSHNPHVKGETKGGDNWIMGGRFPHAVLVSLTRSDAFISVWHFPCSHSLHPATL

SEQ ID NO: 981786 - protein, 107 aa, Homo sapiens
MGSCGWLGATVALIGAALDNDEKESGGSGATLALMGAALDNDEKESGGSGPPVALMGAALDSDEKESGGSGATVALVRAALDSDEKESGLQFRDSVPGDPWAKGLIR

SEQ ID NO: 981787 - protein, 78 aa, Homo sapiens
MSNEVLGPGHAWVLSGLGSSILRSSVASKFWKVVLNLRFPSKDFLSEQILPVEEQDHRDVRSHLLFQMLLKRFRASCR

SEQ ID NO: 981788 - protein, 35 aa, Homo sapiens
VGPVNPLVRVRCDLRLKAFSDRADLIRHFSIQVLN

SEQ ID NO: 981789 - protein, 112 aa, Homo sapiens
VPVNCTDTHSGTPGAQVIPVGSGTRRVLWRTSLECCMTRHETVLSVNHPARETSSFTHWKSPAHTKTCTRMLIASFFIITKTWKRPRCPSVDKWKNKPWCIHTGLLSSTEKK

SEQ ID NO: 981790 - protein, 68 aa, Homo sapiens
FSLDADWHPEPKISNGQEEAGEGLRCFKEEATQIVDKYRHFLYFCHQKTHSGLAYLSRFLKNRQKRIN

SEQ ID NO: 981791 - protein, 100 aa, Homo sapiens
EPTCTVTESTTEITYPTTMTETSSTATSLPPTSSLVLTAETAKTPTTTLVTTTTKTTSHSTTSFTSSTIYSTASTPTTAITSVPTTLGTMVTSTSMIPST

SEQ ID NO: 981792 - protein, 98 aa, Homo sapiens
MVLQVHMYVHVQVSVYVMYVAVCHVYTCAGVYVCACMYVALCHVYTCGVYVCMHVCDSVPCTYVCRCAGICVHAFTWHCAHVHMQVCVHVCTCEGVNV

SEQ ID NO: 981793 - protein, 40 aa, Homo sapiens
LGPLALNFGEPGAVMSRGFIVTFPVRPLSRIFARVAFGGL

SEQ ID NO: 981794 - protein, 33 aa, Homo sapiens
MSRLRFGTTATVFLRFGDGLNLAVQYQVKTMAT

SEQ ID NO: 981795 - protein, 41 aa, Homo sapiens
KSARYRKSLASRSASTSRYAAGRLVGTTAFTVVAECLPMYA

SEQ ID NO: 981796 - protein, 64 aa, Homo sapiens
IELVPAEGARCSCATDPATFCVGTETDHVAPWRSVYKLHDLSPAPLTFVLTSGGHNAGIVSEPG

SEQ ID NO: 981797 - protein, 50 aa, Homo sapiens
MVHQTESSECGLACLAMICGYYGKNVDLIALRRQFSLSTRGATLAGLTGI

SEQ ID NO: 981798 - protein, 81 aa, Homo sapiens
GPSYFCPRPAERRANWRTAARLASLADETPEGRSIVALADKAIHAPAVRAADAEYCALHRADPYELCVHLKDRMIRKGAVD

SEQ ID NO: 981799 - protein, 111 aa, Homo sapiens
SALWVAFDSNALELSAVKGKAHVAVALSAMEAAKIRRLTGVTASLELTITLAGAPLHLHLVGRRVNNLEWAGTASAFSDTQSVARDLVHGLSFAEQVVSEANSVIVIVDQH

SEQ ID NO: 981800 - protein, 42 aa, Homo sapiens
LLWLLGSDTYSLLLIVDRLECGDSLSRSMRDRMPVRLGRRMQ

SEQ ID NO: 981801 - protein, 56 aa, Homo sapiens
LRLRCSAAAAGGRIPSANSMPAGTVWKDWRDRKGELFQAVRMEKNMMGLLLSLIVA

SEQ ID NO: 981802 - protein, 102 aa, Homo sapiens
FARMHGDAQAGVARAVEVVEEQAAGEAQLIARQIQRGNAVAVRQQPFQFLQTGGLAKGAAHDADQANVDVAIAAARTDPVDHRFHHAGDRQLVLHRHVVRGE

SEQ ID NO: 981803 - protein, 67 aa, Homo sapiens
LVYCQVVLRDSSWRIARYRLVVDRGNFQIVVGSSSSTVNNRKSRITLGDRNWLIKLSSLKSRMAKCK

SEQ ID NO: 981804 - protein, 39 aa, Homo sapiens
VINHNIPVPRGLLAYHLITSKRFLPCRCWCRSEGTRSEV

SEQ ID NO: 981805 - protein, 71 aa, Homo sapiens
HAKHDFTLATQMLAVVLPLRGLLRMEPPVMLPAAEGSGELDFTYCNLRVRILAVVCRVMPDRRNSVRGGVP

SEQ ID NO: 981806 - protein, 44 aa, Homo sapiens
LRILRDGDSYECNEDMCSEKDLSAALVAGSGGQRRGHICVTGYD

SEQ ID NO: 981807 - protein, 63 aa, Homo sapiens
ELVREVVGGAHRIAQVIGGQAERVHQAQVDVHAHRRRRGTGNVDRSNAADLAEALGQQRIGDV

SEQ ID NO: 981808 - protein, 38 aa, Homo sapiens
VCRWAEVLLTGGQEAACCLGRCRGQVRQHLFHLGQLIG

SEQ ID NO: 981809 - protein, 68 aa, Homo sapiens
RCPVENAVHECSVSEQALDVVEVSDRCRRGAHCMPTGRKVIFVAIDEGHSEVEEQVDEKGPRVLCKEP

SEQ ID NO: 981810 - protein, 32 aa, Homo sapiens
MPMLMNFSPRPIAFKPEIQHAGGGHEEQQAAQ

SEQ ID NO: 981811 - protein, 40 aa, Homo sapiens
SDYSESQDPNLFLSIRCSGNLPLSTDELLYFRSSVQSTNS

SEQ ID NO: 981812 - protein, 54 aa, Homo sapiens
VVLAVELPELPDTWLLQNPSRRTCCTFTDSLNDAVLRAPTRPSEAVWLCCDAKV

SEQ ID NO: 981813 - protein, 63 aa, Homo sapiens
LYRTAAEKSLSPARRQPGALINLVMEVESGDKLRESLAPGNLAVGIAAGDELHRHLRPIGIHF

SEQ ID NO: 981814 - protein, 53 aa, Homo sapiens
VIDEYVSVTFEFQVIAEANRFLVIVSAWQFICTGAAGVKTRNRTMKRITAKNP

SEQ ID NO: 981815 - protein, 103 aa, Homo sapiens
MLVRVVLADTLLFPALAVATAWLWKAAAIHSTLGHSLVLLLLAGTAELAISALRARTATGSPGSCRCTAGPLPCASALEELLLPGDLIQPDKVPSSATSARNP

SEQ ID NO: 981816 - protein, 74 aa, Homo sapiens
MIMTANRSPDAHKDGVHYAKVHQDPSHHHGASGIPPPLTPQHNQVVAALAVDLPATQYLGLKLVGRDNVCKEPT

SEQ ID NO: 981817 - protein, 51 aa, Homo sapiens
HQLTALVTTAESPVVGPLHGVSWCRITFLLMWTLKSPRYWFLGQPQPQFGV

SEQ ID NO: 981818 - protein, 108 aa, Homo sapiens
QLQTCGKWPELALDALGCHMSGHCFLGDLRLSARMNEAADCRRRARVLWGTCWGSGVGTHAERPWVRYLSMTLVSTGYETASNTFPVPPCLAMPLPPAPRPLAREPHA

SEQ ID NO: 981819 - protein, 58 aa, Homo sapiens
HDFRHCSMTTIVVMLQWHSPNEALMTSAHRFCRIFVLALLIPLTALATPTNDALRTIE

SEQ ID NO: 981820 - protein, 61 aa, Homo sapiens
YRIELGPQLFDFTESGQRRRQQLFNEVVGSLAPAFSLYTNDPGKGNRITKLQQDSLGFAQS

SEQ ID NO: 981821 - protein, 35 aa, Homo sapiens
IARLVDEHLRFVLSWRIWLLICSSVRTAVSVFCTR

SEQ ID NO: 981822 - protein, 45 aa, Homo sapiens
YRVIGGMAGGVRIGAARKGIDAPTAGGEGLQTFAHVRAQGRDQFA

SEQ ID NO: 981823 - protein, 38 aa, Homo sapiens
TGEIARYEIVIDRRTPRRCSSAIVRSCARRGQHHAFRD

SEQ ID NO: 981824 - protein, 66 aa, Homo sapiens
PGDVRKIGRCSTAGVIHFCIICKSVSYEYPLLCRRRGGYSGCGLMTGFGAVPSRPHREKTHKPRGA

SEQ ID NO: 981825 - protein, 53 aa, Homo sapiens
RIELGTDDHGTTVRGAFHARYWVGGGSAVKMTEHSRFLRIERPLVLPRRGLSL

SEQ ID NO: 981826 - protein, 66 aa, Homo sapiens
GPVGGETALVLFGTVGVGVEVVMHPVQQRQGFVQLDRGVLDQAVHLAQARVVFDQARQLVPHLLQQ

SEQ ID NO: 981827 - protein, 39 aa, Homo sapiens
PSSFSQCFNRHRDVMAFAQFSAAALVQSRCNDREVKKVQ

SEQ ID NO: 981828 - protein, 56 aa, Homo sapiens
LWAQWSVWLSVLLSLLGSDASVPTGVMEDLPPSLLTHPCWRAGEEALAGTSGELVP

SEQ ID NO: 981829 - protein, 35 aa, Homo sapiens
MLTLSTDQRPQLPLTLASSPPNCSSRPRAAGSQWE

SEQ ID NO: 981830 - protein, 56 aa, Homo sapiens
MASEGASSKPFRFQVVLSLQMHRRINVHEPPPRFQKMYENAWKSRPKLAVHGSGGA

SEQ ID NO: 981831 - protein, 35 aa, Homo sapiens
LEDPNMLTLLVSPLDLDSLQKDSLTPKLRNGTGGA

SEQ ID NO: 981832 - protein, 81 aa, Homo sapiens
RSAGSAAQVRDTGVNTRRLIAILSVDRTLQSRALDATETLEKSAYPGITLLGVLREALQLGGTGSKKSFICIKYMLDGLVG

SEQ ID NO: 981833 - protein, 60 aa, Homo sapiens
GEVTACQRVNNSPQVTLIRVVIIQPRSIKHIMHGHQVGPFSLIDSSNEPSASSMHRDHTT

SEQ ID NO: 981834 - protein, 107 aa, Homo sapiens
MPQRFNGARQGPTLLLGSRVAFPHPVSDGLGHSNLPPQRQPLTGPIYHFSSVSLGPSTSLLSNSSIQHTLGAQHCLRGGSFYLNQVSYGLSRISQAVDTKNPESGFT

SEQ ID NO: 981835 - protein, 43 aa, Homo sapiens
SRYALLTHSSAWLGRLRKETQSWQKAKEKQAPSSQGSRKVSAY

SEQ ID NO: 981836 - protein, 109 aa, Homo sapiens
YTELSGYHSYSTYAHGSLSIDHVSQTSTMSSNCRLGTASREKRSSLFWWQSSLKEVADDVAARRDTNCSLSTEVVTAVSVLEPQKSIVFVKGLHHSLGVDGVIIHHGLL

SEQ ID NO: 981837 - protein, 68 aa, Homo sapiens
AYGTALGRVGIYHWRASIRWNSAYVGLKAVTKLGELFEAQQALPGKSQDIVRRTPSYREYRTIIYHPN

SEQ ID NO: 981838 - protein, 40 aa, Homo sapiens
TLIHLLGSQAVTGITGVSHCSWLRFMGSYCTGSQIKAIIS

SEQ ID NO: 981839 - protein, 101 aa, Homo sapiens
TRYHAQQDAVSRLSLGDQCKSREEYLECWLAEASNASFSRPPRQVFFIVISFSPEPVDPRPKALSEAQESDLALVALRPLILQCKAKNTVASRTLCGRTRP

SEQ ID NO: 981840 - protein, 48 aa, Homo sapiens
MTKDETEQDHMSIMRTLMTETSIMTGDLKRGTLIPAATFGTVSRLQQR

SEQ ID NO: 981841 - protein, 58 aa, Homo sapiens
SLFHRQTVVTLEHACAAGAEGLLMFGERDFYIHAIAVFADINGLRVAISPTPCAIRYA

SEQ ID NO: 981842 - protein, 47 aa, Homo sapiens
LNGGGMSYKIPYDRQETHLEWHTNLDFQLEQYIYHRPRDGIYIINHK

SEQ ID NO: 981843 - protein, 46 aa, Homo sapiens
HVRACCCAGGCTSNTDAPQAFMATPRTRGQQFLYCLYILWYARDSP

SEQ ID NO: 981844 - protein, 46 aa, Homo sapiens
MVAGLMPDCYLGYSTGEYTRSLYQVVTILLLVVSWIAAVLFIPYLG

SEQ ID NO: 981845 - protein, 85 aa, Homo sapiens
PALINQAWQIPGTIQLTADHEFLGLALADEQLRATRLRTDFGQVAAHAVTSAQHVARKALYFGNEAFGVCPPRYDIDVSRALARY

SEQ ID NO: 981846 - protein, 78 aa, Homo sapiens
DQQVHVNKFTNVQTRPSLPGLFAAFLAIPLANQRELLCQLIFEPRAPGQAMLLITVVVGVAPAGVQVQAQCIQGLPCQ

SEQ ID NO: 981847 - protein, 144 aa, Homo sapiens
TKCFPQDGRMRTSLCATLRLHRHTDGCSLEDFQIMISHRTRYSLAQFLSIQEASASIALFSKYGVEHLSLYPSQLLTGIMNIVRDQDDRTLLLVLQEIVATPGNLRAKSTQCRDQVVFNRCRVSDGRVRLQQLLVLREIAVDQQ

SEQ ID NO: 981848 - protein, 57 aa, Homo sapiens
MPRFSKKKSHLSASNTSGNAISSAYTALASMRMLSPPKSAFCPQAKIKYIDRQRVAH

SEQ ID NO: 981849 - protein, 71 aa, Homo sapiens
MKRLIALPFSALMVVSVQVSALCLNISESFTGIIGPGGDSVAHGPFTISGANGCSGASINAMVSAGGAGRS

SEQ ID NO: 981850 - protein, 138 aa, Homo sapiens
YSTPGPDIVAANRLMIQGDRHYDYDAFGNLIRERRGKSQQLVTEYRYDCRHRLISITKPNGETASYRYDPYGRRISKTVDGKTTGFSGKADKLIAEHHAERHRSYLYEPDSFRPLALLEGFGPKETTPYHYQLDHLGT

SEQ ID NO: 981851 - protein, 121 aa, Homo sapiens
SRKPSPKSKATVMLTTKELKRFDVTREEELVARDNQHFPFLLGYRYIMQLKVLNGCFWPVSACCVSAAHWPSRMHAVFSTNAIDWSNGCNCAGMDYKPQFPGKEVLSMDIRHQRLSIGMSE

SEQ ID NO: 981852 - protein, 135 aa, Homo sapiens
RQQAADTAKAVQHHIGAFAGGSVLLANHIGHFFTHELLGSAAGAFFTEFVGQLAQVYRSRAELELAHGFEQWECFVDGEFAVVGGAMARKAMGFENRDDRLVDQAAAIDRAHHIVIAVQLTDKRNHRFSECFTVD

SEQ ID NO: 981853 - protein, 58 aa, Homo sapiens
IADRRVVCPGVIVRSSANAQAGATTRLSAMFHGLWLLDFVLWLSSVLQSIPVASLAVV

SEQ ID NO: 981854 - protein, 124 aa, Homo sapiens
FLASALLLIVGLAIRLGVNESPEFLEDKALAEKARAIKQGQAPVLEDDEDRLASTVVVHWRQYVGNSGVYFTNTFMIAYSTQQLNLPRSLILECLFFVAIIQFCVQPLAAWVAEKVGATQFLCA

SEQ ID NO: 981855 - protein, 123 aa, Homo sapiens
RQAPAGLYAEPLVHDQRFVLEVFGKHREGLGFLCFERRVHQHRQRRQAYGHVIAGVELIQGGRQYFRLAAEHQVRQRDVLQRTAGEALGLCHVRRLLGQLAVVLVAHAQAFEQVVGQLLAGYS

SEQ ID NO: 981856 - protein, 112 aa, Homo sapiens
MYATLTQTYSAVQIGDTLKENLRASQQIVLSGGVDDDGLFTFSFDDERYLPFEGTGAISSWALEFTSTDVAARNRLFESLTDIILKLHYTAKAVLGGGIVNHDESLHIAAPS

SEQ ID NO: 981857 - protein, 34 aa, Homo sapiens
MLVPVAFAPTGASESSSPKMSCSSPLSYLQLAPE

SEQ ID NO: 981858 - protein, 35 aa, Homo sapiens
MHEIAQNYKVTNTEGELRSVMVPTLASIIFPSDYP

SEQ ID NO: 981859 - protein, 46 aa, Homo sapiens
TKASCCGHIPAFCAGPEFTPKSGVKIQALHQFCCILLIAGAEVAGH

SEQ ID NO: 981860 - protein, 80 aa, Homo sapiens
QNKLKAWIHMSVESSDVSWKKSRLPGSSCWFLHATTPQFLHQIDSLAHADIINAVKKFVSGQNSMAASGNLGHTPFVDEL

SEQ ID NO: 981861 - protein, 51 aa, Homo sapiens
QTVVTHTSPLVTNPDGNGSHDLIGTFHTSLDQLLHLLPLGVDDLRGSSPLS

SEQ ID NO: 981862 - protein, 51 aa, Homo sapiens
PHQAVRAARQAADFCSEGGSGMQLAPELQLAPELAARPVSSIALSQQLAPE

SEQ ID NO: 981863 - protein, 86 aa, Homo sapiens
FKDDSDCQTLIQPSDPTQTQFRTLIQPSKPRARFFQTLDQRRADSSQSLLHEPWLEASRRHSDAVHDPGSQPSRPHSDAGRRLSCS

SEQ ID NO: 981864 - protein, 38 aa, Homo sapiens
ISLSYSIQMPHDIIIFHIFFETTLIPTLCYHHPMSVSS

SEQ ID NO: 981865 - protein, 87 aa, Homo sapiens
MDLLQSTFLQTGRPSSVGWHLVSGAIRARVSRVSSSVVSTVSMLPGFYPRTPRVSLSLAPNQGIEGLYTFFLSFKAGQSAVAIRVIL

SEQ ID NO: 981866 - protein, 48 aa, Homo sapiens
LAAELVESKDVARNYAEAKDVFLGMLWYEYAKTGILSDSCRCCVLEDL

SEQ ID NO: 981867 - protein, 70 aa, Homo sapiens
GSAVRHVSCVYLLQCGHAPAVVNTRRPGSMFAFFGGERGAHVSAVLVKGGMHRSGEYTSSRRHACVLGVL

SEQ ID NO: 981868 - protein, 39 aa, Homo sapiens
GLLIFLLSLMTLTLCSPDLLGEPDNYDLAKHLKTLLKSP

SEQ ID NO: 981869 - protein, 36 aa, Homo sapiens
MFIARKNDWSSRIWAFRAPGTEWYPNIHLNTVKLAI

SEQ ID NO: 981870 - protein, 72 aa, Homo sapiens
EYDRLQLERYGEVSTALTCRRNWYRVGMHRRGEHVVPGFSLTYIWEVSTGLTCRRNWSRVGMHRSGEYTSTC

SEQ ID NO: 981871 - protein, 39 aa, Homo sapiens
GQQGAHVSTELGQEGMHRNGEYTYDQAPAERLLGGQTRC

SEQ ID NO: 981872 - protein, 53 aa, Homo sapiens
YHSWDPAFTDGMHPRRHWETGEVGYHKEAGVSTRASLVSEDSAASNPKAFTND

SEQ ID NO: 981873 - protein, 42 aa, Homo sapiens
RDCQRLKVINAAPMSHSSQGFTSVTQETFDEYFISETGHNVN

SEQ ID NO: 981874 - protein, 91 aa, Homo sapiens
ADLEDSFHPSQIWQQVFQTYLPRLKQLDQGPKELEDFMAQLKSTRLGLRFEMFMWFLRDHHYHAYELLGHSIQIIDGARTTGELDFLIKNT

SEQ ID NO: 981875 - protein, 97 aa, Homo sapiens
MEGRAWNIWSSPSRDAKARVQQFAYAVRDTFAELAIRDGQCKFAQKPGIILRIKRHCSLYVFPWKYVIPYPFNGCGVSFVWSRKTVICQLYPSDRGA

SEQ ID NO: 981876 - protein, 70 aa, Homo sapiens
VTLWELAYNRDTANHGKLVYRGGNFIVNQVPRLHVVSPKHASLLQNAQEHHFCMRELMCHILNTLKQVYV

SEQ ID NO: 981877 - protein, 43 aa, Homo sapiens
IRYADVLTYEEHAPFHAGVYTVVSVGQFLFRFRLVERVTVSHG

SEQ ID NO: 981878 - protein, 149 aa, Homo sapiens
RTTNTKDTINAFNHLNQMWRKHTIAEAAAFIPISTVRFIRISTYYTLNYLVFAYWCNARLACNEFSKAIFVDEHVSGYSKLGEFREMNAINLHEPHIVGAVLVVRDFSSRATFGANDGLDQVGMRTVMSRCSDDADLASLASNVRTRWG

SEQ ID NO: 981879 - protein, 123 aa, Homo sapiens
MREITPGITPPGDWNVLTRVSYGLMPTYNSEENNEIGVDRMAQGTAQTTVDVGGHVETKLRYGALDEFMASCFGKDWVGNVLTMGNDRISFSIGSYANDVGIAAIARGAQVATMNFEIPSDNE

SEQ ID NO: 981880 - protein, 161 aa, Homo sapiens
MCRPVFPSCKRLTLERMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNE

SEQ ID NO: 981881 - protein, 47 aa, Homo sapiens
HYCRHNIYEDVKPVGDYENVCAGEASGFMNKDADRSRAMWLIEEYAM

SEQ ID NO: 981882 - protein, 54 aa, Homo sapiens
MDNIYVGHSGTGACGARREGTPSSGTLTSLTRLVKAYYIHRGIVPTVPESRLKI

SEQ ID NO: 981883 - protein, 125 aa, Homo sapiens
QLQQLYSFYETGSLYDLQNGDSEHPDHNVQLIKLEFDAEELTSPSVQHIIVNPNAGYDKFKDKRLSTKGLDFSDRIGKHQEDRDESGEYQMLGEGLGVKETPQQKYQRLLHEVQELTTEVERIKT

SEQ ID NO: 981884 - protein, 35 aa, Homo sapiens
FAAGINTILNRPPRRPDNYNLANLYFTPIPLARNP

SEQ ID NO: 981885 - protein, 69 aa, Homo sapiens
LTSVMCICAYERAKHWKCCYLYKNNPYGHVDYQYKRRRQEIHKRDETSTMAEAQGMEIKKSQEKSGRYT

SEQ ID NO: 981886 - protein, 170 aa, Homo sapiens
FFEASPPKNAVLYCLGVLRIAECHRLAPVSLFSTSLETAFFWAFSNALFAPFMSCLRVVISRRYMLVDFLDSGVPGPWWGSRETRMRCCRVVMPVPSAIWIGCMLARRRVSWGSPVFISSSVMVPRPGKAWTPGDSRSSDVGGTLDCAAAALQGTHGQRRKNSILEFNYC

SEQ ID NO: 981887 - protein, 90 aa, Homo sapiens
ACLVKCFGENLEEEAIIMKVVTDWTVGESVFHTTRWVPPLIGELYGLRTTEEALHASHGFMWYTEALCPPATWIPAPPHWDGINALQGTH

SEQ ID NO: 981888 - protein, 71 aa, Homo sapiens
TAGIRAAARHLGLSQAAVTRALRELEQEQALPLLIRTPTGLGFTPYGKTLLAHARLVLNQLEQAQGEMAAL

SEQ ID NO: 981889 - protein, 95 aa, Homo sapiens
AWVLADPGQDSKAASPQAAGCSVHCPTLSYKEEQLMAAHGTSHPPCQLHSARLVHVTQGSEHLYSLMVLRKQQQRLIRQWKRSRSISFCICKEPT

SEQ ID NO: 981890 - protein, 166 aa, Homo sapiens
MSSLQRLGPLCVSIYGLLVQSIILHQSRIGDALDQPSHWWQDDLHHLPTLYPKVAAPQWFPRTGSWSADSHRSLYRASSSVYFLLVHELDDPWTSSCSVMLMSSSCCRNCSRMYLGIMSTRDCLAEGVMPCCTTMRARVMFSSCMRWQYTLMVLMPTLGSSARNPR

SEQ ID NO: 981891 - protein, 74 aa, Homo sapiens
VNRARYRSLMAVAEHGLSVMSETSPVVRGGHSSLFWLLWSPPWHEFSRCCFSVLVRLGGVPGCVTAWGLPLKEL

SEQ ID NO: 981892 - protein, 116 aa, Homo sapiens
RWVLLQSKPFGVILKPGAAGRERVVTLTAVWMECFREAAYTKRLGTEKEVEVIGGADKYHSVCRLCYFKKASGQPAGPDNKENCPVPGKPGEAVAARKLFAPQQILQCSSARNARR

SEQ ID NO: 981893 - protein, 35 aa, Homo sapiens
IELYRSLIAVALTLLSCVLPYAGRRGYPLSHVHAT

SEQ ID NO: 981894 - protein, 75 aa, Homo sapiens
MINNSNAGPSRRGSLTYRRLLEGEDAELYYSRIAACNVCAHAPPLDDVVELGTPCVRLPASDWQCLQEPTLCKEP

SEQ ID NO: 981895 - protein, 40 aa, Homo sapiens
TGGTRLQVLWHPCTQMREHPHTLPLVPIARGEVRMVDRPR

SEQ ID NO: 981896 - protein, 46 aa, Homo sapiens
MRQLLRAAGAGATGRYPRSACCPRRWLRVESRLQIDMGYRSSNFVK

SEQ ID NO: 981897 - protein, 40 aa, Homo sapiens
TLEAHTHRHRSRQAITVAGERFHMVQNVSMAVHHICKEPT

SEQ ID NO: 981898 - protein, 127 aa, Homo sapiens
IYVVQDGGLIVFPSPPSRQVSPDDEYSDFVLYEDDKRVGEGIEPPGRYEGIQSYEQHQIPGEYDRKAVWAVSSKRPNIKILFFIPCWNIEFLLVLKISKSAHCSITIVTNNAVWQVNSTIFLCKEST

SEQ ID NO: 981899 - protein, 38 aa, Homo sapiens
FVRLRIRIPSARKELVAVQRVSSSSQNWAARHISSSAS

SEQ ID NO: 981900 - protein, 76 aa, Homo sapiens
SRRGGRGLRYHGIQIWELTGWREPFLSGTSQPFLESPSADSSPSLGSRSPDSQCPPPSVPGRTQEPGSQPNHPVGW

SEQ ID NO: 981901 - protein, 36 aa, Homo sapiens
LDGSRSDWGGDGRHWNCGLGGSSAWPLLARRDWMDA

SEQ ID NO: 981902 - protein, 57 aa, Homo sapiens
FINHNTLRINKYNIKYGMTSRANVIVGLIITDPDDHIILNWISHSIVVCRLHYTGDP

SEQ ID NO: 981903 - protein, 33 aa, Homo sapiens
TVRAGTHDMLVKGLRRWGCDMEPELTWWVGIVC

SEQ ID NO: 981904 - protein, 63 aa, Homo sapiens
SSSRIQIRPTFSSTKPNYDLYEEMGKVKKIDASTVCRMNVAGSSCGRFYDKERTNSKTVKGIL

SEQ ID NO: 981905 - protein, 36 aa, Homo sapiens
VFSEDPAPPERVAAAVDPCVSVPRLVSGIMNRPVHA

SEQ ID NO: 981906 - protein, 35 aa, Homo sapiens
LIFNPLATFFQSCCGREGVPGPVVPEVGPVRPPPQ

SEQ ID NO: 981907 - protein, 33 aa, Homo sapiens
PAAEWRRRTGNDTGATACRRGDRLNRFHTSWAN

SEQ ID NO: 981908 - protein, 105 aa, Homo sapiens
SSRFQRACAQCFSHIRGSGCTCHAVFLQFTADVGVRVLVVHKYCCARFMSIVRLLKSPAGDSTGIGFGRGIYGQRWIKKTHGVALAKEWYLGSRTLFMWLECNVY

SEQ ID NO: 981909 - protein, 74 aa, Homo sapiens
KNARYNAQCQETYPRYYKPCTPETIAKATSKNGNAMDFTPCLDALEPLVSHWAWPTPSLSQARYVTHQCLLSAR

SEQ ID NO: 981910 - protein, 74 aa, Homo sapiens
YNAIYRPFCYNETRLVCYTKRLPVCSHLYVVGNLLACYFTHALPPGRINNVFSDTISVAYMHIILTYIGFKFHK

SEQ ID NO: 981911 - protein, 71 aa, Homo sapiens
RLLERSPVLTFNTPQYYILKGDRGKTPRSQGIGGCHLNAPSAGHMSSSSETLTKCRCRQTHLSCFNKPNGT

SEQ ID NO: 981912 - protein, 42 aa, Homo sapiens
MYREYGLTPHLNSILKILQSRGFNNIDSTHSHNSISQKVISK

SEQ ID NO: 981913 - protein, 49 aa, Homo sapiens
MWSIYSIPLQPHDHLEALIDPFDLDVFTPHQSTATFIAYFTPNPVIVGL

SEQ ID NO: 981914 - protein, 136 aa, Homo sapiens
LQSPLITILSWRMRTESTGLVNGELQHQLLLGSPCPPGPRPRSALGVPVGGQDILRNLPLWYQMSPLLHQGRPRCKYAHLVSIAHHKQLLVSVETQAGHSSKWPVESLVHDCTSQLEEGCHRLTRLVPVSPEIVGF

SEQ ID NO: 981915 - protein, 40 aa, Homo sapiens
YCWSSLTGSRESSTSNFDPIKGQTPYSSMVMWCNVQLVDV

SEQ ID NO: 981916 - protein, 71 aa, Homo sapiens
YNPTITHNPTITATITLLNLYFYLRLFYTKPRDRGVVITTPRSLFPYKGKYNKHSLASCLAIGIRGVLNST

SEQ ID NO: 981917 - protein, 186 aa, Homo sapiens
SRGSRLLLNPHRTIARPPTPDVSDLFHFLQVVDRVGLLNHLDGRILMDRPPHSERIELHLGCRRTARTMHADCLDHFLVDHTRPALVTTDTLIGHVGFSRRPVALQQFARTEHQTNEGLRLLHLLQDLQGDRIDEQIDHQVHLAQVAHADLFVLQDVQVNVLLVEQTNRIVTQPLVELEEAARSAC

SEQ ID NO: 981918 - protein, 33 aa, Homo sapiens
MLSTRDVWMLFDYLADKHGFTARRYLVYTLQSA

SEQ ID NO: 981919 - protein, 41 aa, Homo sapiens
GSPYTPRLPGLVVVVNLYITLYGQLTSLSDTATGLGVDFGR

SEQ ID NO: 981920 - protein, 100 aa, Homo sapiens
LEDPVVQLRIWYGRCEINLSPDFTGSENSRTPRKRDAFQGHGPSLGANPFQGALAFTKKRELFPGLPPGFSGESVALPALERPRGRPISRHSGIPGNLKP

SEQ ID NO: 981921 - protein, 39 aa, Homo sapiens
MAGRSRICVTDSILVAGVADTGVIQVTQEASLAHATGTA

SEQ ID NO: 981922 - protein, 32 aa, Homo sapiens
GSKDPPAVQLRVTMPGRRDGLVVALGGRNWYG

SEQ ID NO: 981923 - protein, 33 aa, Homo sapiens
KIPCVQLRVTIPGRREGGCRLGETQLVRRGVQK

SEQ ID NO: 981924 - protein, 36 aa, Homo sapiens
ITLTSTITTITITTTTITIITLTHIPSTPITTHKHH

SEQ ID NO: 981925 - protein, 46 aa, Homo sapiens
DPLAIHRHHHEPPSPSLTSTSTYAYFTPTPVPMNSEVPINEVPINS

SEQ ID NO: 981926 - protein, 107 aa, Homo sapiens
AIIGTLFHNPIPAVTLNKVVINDVNKTEFNVLPRLLQIGKHIRSQWMCRSAPFSDVFKPAATERDLPTFLPELALSYTSSIESSLALFWACMGSLQSGMASWWGADE

SEQ ID NO: 981927 - protein, 44 aa, Homo sapiens
RLFIGTLFIGTLFIGTRIEFKYYIKYAWTSRANGADKAEVPMNS

SEQ ID NO: 981928 - protein, 45 aa, Homo sapiens
SRGIPSFIIGTSLFIGTISSRGPCILNIKLEYNTGADEIARCRSM

SEQ ID NO: 981929 - protein, 78 aa, Homo sapiens
GSLVIIGTQLPSLDGDLEEQMFSSKGPHVSLPGPRSRLDLHVNLFYANKSLVTCTVDSELTIGPRFATGDLGWHLVTQ

SEQ ID NO: 981930 - protein, 45 aa, Homo sapiens
RHLEDPSSIIGTSLFIGTRIEFKYNIKYAWTSRANGCRLIARCRS

SEQ ID NO: 981931 - protein, 46 aa, Homo sapiens
PHYYYPVPMNSDTSLFIGTSLSSAPRYSSGTCASLVSIVLWGCRLI

SEQ ID NO: 981932 - protein, 68 aa, Homo sapiens
FIGTRIEFNTPQYYVAIHRHRGWCKLGVREVEVKEGDGADNSTYYCGVLNSLFIGTCHRGWLVFVFLV

SEQ ID NO: 981933 - protein, 33 aa, Homo sapiens
AIIGTSLFIGTISSRGPCILILYYNSIRVPINS

SEQ ID NO: 981934 - protein, 123 aa, Homo sapiens
MFRDIISYQEKITFKPQRELRLCYHGGQAERPSGVLAGGQQGGTAGESAHGPATPESRLAVFMKLKICCPMPQQPPSSVFTQEKGKHSCFHANRHRDSHRYSCDLHRLGASTQTSSRTLTASA

SEQ ID NO: 981935 - protein, 36 aa, Homo sapiens
GEHDHAHGVFYCTDDLTTCLPAPGVAAALTDNLPRT

SEQ ID NO: 981936 - protein, 86 aa, Homo sapiens
VHYVQIAMRASVAPSELGDGIAIGDVSLYYMRIAAGHASGAGYTLTGLRIQVVDEDACAFAGKGVGDTLAKAWTRARDDGNLAGYR

SEQ ID NO: 981937 - protein, 38 aa, Homo sapiens
VASQQAPLSCSSCIMHVTSINHHFGVSSLPEMQSTFTF

SEQ ID NO: 981938 - protein, 66 aa, Homo sapiens
WYSCWNVGRSTSTDGGAQSGPVPNVPAECRGGMLERLVSELSPMNYIGLDDFVEITKKEAKGVPSS

SEQ ID NO: 981939 - protein, 102 aa, Homo sapiens
ATLEYQTEAIEWLGRCEREGESHGAHPTFLLPSRPPGSPSWLPHRAVVAGSCSLSQCLCFISLSIKCKDFLLERSLWYSIESCADSRVRRRRSTLRLPGLSE

SEQ ID NO: 981940 - protein, 59 aa, Homo sapiens
ARCWPVIPELNGKLTGMCFRGPTSNVSVVELKLRLEKLKIYDIKKVVKQASERPLKGIL

SEQ ID NO: 981941 - protein, 33 aa, Homo sapiens
TKHRLLIGKVTKVKELGKSYPAYFRPTPVRLSG

SEQ ID NO: 981942 - protein, 81 aa, Homo sapiens
ASPITSTPTASTTTVIIPHLPSAITSRANTSTTIIIITITTTITITTITITTITSTPTAATSSIIITRITMPHSSLFGMSG

SEQ ID NO: 981943 - protein, 85 aa, Homo sapiens
IHKKSHWCKAPSPNLMDITYAQDAIPSPRSLVHALTVLLCVGCSTVLCQPTGGKAGLTEGCSFMEEAASACTLTSVLGILVSGSR

SEQ ID NO: 981944 - protein, 38 aa, Homo sapiens
LIAVISQIVSSITASREIVMAPWNVDLTGIPDQPGALT

SEQ ID NO: 981945 - protein, 44 aa, Homo sapiens
ISNGAYIDASFSKSSKQSPKHPYIIHPSIHPSNYPSIHLPNQPP

SEQ ID NO: 981946 - protein, 49 aa, Homo sapiens
EHHSNTIIIITITTIITITSTPTPPPPPSSSIITITIAYLTPTPVRLSG

SEQ ID NO: 981947 - protein, 34 aa, Homo sapiens
TWGLSDQPNTIITTIIITTITIAYFTPTPVRLSG

SEQ ID NO: 981948 - protein, 45 aa, Homo sapiens
PVVPCHVCAGSHYTTKQYRYLNTTFFDPAGEGDPDFTPTPVRLSG

SEQ ID NO: 981949 - protein, 69 aa, Homo sapiens
LCSRTQSTLLTIRDRLFSASILVAVVHTGQSGDIFHVRYTLTLGRRRTGHCPQSDTTAFGAMVPAHLKH

SEQ ID NO: 981950 - protein, 85 aa, Homo sapiens
YTFWDNPQYLIKLEEEDEDEEDGESGCTFLVGAHSEAPSGRQRKHGLMHMHTIVLWHLCRFHEELSGADQHPLSASDFFLHEIAP

SEQ ID NO: 981951 - protein, 66 aa, Homo sapiens
TLRITKHKVLLSAKMTSLMTIMARLLCVSRLQTTSVLDANHDRRQDLGHAAAKPFNRARALRYFTL

SEQ ID NO: 981952 - protein, 146 aa, Homo sapiens
SAEHMSRRSCGVWALCHACQAPSLAVRTFNSLAMGVLALGPLARLGAPQDDGSFLGVTGTFTGVALPSLWVPPFGLLAWNSLILDVASPPLSEFRPTFADLTWSLESSHICAGSPQAEEVAKWIGRLVRWIVLLQGCWVVGILWRH

SEQ ID NO: 981953 - protein, 38 aa, Homo sapiens
LHNEVTQSYPIYSFTHSTILTSIANPTKTLTRVFGLSG

SEQ ID NO: 981954 - protein, 53 aa, Homo sapiens
RISEHHRPVIGVHSGIARMPTPVLSCQSIYLHICAIYPSTSADFTPTPVRLSG

SEQ ID NO: 981955 - protein, 88 aa, Homo sapiens
LAPPYVILPPPYTTIPPPCSLKQPYNHSSTTLPPPYTTLHHPTTTLPPENYPTTTLPPYNYPTSTYHRATITLPSPAYFTPTPVRLSG

SEQ ID NO: 981956 - protein, 119 aa, Homo sapiens
MSGNSYTLLSGKHFGRFFYHSKPGLCFVMEKHAGTLSKQKTDYDSSGRETSSQCLRRKNTKVDDTLELERGPDCDRSHTRVCRLHGGQKRGFVPGLTKIRRPGVVANACNPITVEGRGR

SEQ ID NO: 981957 - protein, 41 aa, Homo sapiens
LYACNSSIAQLIHASEVYLDENRLLSMKDERAVGLFKNTAK

SEQ ID NO: 981958 - protein, 72 aa, Homo sapiens
TLGDFQQVKAVLSYDREHCLHPVATEQDPISWEKTSRTAIPQDKRIVSLYKDSISYWISEEACISGSQKIIG

SEQ ID NO: 981959 - protein, 74 aa, Homo sapiens
CAAGVDGFMDLNAIIADHALDVSGTMHDTGFRCLEEEKIVSDCRTQTNPPPEQHLCGVRTIVSLKPYSDTCRPT

SEQ ID NO: 981960 - protein, 41 aa, Homo sapiens
MKNSQKTIASSSRTIIVYHHPSLTSTSTYAYCYTSPTVRWP

SEQ ID NO: 981961 - protein, 65 aa, Homo sapiens
DLQDPRLGHAPCALGVPSHFRYEKDTVVVQDSGYIFTACPLYSGCGISALLTLRGIKCCMDPHPV

SEQ ID NO: 981962 - protein, 139 aa, Homo sapiens
LGQRTVSEGTTAVTKIQLRVSLPLHTSRSLFLCSGVSDPGRICSSSLIRLLDGHCVDQKKDGKKRKRSRKESYSVYVYKVLKQVHPDTGISSKAMGIMNSFVNDIFERIAGEASRLAHYNKRSTITSREIQTAVRLLLP

SEQ ID NO: 981963 - protein, 113 aa, Homo sapiens
MPSGHAPCRANATVLCQRTVLGLRTVVQQYAKLISGARPCARMLGPPNKDAGGLTPHGSVVDHFACFGGLNAARYLSTHPGLLNRQHVGPTHSDGSASIDDAPGGLKAGDGAL

SEQ ID NO: 981964 - protein, 34 aa, Homo sapiens
MYCGVTVRWPNTVRWPNTVRWPSTVRWPNTVRWP

SEQ ID NO: 981965 - protein, 70 aa, Homo sapiens
LVHAPSVPTGELGSGLQVGAPGAEEEVEESSPLQEPPSQAAGTTPGPDPTAYQLLSARSACLLGLLAAIN

SEQ ID NO: 981966 - protein, 76 aa, Homo sapiens
QPPLHHNYYGAQSPTTLTTVIPSFTRENTLMFTHQPHGCVGPGALTHRSLGQRTVQFVPFQFYSELLPGGSTVRWP

SEQ ID NO: 981967 - protein, 80 aa, Homo sapiens
FSRLVSIGDSSILSEVILNGEQNCIFSLTSGSYAMRMPRRQNDTTGRARWLHACDPSTSEAEAGRSRGPEIETILATTVL

SEQ ID NO: 981968 - protein, 68 aa, Homo sapiens
EPKALTITVRRRFKESSILYCPTLRYCAYATNKTKHILPTLASGKFLVHNVQELEVLLICNISYGADE

SEQ ID NO: 981969 - protein, 77 aa, Homo sapiens
FFRIVDCSPLQSFWVQSPPRFHASILWQVLAVLRSLSGDLSGRDSQHLSLIDVRAPSMLRQPDMVVGSVAHEPRVRG

SEQ ID NO: 981970 - protein, 37 aa, Homo sapiens
MRFLAACSVVATRSFRDSLTSLFLPYPSSIPVSSTGH

SEQ ID NO: 981971 - protein, 36 aa, Homo sapiens
HELVLTIHDHSHHSPSLIIYFYLRLFYTNPVIVGLE

SEQ ID NO: 981972 - protein, 44 aa, Homo sapiens
RYHRHLAIHRHRGWCKIGVVEVEVKEGDGGYYVRTNSEVPMSSE

SEQ ID NO: 981973 - protein, 136 aa, Homo sapiens
HDLSLFPRSPSDAEPKLDCTAAISAHCNLPAWFSCLSLPSACDRRRALPRLTGFRIFLVETGFRCVGRAGLQLLTASDPPASASRGAGTADGVWFTQCSMVPRLECSGMKDDGNPWSPVGPGKTPLPDLTKVIVGL

SEQ ID NO: 981974 - protein, 36 aa, Homo sapiens
MWHQALLRSGDKVRIDPPVTNTTAASTYLNNPYGAL

SEQ ID NO: 981975 - protein, 58 aa, Homo sapiens
TADIILFGFRTSVGSQLILSRRARDRDDYSSGGEICSCVYVYPYGALAQDIRARYRDR

SEQ ID NO: 981976 - protein, 95 aa, Homo sapiens
PVLHRLRRAAVRCDALLSSVYSRRLSVGGLAGAHEFWAVVRYADRVYALKFGIHMVTSRRTGAYPPRVLTEIREVPQSTRRPCRFGTDARSSLNL

SEQ ID NO: 981977 - protein, 155 aa, Homo sapiens
SGSDLTSTITLKATHPYPAQCQHPIPQHALKGLKPVITRLLQHGLLKPINSPYNSPILPVQKLEKPYRLVQDLCLINQIVLPIHPMVPNPYTLLSSIPPSTIHYSVLDLKHAFFPIPLHPSSQPLFPFTWTDPDTHQAQQITWAVLPQGFTDRPH

SEQ ID NO: 981978 - protein, 84 aa, Homo sapiens
APVATSISNRAIAIHGFISPCEPAGGLRVQEEPNQPVWLPASCTMIHEERGDINHTNSRGRGGTGSDPRQPDSLGPDWLLGSPT

SEQ ID NO: 981979 - protein, 43 aa, Homo sapiens
PVAIIGTSKPRCCNQLVLLHLDFTANLLTMLEMCLATCLAVTA

SEQ ID NO: 981980 - protein, 102 aa, Homo sapiens
MRQVSKEWDSDRTEQFWSSSNRFAGRETEIIFQGRDLHTPGASQWYWLLHNAPWWAPQASRCGEGTEGSRQAGKGLGSSHADVTQAYLVPVPTFTKRRSVKC

SEQ ID NO: 981981 - protein, 44 aa, Homo sapiens
SRHLALRGPCILHIILKFNTGCPINSELFIVHRVKYCACVEFNY

SEQ ID NO: 981982 - protein, 33 aa, Homo sapiens
CWDYRREPLRPAPLIFRTALLAYVTPTPRCVGP

SEQ ID NO: 981983 - protein, 39 aa, Homo sapiens
RIPSLFIGTPYSSAPFALEVHAFFILYLVPMNSEVPINR

SEQ ID NO: 981984 - protein, 44 aa, Homo sapiens
MGNGWMAPSTSDFRKSLSELSCPLPVSWVQPAHTFPGWERCVGP

SEQ ID NO: 981985 - protein, 103 aa, Homo sapiens
TGRLSQCPEPLMSCDNKEEDVLKFRCCRNPLRCTNLDFQMEQYIYKRKSDGIYIINLKRTWEKLLVAARAIVAIENPADVSVISSRNTGQRAVLKFAAATGAT

SEQ ID NO: 981986 - protein, 85 aa, Homo sapiens
DPPPVAPVGHANSQSFSSKARRSTISPSQALKQHGIYTTAGSVVSGLTQQASRQPSVNAPQAFCLQALLPDGDGSSACLYSRALG

SEQ ID NO: 981987 - protein, 47 aa, Homo sapiens
PRLSSAPGRGVISVNVSTGGEVEVDLFRVTKNYSSAICALVMVGRDE

SEQ ID NO: 981988 - protein, 66 aa, Homo sapiens
PLKSPRSLSYCLSGMYDHRYSATVSSQCRVTTGHCVSLESACRTNVTDDTTFTTSSTPLNPFESPY

SEQ ID NO: 981989 - protein, 62 aa, Homo sapiens
WTLSLNKLTFNSGCTIGYVLIHYRGRNPIVDIDSRIGLAVIPWVTCPVGHVIASISDRGVVK

SEQ ID NO: 981990 - protein, 101 aa, Homo sapiens
RRSTIPVYMYQDEDNDCEHLIRIIFIESQNGAICSTSTICSKPVLRLLCMSLPWIESLILAVSCIKIDENSSALLALWFCIMYASLPLVTTSSLRFLPRGR

SEQ ID NO: 981991 - protein, 72 aa, Homo sapiens
MLPTTMGRYWFILRVSYVWPILIFGATYLLDFPTSWVIAFGNWGLQIVDDMIIIGCLEWIQAELWSEAPCEK

SEQ ID NO: 981992 - protein, 45 aa, Homo sapiens
SSALAIIGTSLFIGTSLFIGTSKTNSQTLENDSYQSEVPMNSEVP

SEQ ID NO: 981993 - protein, 102 aa, Homo sapiens
EITQSPDPSSYRSGRLNTHWGDSHWQEAIIARQCKADTEQCSLDCSVTVLLTALRQAQLHRFILACSLTKVTVVASLATLCPGLRPSYVLYVLVPTTAPEGG

SEQ ID NO: 981994 - protein, 52 aa, Homo sapiens
DSTGSRLGTHRPLVNLAIISLANPFKHPFPTSKPEVIFPIRLFYTNPTVRWP

SEQ ID NO: 981995 - protein, 34 aa, Homo sapiens
IGTCIIGTLAPRERNHSTGSIESTCSLGGCRLIA

SEQ ID NO: 981996 - protein, 101 aa, Homo sapiens
DRPAHFKARAPQCSIFTTCSRYVSAAFYTRLCFTSPKRGWEEEHLAIEKLSFSLESATVISCMCCQCLVVPRSQVLPVKPTSVRLSCHISFLVPSPLSVSF

SEQ ID NO: 981997 - protein, 98 aa, Homo sapiens
ASAPYWANRTVWGQRTGVGPSHRVGLSHRSSIDIAHEHRVHTHCPTSDADHQWDEPSRELIQHSQNLYILTFTHFLHTPPEVTPTATTKITINPTVRW

SEQ ID NO: 981998 - protein, 52 aa, Homo sapiens
VESGSVTRLVCMGSVISASRQPPPAGFDSPFSASLVVWDYGCEPPRPAGDGA

SEQ ID NO: 981999 - protein, 49 aa, Homo sapiens
MPEVSAERPIGLAALQPINSWAHAILPPQASRSSSDYRHAPPRPARCVG

SEQ ID NO: 982000 - protein, 42 aa, Homo sapiens
MHHLCHPEALEDQLHHVHPVHSLNGQCAPLGYRRAPEVTSHH

SEQ ID NO: 982001 - protein, 42 aa, Homo sapiens
SPIHGTGVGENRRYVEVEVKDGDGGYDGGDDAGLLFLVIFFD

SEQ ID NO: 982002 - protein, 33 aa, Homo sapiens
MSSTAIIGTRFFIGTSLSSAPSAMFVSLAGGAD

SEQ ID NO: 982003 - protein, 63 aa, Homo sapiens
RGSPRYYSAPAFGTTAFFIAPVMLRVGPSTDPGPSASSSIWSVASRKIDHVEGHKSSPYTSIS

SEQ ID NO: 982004 - protein, 43 aa, Homo sapiens
RHFSYSSGPRYNIGPSLYIGTSLFIGRIEFNTPQYYDLVPMNS

SEQ ID NO: 982005 - protein, 107 aa, Homo sapiens
PSITHVDGPTEIYKLTRTGGPWSRRLQQSGWDGLLHNRDPLTSVGSMPERAQCKTLMPHGSSSVVLLDLAACPFVGVPFDGGCRERRFLQPLNAVVYYNINSSMTHF

SEQ ID NO: 982006 - protein, 68 aa, Homo sapiens
AILGTSLYIGTSLFIGTGGWCKKALGRSRALRRVMVAMMVRMSGEVPINSEVPMNSEVLMNSEVPINS

SEQ ID NO: 982007 - protein, 128 aa, Homo sapiens
YHSITYDEFWPLIHVSMLSSCSSRGSPPQACRRCTSGHGLFCCCSRRWGSILPLRLTGSSFCSLNFHWLLSEVAGGDHASLRSCLRMASVAYRHVLSCSTYYASVQLYVVMQLTKEGFTQKDIQLIRP

SEQ ID NO: 982008 - protein, 37 aa, Homo sapiens
ALHRHSLFIGTISSRGPCILNIILEFNYGCRCSEVPM

SEQ ID NO: 982009 - protein, 54 aa, Homo sapiens
KAAVVDMRHSHTESAVVMESAVVLYDTAVGAMECHTIRCTSWKGDSTASGGSAL

SEQ ID NO: 982010 - protein, 122 aa, Homo sapiens
MVCVQVRWLGLDHLEGLQLVIRSAVDGGSWHSPHQDCGEAAPEGPGALVASRSSRNASIVPAECVVGLETRCAQRAPFGAHVQRLQDTIAVQEALPFGIGEAPQSGGRRPLARHGRAAHTAG

SEQ ID NO: 982011 - protein, 39 aa, Homo sapiens
SDRLGLPRCLAITVCEPHPGSFMILATKEGFSLVYVCVA

SEQ ID NO: 982012 - protein, 59 aa, Homo sapiens
KLKRRDVPPNFSLAHYNLLSWRQLLMYDMSPFPTWSPPRMLSSCGAGTIIPDSGHSTPP

SEQ ID NO: 982013 - protein, 48 aa, Homo sapiens
MLVAECFQCKYLDGSQAVYIIYFLYSLESRLITRFTTRLSDRLRRSRQ

SEQ ID NO: 982014 - protein, 67 aa, Homo sapiens
ISGRLVSSGVPNRADLEGSTLAVLMMTPRMASLVWFILGPYSARATRGITIGGVHEIPIKNSLEVFQ

SEQ ID NO: 982015 - protein, 43 aa, Homo sapiens
MEKVLRSSNNPPLFSCAYQRKCIQSTPGGEERCNILWAKWCNA

SEQ ID NO: 982016 - protein, 37 aa, Homo sapiens
VTQNTDLVMQGDSLSSGHSTPPRSVNGHPAERASICK

SEQ ID NO: 982017 - protein, 61 aa, Homo sapiens
LVQLFPLLALRILGGTLLCSDLADSYDLLHISSTSSSLTLWTMNFSEATVQYVLCVFVASI

SEQ ID NO: 982018 - protein, 141 aa, Homo sapiens
GVGSVCWDSASGSRTVTGSVCSAPCNGERGGETPRLCTPMRTIEQHLRNGVPAAVSSCGISSLSVGSLRQQLHGNVMHPKSSPRTPGHLSSALTSWAHPVPGRLQLVLSYFSWTLKEPSQSWPHISLCDPPHLGSITPSSV

SEQ ID NO: 982019 - protein, 119 aa, Homo sapiens
LECVEFAVFPFNHRGQAHVCGSTAAYRGWAIMRAIPTVLLLTVLVALTYIVGLLYKEPFTAEIYRQKASGSHKRSCLSCDSFAEGLASLLACPKWQALRRARLVPVAQGSPPACAAPVP

SEQ ID NO: 982020 - protein, 73 aa, Homo sapiens
GEHVRPSRPSSRSCSSMGEKKITINKDSKVPNACVCTIIKEDHTCGNRSLNHNSYRTRKCYLLATKSPTPSGG

SEQ ID NO: 982021 - protein, 34 aa, Homo sapiens
HETPSNSAQLTHTARVSPATCFCSACGDLKPATS

SEQ ID NO: 982022 - protein, 111 aa, Homo sapiens
MREWPAFTKKVARDHRAFLCDPRRRNNVHGFPAGQRASAEGVPLQTHPLPQEALVPYKGDSSAEELKLVTPLTGPVMPVRNVYYKKKARVITEEEKNFKAFASLRMAFQRL

SEQ ID NO: 982023 - protein, 66 aa, Homo sapiens
DKIINGAHFSPCSVNPISIFITHLSNYGNDRLGLYTFKHLVRFLHSWTNLRLQTLPHGAEAQHGAL

SEQ ID NO: 982024 - protein, 44 aa, Homo sapiens
GDDHGLLLLVREADTDTHSEVVLILYGVFAHPPEVIPSSRNLLS

SEQ ID NO: 982025 - protein, 91 aa, Homo sapiens
RSTGSRRLDVFRVSDEHHSLYCTSQVLVCVGEDQQSLASMDTKAVSTAKKYLILLTDHKTVSASLCNHVLPMGSDVQSSHSADSHIGHSTP

SEQ ID NO: 982026 - protein, 37 aa, Homo sapiens
MPFTHPLISGEHQTRDYALIGAGALAQHGAFAQYGAL

SEQ ID NO: 982027 - protein, 42 aa, Homo sapiens
DTSYHVAALLSQAGVALVPTCAAFYYLLAQNWSSRWDLLGDY

SEQ ID NO: 982028 - protein, 75 aa, Homo sapiens
ALIGRRGRIGSTARGTEYLPHAYIVSCNHLTKSKVTNPSRSVSRVLKNRNMVSSRTRQQTKLCQSRPPCWAPSSG

SEQ ID NO: 982029 - protein, 84 aa, Homo sapiens
LRSRKHATKQSATPILHLTPRCVGPTATHRVGPRTVLGNAPCWANAPCQDAGRSLQKCLAFTLVFWRDVDIRIKAPGDPTKGAL

SEQ ID NO: 982030 - protein, 57 aa, Homo sapiens
MPESGLPPLLRALYIVIFQFGWASTLISHLSLIPELVTNNHKKVELTALSVCVHCAL

SEQ ID NO: 982031 - protein, 134 aa, Homo sapiens
LTLQDPPEALNGQLDPTVDTTRRGFVFITFKEEEPVKMVLDVKSSILSVEASVRSRCVPVHRSLSAAAVWLWGPWKSQPREPRQCRSWLRWSVRVRVGIRATATTVTRATGTSRANGPGYCGYEYSSLWPFNAS

SEQ ID NO: 982032 - protein, 34 aa, Homo sapiens
GDDNGLLLLGDQADSKTPTLQWLSSWYGALARTR

SEQ ID NO: 982033 - protein, 44 aa, Homo sapiens
SRLIQDPRGALNGLYRSMRQEGGPRDLQLVVDEELGRSVVMNAE

SEQ ID NO: 982034 - protein, 72 aa, Homo sapiens
LTLFHRGLGQPLSTFFFRESCAWTFNYLEKRGGAPAVARSCASNCRVDAPPRRCWRKQMYGSSLKARSHTVR

SEQ ID NO: 982035 - protein, 46 aa, Homo sapiens
MTFCRYPRAVLGTQQFIALFLPQGWFRNLSRPAPVGLYPLDRCVGP

SEQ ID NO: 982036 - protein, 113 aa, Homo sapiens
ICHVPRECGDGLTLPSVIGQSRPWLAVAVNVVVHLDLLPFLGAAAQAGSCDGSSLVVCGSSFQSRVCPGMCSSYPSLEGVGVLCTHAIHGMLRLGGPFNASGPFNSSGPFNAS

SEQ ID NO: 982037 - protein, 93 aa, Homo sapiens
SGSPEALNGPGGFEWPGGQWPLITLHVYVLSHFHYFLSIGAVFAIIGRFISLISPILRLYPTSYLRQNPFHYPIHSAYICLSSHHTFSAIQRL

SEQ ID NO: 982038 - protein, 36 aa, Homo sapiens
QWWPGLRFPGHHLGSECTLMEPPILQTLELCARCVV

SEQ ID NO: 982039 - protein, 121 aa, Homo sapiens
NILPKILVSFTFFLRRSLAVAEAGVQWRNLGPLQPPPPGFKRFSCLSLLNSRDHRQAPPCPANFGIFSRDGVHHVGQVGLDLMTSWSARLGLPKCWDYMLEPPYPANISSFFFVLVQVWFV

SEQ ID NO: 982040 - protein, 119 aa, Homo sapiens
STGSPEALNGLPSWVWNLVGIHETTFNSIYEVDVNIRKDLFANTVSVWAALTMYPGIADRMHNEITALVPSTIKIKITRIPLANYSVWIGGSILASLSTFQKMWISKQEYDESGHSTPP

SEQ ID NO: 982041 - protein, 51 aa, Homo sapiens
SNEAIESLYEALYGDYFARTCDNVGMMHNDSIIHLAIIVIICRSPAVPGVH

SEQ ID NO: 982042 - protein, 89 aa, Homo sapiens
ALRRLMATQRLLPAAVLVEQAGGEMSFRARRAQMPLKRMMYSNRRFLGGSSSTSWFTLSVISASMALGALDGLCALLVVQGRARGHLLV

SEQ ID NO: 982043 - protein, 40 aa, Homo sapiens
QQSLATSRQAVQSANVYYYTNPTVSLALHGAFFPHGALGL

SEQ ID NO: 982044 - protein, 72 aa, Homo sapiens
LYRIPVSRLMSRQAVEWSTILHLLVFLPCSTVTYKNVKFTVWDVSSQDQIRPLCRHYYTGDPRFSFFVLNRP

SEQ ID NO: 982045 - protein, 75 aa, Homo sapiens
MNGLSRKSFCRHWANGEGTASEKPCHQQGCPGPPSYSSHSSLAAVLAGLKSKYRLQPGPGVFLTRFSEESRALLL

SEQ ID NO: 982046 - protein, 52 aa, Homo sapiens
LYTLRDLEPALRFVFCFGIHFWCSQTKAVLWYDLVLQFRPCTTSIRPFDASG

SEQ ID NO: 982047 - protein, 47 aa, Homo sapiens
VWCRSFHDWLLRFLEETIVHASLSPTVNDFVSTVQQTLSSLLLTIAD

SEQ ID NO: 982048 - protein, 70 aa, Homo sapiens
AYVTPQTGGKDITDEVITDIAGVIPAEENDGVLLPVRVALLDKLESCGHGFTSMRVMQQLSSSINSKMWW

SEQ ID NO: 982049 - protein, 33 aa, Homo sapiens
WLTRRVSQYMRRCMAICPCCLQEQTSGSLSEGL

SEQ ID NO: 982050 - protein, 159 aa, Homo sapiens
SPHHNTMHTTHTYHYTHTPLHTHYTHHYAHTTHTRHYTHHYTHSNTHHYAHTTTHTTHTTTLHTHHYAHYTYTPHTHTPQTQHLYTPCTTHIPHTVYTHNTHNTLHTHIYIPQVPTTHTDHTHISGIHLHTPHRIPTILICRTQLGFQGAWIVKYLMGV

SEQ ID NO: 982051 - protein, 69 aa, Homo sapiens
PGGLDGRKARDYERDLGDNTIQDNVPPILTLKAVMVGMKKLDMSHLEYTLRGAIQRLRAIQCLRAINAS

SEQ ID NO: 982052 - protein, 69 aa, Homo sapiens
TYIIAHECTSSLLFWAWRTLYYERTHRRIIILSQGHSNSTPTNSFLMTSSQPRYLAYCTPTPYHVAITG

SEQ ID NO: 982053 - protein, 60 aa, Homo sapiens
SLNGPGSSNCWLLQEGPIGNMPSPGPRDAFRPSPCAGLQHSQRPRVTRDSCASCTTVQYS

SEQ ID NO: 982054 - protein, 120 aa, Homo sapiens
IPVLLHKQDQTRDEGMKVKGDTNDGGYAQAGAGQKAIMSNFFNKMKLTRPGTVARACNPNYSGGGGKRIAGIREAEAAVSRDRATALQPGRHSDDSVQKKKKRNGVQKGKGRSLVCGGST

SEQ ID NO: 982055 - protein, 42 aa, Homo sapiens
TTQTDPVVYKTRSPIMGISVPVPSTTMMTFSTPSYLLVGGST

SEQ ID NO: 982056 - protein, 66 aa, Homo sapiens
LNGQPSPVLLDGPGLFPILRSSRIARFSLVPILRSPYNHPPGLSFNTASSLQSTRMPGGTQSRALT

SEQ ID NO: 982057 - protein, 124 aa, Homo sapiens
SLRLRLCHFRKEFLVEEEDEKVDIDLGLFEEFHDSHTLILELQEILIVKLKSLHVHTQELGIYFRLSCLISRRCCHSCRLDRIRGGKIFNFHQDTLFQELSSSVMKRRLLLPLPRTLGVGGQVV

SEQ ID NO: 982058 - protein, 126 aa, Homo sapiens
AVAAVTLQDPRSALTGMSVWAVKCSNVVVTAIRGAIILAKLSIVLDSQRLLGEQGSVSPYTVPCKVTGRCGSVLVRLIPAPPGALGIVSAPVPKKLLIMAGIDDCYTSARGCTATLGNFAKAIQRL

SEQ ID NO: 982059 - protein, 42 aa, Homo sapiens
MAYPGRQSLQYADERHGGSQSQEFESSLGYSSASRGTDARSS

SEQ ID NO: 982060 - protein, 147 aa, Homo sapiens
DAPSEEMSSIAFYRYRSSTMLIVTETPVLPRRPAVDRDWAVLGKLVLSLMHLANEVDEVLPLVWHTLFRPVCELELADSPGLDIPGICDLELSQDILRHSCILPSDLSQSTGSGAERSAGQYLVTLLPGHTPAGWYSINTIVEMFSP

SEQ ID NO: 982061 - protein, 80 aa, Homo sapiens
DPVGPRTVEDSTWFSWFPWLCVCVWRRPRPLDHLLELVVQDQPEGAPHAPQDVGPRTLEEGLAPLISEDLPPTVDGALAP

SEQ ID NO: 982062 - protein, 70 aa, Homo sapiens
RANAPCWATHRAVDTLFQRGFLGPLCVVGVSYTAQPKRSPQYGSMPVMPVILGRLCLFHRDVQSAHGALA

SEQ ID NO: 982063 - protein, 94 aa, Homo sapiens
NARVGPTHRGHSGLYIYNLYAPLCCTGCPAILGMRTDTVVVQDLGYIFTRLPLKRMWHQALLRSGDKVRIDPPCIRQHTAASTYLNNPYGALAL

SEQ ID NO: 982064 - protein, 54 aa, Homo sapiens
VHADAAVGLQDPRGAAHRVNLVEVEHQVQFTDTCGNIRLRPPRIVVKWPPGKTG

SEQ ID NO: 982065 - protein, 33 aa, Homo sapiens
MNVYEAGRMPPQKSKSNGNVERIEESALFTLNG

SEQ ID NO: 982066 - protein, 51 aa, Homo sapiens
DAVSERYCSITEREEVEMIRPPLVVAGNGDQEHALNLDTQGTLVLLKLLKL

SEQ ID NO: 982067 - protein, 84 aa, Homo sapiens
RFASFSSTIHLRGRYCCLVDYADSLLAAAVSSSSTLEQKAVGAGEVTKSAQKAQKARWNIILDTCHPILNQWWKNGLRTVCTFW

SEQ ID NO: 982068 - protein, 51 aa, Homo sapiens
DGHERSGQLGGQFQFFSITVSLLGGPEWLPGEEDEFGAVLLQSLSRWPFNA

SEQ ID NO: 982069 - protein, 82 aa, Homo sapiens
WPGSALNGQLGSSFHDGYADYLEEHIVSDLEHSEDLLHISKHFQLLDVVNQELPEASGQTCALFFVASINNVGHQDLALESS

SEQ ID NO: 982070 - protein, 34 aa, Homo sapiens
RHIELAGADEVGGLWRRLTFSSVDTHLRVWALTT

SEQ ID NO: 982071 - protein, 45 aa, Homo sapiens
VVVDRKAARMNSAMPVSRTSCCSSSRRPAPICKSLLPAINSIARV

SEQ ID NO: 982072 - protein, 68 aa, Homo sapiens
FDSIGTVRYVGLPAQQSRSSCRTQNFTRAGSKARQSYRSADIEPKADSSWREGDEVTLVCSADAHSTP

SEQ ID NO: 982073 - protein, 45 aa, Homo sapiens
VTPVRPYMSRIKRTGGKPRGIENRVRRIFKIWPCNLLRTLLSTPP

SEQ ID NO: 982074 - protein, 33 aa, Homo sapiens
MTAVAGSTARFSACWGGFAFQYNSSSVSIRPLH

SEQ ID NO: 982075 - protein, 35 aa, Homo sapiens
MLCCALRQSPVDSFPYSSSLSSWVGTREADVLGQA

SEQ ID NO: 982076 - protein, 74 aa, Homo sapiens
MIKEAPKRVIFISLVSLPVVVSENFGINVTLLDLYITGLHSRSLMKLSSSCPCCLFQLLALPDTVKSQAVRAHL

SEQ ID NO: 982077 - protein, 72 aa, Homo sapiens
MNTLMLHHTATWKLNNLHLTDSWANNEIQADIKKYYETNENKETMYQNLWDTEILLKQWYEGNLCPLNAIET

SEQ ID NO: 982078 - protein, 44 aa, Homo sapiens
LDLSEASWARTGSLYTGSEAEQAAVVQMCGHECKSEAFTLRVRA

SEQ ID NO: 982079 - protein, 54 aa, Homo sapiens
QSEDPNSHLKTLIRIVLYLTSVFQMRGESPVWYGFKRSLHQNIGLDAIETSKTR

SEQ ID NO: 982080 - protein, 36 aa, Homo sapiens
ASVVLTRKSCVVQTEAAGSWRRLIVSSLYTTLQVLG

SEQ ID NO: 982081 - protein, 125 aa, Homo sapiens
NSEAAALPVPPMMSDQLPLRSFTANSDYGTDEALNCCWNDGLLLSQSRQRIVWLISFVASVQVTTIDLSASLVLNTCIIHYRHQEFSHWLHLLALETQGSSSPVLKQRKKRTFPQILAPIIFSTS

SEQ ID NO: 982082 - protein, 51 aa, Homo sapiens
MWENSFTKSAICSPVSPYFTNQWPVLQLHLLVEGIHKPLIPHGKLQAMNAS

SEQ ID NO: 982083 - protein, 34 aa, Homo sapiens
TKHSSSSHIIATITLLNLYFYLRLLYTNPGHSTP

SEQ ID NO: 982084 - protein, 42 aa, Homo sapiens
LGWIQHSPLDTMMPFAAQVANSGLSDSLTTSTPRPSNGALAQ

SEQ ID NO: 982085 - protein, 55 aa, Homo sapiens
MASSHSGCWSGRINTYRAPSPRQAPVSLDAEGSESGQPATVDRAPGVESRPFNAS

SEQ ID NO: 982086 - protein, 39 aa, Homo sapiens
MPHPLEGRRVKMLPKSWTITVSFSYLKWLGTPPAHGALA

SEQ ID NO: 982087 - protein, 56 aa, Homo sapiens
RTRAGSVRSSSSRYHSFSRDAGTWGSSSACVAPSTGPPAASVFTSLNVPRNPLSAR

SEQ ID NO: 982088 - protein, 69 aa, Homo sapiens
ADRERAAGGGAELQWSERHLGGCSAPHCQLSSRLISHSQQQAPWLSSCCVCRPRSFCQALQTHIASSSD

SEQ ID NO: 982089 - protein, 50 aa, Homo sapiens
SSSSLTTESAMKKMKTQHTCVHCGCKAKQAPDEQAVKKLYDIDVAIHTPP

SEQ ID NO: 982090 - protein, 36 aa, Homo sapiens
MISSTGDTARLHLKQTNKKQNSNCTLNNSAWPGALL

SEQ ID NO: 982091 - protein, 144 aa, Homo sapiens
GESCTMSNSVLCTKHQSCGSVSCTNSAEILLVAYHREDVTTIGKSIGHIMEHGRGHIGNKSWPPQPAATSCSGPLPWCGSFVLLLFTINLATAHPLDVVPSLRAVTLTAKVRGFILEVSETTKPPKEPTPDTLCLYVIILPLKL

SEQ ID NO: 982092 - protein, 62 aa, Homo sapiens
RQEEVDADCYHHRWQGWAETKEAAGLGTVVREAWWCQAQPLAFTYLGTSRASSVTFSRYRRS

SEQ ID NO: 982093 - protein, 34 aa, Homo sapiens
MATPAFFFFFLGKGSGSAGQGRDVQGRIGLQWSV

SEQ ID NO: 982094 - protein, 30 aa, Homo sapiens
MPGLPQSHVTNPRKERTGVRGAQSTAEEQG

SEQ ID NO: 982095 - protein, 138 aa, Homo sapiens
ADILMVVFLFLPSVNNAPICGQQSSLPVQKDAMTGMACAVTSSSKPHVPVLNLDVSCKVHAVIGVLMDDRDPLVTVMNFEQAPRRPMQIWGGWTTKFRKSRYDGWVTISGFQFGLLWSHLGYLAGVRDVGLFINQTNS

SEQ ID NO: 982096 - protein, 40 aa, Homo sapiens
QSARTFSSICVTHRGPGPAQLQSPSLLQSEIQGSTDMCPS

SEQ ID NO: 982097 - protein, 58 aa, Homo sapiens
KDDSVNAVVRNEGALRQWCYIFYPRKLDSSYETYGIEGGFIITVRVEWLVEQGHSTPP

SEQ ID NO: 982098 - protein, 63 aa, Homo sapiens
MADESVVEIKLDLRLMTIIAVNGFWRKSGSRVQPENEGKSVNDASYDGQFSSYVIGHRPFNAS

SEQ ID NO: 982099 - protein, 44 aa, Homo sapiens
EVAHSQTARCATDPRKDTVDVETHFTFKDLHFKMLDERVVSGLE

SEQ ID NO: 982100 - protein, 37 aa, Homo sapiens
MHKCLEEACSDVHIVVTYLFCGFVATIGKTFQIIPQA

SEQ ID NO: 982101 - protein, 46 aa, Homo sapiens
SFKPRGTRKTYPPVALAGQYNTEGIVRAMLMFRTNRVKTKITSKRQ

SEQ ID NO: 982102 - protein, 35 aa, Homo sapiens
VRSISSTCERITPVTSGPWELNEGIIGQTGPRMDE

SEQ ID NO: 982103 - protein, 64 aa, Homo sapiens
SAHETLDMNESIQITHPSIRGRTHGLNWVLEVAGRAMAGTSELPTRLWHVAAPDPGPPEWKSPS

SEQ ID NO: 982104 - protein, 39 aa, Homo sapiens
ADHDVTLIVITFFILLLLSTHVSSSPSSSSSSSSSSSTT

SEQ ID NO: 982105 - protein, 40 aa, Homo sapiens
PDARSGAVISRNFLPTLMRVGEQCGHQPLFIFMYIHLVKK

SEQ ID NO: 982106 - protein, 37 aa, Homo sapiens
SDHMIVHAPFLLPLGAAPLTSCAVCSDQILNYSNKAG

SEQ ID NO: 982107 - protein, 39 aa, Homo sapiens
LDHMMLTLELMRARKRHIWKVVRLGFSLSIPLISSVLSG

SEQ ID NO: 982108 - protein, 56 aa, Homo sapiens
MHRGKQLCSFIMYTGTLDCWRKIARDEGGKAFFNGALPNRCVGQHGALAQHGALDQ

SEQ ID NO: 982109 - protein, 38 aa, Homo sapiens
GSLTWGGVKEAYVEVEVKEGAWPHGALANTVRWPNTVR

SEQ ID NO: 982110 - protein, 47 aa, Homo sapiens
EDTAAVRASLLEARERPYVGRLLQVEDGVRNRGLPQHTRCVGPTGIL

SEQ ID NO: 982111 - protein, 50 aa, Homo sapiens
EEESYSDDDRSSHIDVELHIIEPGAGADLIKQATTYGMADGDFVQDAPEM

SEQ ID NO: 982112 - protein, 34 aa, Homo sapiens
TVSTSHGSPSAARWREPAGYLQLGIIEIEPAVLY

SEQ ID NO: 982113 - protein, 63 aa, Homo sapiens
YVEWPSMSGSMAWDRLRICSHGGWTRNFPNVTTQARAQPSQQRSSNNPRSQRTPTLTKPMREN

SEQ ID NO: 982114 - protein, 58 aa, Homo sapiens
MWIYAGKAISGVPIIRGTSQLAKASDYDGYYYEEDSYKCMGCDDNVVDCWLATYTGAR

SEQ ID NO: 982115 - protein, 51 aa, Homo sapiens
DFENDCAGKASGVLDENGCEQLGLCCLIEEYAMSDFSSCIAVMPDKPLGRS

SEQ ID NO: 982116 - protein, 77 aa, Homo sapiens
TRPRVSKGTPVQSAHNRSRTHVLITILPSKLKLRTHSQWLHNPLSGTSNSTPTNSLVITSSKPRYLAYFTPTPPLGR

SEQ ID NO: 982117 - protein, 82 aa, Homo sapiens
TVAGCEQRLLVERMARENVEPGHKRFARSLGPVLGMHHEEHVRDTSAEVGAIRVDGVCDEWGVYTSMRLWAVELHHGFTWDV

SEQ ID NO: 982118 - protein, 51 aa, Homo sapiens
MRHHWLDNPEKNGNTVKMVSPKKEVALAYQEAMYNMATLTSTAAGLMHTFN

SEQ ID NO: 982119 - protein, 36 aa, Homo sapiens
GRLVPGSDDRRILGTHRVMRLKVSINPVGLLPISSV

SEQ ID NO: 982120 - protein, 38 aa, Homo sapiens
MLFPIFGSTLKLERGVENPFALCADERQKTTSSNPCHN

SEQ ID NO: 982121 - protein, 67 aa, Homo sapiens
DETANTGNRNNTDVKPIYEENSLNCSAYIHVYVYAKINAIQAVTECTENMYIFLRYLHSSVQLHLRL

SEQ ID NO: 982122 - protein, 32 aa, Homo sapiens
MDTKSYEILFSIYRAIINSSLLIEAANEGSCT

SEQ ID NO: 982123 - protein, 83 aa, Homo sapiens
RRSHKQESHRVDKVDDAEDEKYCAETGAHASEGEHRRSLQSDAEEEVPLYNLTTCKTSGDSKVCILRSLVLEEVERNTQIHCW

SEQ ID NO: 982124 - protein, 34 aa, Homo sapiens
CSTGFLAAPLYRGSEFLFAFYLWYCPDSPCDSST

SEQ ID NO: 982125 - protein, 57 aa, Homo sapiens
GADISTATGSRHLVFIRGSRPAMVATSFILDDYFSRTKSWLHESQNLEGSQPALVLS

SEQ ID NO: 982126 - protein, 49 aa, Homo sapiens
VLRPLIRRRLLRLLRGLSTGEYTRSLFQVVTIALVVSWIAAVLFIPYLG

SEQ ID NO: 982127 - protein, 72 aa, Homo sapiens
ICRFGRSRHRTAVLGRIPSPEELDYLCRRRICRLRKRGRRGLSRVCHKRINPLRPLFQCRSVLRHADCPRLH

SEQ ID NO: 982128 - protein, 89 aa, Homo sapiens
MVRTQVGTLLAKEGASLLGSLGFNYIDWSGKTKDLRYVSPYLGNALLLDDHGPYVHPGQEHLWVEIPLFGSPYPPDDDGLEVASRLIRA

SEQ ID NO: 982129 - protein, 81 aa, Homo sapiens
WLISPGLADFWHFQLDSSIMNSWGGAADEQLRAAVRTDFGQVAAHAVTSAQHVARKALVLRNEAFGLPPDVDIDVAALGGA

SEQ ID NO: 982130 - protein, 46 aa, Homo sapiens
PSGIGACTVSRRIPVTIGDAHPLQRWRISASGPVARRTVRRLEIAL

SEQ ID NO: 982131 - protein, 49 aa, Homo sapiens
QLGQIVMVLIVTAVMAQIPPRVYESWAPYLYIFCVILLILVDAFGQISK

SEQ ID NO: 982132 - protein, 39 aa, Homo sapiens
GYTGLDGVLTPWWTWGHATAGLQTLTYCPDKWHPSSNFS

SEQ ID NO: 982133 - protein, 65 aa, Homo sapiens
MGRLLKDGFLAFQTSRYKLHYYETPTGINICHEYLSPHGQIARIEFKYNIKYAWTSRANSKSAHV

SEQ ID NO: 982134 - protein, 55 aa, Homo sapiens
KEGEEEKVAKRKAAVLSDSEDKRKHQQRRVVLSLMQIAMVFSLLPDLSDTASLSE

SEQ ID NO: 982135 - protein, 33 aa, Homo sapiens
RAPVLAGLRFSLGIVFYPGTVFPWPPFFPGDPF

SEQ ID NO: 982136 - protein, 142 aa, Homo sapiens
RTTRSSYNSSVTTATWTTMDTKARLADLESRAKALNVPVGSDPDDELERQIASGYSSLRGTVERAIREVFLNNTVQPFSDVVSVEAFGAVIGHPAEEWEQLLAVYARACEATEAHDTPGERQLPLSAREELLGDIAQVLELI

SEQ ID NO: 982137 - protein, 144 aa, Homo sapiens
ELGFPPVTTAQQLVGDLRLADSTVKFGDSDAFYQLDLKSLSGQGTFVMGTDFAQGLADFLNITGDATGHHDLLLTSSGTEPVNPGDVHIVHTGGGDAQFALVGGNVDVEAWSYGLQQDGNDSVLDPNNRTDSPGTRSVLALFNT

SEQ ID NO: 982138 - protein, 48 aa, Homo sapiens
MCIGLTSCPHSFARFPLAAHSQQRWLGPCQVSQRALLLGQVVLAQTLL

SEQ ID NO: 982139 - protein, 39 aa, Homo sapiens
MIPSAIIGTSLFIGTYAIHRHLAYYIRHTSRTIISAPFD

SEQ ID NO: 982140 - protein, 35 aa, Homo sapiens
TSGRGPYVLPRSSSHLGYYGGAHDSVSTTLRSLGS

SEQ ID NO: 982141 - protein, 65 aa, Homo sapiens
RRHTYNFKDLHFKMFEVGGSAALRRKKWIHMLEGVTDIIYCVALSAYDLVLAELTRTMNRMPDEH

SEQ ID NO: 982142 - protein, 49 aa, Homo sapiens
YVLHKQQHVRMTRVKTTGIEETHFTIKDLHLQECEDVGLVSWSDAEDSG

SEQ ID NO: 982143 - protein, 55 aa, Homo sapiens
VIYRCLCYSTNRGQKKGTDFIGEKTKFQTYCVRYWKRRSMCYYEEGTMPILPSYT

SEQ ID NO: 982144 - protein, 37 aa, Homo sapiens
SYLIPTITHNPTITLINLYFYLRLFYTNPVSVVCCNV

SEQ ID NO: 982145 - protein, 36 aa, Homo sapiens
VLTSTITKVSMSSTVQAATSLREGGLAALIVGGIVG

SEQ ID NO: 982146 - protein, 51 aa, Homo sapiens
RYSSAPPGHRDFIKNMITGTSQADCAVLIVAAGANNSELFIGTHISDRGVV

SEQ ID NO: 982147 - protein, 98 aa, Homo sapiens
NALIAQSVITQDNSYYYEHLINAQEMNSVWTILHAIILFLIALPSLRILYITDEVNDPSLTIKSMEHQWYVDTYEYTENGGLIYNSYILPPLLPRTRR

SEQ ID NO: 982148 - protein, 39 aa, Homo sapiens
TVCYSSAPRLFIGTSLFIWHLAIHRPLAIHLAPDLPSNG

SEQ ID NO: 982149 - protein, 50 aa, Homo sapiens
MTNISDAQRHINRLNYLTGIILILIALPSLRILYITDEVNDPSLTIKSIG

SEQ ID NO: 982150 - protein, 95 aa, Homo sapiens
QSDWRVSYTHDRTISVVTILDAQAIDTVCPILPAILPVLIALPSLRILYIHRRGQRSLPYHQITLATNGTEPTRYTDYGGLIFTSYILPPLFLEP

SEQ ID NO: 982151 - protein, 88 aa, Homo sapiens
MHSIVSLCFMTGHMISLEQNGGHSVFEQLIVRIPSNILLPEDKCQETPYSEEDFQHLQKEIEQLQEKYKTELCTKQALLAELEEQKIV

SEQ ID NO: 982152 - protein, 39 aa, Homo sapiens
RIPYKYTITGKAPKQPVIVKAKFLQQKAEAKIKSDSWVG

SEQ ID NO: 982153 - protein, 39 aa, Homo sapiens
MSNDHSQTHITLLNLYFYLRLFYTNPEIVVVVNPTITNR

SEQ ID NO: 982154 - protein, 72 aa, Homo sapiens
GAETAGEPYHVQVCHEERGTTAPVPEATICWVIVGLYYNPTITPTPASEVTSPTLTLLPPSVTDPCESIVAP

SEQ ID NO: 982155 - protein, 34 aa, Homo sapiens
MSSDHMIDHRSIAKCSDIIIYIVTIYLALTSGAV

SEQ ID NO: 982156 - protein, 34 aa, Homo sapiens
MPTLNSNSTYAYFSTNPHSIVVVVSIQLTGYARL

SEQ ID NO: 982157 - protein, 36 aa, Homo sapiens
MLTAPTVARLDDRWYTTGGTDDVTASSASVPCAPVW

SEQ ID NO: 982158 - protein, 71 aa, Homo sapiens
MSREMKKGMWEQMKKKKQQRNLQLKKMNGKLYSHHWDPVWRGNVKFTSFLLGRDWFGMPPNPRSPRPLVSV

SEQ ID NO: 982159 - protein, 45 aa, Homo sapiens
DHQRIMWASRAQAFTASHTKVLDPWNHFIALYVLSTTLPLDYHRD

SEQ ID NO: 982160 - protein, 35 aa, Homo sapiens
ENGAEEEEEETAEDGERDPSPGSLELQDPRGGVSL

SEQ ID NO: 982161 - protein, 54 aa, Homo sapiens
NDHKDTSLKGVDPKFLRIMRFAHEAQIKTGPRDMIRPNNAKAMECTCARAIKVP

SEQ ID NO: 982162 - protein, 53 aa, Homo sapiens
MIVHAPGALESSLLSHLVGSQGPGATGCNVHSGYCVWHYSGQEKPKYGDGGGY

SEQ ID NO: 982163 - protein, 96 aa, Homo sapiens
LALPGVLCDRQILECTESHWSISPDGGFGHIFFLLFTGPSDYRYYPQQSFQTPQQPSFLFQDPRVSWSLVYLPTLPSCWNYGFSCSSDVCLPLWLR

SEQ ID NO: 982164 - protein, 53 aa, Homo sapiens
MSLWESLEFLSFLAEKPLESVVRSEVIFGILTKRSGFSDWFPETASRSHGEGC

SEQ ID NO: 982165 - protein, 102 aa, Homo sapiens
DKEEDRSSGDLRIQDLIHGIYESCLIQKISMLWDPYTVIWQSQNYKENNNRAEPKLNTKPFTTALSQDSMLYHLTEHIASQAAAGSSLANNPADGDSRQGDG

SEQ ID NO: 982166 - protein, 45 aa, Homo sapiens
EDTAHRLRLAASRVAHGRPGPPPLSPVTTAYSVGNGLLERMEQLM

SEQ ID NO: 982167 - protein, 75 aa, Homo sapiens
SRLTENKTQTYSTNIYTNNNPELTCEDETVPGATEKLKKLGESDFHIHDSPSSYSAQHQVYGKSPLNSGLLHGKK

SEQ ID NO: 982168 - protein, 40 aa, Homo sapiens
TVSEMRTVLQGTARLRRHSKTKTQAPLIENRHQMAIHQHK

SEQ ID NO: 982169 - protein, 42 aa, Homo sapiens
SGSEDPDDGHGQRGYRARAVPKKNNKKKKFLKRMVMHGQIVG

SEQ ID NO: 982170 - protein, 42 aa, Homo sapiens
SILTNYIIKTGCSKLRSHSEVMGAHEFEGPFVCCREPCCSPA

SEQ ID NO: 982171 - protein, 96 aa, Homo sapiens
MISLDLQPGKVKSAAERLKGSMPPSEIISPEKQQPFQNLLQEYFTSLTKHLKRDHRELQTPERHNRRILHSKGALSEDRHKQYEEFAMSYQKLLAP

SEQ ID NO: 982172 - protein, 103 aa, Homo sapiens
RRDAPDTMPMDVVGRMESEKQTLSQVSQITLRHCYMGWAWESDGKCAAFQGNNALGYWAIADISQNTYFVKGAQQLVRAALYVSWLMDQSKQIKLDHLLMPKV

SEQ ID NO: 982173 - protein, 138 aa, Homo sapiens
MVGGPIEQRRPKPYRGQIHQASVQVARLKLGHAYGGDFQEGESERLKLDKEVGVDLEEWGWRELASLLAVPLGFISFLFFFFFLEKDSQGAAKAEVQGHKVGPGHPRSRGIKEDLGPLCQVRKRALEAGKGHKKGTSQ

SEQ ID NO: 982174 - protein, 55 aa, Homo sapiens
GQHKRDFGGGVQSELGDFSDLATISSGVLEPSSSTAGPVLKDLDGGVATHIKPAG

SEQ ID NO: 982175 - protein, 49 aa, Homo sapiens
VTWPGLIPGSCMGVKQHRPDTDYGIGSQKCHLSTSEWLADTVRVPTLTS

SEQ ID NO: 982176 - protein, 57 aa, Homo sapiens
VGAWTGYSKGNSSVMLLGEPRHASCPWGLADVPVLLGHTGLSGVHAGLTSLHVAELT

SEQ ID NO: 982177 - protein, 86 aa, Homo sapiens
YCLRFWSSRMDVFGKMTGVLPFAILRQSYCSLCRFLWDRLNKMIRMINASSSTAITAPTIPYTRLGAMLNSQVSPQYQCVFVFGHR

SEQ ID NO: 982178 - protein, 67 aa, Homo sapiens
CVEPTAVVSGGQKELVAASKIPGDKRHVWFGEKLTDGFQFESGGQGSEPADVAIQLTFLRLMSSEGS

SEQ ID NO: 982179 - protein, 36 aa, Homo sapiens
LRAHLLFFIAGQAYRCRLVVRRETRCSGALLEQGLQ

SEQ ID NO: 982180 - protein, 99 aa, Homo sapiens
ICVGVAILVGMLNGFLNVVHYFNANSRSPYSGRNDFTSGGAEGSDYEAKYEGLHDLSPDPLSAYSLIWSTYGVLSTIPVDPPSLQSITGSCILTFRASD

SEQ ID NO: 982181 - protein, 65 aa, Homo sapiens
GRWSVDEHIGRSEPWAHSQNWNPSVMRSPNQTCLLSLRVLADVPVLLRPHWADVGYAQVSPVSMW

SEQ ID NO: 982182 - protein, 77 aa, Homo sapiens
RDVEGALNTTLKERGVRGEPMKVSRKVSEHDLIEEDPSVGDKLHHRRQGEKAITQQKRAVDWVTKISEGARSQCYRN

SEQ ID NO: 982183 - protein, 85 aa, Homo sapiens
ERVPGSKVVLDTRKCSRLQDDIVLDHDATVEQSRGCSPLYTEEDVALQNDIHPILEEGTEVLVFLGGCVIHLFCEISVSHFRCHT

SEQ ID NO: 982184 - protein, 86 aa, Homo sapiens
MDQVMQFVEPRRHFVKDSIRLVNTDALNLIEKQFQQDCPWLTANRDLLIMRHSIGLRFVHIDRVFLIQSTSICCVGQQSPFLGKQQ

SEQ ID NO: 982185 - protein, 61 aa, Homo sapiens
MLRVLAYYGVDWVGSHGSRNAVMSEPSRPLVQDSIRLVKRCTKPDRNDFQKIAMATSTRIC

SEQ ID NO: 982186 - protein, 46 aa, Homo sapiens
LGRSRGSQQVSSSTLGSEVIRGGRQMEFLGYHGVEVAGMPEELTGW

SEQ ID NO: 982187 - protein, 52 aa, Homo sapiens
SNGSQQQHTTFHEGLQRLTRQAWAWTLGAVASPARGDDPKGFVFALQPSVRI

SEQ ID NO: 982188 - protein, 39 aa, Homo sapiens
MIPGCSKSVLLVGSRMDMSSNNGCMRDPTLYRWKIQPHP

SEQ ID NO: 982189 - protein, 53 aa, Homo sapiens
MEAEATSDTLRPQNALKNQQETPEHTTSPSFRLAPPLRPAPGRRPPPAPNPCP

SEQ ID NO: 982190 - protein, 38 aa, Homo sapiens
MASKQNKIPQESTLTRRCDRTSFKAELQTTASTIKRGH

SEQ ID NO: 982191 - protein, 30 aa, Homo sapiens
MDGGLGHRLACGGSTRISAIHLQCPSAITS

SEQ ID NO: 982192 - protein, 70 aa, Homo sapiens
GVLAERIQDAASQCSGQPLRQSHGTGSSPRQFQFRAAVATPGAPASRAPYSSPGSTAHLPRDHGDDTNTG

SEQ ID NO: 982193 - protein, 49 aa, Homo sapiens
AALDGLERVGPRGVMIPQELCEEHLPGVKNYFDFCLECDDRGPVLCETY

SEQ ID NO: 982194 - protein, 70 aa, Homo sapiens
ALEVPEEPSHPRPSGTGGFALQPHGPIPVGEAGELCPLGLGSAPPNPAVVSLDSAPAVFPTARGPTSREV

SEQ ID NO: 982195 - protein, 36 aa, Homo sapiens
AALEDLERWDTGLKRDPSSQIAGGAGASSPFCSPPV

SEQ ID NO: 982196 - protein, 95 aa, Homo sapiens
SARSSLFDSGTGGSLIDQAPSYRVYGGQHGAHVSTKLVQGGMHRSGEYTSTRIHVCNIVDVNTDLIYSRNLYRNVCIGSGEYTSSWRHACVLGYW

SEQ ID NO: 982197 - protein, 42 aa, Homo sapiens
FVSQRLNDLRDLSTERSNPGRIYLLQIPPMYERTMRNKAYYH

SEQ ID NO: 982198 - protein, 104 aa, Homo sapiens
MSFVLESSLNPTTSFTNSFLTGTSRMKSEPDKADPFSFEGPEIVDCDGCTIDWKKGKNVTVKTIKKKQKHKGRGTVRTITKQVPNESFFNFFNPLKASGDGESL

SEQ ID NO: 982199 - protein, 65 aa, Homo sapiens
MQAKSVLSVDFYNKLSHTGCLKKYTLISPGLEAGKFKIKVLADWVSGESQPPGLQMATFQVYHHI

SEQ ID NO: 982200 - protein, 113 aa, Homo sapiens
MYTCMSLFKCNFYFSLERLYVYLCCSSTLMPMTSFTNSFLIGNSLVKSEPDKADPFSFEGPEIVDCDGCTIDWKKGKNVTVKTIKKKRKHKGRGTVRTITKQVPNESFFNFFN

SEQ ID NO: 982201 - protein, 69 aa, Homo sapiens
SDILVGYNTSGGQFDLMVRDGSMTSSVMYRMRKDGRAMRTQDDGGQDSSNTVFHFLSVLSMFSHRSVML

SEQ ID NO: 982202 - protein, 140 aa, Homo sapiens
RFSLDINWYRKKLQQLKSIILSYLLGAAEHFPYLISPLNQEWQSSTFGSAVLIFKLPVSWTSPSLPRGSQTFYEATGEIYLLHSNHSPLEPNHFGWAHKNDGGEGCGSGYALSPSDWVKRRMMLVPLLCPRHQTLASGHD

SEQ ID NO: 982203 - protein, 72 aa, Homo sapiens
IIQDCSIKCQNVEVRPTETVSRNPLLNAHQTTSVSRRQKAYKPEESGGQYSTFLPKRISTQNFISSQTKLHK

SEQ ID NO: 982204 - protein, 75 aa, Homo sapiens
KDMALIYKQYRIQMVFNGGSEAVPYFQLQLDASPDGDCPLVSMVTNFNGDQHYGRNFLALETGQRKQKFWILVLV

SEQ ID NO: 982205 - protein, 34 aa, Homo sapiens
MTSEIHFPWAACTVMSYILFPGLAVPVTFINFRG

SEQ ID NO: 982206 - protein, 34 aa, Homo sapiens
MGFTSSSARLYGQDQMGLGQAACGRALGLEQPSE

SEQ ID NO: 982207 - protein, 44 aa, Homo sapiens
MLNRKNTHKISKYGNNGKTNEINYAWYTQGYQEEIKKEKSGVPE

SEQ ID NO: 982208 - protein, 42 aa, Homo sapiens
VPQLDQFTEHFNNMSYWVRSIIMLHGKWPSDWGTVLLGMFIN

SEQ ID NO: 982209 - protein, 38 aa, Homo sapiens
MRAWRSTCIHLLRCYASLYKSGRHVSTVLTSKYRKAGA

SEQ ID NO: 982210 - protein, 121 aa, Homo sapiens
VPDLEHTVRSAPREHCVLIYSATGATQLAGDMGTLPGVPNPPLSTHPPALLQTGGVTAYAKGRDYCDLCAWPGCMDCSVLHHVALAMAASQTFLWILLPGCVTGQTLTLSEQGHRERLCVV

SEQ ID NO: 982211 - protein, 102 aa, Homo sapiens
GCRSPETNIIIVMDVAALYSGAIPGIAIDGMSHWWRKPYKCKECGKTSSQESSLTCHRRLHTEVNGDNGNGVWARILGQIPALLFGEGNGSREKFLTGVWMW

SEQ ID NO: 982212 - protein, 69 aa, Homo sapiens
CHFFTGLILESSLIWVNHYWFPNLVFKLADDWKIKPLLGSNLIWKLEWFLPELQTIQSMQSKQECGISR

SEQ ID NO: 982213 - protein, 103 aa, Homo sapiens
GKDDFILAEKETTSVPMRINHLSTATRNSIPHGVDLQYASHRVQIDYQTTGILKKKSECGAENELKGLEPENCAMHNSIILVTDPQAFTNTHCAALVFIIIAY

SEQ ID NO: 982214 - protein, 79 aa, Homo sapiens
SIPIQSNRRCNLTGNPHTATISTSMEDAGIPQPVTPQSYLEKGLDEVGIGFGSIRFTEVNQGVPSILAAGVPSGGLYTG

SEQ ID NO: 982215 - protein, 41 aa, Homo sapiens
RIREGGTLGWPRSEGLGPPRAASEQWKSPAPNPARWGGPDM

SEQ ID NO: 982216 - protein, 110 aa, Homo sapiens
DDILIRNTRARSPSTQCPGLTHSRWANWCSEHELPAIGAHSSLMLTNLHALLQTGGVTPMPKVVTTKILAPGLAAWTVVCAPCGPGHGCIPGLPVDPAPRLCHWADAHPL

SEQ ID NO: 982217 - protein, 109 aa, Homo sapiens
VVLSEDPRGGTRALGEPPSREASTTTSQATACLSTPLCPATRAVASVLRGSLPCPHRPPPPPLHSCCYPCVPRAGSTWGPIPPAVMVEAGGGHGLPPSCQGHRTRGPTS

SEQ ID NO: 982218 - protein, 177 aa, Homo sapiens
ADVTDLDDSSGPSKGHSKMTAYLGLYAISGKELVQTDATVILDSLYVIDEFNAVDFKMDTHSFINTEMDDNYAGFFFGYQSSSRLYVVMWKPVAQPYWDTNPTRAQGYSGLSVKVVNSTTGPGEHLRNALWHTGNTPGQVRTLWHDPRHIGWKDFTAYRWRLSHRPKTGFIRVVMYE

SEQ ID NO: 982219 - protein, 48 aa, Homo sapiens
MIAKCRTAKVRGKRGKPSHRPTEPDAELLHPRRSRAPQQSDEEVLGEE

SEQ ID NO: 982220 - protein, 41 aa, Homo sapiens
DLEDPMACSEECRFWKKIEEGIELVKHFLVERGVMDEYLQV

SEQ ID NO: 982221 - protein, 37 aa, Homo sapiens
SQYKMDVTVIDTKIFRFYFKDSSSRRITYSSVISCIW

SEQ ID NO: 982222 - protein, 77 aa, Homo sapiens
YSGSRIKAQPVVTSWHGYEVSELDARVKRGTQSYAGCASVRDILSEEGKGAQALDLGPGLGSDMYGMRSVLSFEAWG

SEQ ID NO: 982223 - protein, 98 aa, Homo sapiens
MAWFYFLYPDWPSYYSQCGGSGWLQSRSGSQAETLDWGSHEAKHLHSKGFLVFAGCLMKDKGHDGVKELDSLNSDRLRTVQLNVCSSEEVEKVVGQNI

SEQ ID NO: 982224 - protein, 62 aa, Homo sapiens
RPCGAELGRLPQRSGSHSSGDGLEVGLSNWRFRYVTVSLYALTISSAVLMYSGAGGTGARNS

SEQ ID NO: 982225 - protein, 40 aa, Homo sapiens
DPMGCGEEHIDSKVIGEGYLYQGKRKTEEGEAAILRYLTK

SEQ ID NO: 982226 - protein, 78 aa, Homo sapiens
RTFSSQYGAHMMLSISRGTQSCGVGVMSSSISSPAATSIKSSLPNSPRMCQGQASSGDSSSNIPFVVHKHSAYRVRSA

SEQ ID NO: 982227 - protein, 39 aa, Homo sapiens
VRDFDSELLSVLVSCLQELFKAHLRGEVLPEEITEESRG

SEQ ID NO: 982228 - protein, 67 aa, Homo sapiens
VGTCAYFVAFIRVSLKMAVYEAEQEVVTLIGVYRITEQAPLQGYEAPPGPLSIKLAALVTVLGEQFT

SEQ ID NO: 982229 - protein, 35 aa, Homo sapiens
CIQVSAGRGDIFPLQVGQNIIGWTLIFPLQVGQNI

SEQ ID NO: 982230 - protein, 76 aa, Homo sapiens
TFYPREELFQRHRFAKEPAAQHLLGEARFRRTAAFAFGLQHEDVTGAELTLIAQDCQRVELRRRREGQQEIDGYRA

SEQ ID NO: 982231 - protein, 39 aa, Homo sapiens
YGQCYRRHRWRVQWIVDAYTTSTATRTPPRRSCSEATCW

SEQ ID NO: 982232 - protein, 46 aa, Homo sapiens
YPQQASVVFESPFTICDGIYGSTCRGSHRLPRTSRHDGLNCPHYMP

SEQ ID NO: 982233 - protein, 36 aa, Homo sapiens
IHPPQSLRAGAITGDEQRLPGPDLCLTLPDTPYSYT

SEQ ID NO: 982234 - protein, 56 aa, Homo sapiens
EPGSHLSRVRDSSVVPPTGSAQQLDWSSPQTTRLSLLAQFEGWHPDILALLHASNE

SEQ ID NO: 982235 - protein, 137 aa, Homo sapiens
PFTARWSGVGVDKPRLASYPLRYMRGVADAFARGDLAHEVWVYRQDRVAEQLVNGRFLPPFASNCRSRETVAGFPGCGVGLCGALCLFLEVGEFLSVAADAWLVEMSTTTLAMQADEYLHQMPKNLHYHTYDKKLRH

SEQ ID NO: 982236 - protein, 46 aa, Homo sapiens
MPTWALIEDFTTHNSLIIPNIIATITLINLNSTYAYFTPTPVPMNS

SEQ ID NO: 982237 - protein, 90 aa, Homo sapiens
IYTNPARRAPGQWQAICTTRVLDAQPGRTRRPRDMQNEGYMMSDSVDVYVVPVLQHGLPSRQYRTSMDGGLLPELLCQVVEPLQPADLIQ

SEQ ID NO: 982238 - protein, 36 aa, Homo sapiens
VIQLGGDDGGDVVVMVVVVMIVMTVMVMMMMVPINS

SEQ ID NO: 982239 - protein, 69 aa, Homo sapiens
KKLFTETPNLSETYLLMRIPVPVERSKISSLIQTHSAAIQVQNPPDKPTYAQISNFNSQPEAVKVQAFR

SEQ ID NO: 982240 - protein, 32 aa, Homo sapiens
MCLSAQTPLQESRAHQRHVAAVAENCPEMKKG

SEQ ID NO: 982241 - protein, 64 aa, Homo sapiens
EASSLESCLQRNVWSLLSIMYAQKLFIYYWGMLLQHADFTLCNPEEEGSVATEQYPGDPCCMFW

SEQ ID NO: 982242 - protein, 46 aa, Homo sapiens
SEWDTGRAVTMGELQEGGGGPEALAVCEDKQWVTPSRPYCPSLHQC

SEQ ID NO: 982243 - protein, 46 aa, Homo sapiens
GDSPARRIDASAIADSDDLVPCAPAVVACSSPAVIVASSSLVVPPL

SEQ ID NO: 982244 - protein, 42 aa, Homo sapiens
MALAIHRHFAIHRHLAIHRHLAIIGPYRTLSRPCNWNESTLN

SEQ ID NO: 982245 - protein, 42 aa, Homo sapiens
EDAVGDCAEDEVGGGLVMLTVPSDQAEEEARSHKGVATCLGC

SEQ ID NO: 982246 - protein, 89 aa, Homo sapiens
VLEVPGARVMGLVPPARPPSLCACGTPNIMNVCCLLVSSWQHAGCMLLNAACSSTMWQHASTWALPLPTPCAPVVPPSRCTYALTSVII

SEQ ID NO: 982247 - protein, 77 aa, Homo sapiens
WVDWGLDSASFCSASKDGPKHCHFSNIKMLNDMGPVQWYLSIQNIQVQILLTEPEDGVFIFIHPRGESARGEQHRQW

SEQ ID NO: 982248 - protein, 57 aa, Homo sapiens
SFHRHAKHIIHKRLSPIYYSHRYLPDKRLFYTNPGADEERSADEERGAANSEVPMNS

SEQ ID NO: 982249 - protein, 40 aa, Homo sapiens
GRTAIHRHSLFIPTIIATSPSLTSTSTYAYITPTPVPMNS

SEQ ID NO: 982250 - protein, 36 aa, Homo sapiens
MDPCEKMLCPKYCPGKNMQKEVNITGIQFLGVRYFN

SEQ ID NO: 982251 - protein, 116 aa, Homo sapiens
IYVFIYGVLVGLSNQYRPDISPTERTHNVIADVNKMLSMREVVIQEVDQVDRKRMIWQVHCVRDGLHLNSHFENGPILSRIEWAARDVPSGSVHSGITGTGCIVSNQNLIIPCQPF

SEQ ID NO: 982252 - protein, 35 aa, Homo sapiens
DFAIHRHLAIHRHWVVIHWIQDLLQWITTQVPMNS

SEQ ID NO: 982253 - protein, 87 aa, Homo sapiens
RGATRVERCDHCGEMVGPRGEVGPRGGVRMLVGDSVPLLVLLLKAFFALSTLLLAPLVVGGVLLLAAWIVSADLASPSQVVPEHRIS

SEQ ID NO: 982254 - protein, 106 aa, Homo sapiens
EIDNIKNHACKLEAAIAEAVRSVWSWRLKDARAKQEELETALQRGMQDIARSPAEYQEIMIVMLTLYLEIATYRKLLEGEESRLAGDGVGAVNISVMNSTGGSEHK

SEQ ID NO: 982255 - protein, 145 aa, Homo sapiens
MTHIQQVLVIMILILSSFFFSTHQLFAFFPPSLISGIKGQQTWRKGMQIVPYTYWEPHQREDCRRQMIDVYMALGQGLAAGEGRCAGLSCCADNHSGDLRAALRGTRRGRRHSSCVSLGPFLDPSRQIMGPQRELLLNSAVTWCG

SEQ ID NO: 982256 - protein, 95 aa, Homo sapiens
MFISYHKGLQQTYELKKHAFSNPNMDILYTKPSGSFYQIAFRVFECPPDTSPGGHRENNILSVNIERLVLDTLNNGHKCIPDIPRHLLLGGSEHK

SEQ ID NO: 982257 - protein, 124 aa, Homo sapiens
MVRTHRTFAESPRGCRVQIPGERLLVQAAVISKATQVILSDAGREGVLMWWVPGRRTRGSFLSSWSLEGQGSERHSSTPTTQQLLSLPLPIPGCEAHLIRGGQRLQRWEDHMSLGGRGCRGGRI

SEQ ID NO: 982258 - protein, 137 aa, Homo sapiens
MTPVLDRFPEHLQIIQIARISSEGIGDYPGTTYRTASEFYGPENICVTERQRSRKGRGKEDWQNRWQGMPLFFIKLSKVQLNAMYSDTSTRSFIETTIKQSREVNTVTLTVYICFLKLPVSLFAHLIYIPVVPLSPS

SEQ ID NO: 982259 - protein, 67 aa, Homo sapiens
ETMNYGPEQGLNHIAPYVTSSLCEDGHDNYGQCRTLATVPWGFPKAPRMPVWSLSDPAKDNIYVDSG

SEQ ID NO: 982260 - protein, 109 aa, Homo sapiens
MEYVAWSMDHTIFDLSNHVTDFLFWIIQILIEFSSHNMNITSQILDHSHNPFPGAKVSCAENVLNFSWHQEFFEFSWQTVAPVWDVQISYYQHQHPVTGLRSVTTTVAA

SEQ ID NO: 982261 - protein, 109 aa, Homo sapiens
MVTLSRVSPGEGSCSVGRLGHGRVELEAHQDRVVVRGPPLVRGVQVLGHVVVARVLQCHGFVRVDHPDVLAGDRRRRRRQGVDPVQAADGAAERVQVLARERALREVPG

SEQ ID NO: 982262 - protein, 36 aa, Homo sapiens
FELGTVFFAYSPRSAHCSLGLGSYNLLEANLGMVPI

SEQ ID NO: 982263 - protein, 35 aa, Homo sapiens
PCMLLPLHRHSGAGAHNNRFREMTGLLSYPRGPSS

SEQ ID NO: 982264 - protein, 56 aa, Homo sapiens
MGQPFLGARMEQLYAQEPDSLCFVIHPDSVQGDVDGDGGGIMVGYENVPTIDIHMN

SEQ ID NO: 982265 - protein, 122 aa, Homo sapiens
QQVGPRVTTRKRIIDSARSAYQEDMHIRKKDTEPPTNTMRMLITLNLVLLLLAPIIPSLPLPLHHGHSHWISSPAGVSTFTVSPWDSFTVPRKGECGLRPSAIGYVSVLSGRLDLKAGRALI

SEQ ID NO: 982266 - protein, 54 aa, Homo sapiens
IYPLLEESVFCNRVTPRIKPHHRLATDLYDRRSSDKTLYEQRQSYAAIYPLVKT

SEQ ID NO: 982267 - protein, 87 aa, Homo sapiens
NDLWTHCDRGLCLRDVTSLSACTSSSPEGPDTNVIFSPVSISTALDYLSLGGPIIPPLTEDSHKAYKFNSHRRLLEAGNSPRASRTY

SEQ ID NO: 982268 - protein, 34 aa, Homo sapiens
LEDPVHSDVVLSFDVGSSSRIEQDYHGNNTSGGY

SEQ ID NO: 982269 - protein, 73 aa, Homo sapiens
MRHTEGLVTDCEEERACPVQPHDSCPSTMSRNTENPTKRRNNIIPSTRCLQERQLRTGYTKRGHSIYPDCSML

SEQ ID NO: 982270 - protein, 112 aa, Homo sapiens
VKGREWTHELADRSATEMSWQRLRLGFTVSPQKSQSEILLKSWTKGKKTGAADDIPQPAVRHQDPEPLLVVKPTHSSREGGCREVPQAASKTHGLLQAVRPQAQDKRPAVAA

SEQ ID NO: 982271 - protein, 48 aa, Homo sapiens
DSDYARSIVDYAVIDLDYAAQVLNYQTCINTFRLEDDLREQNPILRDS

SEQ ID NO: 982272 - protein, 67 aa, Homo sapiens
LPLLPQKIYQGSKDPKCHINTSNKLQLTQRTSQSISHGYHTPSTTHHQTGNSGLGPQHRPSILGRLH

SEQ ID NO: 982273 - protein, 48 aa, Homo sapiens
CSRGYRTVVHTCTVVHTCTVVHTCAVVHTCTAVHTWSLYRGVMGYEQQ

SEQ ID NO: 982274 - protein, 43 aa, Homo sapiens
YCTVVQTPPRVLQPPDTASRYEQQCRFEQQCRYEQQCRYEQQC

SEQ ID NO: 982275 - protein, 57 aa, Homo sapiens
RSLGSRIRRVLLPGGLYTLGGGYEQQCKYEQQCRYKQQCRYKQQCMYKQQCRYKQQC

SEQ ID NO: 982276 - protein, 42 aa, Homo sapiens
AALRIPALLFIPPPGYSDQVLNNSWRFEQQCRFEQQCRFEQQ

SEQ ID NO: 982277 - protein, 71 aa, Homo sapiens
VSVKALSEPPVERKSTCIQSNLTWIHDTIMAIEFLLPILNTLNTTIYHYMTTSNLKNITDFTGIHIELMQT

SEQ ID NO: 982278 - protein, 33 aa, Homo sapiens
GVLRIPTVVIPSVQPPRSASKYEQQCRYEQQWG

SEQ ID NO: 982279 - protein, 42 aa, Homo sapiens
VAVLEVPDSLGRGYEQHGMYNKQCKYEQQCRYEQQCRYEQQC

SEQ ID NO: 982280 - protein, 55 aa, Homo sapiens
CVSEDPLLSYCTVVHTALLVACIGGGAVNIGGGYEQQCKYEQQCRYKQQCRYKQQ

SEQ ID NO: 982281 - protein, 33 aa, Homo sapiens
MKVRSREARFTVCIDVAHCSIYGKGELRLYKKL

SEQ ID NO: 982282 - protein, 42 aa, Homo sapiens
MIMGTVVVHNFACHVNRRQIFTLENMNHSLVKDDHPLSSVGY

SEQ ID NO: 982283 - protein, 49 aa, Homo sapiens
RSYWEARSISIEFEQVAPSQPGLQRALEEEGSGAHFKGLEKELVPRWAT

SEQ ID NO: 982284 - protein, 37 aa, Homo sapiens
DWEDRLSQEFWAVVRYADRVSALMFGINMVTSRELGD

SEQ ID NO: 982285 - protein, 60 aa, Homo sapiens
SSLFDIHANGILYVSAVDQSAGKENKITITTDQGRLSKEDFACMVQEAEKYIAEDYKHRD

SEQ ID NO: 982286 - protein, 38 aa, Homo sapiens
IPYLCVNALGILAERHPVVQLIAFIYIDTGHLGRIQVI

SEQ ID NO: 982287 - protein, 38 aa, Homo sapiens
KRPGAARGRVPLEAGCRYEARVPLEAPGEGVCGWGYRA

SEQ ID NO: 982288 - protein, 69 aa, Homo sapiens
GLQNGKQRMQKANLAATDVYLLQLCHSVICACDCDEGHLADHVVLCFNELTPIYLTGGRLTCHNVPLGL

SEQ ID NO: 982289 - protein, 92 aa, Homo sapiens
MRSDKNTELTIHRPNIYNTTNQVIITLTVNPNTGMLITERLHNSKQELGHISTPTCLPNNINLLSITRYEQAPTCPDDTCLNEPRKPMTRCT

SEQ ID NO: 982290 - protein, 90 aa, Homo sapiens
MPRVSFVYRNKQTNRSWSLYQGAVVWNEREVETAEEASREKAWEEAKKKVGVGARPGAPRSLRSAYGFPGMNDSSLPSPQSTGQGDSHAW

SEQ ID NO: 982291 - protein, 69 aa, Homo sapiens
GGCGGYWREAISQSLQLSRDPANAGPAWATEQDSVSRKKKKKGVDTKGSMPYQIIKKPDLEYDVADFSL

SEQ ID NO: 982292 - protein, 51 aa, Homo sapiens
SRGVPQMVVHTWHCGIIPCTCSHTCTVVIPALLFILALLFIPGRCIGGGER

SEQ ID NO: 982293 - protein, 46 aa, Homo sapiens
PEDPPLCSYLALCIGGGYEQQCKYEQQCRYEQQCKYEQQCKYEQQC

SEQ ID NO: 982294 - protein, 58 aa, Homo sapiens
MIQTVYRDGYRDGYRDGPRRGSGSTMVAGIASDDRWQQTTTDDEAMTSRHRHVGSVGY

SEQ ID NO: 982295 - protein, 94 aa, Homo sapiens
TLRIPIYEKARRRQDKEIRKKKKAAEKKGSGLEPKKTQIQISFPVERRVFPLSGEERKRSHSRSPRRQNQEPEELKKMLKEKAKEEERKEMLER

SEQ ID NO: 982296 - protein, 34 aa, Homo sapiens
LVVRCFDIDDDVVCEVDSGLVCGSVPESGLGQVG

SEQ ID NO: 982297 - protein, 35 aa, Homo sapiens
MIIISYGAEYAVLAQIASMDLVKWIIQQTSSIKWI

SEQ ID NO: 982298 - protein, 47 aa, Homo sapiens
MSGHNNFLLPCCKIPVQLPYSLLRYGQPIVRSNYKGRKKWKISVPIS

SEQ ID NO: 982299 - protein, 92 aa, Homo sapiens
TVITQESGLTSVVSVGRASDESSTFTFTGASTPGEQAYQCYECGQGFSQSSDFRIHLRVPPGRASPLTVASVGRDFSPQSKLLIPPESTHLG

SEQ ID NO: 982300 - protein, 86 aa, Homo sapiens
MVSGSRSGLQMNIQSSLIFSHQFCGLLPIVIPLKTVTDHVLELLLSQLNAMLDAIPQVLDPLPIFLLLLFSYLNRKLYFSISVPIA

SEQ ID NO: 982301 - protein, 165 aa, Homo sapiens
TDRDRERRTTSRTQAEIENENGPNLIDPQVPLSPEADCKGTGAVPVERHLTSASFSTWSEEPGLDKPALEESAGADTTQETLSLPEGEITTIEIHRSNPYIQLGISIVGGNRNTFDNIVIQEVYRDGVIARDGRLLAGEQILQVNNYNISNVSHNYARAVLSQPC

SEQ ID NO: 982302 - protein, 102 aa, Homo sapiens
LSPCLDCIGLADAVGIIWMCFLCVLNFFENFFITLEPRCRVESLFSHFLFSLSFSPLLNFWASISSSANFCAHFLKWAQKLSKKKTLLTEISCIFSALYFST

SEQ ID NO: 982303 - protein, 97 aa, Homo sapiens
DYGKLRKDDPLTNLNTALDVTEKYLVHPHRCWYAVRHRVESARTGMSTAIHELTLSRLLPAPISVSPARRSTASQLALCDGVGPSTTENAAALWQDY

SEQ ID NO: 982304 - protein, 131 aa, Homo sapiens
MFLRQLSVDGLQKSILYYADACLVECRRDSIYVAGCVSLPPSRCMCDMRHIFGAWLISERGDWSARDLMTVIVVSPSRSARLMPRKRTSFKLGVGRTTNDTNLFVMNLTLRFFENPIGLSRLLNRIFCALF

SEQ ID NO: 982305 - protein, 124 aa, Homo sapiens
SRSLICRLKADVRHERALGGSTEATAVGDFDEITQLPGGDQESCLFEMSSEPGRYYSQPLPMAKVNGISIEGKVMSPVELMSQWTFGGIDWLVIGLGVTVAYIVFGIAGFGTALEAGPILILFM

SEQ ID NO: 982306 - protein, 57 aa, Homo sapiens
GIADPQWGERPFALLVVREGHVIDARELKEHLKPFVELGHLRQVGDPEASIACYCKF

SEQ ID NO: 982307 - protein, 152 aa, Homo sapiens
LIIRLDVSLDFRYHHRIDYTAHLLGVSPLHLGLQTLDLAQDVCLIHTVTTKGNGQQKDHDRAKDAVDHADHRLVGLVVSIIWAEELGFQRTNLSALDGHGRDVVRIQAPRLDQLTQRPLIGSLLNFARHLAIGDRVARPIYCACTRPLQGLH

SEQ ID NO: 982308 - protein, 39 aa, Homo sapiens
MECLIHHRGRNTLIVDMDTRNEDCAIIPRVNYVPLCQVI

SEQ ID NO: 982309 - protein, 41 aa, Homo sapiens
LIDIEVVHPIVDIGLVEEDCAVIPRATLVPVVQRYWSHLTL

SEQ ID NO: 982310 - protein, 92 aa, Homo sapiens
QLVVVMVCYFILSIIDSMVQSYARRFLQRLNSEEKTKEVEEVITLQQIGVVGTALNWEDSKPGRIIPFANLYQFVTTFFLKAVCPSEPFVRS

SEQ ID NO: 982311 - protein, 92 aa, Homo sapiens
VDEDSVNSFHQLLRIDRDSSRVDQPPNSCTDNHIHSWTVIQWQHSSRLHFRLTCDETEDGPMTHVPLNATKGLQGGTLDCVLQSRSLGDEIQ

SEQ ID NO: 982312 - protein, 42 aa, Homo sapiens
MAQKLKTKASSSALRTATYRKIGEGQNQCDGTQHGFELRQAT

SEQ ID NO: 982313 - protein, 85 aa, Homo sapiens
KWPEIQYLLRRIGLAQLRDHRSAFMVLNFFENFFRTLEPSARLESLFSHFLVGCPSASNLISRASISSYCEYLVPLFQVYQSYQL

SEQ ID NO: 982314 - protein, 38 aa, Homo sapiens
TNSTLRENFSESGIGLPITIEMLSMDVVRRGDTLLCFS

SEQ ID NO: 982315 - protein, 36 aa, Homo sapiens
LGPTPPAVFCIQPGKALLWGAICAFIPAVPSTFRMD

SEQ ID NO: 982316 - protein, 111 aa, Homo sapiens
DPPTIIVGGRRISNLYKQSLLVLIVVRDISLRCWVRQPSSPLYARAICIIFSVVAISQAATGGTEETIIVSSPTPLTDSCPVTAYFNFSSGFVELQTITHLFAVWPLPTLS

SEQ ID NO: 982317 - protein, 86 aa, Homo sapiens
SSRGSQVSNSTRPLSPFFWDQDNSPAYQYPEIDGNHRCAPPCLANYFCVCISRDGVSACRPSLVNVLAVKVMCPLDVPNVLSDYMA

SEQ ID NO: 982318 - protein, 93 aa, Homo sapiens
YLIHSHQLPKKKVIILSATISETIAKMMFGPEVKYWDVEMTESKGEIVQIPIKSFSRYAIKENEELLNLAKKLIDIYNPNSTIITYKGFMEQD

SEQ ID NO: 982319 - protein, 73 aa, Homo sapiens
LQDSFQNGRTVRGLFFPHHPLIKERGKEEETPTLSTHLFSEWPNSKGLLLPTPPPNKREGKRRRDSPTLSTHL

SEQ ID NO: 982320 - protein, 168 aa, Homo sapiens
ISRVQHMRTDRCRGQPTLPCCSMNTTSAEKVEKVVSPPREIRSDKKLPSGVQARTFYEERYSTANDEAPDQVYQQRADWKIWEQAVEFECEKPACDTANRSTDDYREKRAIHSVSPFPEGIIGKTRTSLRPFPGFVGIISQRRLRRNAISLHVAEQSASGIFNAPTIG

SEQ ID NO: 982321 - protein, 97 aa, Homo sapiens
LRIPLHPGEYLPQRREVHWHIGLMPDVANKLREGVAWLAFSTTEPFLFAYFLIPLSPCIFLSFPSLNVESRTRSVKGQPFTFLLLNEPFFCLVYKMP

SEQ ID NO: 982322 - protein, 61 aa, Homo sapiens
RFYAERHSRAACGEDRARWQVLICVVVGGELYVGVAYFFRANEEFLNNGEDTLNWLPRTRL

SEQ ID NO: 982323 - protein, 34 aa, Homo sapiens
MILTYAYLGNPDMQSTLINRSFCAHFTKFLVPIS

SEQ ID NO: 982324 - protein, 106 aa, Homo sapiens
DSWDPPVSREREKRFEMLGAVLVCFHATDKDITEIGKTKRFNWTYSSTWLGRPQNHGGRQKALLTWQRQEKNEEEAKVETLINPSGLVRHNHYHKNSTGKTGPPGY

SEQ ID NO: 982325 - protein, 51 aa, Homo sapiens
SALVMGPKFPMLFTSHTGTASLIISIPHQSGMFVTVDEADIDTSSPKVHTF

SEQ ID NO: 982326 - protein, 95 aa, Homo sapiens
MAECCEKDPVPMLFVHQLPMVVSVSPSPSFLVRSDLFVRLRIRPILELSGLKAALILSCYFENTTPGSGDVSACSISLLPASEEARYPLIPVPFS

SEQ ID NO: 982327 - protein, 63 aa, Homo sapiens
MKDLVGTKGIPHLVTHDARTIRYPGIASSRVNDTIQIDFGDLGKTTCFRSTFDHWVTLGYWGY

SEQ ID NO: 982328 - protein, 38 aa, Homo sapiens
ALMFHCSVCDNCVEEFDHHCPWVNNCIGRRNYRYIFRF

SEQ ID NO: 982329 - protein, 43 aa, Homo sapiens
FSVLLRIPAESCPGDSVWFYNLLRSGEGDYRTRHAACPVQVGY

SEQ ID NO: 982330 - protein, 64 aa, Homo sapiens
MSRDLEDPEYHLKYHLPLVTTTDTGLPPTFWAVPLVQTSPDPSDAIAVGAPQGLSSSLLRRSQN

SEQ ID NO: 982331 - protein, 36 aa, Homo sapiens
MTLEDPDVGTLKNYGIDCYSITEKRNSIYDAQNISE

SEQ ID NO: 982332 - protein, 40 aa, Homo sapiens
MHDVPDEQYTLSEFHVSLGDYACKLYVILRYILMVRCCTA

SEQ ID NO: 982333 - protein, 35 aa, Homo sapiens
MSVKVNTVRCIGHGIQHCIMEVYPRVLTGAILLPY

SEQ ID NO: 982334 - protein, 33 aa, Homo sapiens
FSGHSPVQLPCFDSIWFGCPDGIIVSALLSVFE

SEQ ID NO: 982335 - protein, 46 aa, Homo sapiens
YVGISGLRMSYCRASTWHNSAYDALDEVKRARVRQNTIDAWWWICD

SEQ ID NO: 982336 - protein, 73 aa, Homo sapiens
ASGADEEWAQLAVVLQHHQQQHPALYNTMLQLDQHPLIQKNRQSGAGLHSCSCCWGWVLIHGLAWDMEATPLS

SEQ ID NO: 982337 - protein, 70 aa, Homo sapiens
ACSEDMDVPRIPTSLRSTAKTLVRPRCLAHPVKKQVQLPALEGKPSFAERQSREGKGEVRVSNTAYESDS

SEQ ID NO: 982338 - protein, 94 aa, Homo sapiens
GGSHNAYAPIPPKYFKYTQTAHRLNITKLNIKLYTWVGRQAERKDPSPPFKRGHAVITKSTQLAAISPSIFSGKKRLKHRAASAKKTPGTQFGD

SEQ ID NO: 982339 - protein, 48 aa, Homo sapiens
MGRSLHKQLSLGDCHVHSPSPAPYPCPDPYRLCLSSGGKGPSHHSWGA

SEQ ID NO: 982340 - protein, 77 aa, Homo sapiens
ICCVYRRMPEHDVLFESHSVMTSYQTPGNPRCTCYLGAITTRKNPEMYDLPLLRTHSCVGYILPHPLPERCELWDSV

SEQ ID NO: 982341 - protein, 72 aa, Homo sapiens
DLEDPGGNGDRSIVERLSDFQVAVVHSVCGQCTLSRKAGKIVQDSSSRQTVSFLAIIHMENLITIKVKHKLA

SEQ ID NO: 982342 - protein, 66 aa, Homo sapiens
KGEIRGREIEPEPYPKAVKMGNTPSKTGSKGDTDGNKDIPLDISLGLMLITLEVMAKGLNLGKSNK

SEQ ID NO: 982343 - protein, 46 aa, Homo sapiens
MVILGHPATPLPTGSSRLTGWCLSSLRQLFQLLSFHPTPPRFLPLD

SEQ ID NO: 982344 - protein, 45 aa, Homo sapiens
MDAWVQVDVYSPTGGAASLYLFRTTREHRARPPNIVSARQPGIDY

SEQ ID NO: 982345 - protein, 94 aa, Homo sapiens
RLECTVMMGDGMFQVMGEMSCEIGEMLHVEGDGMYRVTGDGMFHVMGYWDVPCDGMTGCSVCQVMGLFRVTGEMFHVSRVTVMYRVKGAMFCVT

SEQ ID NO: 982346 - protein, 100 aa, Homo sapiens
GSLEERVFGCSKSLIPPYEKHPQVWRGNPALHMQSVISQKLLCAVLGCKWVKESYIHSVGQEIYWSAWGTRQCCNPQHCGEARGEEDGSEPMEFKDQPGT

SEQ ID NO: 982347 - protein, 70 aa, Homo sapiens
TVPTHNVTPNTVNQQSGAQQLYSRGPPCPSYCGIHSRIFTRSSIVSIPSAYECLPTILLFCGSPSRPGYT

SEQ ID NO: 982348 - protein, 69 aa, Homo sapiens
SRGSRTYGDQSWGSSVSSRREITTIHGSPPVYHHHSGITTVCITGHSGDHHHFMASPHIQGNRRSQIRN

SEQ ID NO: 982349 - protein, 155 aa, Homo sapiens
PPSPVVRTESCKTASGTACERAKRTLSGRSQASIEIDSLYEGIDFYTSIHRGRFEELNAELFLGTWDQAEKALRDAKLDKSQIHDHCPGVGVLTRYPKIQKLLQDFFNGKAMNSSIKPDAAVAYGAAVQAAILSGDKSANGQALQIMDVTPLSLG

SEQ ID NO: 982350 - protein, 41 aa, Homo sapiens
WRSRGSQRETKKRERIYLVSHDQMMQDISNNEYLEYGGHED

SEQ ID NO: 982351 - protein, 48 aa, Homo sapiens
GVAVLEDTLIAVQTGPCPVAALGVRRSPVRCFDRKLPRRWLPRLTMDS

SEQ ID NO: 982352 - protein, 133 aa, Homo sapiens
YLTGWFNLNGLDLCNHRGQYCTANGPNAKKGHRDAENEDLARVAKKYGESKKIDRHLYHSRSLKVKGKGVNNKGNLRDHIPKRTADTARKKLRADQAEARRLYTREARKRREKRLRAKKEEIITTSPREVPTV

SEQ ID NO: 982353 - protein, 65 aa, Homo sapiens
RGSRSRVANTDAQALTMEGAGSVQMGTQVTQGLGAGSQPECRCRSRAGSHRRNPGLQLADIRNVE

SEQ ID NO: 982354 - protein, 73 aa, Homo sapiens
QYPSMHACLRVDVYVTTAVHASLNKIRRHVRTSDDLQISLSWSLDDVYITTAVHASLYKFRRHVSTVLTSKYR

SEQ ID NO: 982355 - protein, 40 aa, Homo sapiens
MVQAVLLTGASAPGPKREHGQLNSRHSSLVMPSLVGSINI

SEQ ID NO: 982356 - protein, 66 aa, Homo sapiens
VYSPLRCMPSLNKFRSTREHRAELPNIVKLAPGRRVITIAVHASLYKFRRHVSTVLSSKYLKLEPG

SEQ ID NO: 982357 - protein, 41 aa, Homo sapiens
LEVPDVVSYPAAPIQRLSMNNSAGINNRCRYNNSACSEHTV

SEQ ID NO: 982358 - protein, 39 aa, Homo sapiens
VREGVGGSVRLASVGLAALKLLSTLTKPASSSLRRWTDR

SEQ ID NO: 982359 - protein, 66 aa, Homo sapiens
FSTYPMSSASLGKPPNGVSSYLLQVCLGQQQVHSYLPRAKLPKGAVGCQLFCFTAFTDDNSRYWKI

SEQ ID NO: 982360 - protein, 36 aa, Homo sapiens
SVPDRVLGGSHSMRYFHTSVYLALAAGETRFISVVL

SEQ ID NO: 982361 - protein, 45 aa, Homo sapiens
MLMLSRELVQAGMHRVVNTLSNQCSSLNDYCEQVMHGCSLCRTEA

SEQ ID NO: 982362 - protein, 38 aa, Homo sapiens
PRYSAQYQTPLYRLILLSHSTVLHSSISRPYVLGCMDI

SEQ ID NO: 982363 - protein, 63 aa, Homo sapiens
MGHRPHSHQVAGVASKQSRAISRPGQGGARGWFCLAAGTDNFWLQFIYKDLSLYIPDLDAGYR

SEQ ID NO: 982364 - protein, 51 aa, Homo sapiens
VLSHLKPRLHPDDLPLLKRALVYHLKGRSEDYLVEYRVRHGDCAIETSKTR

SEQ ID NO: 982365 - protein, 72 aa, Homo sapiens
QDDFVTEKTAVDLCQQTIFLTLLASSQRSLLCECADWILDKTTGSACLVVENEHLYLGFHEQTLKPDDFVLD

SEQ ID NO: 982366 - protein, 40 aa, Homo sapiens
VGQWSSPSSFENVKEKWVPEITHHSNRLRCLHCRGLKIDL

SEQ ID NO: 982367 - protein, 56 aa, Homo sapiens
MMTEARMTASVRNGASPCFQLTGLEYQLANNSPRGHPCEGDDSITPNLILVAEAGS

SEQ ID NO: 982368 - protein, 56 aa, Homo sapiens
KWFTEIFRRQLSLYGPPNSKSVIRYSIACIHCSDGIRSTIGAVCGSASPASRRRFY

SEQ ID NO: 982369 - protein, 80 aa, Homo sapiens
QWEDSQYDVRYDRRQRSGARPVKPRREDTNRKRGSNTKVSTSSNRPNPFTTQVHCLHDRAMEVSPKGSLAPRLGGCRSLI

SEQ ID NO: 982370 - protein, 86 aa, Homo sapiens
PRERHQLQLTGRRFDLCPICVVPFVPPSRGNNCRRLVAHGCDPLSVSTMAHPLKRMPPYQCTQLAIHSAIIVTPSALSSQARLQAD

SEQ ID NO: 982371 - protein, 39 aa, Homo sapiens
DSRVIPYPDYSAYMPYYVLCRPAKQVVGLALLVSIYQHW

SEQ ID NO: 982372 - protein, 128 aa, Homo sapiens
TGETRPHYFDTSQPRMRNTASEEDAAAAAGHIWRTRPAPWMNTLQLSEQQDTQRHAWEKDLVAAWGKDPALRLEATVYQPTEMACRAQRWDHPNCSAKSHRKTPLVKDFKFQRIRISLTDLPPWLCLS

SEQ ID NO: 982373 - protein, 74 aa, Homo sapiens
IHRKGTKPVWVSVLYTPDAPDGVAFRELTKGLVELDTPKAKPEWQTYFTSQMATKDTKEITRIFNDTRSVYRYT

SEQ ID NO: 982374 - protein, 63 aa, Homo sapiens
RQHSCVMARDIFLGVTVVCRPGSPPQGSEHALVPDAENLGERTHSPHIPQAHGLTLVTYSYQH

SEQ ID NO: 982375 - protein, 67 aa, Homo sapiens
RQTPCPIFTVLCGDLEEVGLLWGEGDLQRSAHKLSPSHMCQSISYSPLTDRLLAGGSSQDILPSNCI

SEQ ID NO: 982376 - protein, 133 aa, Homo sapiens
MYERKDKVVGVKHTARPQLTETQGRSRTPSIVILCLEDFLMALLQEAPQGLCKYGDISDTDNPYSLLYIDNDQEPPGMNMRRWLADIGHTEETINHTTHTGGILMQEDNRTAGDPKTELCISCIEIIPQYGLA

SEQ ID NO: 982377 - protein, 39 aa, Homo sapiens
NVNILQYISVISSAPLTLKQIHYWNFLLEESSPNSVPIQ

SEQ ID NO: 982378 - protein, 210 aa, Homo sapiens
VFDPVIKGKREIRAEDGDGFLAIARVAIGLAEGAGRNAHELTLLTARREEGPLSIGKDGSQFRERYAQLIRRNLSSDCASFSQCDELSGQIGCPRSNFVTEDDRGGGFLHAVDTADLVQQLVQLLRRIGAQPSHVIELPTHRAQLLHLRHGAQPAQHLFAGAGLHGNAHVSLQTTIRNALAQAHAVTGDDLEFLQGELNEPVRVESEQGK

SEQ ID NO: 982379 - protein, 48 aa, Homo sapiens
SLRKHGLEVIYNIEPIDDYCVQQLKEYEGKTLGVSHQMKAWTFWVPML

SEQ ID NO: 982380 - protein, 51 aa, Homo sapiens
LRGYVKVLRQVVADCSEGGRVRCPVIDELGSSERRSYDPVPMTAVSLSAVK

SEQ ID NO: 982381 - protein, 79 aa, Homo sapiens
LVLEVSIARATGPDDADHITGRGGQGHTFEHFMTATAFMQVLDFKFVHAVGSHKNSWSVVEQAPVPQRFAPLLLKLLKL

SEQ ID NO: 982382 - protein, 46 aa, Homo sapiens
MPDEAYIDYRTCTWRYEITWNGGVECTEGEVGNVAGKRKRTSERVK

SEQ ID NO: 982383 - protein, 73 aa, Homo sapiens
VDHNTLQTGMAMVLSLSQLCSGRPRMLPSEHANADQDGSHLPQESHRISLGEILTEVHGEHTEGDASIYAQPR

SEQ ID NO: 982384 - protein, 66 aa, Homo sapiens
VDKVGEEEFEKLYSSYEKQGRVRKFVKAQQLWYTIIESQTETGTPYILYKDSCNRKSNQQKLGTIK

SEQ ID NO: 982385 - protein, 33 aa, Homo sapiens
VVRVMVMVMMMMSGDDYGVVVVMVIVVMVEGGE

SEQ ID NO: 982386 - protein, 37 aa, Homo sapiens
EYWCYIIALDIEVSTTDVIHDSLSTMMAPSECSTLVW

SEQ ID NO: 982387 - protein, 78 aa, Homo sapiens
MGSLWVRTQVRLPLLLLMTMALAGVSGNASAEAFDSGLGDYGVLPPGLSVDLTPCKPTLRKRSCTHVREVAGCSHFVS

SEQ ID NO: 982388 - protein, 70 aa, Homo sapiens
MELLCRPEDTALPPDRRVCSLSSWMVASVDWITACEFWSCKGVGYTGGHLGGTHYDDSPEFTPVAGKGPE

SEQ ID NO: 982389 - protein, 65 aa, Homo sapiens
MTFRRRARPATPEEAGFRKGLGRRQLQMIAVGSAIGTGLFLGTGARLEIAGPSVALMYLVCGRVP

SEQ ID NO: 982390 - protein, 36 aa, Homo sapiens
MNDPDGPVIRWRYPSIEIPVTHWSLACFRDITGHPP

SEQ ID NO: 982391 - protein, 34 aa, Homo sapiens
CGDLEDPSVANQVELVALLGAFQVHFVAKKWQEE

SEQ ID NO: 982392 - protein, 51 aa, Homo sapiens
MGDGGGARQARRTRRGRPGRGGLEVTLAVHAPWRRTCSPEHLALESVAGTW

SEQ ID NO: 982393 - protein, 33 aa, Homo sapiens
LEDPSVANQVEGTAIAKALREEIICRNHPVKWL

SEQ ID NO: 982394 - protein, 36 aa, Homo sapiens
LRIPRIQVDGMHTTHGIETWIRDRTWIRDRTWIRDR

SEQ ID NO: 982395 - protein, 65 aa, Homo sapiens
VAIQRIPDTGKGPFALPGESQKALLVEDEMQFQPEMMRSLSSAMWRKEHSRQRDQSEQTHSGVKL

SEQ ID NO: 982396 - protein, 124 aa, Homo sapiens
EASRGSQAWRKKSIGTSMSYLNGCAGSQGPATSSCSSIQEVRRCTRAEMPDNLYTLVLKVKDRTDIILEVGDEQQLNSWMAELSECTGRGRLESTEAEMHIPSALEPSTSSSPRGSTDSLNQGA

SEQ ID NO: 982397 - protein, 116 aa, Homo sapiens
MRVTEFAVTWKVEFSAATVHTELRIDICCTLLGELVSAPAKQELRWYFNLVHSRDQEGHQAALIGEVDWIQTLLPILEISDESIYKEVFGQEAGSGMFTEVAVLGRSRYCGSSPSS

SEQ ID NO: 982398 - protein, 68 aa, Homo sapiens
GDLEDPCRSLEDSRTRRPGIRGSSRPCSLSRQRDQQGQVVPELQPLHLCQQDRDWRVMWGALVRKSWS

SEQ ID NO: 982399 - protein, 55 aa, Homo sapiens
VCGTDGGMHQPIGELLISQAGCDPSVHGPLNPQYVISKVASKAKVAASRKPRSRW

SEQ ID NO: 982400 - protein, 38 aa, Homo sapiens
MPTQEMQQKHTNTHTDTHLGQAILLPNSQLPALLVMGE

SEQ ID NO: 982401 - protein, 57 aa, Homo sapiens
WGACQKYSSSQEMSVVVTPRYRWGQQGGEGHTGPRAKSSSGVYVQGARYVTARYLVR

SEQ ID NO: 982402 - protein, 36 aa, Homo sapiens
MAIPLVVGTNNLIILIHNKQRLEETLMVVDENDKVM

SEQ ID NO: 982403 - protein, 62 aa, Homo sapiens
MRLRGHVTSQHHLGWWPTSPRKKEVFPIAGKQLLQSSYKPRSPAAKITNIPSLHSCCFPETG

SEQ ID NO: 982404 - protein, 35 aa, Homo sapiens
MGLNLIGVRHFFGGFMVIIARFRTVFNSPHELPNF

SEQ ID NO: 982405 - protein, 47 aa, Homo sapiens
MQYTLQKDFRRMQVCVIEAQAVSISGGLWFPTYSLWKRISTRATKLN

SEQ ID NO: 982406 - protein, 43 aa, Homo sapiens
RIQVLTVSVENCGPPETPVSSWSGWYSMVNRDSADLVPDALNS

SEQ ID NO: 982407 - protein, 42 aa, Homo sapiens
SRGSRLRACPNGARVPCRAEPMLVLFAQKQPSVGLVSNSGCL

SEQ ID NO: 982408 - protein, 40 aa, Homo sapiens
LQSWVRLPAASPGVVGSSGWEEFNFPVPIITPTDPIDREM

SEQ ID NO: 982409 - protein, 34 aa, Homo sapiens
ADLEVPLTLAVEVPLLLAEFMPGPLETIPYTCPR

SEQ ID NO: 982410 - protein, 30 aa, Homo sapiens
MLSLVCVSPREEVLAELWDDALLVLLLLAH

SEQ ID NO: 982411 - protein, 101 aa, Homo sapiens
ASEDPVVRTRSDSMKNEKNLDRRHSYMTVSVGIRTPKWDRHYEQASKMFLITIKCRNPHLKYQQAIFSIILAQKSSVKYSQAICSSTVKGLYSKTEVRFIA

SEQ ID NO: 982412 - protein, 111 aa, Homo sapiens
ERAVIASRTTQGPVANSERDFLPGASSPTDATAAGGHDPSEATARGKPITRDRSINTVHLPPLKAHLPELPIMSACHPLTATPQEAECALSPSNPAYSKRDIGRMTPSLVH

SEQ ID NO: 982413 - protein, 103 aa, Homo sapiens
TVSDRPDALHPSTLWITTDYFVPVDLPVHVHVNGVMAHVSLCSPEGVRPQRDAGQGISGSMRQSSLLSVVKQFSIFVYPLVDGLFLVWALSNAPVDILVHVFV

SEQ ID NO: 982414 - protein, 66 aa, Homo sapiens
MGTVPDGEWRRVCSNPVWGQLAPVNVTTEVKSVESAPVKLDVKLFRGDNGGLQVSTNVSCQGMFVG

SEQ ID NO: 982415 - protein, 44 aa, Homo sapiens
MVRDLLQIMLPPRDQELTPQACEPQQAGPTPVRLDWGLGGKSVR

SEQ ID NO: 982416 - protein, 62 aa, Homo sapiens
IQSRKCISKDSHIKLYGIEFQMSVLLIAYRILLRCLAVSLPMNSSSHRISIHQRESVLITCT

SEQ ID NO: 982417 - protein, 44 aa, Homo sapiens
MLSSRTGREIGLKRLSPRVDEEKEQFRKLFMGGLSLETTEESLR

SEQ ID NO: 982418 - protein, 48 aa, Homo sapiens
MGNFRFSIPKDILLGCLIRKPTNLRPQSRYPCLVLFYNSIWPQYELDN

SEQ ID NO: 982419 - protein, 44 aa, Homo sapiens
ARPVAYSGRRSGRHDDPGGSARLDSTQCRRPYRLRPSPVAGIPL

SEQ ID NO: 982420 - protein, 67 aa, Homo sapiens
FFTDDSFAVGSSCQARTSTTSQVNELAHYRQQPPGPTAMLWWLKLTDNLSKVTAAMGQEEDRHRDQR

SEQ ID NO: 982421 - protein, 57 aa, Homo sapiens
EYRLYFYLTNGYHITFMGGNSFCKHKGEEKKLEWPPQFLGNIEVQIFIQKAVCNPQG

SEQ ID NO: 982422 - protein, 32 aa, Homo sapiens
APSINDICEVSTVLTCQKELVQGRHAPPMVKY

SEQ ID NO: 982423 - protein, 140 aa, Homo sapiens
SLAGARLRLAIMSVTGEDDRDRLLLNGGRLFVAGRQNGSNNIRIKIESGEAAGFLGHGSASRCIRKDPCSKAAHALKDRQVTQAALAVGICENDGKRKRGKVRLADVQPKLDSEDLHHLILRSAKRPARTIPEIVRGREE

SEQ ID NO: 982424 - protein, 75 aa, Homo sapiens
QNDWKCPVLPEHSHVSSNQLYGLQRVHAESLMQRPGPFYPPSTSSSNIYPPPPLHIIITPIWTDMLIENHPQIVR

SEQ ID NO: 982425 - protein, 42 aa, Homo sapiens
QLRTAKSVTCTYSPDLNKMYCQLAKTALLQLWVDTTPPTRHP

SEQ ID NO: 982426 - protein, 51 aa, Homo sapiens
ISNNNCKLVDGECYDVRRTFHCMSEGRVSYVSLEAVANSVFRGVKSHTQVG

SEQ ID NO: 982427 - protein, 121 aa, Homo sapiens
LDSHVSVTTASGPISYALCAGGWSQVHACLVPLALWISGTVAIRQLPAGIRLSRRCLEMPQMGHHRASSLFSLDLRLLSPAVSCSTSKQLARGFTKKCTWPGTVAHAYNPNSLGGRGGWIF

SEQ ID NO: 982428 - protein, 73 aa, Homo sapiens
IAVYQRGYYGSNGARARLAHYDLPPALLVDISRIKQYLSYCDRCISLNIMSSRVIYIVPYCRILFFFFFFEAE

SEQ ID NO: 982429 - protein, 102 aa, Homo sapiens
RLCYNQERKSESKTSDTSYRHKRCDGIGGIPYRGSPGNKFGSGEYVQVNLRNAEAPQSERGNLTNRGTYPAGTDRIDMIDSSSRSVVVVMAFLVGEHLLVIR

SEQ ID NO: 982430 - protein, 46 aa, Homo sapiens
MTGLGDTLFSPSQACWNTDVARLLRVSEGIEVVAQLFQLFAVLQRV

SEQ ID NO: 982431 - protein, 139 aa, Homo sapiens
CRSISMICLHNGRLAHRSYLNQTFLLLIPGLRHNLLFNQLPHRKLWNSCMTWTPLLRVVLPFGTQPMYSLDILIDVICPPKMFKIKLQPNHLGHLFLGCPGAISWAIVHSHLAQNKYLQIFYSESFCQHCMGNKLKKNI

SEQ ID NO: 982432 - protein, 49 aa, Homo sapiens
HEKIEQTSTNVLWYGSVDEWKLRELTQRYLDPERAPEEKLGYSRCSHDR

SEQ ID NO: 982433 - protein, 70 aa, Homo sapiens
ANYSGTGYAVIPISYEDPLPTSDVFAGCQITLLKSENFYRIEEPDDEGDRNQQQQQGIITTLMELGHSVV

SEQ ID NO: 982434 - protein, 103 aa, Homo sapiens
TPYEKNPSSATLEVGWCHPNDLPPEADPEDETLRKLYEQHQMVQDMLVPIKCLQQALHTFQNDSPRLPHLAVSVHPAQTDQDLVHPKRKGGRATHIDIGAYGA

SEQ ID NO: 982435 - protein, 131 aa, Homo sapiens
DEFTNNAAQPHQVPMVAGSPLGATQTCNKVRCVVPQTTVILNNDRQNAIVAKMEDPLSNRDRISLENVISNAVPGRRQNTIVVKVPGQEDSHHEDGESGSEASDSVSRCGLAGRQSIEEHVTLITRNSVRG

SEQ ID NO: 982436 - protein, 50 aa, Homo sapiens
IPTCAVTGTLTHPTASSAKSATSPKGKKLTTRFCQLILDPIFKVSDAIIN

SEQ ID NO: 982437 - protein, 34 aa, Homo sapiens
VVRSYGKQSAEMNTAKIIPQEQSGYYIGTLDTLV

SEQ ID NO: 982438 - protein, 34 aa, Homo sapiens
GEHSIAVEEDAESEDAEEEDSETLQVLSGTAVLP

SEQ ID NO: 982439 - protein, 95 aa, Homo sapiens
MRSALAQMRVDYQQVPLTALKTSNNRLLNKRRPKQAGSSSASEDCNNQQLMGPWRSPVRQSPGGPRVILFTKGTSVVSTFVTRTFRMEDPDHKPP

SEQ ID NO: 982440 - protein, 67 aa, Homo sapiens
SHTSSTTSSTLHTTPPALPPPLPPPAPPPPLPPPAPPPPPPPPPPPPAPPGPLSFKLWLVVVLAEQW

SEQ ID NO: 982441 - protein, 118 aa, Homo sapiens
DVLVARSRLEAPEVLILLGCSDNSYRTNFEVRSVDGFQCYLQFEHAVTFVSCISMGKRRSSGDGALSSVALGRSDMESGSDPRYRTVEYCCRDACFAVTRSDSRIIRREPVGGVLFSL

SEQ ID NO: 982442 - protein, 67 aa, Homo sapiens
RFTGLTMERKVLALLARLRIGPRSRLFLHFLNFLRFASLGNSAWRFCFFFNFFFLFFDIWSAGLCCG

SEQ ID NO: 982443 - protein, 46 aa, Homo sapiens
DSRGLPPFPPKNPKIIWVCGGRLESQLFGRFFDLVVISSYTFSASI

SEQ ID NO: 982444 - protein, 56 aa, Homo sapiens
SCTDHKLFISGCSLVALMSVERSSDECLPPAMVLCSVAAVLLCAWNGSALTVGTWY

SEQ ID NO: 982445 - protein, 130 aa, Homo sapiens
MSAHTCRLNEWAPQIMDPRPLQLYPPPGKEQPLDEELKDAFQNAYLELGASEKESWVSAIIFLSDEQVSVKGSSLTRDDVNFPIDNLCFVGLISMMDPPWAAVPDAVGKSVEVLELRSSWSQETIQSQVK

SEQ ID NO: 982446 - protein, 50 aa, Homo sapiens
PVVLEDPTHLLQGAGPLWQPDTAEIVIFKVNFDLWYTGCVVASVSNLSNL

SEQ ID NO: 982447 - protein, 60 aa, Homo sapiens
WRLFIGGAPDLLRQHKLSTKSHTRKTAVNYVSSINKHQYHFLFQSISQMEKMRFITTQCV

SEQ ID NO: 982448 - protein, 74 aa, Homo sapiens
IVEDQSIYHASRRRTQPRQHAQVPVIAEVHDEPARVDLEQQILAETLDGEHLARTQLLGEARPARASAASRYGG

SEQ ID NO: 982449 - protein, 67 aa, Homo sapiens
IEVCHDPLPLWMRTIIDTRRHRQSLVLLACYLEDPSVLDTSASGRAFSVLSTGSHAAATTTAEITES

SEQ ID NO: 982450 - protein, 38 aa, Homo sapiens
MHLSLCRGSADVPRTRVWRGYTEHTVVASFGRLPIVAH

SEQ ID NO: 982451 - protein, 79 aa, Homo sapiens
VVPPVFFIEDLLSALEIIDLVYLSVALRMLGLPGLGVASILVLSERVLSNSAALPPPCIPFPLVYGKLAYGSFCGVIFL

SEQ ID NO: 982452 - protein, 65 aa, Homo sapiens
RALRISALGGALLQDPGLSMELAHLHSTLAQGIPASPLFVESQWLTLLGRLFSETRMVKQQFVKG

SEQ ID NO: 982453 - protein, 33 aa, Homo sapiens
SPHVNFMDELGSYAVHSLARPFEQGRSAQMAPF

SEQ ID NO: 982454 - protein, 52 aa, Homo sapiens
SEKPVFFLLVKVGHKLLAGANGSPATLAPGGPGVASKQSRAISRPGQGGAEG

SEQ ID NO: 982455 - protein, 105 aa, Homo sapiens
RSWRPFLRETAFIFFVGKILVRLLWRGTPVLFLSPGNYAVVLLGVPWFTAMRMSLPRVALRAVRRTSPSRGSCMSFSLQHFETDCGKYRRRKQSQQKLNGGPGGS

SEQ ID NO: 982456 - protein, 129 aa, Homo sapiens
ISCALPGTPKSADSLKIDSCMLVSLVLVVDSTIIVIGDHPGVITITIIITVITIIITIITSPSPPLSLSSSPFSITIIIIIIIILIPIIITITTVIAVITIAINVVITIIITIIIITIITITIIITVII

SEQ ID NO: 982457 - protein, 111 aa, Homo sapiens
PPAHLVSGSLSVTIFSVEDMIGSFSVGLSYNRFGRRNSMLMMNLLAFVSAVLMGLSTLLKTLDILILRQYIIGDVSAYLYHSCTRPCMCGEMTPTSPYSRPGKSASGGHSR

SEQ ID NO: 982458 - protein, 32 aa, Homo sapiens
EVRVAGVASEEQEGFADWFVKALDDLHEMNHV

SEQ ID NO: 982459 - protein, 93 aa, Homo sapiens
SLREDGMTLADIAEELETVNARGKVCCCVRKTVEPIEGWAMAVSVQRRDGAVREDGVMVVEVTMGPEVVGTEEMAVVDVLMVEWMVKVKVGVL

SEQ ID NO: 982460 - protein, 36 aa, Homo sapiens
HVTVLYPVLSVTQTLTLTIYCNSARPGTPLPSCTET

SEQ ID NO: 982461 - protein, 71 aa, Homo sapiens
PKHTTVQNPLHDYIQSSKQPPPSIRLPSAQTPNGTDYVASGKSIQYPDSHIGTDTLHYGDNNGGPHQSVLT

SEQ ID NO: 982462 - protein, 95 aa, Homo sapiens
QVHMLNRKMEHRDKTSPQNVACDTSLSSEWTGEQFHTSAEAESPMSLLLRALLEDWKKVKPHACDESANCLEILVVEPGVKKSFTSFYYKWMKDI

SEQ ID NO: 982463 - protein, 75 aa, Homo sapiens
LEVHVRCDHAYESSLGTEQDPVSHTHTNTHTHKKTLNENAHPHCTYAAPPMTTHGQHSSILADFSIRNNSKPEAQ

SEQ ID NO: 982464 - protein, 147 aa, Homo sapiens
PTRGTRVHVHISSQVQYSPEEVWGMVLNNPRAQLKIEAEQTIKDAVITGPVFSQPGRAPSGDKKAARMDGLKVLQLIKDNTATALSYGVFRRKDINTTAQNIMFYDMGSGSTVCTIVPYQMVKTKDAGLFTEQRKGQSAKDVRENPR

SEQ ID NO: 982465 - protein, 53 aa, Homo sapiens
LVTSHSGAQQVATKLEGSDLDLVRIGHWQEGKGRGQRRVVAKVAELCCCLTKE

SEQ ID NO: 982466 - protein, 86 aa, Homo sapiens
IAKTRSHTVTTNTMDTNTVTSRSINTSTTNTITRDTFMSINTSTTNTITTDTFMSINTSTTNTIGMSTFTSNNTSTTNTSATNTFM

SEQ ID NO: 982467 - protein, 49 aa, Homo sapiens
GQYPSGAVDTTQPETDISSTEDFCVNTRTSHPCGPYSLPFFAWLAKQKQ

SEQ ID NO: 982468 - protein, 75 aa, Homo sapiens
AIHLLSYSMRPADMAQVKLQKKELKWYSLEASVKLSCKVTGYIFTSNDIDWMRQTPEQGTLSEIGWISPGEGSTE

SEQ ID NO: 982469 - protein, 142 aa, Homo sapiens
CPQLKGKALRDQWSELYQNLTREQADYGVSHMKPYVDVKVPRAPPRVRLLGVHPLASRRTEPIPGITHPIAACPASPCCMSAPLCAHHLSTVHLKPALAGNEDLGKKGASITRYRGPVNNHHVTGGTQIGVYEAECPLSDYT

SEQ ID NO: 982470 - protein, 134 aa, Homo sapiens
GPHIDTPGYGGSSTIRTFRFEAKASQIMKILNITAVRDLQEPTDDRMFHVVYASGSVRILSGPSGSGRAKFVGSNSSAFTPDESCKCKWHLGSQVGSRVSAGSIGELSAMKPPMMANKLLMGSEHQCRVPQLEC

SEQ ID NO: 982471 - protein, 52 aa, Homo sapiens
LRIPHGGSYRNQQQLFSCSPTFSSDPLTTPRYSDQDEQQCRYEQQCRYEQQC

SEQ ID NO: 982472 - protein, 112 aa, Homo sapiens
MIRFYTETFHSQGQAGDRCLPLVSAAKRPSSFTNPPQHGPFMGVGLGDGGLSFPTRPYLRLSQWRENLDNNQAFLGRGPCGLPQCIVSPRYLRTENGVTLTSKRLEHFNKAI

SEQ ID NO: 982473 - protein, 51 aa, Homo sapiens
WCSRGSHCCHTCTVVHTALLFIPCTVVHTWSLYRGDGVRVWWVHLVGGMNN

SEQ ID NO: 982474 - protein, 74 aa, Homo sapiens
EIVPLQSSLDDRARLRLKKKKTQKTKVSQAWYHTLVVPVTQVRGPFQPRKGGDAVVSCDGATAFGPRQQSETLS

SEQ ID NO: 982475 - protein, 61 aa, Homo sapiens
MSWWLVWLLLAHTRVGGWLLFEPAWTCLDCTGSQCNTLCYKLEPQMRKRAAGSGAVCALAF

SEQ ID NO: 982476 - protein, 79 aa, Homo sapiens
RLDGRQGRGELCRCWELAGGATGVADVLLYSVLGGGRLPVAQLGQAGFDLGQMAFHITRELKCKPGLAEAGTTQKSVLR

SEQ ID NO: 982477 - protein, 60 aa, Homo sapiens
LLFIPALCSYWSLYRGGRGMNNSAGMNNSAGMNNRCRYEQQCWYEQQCRYAQQCLYDQQC

SEQ ID NO: 982478 - protein, 69 aa, Homo sapiens
RPRHMHQILLESNFRVRVRKCHRHHVNPKAKVASSSTPRTLNFRHFWSRQSLSYFCIMTMDGMVFLQYD

SEQ ID NO: 982479 - protein, 71 aa, Homo sapiens
YYVDTGFHHVAQAGIRMPELKVIHHLGFPKCKDGRRERPGAAKTAYFNSEHRRTQLGTAQKTRIGSEMDAV

SEQ ID NO: 982480 - protein, 122 aa, Homo sapiens
AFAITAIQGVGRRYAHMVLRKADIYLITEGRMNSLRIEVQRVITIMQNACKYKIPDCFLTGRKDFQYGRYSPGPSLNAQVQHVSVKTSSERRIFGAVECCVTAGAFESKGSTPRPLAAVVET

SEQ ID NO: 982481 - protein, 62 aa, Homo sapiens
HCSLHQCTWTTLSTKSFILLDTLGALVTLTSMAVGGSSLYGLILHHAHKLHLCCDTTLAMCH

SEQ ID NO: 982482 - protein, 107 aa, Homo sapiens
MSYKCEIGRAYAGAVLNAVGVSTSLVPTLLAWSSQFRQLLSDYGAPSLCYTQGNWKHARCPKVKYAETVGYHSNMLGDGNQSHVRFKHYCHVEAEARNPSCLIRLVR

SEQ ID NO: 982483 - protein, 108 aa, Homo sapiens
MSSTNRIWCLKSTSTYSIASQAGSFTYKDLKNQLARLVVQGGRCSVGFAKLRQTWVFHTSLATETITAEPAEPSAGSASTPTSRGHLCIQPKTLLLIRKTDRRKVSAY

SEQ ID NO: 982484 - protein, 49 aa, Homo sapiens
GVLEDPHCCSYLHCCSYQPKSIEAGVKSVLDHPRYSDQDEQQCKYEQQC

SEQ ID NO: 982485 - protein, 63 aa, Homo sapiens
HNSAGYEQQCRYEQQCRYNNGARYEQLVQDKQQCKYEQQCRYEQQCRYKQQCKYEQQCKYEQQ

SEQ ID NO: 982486 - protein, 68 aa, Homo sapiens
AVLEESLNTVMYEQQCRLTTVQVKQQCRYNNSAGITTVQVKQQCRYEQQCKYEQQCRYEPQCKYEQQC

SEQ ID NO: 982487 - protein, 46 aa, Homo sapiens
SRGSPLLFIPGRCIGGGGGGMNNRCKYEQQCRYEQQCRYKQQCMCY

SEQ ID NO: 982488 - protein, 32 aa, Homo sapiens
MLIDTLLYHMPLQYIYLSKQYNKAVLGMNNSA

SEQ ID NO: 982489 - protein, 34 aa, Homo sapiens
MPYTRRLKPDLIIASVTSPDVIGEVKQNGIFGGY

SEQ ID NO: 982490 - protein, 84 aa, Homo sapiens
WNPYLLLKTQKLAGCGGTHLPFQLLERLTHANHLIPAAGPAVRRDWAIVPQSGRHSENLSQIKTRPGAGWLTSVIPALWDCQGE

SEQ ID NO: 982491 - protein, 53 aa, Homo sapiens
KAQINSSRYTTGPVTTAQLQQLSYNSSSYNSLSSRGPCILHIILEFNTSCLTG

SEQ ID NO: 982492 - protein, 81 aa, Homo sapiens
VDPDNYQTGVVINRQELIHIHPHCWLTVPEVFEGQSASIPLRNIGFQGLFVDFGRYLRAAPEVIQGREAKGLWHREYRGSW

SEQ ID NO: 982493 - protein, 68 aa, Homo sapiens
MATYIRLDGGSVSLRLDDLGTSGDKPMAPRLRTCDVSLREVLALRFVQECHRMDTASWQGLPNADSLL

SEQ ID NO: 982494 - protein, 50 aa, Homo sapiens
LQQFNESGDKEALMSRRPDVMVTENLWLSIAYGLDEGPRAIHETASSLTN

SEQ ID NO: 982495 - protein, 71 aa, Homo sapiens
LATTAKTYVAISITNSSLGDWLRGAVCQLILNTRSITLLISRLTPLGSRAHSRGIQFTEISGGFGQRSISV

SEQ ID NO: 982496 - protein, 91 aa, Homo sapiens
VTTASSYNSFQLQQLQLQQLLLTYQFLSGRLTSLSVVVVMAFPPGVLTVTTPRRQNPALVLYVFSLPHHTTPSIGHFPVKGLESFWEVAGE

SEQ ID NO: 982497 - protein, 97 aa, Homo sapiens
MGSKTSMGSNENLESRESRIEKLESVHRISLLGIVVFVALTVVGIVFAGDLSVSRIAVGIIGVTFVMAFQFNGRELDRYERRYTMSHLADRPKSMKI

SEQ ID NO: 982498 - protein, 177 aa, Homo sapiens
KQLITFTYTKACPDSFLSRKYQVVHNILYLFFDKICNRLTSRKPALIVFCLSFYSATTCSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKESLAERQQLIPELVRNGD

SEQ ID NO: 982499 - protein, 56 aa, Homo sapiens
QLQQRTEGEEEITSATLSLPGELHRFLALKLQPLSLTCVATEAQRRYGTRGSDAYW

SEQ ID NO: 982500 - protein, 45 aa, Homo sapiens
YARLKDLAMHASESLHCRNLSAWLITSDVICRNKLLRVSAKHWHN

SEQ ID NO: 982501 - protein, 78 aa, Homo sapiens
RTAGIAADIDQVLLVFGLAALLGIWVVGALIDQRLRALLVISCGMFALSALALAFWITSPAVIYTTVTLWGHYSLQSP

SEQ ID NO: 982502 - protein, 69 aa, Homo sapiens
YVLRYSRGFSATPQKKADSGFRGRCRNEERGVTGQWGGGFFLGVNGNVLKGGRDDSTPWACTLEKGEIG

SEQ ID NO: 982503 - protein, 37 aa, Homo sapiens
CLEVDVYSPVRVACLSLYKFRRQVSTVLTSKYVKLEP

SEQ ID NO: 982504 - protein, 34 aa, Homo sapiens
MLEGSYVREGQPLVQINDVLLLAPSVQQQQAGVQ

SEQ ID NO: 982505 - protein, 33 aa, Homo sapiens
MWKGSYVREGQPLVQITTCCCAPSVQQQQAGVQ

SEQ ID NO: 982506 - protein, 49 aa, Homo sapiens
AKYSAGPFLKVHLFGARFTLFVYHSTYVLVTAGMRYNQCVQQNLVWKVC

SEQ ID NO: 982507 - protein, 90 aa, Homo sapiens
TLEVPMDSSSRLRAQHPVITCSKENQASNRFPLMVYGGAGNGQLPISRVSGLVAWPSLLHTSHVYFWLRLQKVIHHSPPSFWGDDWELHS

SEQ ID NO: 982508 - protein, 173 aa, Homo sapiens
WSSHRLVKASHPLTTSIKGHLLPRSPCGPRAGGKGLAVVLQQSLECDDGCRSTMRRSQYSSCASGSTGIPGNPLPSSGSLTWLSENNEFNTVEHIEEVAYNALSFVWNVNEEAKVFIGVNCLSTDFSSQKGVKGVPLNLQIDTYDCGLGTERLVHRAVCQIKIFCDKGAERKM

SEQ ID NO: 982509 - protein, 87 aa, Homo sapiens
NGRYFDAEHDRLMLDLANGMIFRSRFPAKMLTPDAFDECAFCVDDAALYFTYEEQCKQIKLSHEQRAELVLNALVAYRFLKPLMPKS

SEQ ID NO: 982510 - protein, 33 aa, Homo sapiens
MIRPPANTWHLSDSCLAWACLVLNVVYKLSPVV

SEQ ID NO: 982511 - protein, 37 aa, Homo sapiens
ANSLTQAHTQPPVLVIYVPSHLLVTRINPTVNQTAGC

SEQ ID NO: 982512 - protein, 43 aa, Homo sapiens
MASLDRVRDGIEQHQQQAYAGSHVQVRDARPEHAQHLVVPGGG

SEQ ID NO: 982513 - protein, 40 aa, Homo sapiens
CCGNPIQAHCRRLFCLDGSVISHPESVTPAASYMAGSEYK

SEQ ID NO: 982514 - protein, 39 aa, Homo sapiens
RSSYLVCKCHFIHPLSNSALTSLYCSLASDTSLSSPSLA

SEQ ID NO: 982515 - protein, 127 aa, Homo sapiens
LLTTQCEFSFIGEGVIYKHSLRRHTDPNIDTHHHHHYCDPNPNTHRHTDPNHDTHHHHQHGDPNPKHPLAHQALTSIVIINTSMVTSSPNTHRHTDPNNDTHHHQQHGDRSPNTPLGTRTPRPRPFA

SEQ ID NO: 982516 - protein, 53 aa, Homo sapiens
YAVEQPYSCRPGEAALWCLKDRLLLPIPSGISATIHAHAMEAHMCSGYLSSEF

SEQ ID NO: 982517 - protein, 75 aa, Homo sapiens
LREDMIATVSASVCLSLLVRHSNEDVMSCGLLMRMTAPVKLQWGLDENGCNYEGYVADGRVCNELILCVLFVICA

SEQ ID NO: 982518 - protein, 161 aa, Homo sapiens
TSNICSLNTVSDIFSRLLRRMAYEKNKRVGIHHPGIVGIAVIALTGYRDVIGAVDVEQIGVGVIDLRKLQVVIIQQLFHQADHRQRGDFLPNPELSGDLIVQMFADAGNSFARRPIGGQTLRSGDLRIDQAHAFEAVRLQVSLHGFGDIFGALTFVQGDPS

SEQ ID NO: 982519 - protein, 46 aa, Homo sapiens
FTAENAGYYKMQSYFELARRYEENRANVIHVLSFIFYYEDIKKENK

SEQ ID NO: 982520 - protein, 70 aa, Homo sapiens
GSIRKAHPNTSVSRIRSIITGAHHSLIENNRTQIIKHGYQQYTGVYYFTLLNKYSEYYRVHPITIFRSGY

SEQ ID NO: 982521 - protein, 53 aa, Homo sapiens
IPTLLVFAAQHRISAMGKSKSNTFEQQEEFSLLEERVYTVSGRVIIAPGEKNK

SEQ ID NO: 982522 - protein, 50 aa, Homo sapiens
TGFGAGMGGQLGVSKEKIGSHLHPTPAGCGPPSCSLPLCDSPVSIPHPWK

SEQ ID NO: 982523 - protein, 65 aa, Homo sapiens
TIASSSSVRNLVADIRRDVNVAFTGSHFRHLYMHIGLVIIVPAHPLCFKSLVVHPIALTEVKAHK

SEQ ID NO: 982524 - protein, 52 aa, Homo sapiens
NGNNALNDLTLDRHALNDLTLEDRGMESHCEKWNRQPSALTNTQFLICEGVL

SEQ ID NO: 982525 - protein, 40 aa, Homo sapiens
AYGTMLTFFEELPAVRSDITDCTSSSSIMRFSVSHPWEQF

SEQ ID NO: 982526 - protein, 126 aa, Homo sapiens
MIPLPTDKELTDMSLNQPMLDAILPSESIKKPRRVMTGESGLTAMECALHLDNNCSSVTSGTAQIGPLSKMTPNECEFIDDTFTVNAHGKAIKELVDQGYQVLRYMVAPEVWLGGKISYYDISVLG

SEQ ID NO: 982527 - protein, 46 aa, Homo sapiens
MRRDQGRRRQKSGLRAWTEMNGIKELDSGQAWWLTPFIPALVRLDG

SEQ ID NO: 982528 - protein, 70 aa, Homo sapiens
LSELLFMKSIGTANRPMGAGEALRMSAVCAWLSGIVMPNGSWHLSALVIQEATDAIGHLDGTATVEDITQ

SEQ ID NO: 982529 - protein, 80 aa, Homo sapiens
WRLRDSLRTALINSTGEEVGMLQLVRSVTVVEDDYALGWRLPAPSPPRYVVAAAEAEPALWPPSQVLGCQPLPQPSPLVG

SEQ ID NO: 982530 - protein, 41 aa, Homo sapiens
MTCGLRGCRAKLGHETLNVLLSAEIYTVCLVAVCNSCQSPV

SEQ ID NO: 982531 - protein, 46 aa, Homo sapiens
DSCVTAQSSSSYRGGAWADLVSVDQEEFVSSSMVMKNNILIFGLFE

SEQ ID NO: 982532 - protein, 69 aa, Homo sapiens
KHPQLSSDSLVLGTSTPSVDVYAMKRHDSSPKKEVYFIVPSFDILNAITYTNEESVHMLDNNGFYTAAG

SEQ ID NO: 982533 - protein, 31 aa, Homo sapiens
MGLNRSDYMYQRSCNGPQPWNMIEINTISAS

SEQ ID NO: 982534 - protein, 35 aa, Homo sapiens
SRGVSSLQRLLTPAVTPHSTRLLTPGGYSSTGRVS

SEQ ID NO: 982535 - protein, 33 aa, Homo sapiens
ACGQDINTGRLPVEMSGNAEPQESSVSPEALCD

SEQ ID NO: 982536 - protein, 46 aa, Homo sapiens
MTQDSQTPGEDHNPTQTNKSTPTNQPRPPPPHQQNPHIKATTPHTP

SEQ ID NO: 982537 - protein, 40 aa, Homo sapiens
MWWVLGLGVTVVVVLMGIMVGVCVLLGVGVAVTVAGVVAG

SEQ ID NO: 982538 - protein, 38 aa, Homo sapiens
LLLTNTHDVSSSSSTDTCHPAPPLQTHSSGYTLFVEVA

SEQ ID NO: 982539 - protein, 59 aa, Homo sapiens
ETPRYVAGGLDGCVEERSDFPLDGNWPLRGNWWGICAIEDIQGDWVNAVGTRWVLYFTF

SEQ ID NO: 982540 - protein, 51 aa, Homo sapiens
CDISEDPGIPRYGRGGHARPVSHLQVSSGVYEPVVIEMPLRSRCPELDDRV

SEQ ID NO: 982541 - protein, 33 aa, Homo sapiens
SQDEKLRQATVQTDLLTNPYPVNHLFTQLTTPV

SEQ ID NO: 982542 - protein, 50 aa, Homo sapiens
RGSVNTRYGAGRIGVLDEGKMKLDYILGLNDRGFLRDDCLHDPVSSMLGF

SEQ ID NO: 982543 - protein, 43 aa, Homo sapiens
YVTHHEFPLCFCLPMALFTIFLGLTLCASWGLDESLPVRGLLP

SEQ ID NO: 982544 - protein, 46 aa, Homo sapiens
LLRIRNTLLCGPSPAALGGQAEMDSFCVPMWGPSQPCISVPVAGCF

SEQ ID NO: 982545 - protein, 37 aa, Homo sapiens
MWGVGVGVPVLVVVLGVMGWLVCVPVCVGVGVPVAGC

SEQ ID NO: 982546 - protein, 62 aa, Homo sapiens
WGYYETTLRPASVHQSADGGGLADVLVVATYQKDAPQDNMATPRTRGQQFLLCLIFCGTPAL

SEQ ID NO: 982547 - protein, 55 aa, Homo sapiens
RGSGYYPLRKLVVPAPGGHHIDAELSADPDRIAHYSPELLGSSDPPTSAHRSWVL

SEQ ID NO: 982548 - protein, 70 aa, Homo sapiens
SNNSTELTKKFQNNRYERMIDKGEGVSDGRMTNRGKDAVFSSGSCYLCFEIPCTVSGIINDQSMCVEKVD

SEQ ID NO: 982549 - protein, 65 aa, Homo sapiens
MCILGSKRWACRKIRVRWARASDIVSEPFPQRLAYVSPVAPPVEGLGRGSKSSALAAGLPGTAAR

SEQ ID NO: 982550 - protein, 52 aa, Homo sapiens
SVSLLYNQVDTRTFQEHQPFQGQQLLAFEALEFLPEKELKKSVISILEKGDQ

SEQ ID NO: 982551 - protein, 61 aa, Homo sapiens
PGMPRNDGDVFQKFGFHGHIPPSLKAQPDSAVSSSDCDITAWSVVPGYLSLEILEYVDHTL

SEQ ID NO: 982552 - protein, 76 aa, Homo sapiens
LEYPRLPRKTGGRLEAGGWRSGGWRDGGEERSSPLDKGTCEFAYKCSIISGQCWVAIFRSAGHQFKVTPVCVLRGS

SEQ ID NO: 982553 - protein, 83 aa, Homo sapiens
KSPGSNKTQQVNCETGTGTNWRSCGGCRQPPRDVYVTRNDSNSLCIWNPELSELQTALTQSPVDVLFRPDTPFISLPDSSGAG

SEQ ID NO: 982554 - protein, 85 aa, Homo sapiens
SPRKTTLCHALRWYYHIYVLRNGIGLACQAVKKALGKYCPAICKTLQELELPVVQMIITFTSLDLIIRRKVKNADRLREERLAGA

SEQ ID NO: 982555 - protein, 38 aa, Homo sapiens
ASRRRLAGAAPPVIVSEEAVAGIKEDPVVLVEFVLRGL

SEQ ID NO: 982556 - protein, 152 aa, Homo sapiens
GSRFKTCREHDPNDKGSNSPPGNTPSEVTAHETSPHAELMCRVSPPSGVHYPVGHTAWASSSHLVLSPLQARSLSLSTLLPPALPGTEERQQSFSVVAASPGHTLRNGLWPARRVLEEHSTLFMATMCMAHVDLLRTRRHRDEAVFPGLQTG

SEQ ID NO: 982557 - protein, 54 aa, Homo sapiens
GSARRDAVRLSFFPVDHRPAKDWLQLFDVLRGLPLYTCERDELASWGVPVLRGL

SEQ ID NO: 982558 - protein, 64 aa, Homo sapiens
CHRETRQDRKKLDSIGKGDEVLTTGVLIGRVTKCGLDTGIIAIALNDTTEVMIKRDFVAAVLPK

SEQ ID NO: 982559 - protein, 90 aa, Homo sapiens
QLRETETEALLGSVFRSRVCVYRWLWPLQAAVEHWRVPRTTLGWAPEDVGCPSCGGCRLAAQPPQDAEMPLLAAKWVSLLPAGLDVFRGL

SEQ ID NO: 982560 - protein, 48 aa, Homo sapiens
PRVYTGSAGIIGMSLCTSPRETFCCGSVLLHVCEEETKAQPWCEGHMF

SEQ ID NO: 982561 - protein, 51 aa, Homo sapiens
PRKTGSPRANLYRECIILQAKVRWRHDGGARETLGWLPALKARLECRNGIS

SEQ ID NO: 982562 - protein, 55 aa, Homo sapiens
GVRPTGPRGERGPRGITGKPGPKDVFGLLGGGRREPKLQGYRDVERLRVSVHLFY

SEQ ID NO: 982563 - protein, 111 aa, Homo sapiens
MAPVCCICFFVILPLNLVGTILGRNLSGQPNFPCRVNAVPRPIPEKKWFMEPTVIVCLGGILPFGSIFIEMYFIFTSFWAYKIYYVYGFMMLGLVILCIVTVCVTIGSHIF

SEQ ID NO: 982564 - protein, 42 aa, Homo sapiens
SYRIELLPDVILALHRFPMREPHCLAVDHQPQGDRGLLAAVL

SEQ ID NO: 982565 - protein, 58 aa, Homo sapiens
ETLRIPVGVVHQSLFASSSRIPHLNPQVWDISTPSLATDHMPITIPLKPNHPYPARRQ

SEQ ID NO: 982566 - protein, 45 aa, Homo sapiens
PTSPTGPLARQPDSRLARQAAFWVMRMFWNQMGWLSGVGAVGLVG

SEQ ID NO: 982567 - protein, 117 aa, Homo sapiens
GHPQLPTAAQCSTDHSTVPWQYHRTNPLVNESTTFQSSPGSTHTKLFPDSTTSSGIVEASTLRHSMHWLTTHNTVPCQLHKPWTSGRIYRLPDPPSLNSHDAFTPRQQCAIETSKTR

SEQ ID NO: 982568 - protein, 52 aa, Homo sapiens
PIADTARAGDVKAPSDFSSLCCNLCVLKHTPGKSLLPFEGESSLLLLTLLKL

SEQ ID NO: 982569 - protein, 39 aa, Homo sapiens
SIFTILLTMNIDLKNNYEMLLSLVKQHQETINTLAYEIS

SEQ ID NO: 982570 - protein, 45 aa, Homo sapiens
LAMLHWDGRGENEHTRYTDTTCVLRYAFSMILCSLVSAIETSKPR

SEQ ID NO: 982571 - protein, 91 aa, Homo sapiens
NTRYVNTPATWNTPLRGTGTLPRLVHALGAHCGALVLSAISSRFSLAPSERGLECNLSVLVSLSLVTLAQVEPVVLSCHSLMQPLGDELWG

SEQ ID NO: 982572 - protein, 33 aa, Homo sapiens
PATEPCIEVAPGGLARELTEVRGALPEQVVGLE

SEQ ID NO: 982573 - protein, 82 aa, Homo sapiens
SGLHMGPMVFFKFYGSLPVTHALAYWVCSLVITGVLYSGTIVSVMSPSVNAHQAGCTSSNIIHGQYQSYHRQLHFHVSFVHL

SEQ ID NO: 982574 - protein, 64 aa, Homo sapiens
PTCYETRQAVACCRRSGRFPEAGNVMLSARGDAGGWGLRGLAVALLSAVSASDLELTPPAIRGL

SEQ ID NO: 982575 - protein, 100 aa, Homo sapiens
VRVRSCIQHLEASRWITESEFKNNWQHGKTPSLLKIQKLGQMRWLSTFPTLWEVKTVGSIEVQEFENSLASMVKPWLSLLKIQKLAGHSGDAYNSSYLGC

SEQ ID NO: 982576 - protein, 59 aa, Homo sapiens
TCALYSDLYAFLHDDKAGSDYDPLKLTCGDEARMTQRDEMTLWSFNLLVQTVPTLRTLV

SEQ ID NO: 982577 - protein, 64 aa, Homo sapiens
VVWGISAFLQLSSATRKGTARPGVYDLLHAQLWPHVEWGWRLGTGQRTRFGPGWAGPAPGRTLG

SEQ ID NO: 982578 - protein, 145 aa, Homo sapiens
SVSSTSAGVSLEAVEETHRIKSQAPTAGLGQQADSALGRMPQGLADFLAHGIAQAHAVACEFTQVILLAETEGRQAPRAGQRREPQYFILFTEVQVQQADAVAKGVGLGRKPAMGDPAAVEGAVHRVSPKRLGHAQSADHAVFVK

SEQ ID NO: 982579 - protein, 75 aa, Homo sapiens
MIHTSPASPLVLHATYTAGSISSSPAPPLVHRYLLAGSISSSPAPPECTDTYKQAPISSSHSSSHVVRGYLSVRH

SEQ ID NO: 982580 - protein, 56 aa, Homo sapiens
QTSHIAQCERATGRHEGLDGMLPPSVTEKETVKLMLNKSSRHVQNDKAAELEPQRL

SEQ ID NO: 982581 - protein, 35 aa, Homo sapiens
QHPLGTGGPRSREAHHIDANLVRTPERHSALQPRT

SEQ ID NO: 982582 - protein, 102 aa, Homo sapiens
MAPLIGAREGEVVITDTTSINLFKVLSAVLSVQRQRTPARKVIVSEASNFPTDLYIAEGLAELLQQGYSLRLVNSPAELPQAIDADVAVVMLTHVYYKTGYM

SEQ ID NO: 982583 - protein, 100 aa, Homo sapiens
IVEQAIPSVSCPHLWYKCAKGQEANGRAWLGSGGKWDGDSQSGGNENQQMNQCEARGCHMPPYEHESRNRGYSTGLSSPQSPRAVLPKFLHPLGRGYRSL

SEQ ID NO: 982584 - protein, 39 aa, Homo sapiens
IVYSGRFQASNSSLCDTSAGPRDHFSGRRPSSSSLGRGT

SEQ ID NO: 982585 - protein, 50 aa, Homo sapiens
PRDPSLILLAGSTRLSSNSDWQDQPGGRRIRTGRINQVVDEFGLAGSTRL

SEQ ID NO: 982586 - protein, 36 aa, Homo sapiens
DPSQDEKLPKDENIAASSHLRITVSDFTDPPIPHPW

SEQ ID NO: 982587 - protein, 119 aa, Homo sapiens
MRQGQDEAQDSALEVQEKKGLKRESCHFNHSSRKATTRKTRVLGIVVKEVSRVLKELVSEEPGQEPERGPEKVQGRVQTMRLPLPDSGCESKGAGQSGVVWIDAGWDRRGQKPVEGLRK

SEQ ID NO: 982588 - protein, 40 aa, Homo sapiens
PLKTVAWVEKYYGTEDSALDGGISWNFSFPALLSFGCVKV

SEQ ID NO: 982589 - protein, 81 aa, Homo sapiens
MQWSLTRLVVLSLFVDDRRKMRDQRCSVISRKGLEVTPQSADYLETPEQETHGTSRNSGHSDSFATSRAEPTEQINYLSTP

SEQ ID NO: 982590 - protein, 66 aa, Homo sapiens
IAAALIRLDMKTVYCVRLGILKDGGGIVCALSGILDGAEDRAKALPECFLHPERKLEVRVEWGGQA

SEQ ID NO: 982591 - protein, 67 aa, Homo sapiens
WYAKVRVRVCQVGSVLMVPVRCEVRCKLQDKSDEQNCGSASLIDQFRCVIGQCIGKHKKCDHNVDCR

SEQ ID NO: 982592 - protein, 41 aa, Homo sapiens
QTLLELLGHVVVADGVQLQQLVDLRACWLLYMGCDRYRRPR

SEQ ID NO: 982593 - protein, 46 aa, Homo sapiens
MDRAGRRDDIKKSVSSFTLAYEQAHENSLSLDLTLCSNHLCWEATR

SEQ ID NO: 982594 - protein, 35 aa, Homo sapiens
AEVTTGLRFPVQMKRFVPLMMKVICKEPTLCKEPT

SEQ ID NO: 982595 - protein, 48 aa, Homo sapiens
EKSSFSLIPHALDNAAFSIMSVEGHMAVVHVCDPCMSHATWLRLWTGY

SEQ ID NO: 982596 - protein, 78 aa, Homo sapiens
MPLYWISHTDSHMHARYARAEVTRLIAVSGKKAAKMALIFLNVWMMSATCLTTGFLCNAHCVLVEPSQIYPAFAVGFV

SEQ ID NO: 982597 - protein, 121 aa, Homo sapiens
MASPYPGSEKLRSLVLAGIHIAEATGNVATGTHRMLRGSCARSSEYHDSRLSALVAPLPSAVVCWLSGALHKKRNSESVLPLRTYKNSSNDEIIAGQQREAGGTVQEELEAVCWSEHVGYR

SEQ ID NO: 982598 - protein, 184 aa, Homo sapiens
LFDPPHRLHLLLPGHVNTALALAGSNKWDIIFCGLGVIMLVDQPDTQEVFIGEGCHHSGLVLCPTPSQPPMAGPLHDLIEVAGTVETLDKEVVSREDTPTILRHHEEDIGEDRRIWVTNNVDGEGIQWGEIWWSCDTENGRCPRTASEARACGRIGHPASLYVILGEAWPSDSFVPVVKVAFLE

SEQ ID NO: 982599 - protein, 46 aa, Homo sapiens
YCWSALELSPACHGWYGSEEWLRLAVEVEPYGQHDARTAIGGSEHK

SEQ ID NO: 982600 - protein, 34 aa, Homo sapiens
MHNHPQDTSISLPIHILHSLHLELCLQLGMMGTG

SEQ ID NO: 982601 - protein, 112 aa, Homo sapiens
IVVLLSEFVHTHVVFSKLVYPVTTKELRKVQEYFEKCRHNISKHALSLTKSCNIPDSEILNGNQFMLKLKIWQAPYAFSTRVSPDFPITHTLSPVQGACLLLVYACLLGTRA

SEQ ID NO: 982602 - protein, 34 aa, Homo sapiens
MSITLSDHPPRRSRYAFGGSLPVQAQSSVMVCPL

SEQ ID NO: 982603 - protein, 78 aa, Homo sapiens
SCRISRHCGKHGDGITQDDLTGLVAHSAESWWSGLKTFKRINFFLAFFFFLSGSEFLGGCRYYGVVEPIRNRISIGYW

SEQ ID NO: 982604 - protein, 39 aa, Homo sapiens
GSPRKTAKGTEKPDCDGGSAIGLLFGLLTEILLLVLRGL

SEQ ID NO: 982605 - protein, 82 aa, Homo sapiens
QPHGRTTEDHSSSWVLETCGLRQDVRYEMGREHRDRRLSCENRKPVLTNEVPYAHLPQLPCGCFQVKVRLAWGLLGEPPCLD

SEQ ID NO: 982606 - protein, 40 aa, Homo sapiens
SPRSPRKTRRRISGEEAEEKAVRQSPHHLRLLSSLSRLAW

SEQ ID NO: 982607 - protein, 142 aa, Homo sapiens
EDPASPQDGALLKRISCSSKSWLDVLREKGAIIVAQRVDLVVLGALISQGHTGLDTIWLVGFQNCVMGGRTLHVPVISVNYSFQHDKMCQEEPTSEASSGTGTALGRHAIHDIGHIYRVDLGNVIGVLPACLMISAPLQGPG

SEQ ID NO: 982608 - protein, 42 aa, Homo sapiens
LKLREPRTSLRGQLLCHSKLLGSAERQQLPVASPNTLGDKYI

SEQ ID NO: 982609 - protein, 39 aa, Homo sapiens
MLISGGARYLSGQVCYASGGVVTGDPFVVWLGVAIFPMN

SEQ ID NO: 982610 - protein, 56 aa, Homo sapiens
LRGSPAFPARRLCSRHGHVLTIQQQCEDRRPGLRTGPLETVPCHAALRHISRLAGS

SEQ ID NO: 982611 - protein, 33 aa, Homo sapiens
GIICASSHRPVREVLREQDRQAPHCSLQCDRLR

SEQ ID NO: 982612 - protein, 44 aa, Homo sapiens
QPRKTVVDSSSEAWLVVLAGTLLSDVTPGWLREVVDSSPIAYGL

SEQ ID NO: 982613 - protein, 47 aa, Homo sapiens
VQDVLTLYLSTRRWEEMLNRSERVSETRMHSAGDRARSVQKKLLMKK

SEQ ID NO: 982614 - protein, 83 aa, Homo sapiens
PAQPRKTPRFPSHPVDHRHGIVLPDGLDRNAPPYLEPSPVIYRQDARWEKDNWNFSKVDGPHGGGFYVDSLGFPLVCVVSGRE

SEQ ID NO: 982615 - protein, 80 aa, Homo sapiens
PTSPARTVVDSSLRPWRGWCWLVTLLSEYNLVGYRRWWILHRRLRLSCCAGESVVVGDLGLLLDGGRCLYLTPGVLVLAR

SEQ ID NO: 982616 - protein, 58 aa, Homo sapiens
DLEGCLLMRTVMTFLPVVAAVHHHGVCEALHNGTLSFAEASGGIPPCTGDAMTTVEAR

SEQ ID NO: 982617 - protein, 130 aa, Homo sapiens
GFPAAPKHATASLYPDPEDSVTWSRGLLSQRVLPGTLRSSWCALSGVPRSAGCSPPDFQTQLTIEPDILNPCCLYGPGCAYGRPSYLRLLRSCRAAVLRGLAGIPRKTAQPRKTQFVPLPFSLTCCVGYR

SEQ ID NO: 982618 - protein, 62 aa, Homo sapiens
YPASTMDGEKLKSPNRGAGFYTKGKEMGEPKWLEKGSEGGECYRFEITGSRIQSGLRPKGVN

SEQ ID NO: 982619 - protein, 61 aa, Homo sapiens
MPRPLDHLLDLVVLDMAAAMPPGKKSLANDMACSVLRSNHRYSIPCLDHRVGGNRGVLRGL

SEQ ID NO: 982620 - protein, 88 aa, Homo sapiens
GVLQISAEGSVEGRSGVGVPHKVATGALPSGAVRTVPPSSRPQNAKSTDSLYCAPGKATDTQTPAYESSQEGGLYPEKPQEYSFPRLC

SEQ ID NO: 982621 - protein, 43 aa, Homo sapiens
AELPHSRSALVNVDGLRAWIKKKGLDLGKRTKPHDIRCAFNET

SEQ ID NO: 982622 - protein, 110 aa, Homo sapiens
QLSEACMGSGGLVTGNSRVSGRNVGIHNEKETMSNLNYRLCSYLERVRSLETENRRLESNIIREHLENEGSPRLETVAISSQIIEYLRAQIFANTVDDARFVLEIDYARL

SEQ ID NO: 982623 - protein, 47 aa, Homo sapiens
APQDAMYTGIADRMQNGDHRPGAQHHLNINDHLHPQERKYYGVDQVA

SEQ ID NO: 982624 - protein, 38 aa, Homo sapiens
ACDLEDPVYLAVDAGFVLSADRCVPLNNGCGCWANGTY

SEQ ID NO: 982625 - protein, 37 aa, Homo sapiens
RIPGCGGGQLLVVRQLGAPSSYFRSLARWLPAIPRKY

SEQ ID NO: 982626 - protein, 44 aa, Homo sapiens
PEPRQESHQALPPGISAFHAFLFILCGLTGEARTLARLGPLARL

SEQ ID NO: 982627 - protein, 41 aa, Homo sapiens
MSTATKGEGQDFEFRLSGCRSPCFFHCACCFQAPHCCLSGL

SEQ ID NO: 982628 - protein, 44 aa, Homo sapiens
SPRKTPSPRRPAPSPPAVRWPSVLDPFTDYGSSLTVTLPVLRGL

SEQ ID NO: 982629 - protein, 45 aa, Homo sapiens
VGTTGAHPKCPANFRIFSRDRVSPVLAMDGLKSLDLGDHALSRSQ

SEQ ID NO: 982630 - protein, 40 aa, Homo sapiens
PRYGGEHPCTVIPTPTPPVTDPNIDTHHHHHYGEPKPNTH

SEQ ID NO: 982631 - protein, 64 aa, Homo sapiens
ELTYFDPDCLDKALQPEDMTRVHSSVYQSVHFVILKEASSPWLCAYGCKGQDSAAGFAFLIPAI

SEQ ID NO: 982632 - protein, 86 aa, Homo sapiens
EWNRHRRSYTGGQRNGTGTEDLTLEDRGMEQALKIFTGGQRNGTGTEDLTLEDRGMEQALKIFTEGQRNGTGTEDLTLEDRGMEQA

SEQ ID NO: 982633 - protein, 84 aa, Homo sapiens
DANEPSPVISLCLSDDKPLPAPAQQLPEAVDETQSPTKSQSSPAKLQSQAEGSLRFFPPDEPEFTSRKSQCITPRVTHLLIGFR

SEQ ID NO: 982634 - protein, 134 aa, Homo sapiens
SCMLSVGDCSGHEKSMMHGQREAIMDGWIKNNDIRSIGSRTKSVVYSDKEWGCSDRQGLPGSDRLGGAGAYRSGNDAAYREESVTREWTIAGREAASTQSGRSRDSTVHGGRGQAERRDDSDGSNRAVRGKVRL

SEQ ID NO: 982635 - protein, 102 aa, Homo sapiens
VGVMATWSAHLPYYVVDLLLDTAWTDMRPHNGSCTHGVSVPLTLTSMPPNVWTEVTAYMDRWSQPVLVSPWVVPSKVHWAPCLVPIPPSGALHLFPQLVGVP

SEQ ID NO: 982636 - protein, 33 aa, Homo sapiens
CFDLEDPALLSAGGSPGATARACEVTNSLRKIS

SEQ ID NO: 982637 - protein, 66 aa, Homo sapiens
MPGLSCRFYQHKFPEVEDVVMVNVRSIAEMGAYVSLLEYNNIEGMILLSELSRRRIRSINKLIRIG

SEQ ID NO: 982638 - protein, 49 aa, Homo sapiens
DWQHHNFPSFITGHMHNPIKPVKHAFQQAVPCMQACTFHIMSSNNMGAS

SEQ ID NO: 982639 - protein, 86 aa, Homo sapiens
RGACAGRDACYVATLTPTFYIPSMGLRHGSRLVNHLIGNIHTHLGHYRVDLDVSKCTKNSFQTLQMKLENITNPWSPRHRVVQPTL

SEQ ID NO: 982640 - protein, 30 aa, Homo sapiens
MGYTPGSLAVKPGVECDCLVGHLRLAEVAL

SEQ ID NO: 982641 - protein, 34 aa, Homo sapiens
WPWHLTPSGIQRLGPFNASGPFNASDLRREAIQR

SEQ ID NO: 982642 - protein, 46 aa, Homo sapiens
GLLSSPLCYPTGPFNASGPFNASGHSTPPAIQRLRAIQSLRAIQRL

SEQ ID NO: 982643 - protein, 89 aa, Homo sapiens
MSCLKAVQLETLLGKLMFLFESCAAGDLAGELMSSMRAVRLEPGGELMFQFEGRAPGDPGRKLMFQFEGCAAEIPGVALMFQFDGHSTP

SEQ ID NO: 982644 - protein, 134 aa, Homo sapiens
FSVSPASGRACYSFVTWDHVSVRLSLWLHSKGVEYIPFYAGSLGAFLRDLENSFSTLSTVCRFVIFQPCVILQCQGHSTQVTLPSFSPSASSPQGPNLEVKVSPNSVPNKTRANPILQARHQTQTQTQTQLQQK

SEQ ID NO: 982645 - protein, 30 aa, Homo sapiens
MSTQRVANTSTSDHGSTSCSCSRCSSGYRA

SEQ ID NO: 982646 - protein, 99 aa, Homo sapiens
MRARLSFPCHDRKCRRDLPLPCDQIQTVTVQAARIDTNSQFPNRLNLVGAINYMVADGDFLIFCVVLDCDRPVHGPQYRPLAPELQLAPELAARPLSCS

SEQ ID NO: 982647 - protein, 130 aa, Homo sapiens
MGEEVEAGAAEDKKERSRMRRAFVHPPGEKSSENYQIVKGILERLNKMCGVGEQMRKKQQRLLKNMDAHKVMLDLLQIPYDKGDAKMMEILRYTHQFLQKFCAGNPGNQALLHKKLHLFLTPGLLEAETM

SEQ ID NO: 982648 - protein, 73 aa, Homo sapiens
MNFSRKVSFSCSLHMFTTWWSLYTFMGSAISPFMLMNLMRCWSASYSMGVITGSWRICFSRFSCSERPSMISE

SEQ ID NO: 982649 - protein, 125 aa, Homo sapiens
MLSLLLLLPACSRKEYFSSSTCLSLVRRLSFWRFSSCSNSCMFCSWDSSAETFLGELVGLARRIWVTLLGHVVQLHLQLGDLVGQLCAHALSLVELELQLLQLRLHFLALVLRVPFALQLAPELG

SEQ ID NO: 982650 - protein, 123 aa, Homo sapiens
SVALRIPPQVRAAARAASHTCLPSLQVDGGITLENGHLHRQSLVAVLELYREGRGASSDVTRLLETLSQMERYQQHSMVFLGRLSRTKSELSLKMYQEEIQEWYEEHAREQEQLALSCSSPLI

SEQ ID NO: 982651 - protein, 117 aa, Homo sapiens
TQLRAAYSCLIILGMAEETCWTLSSRGVPGRSGSSAKDQNTEVGLLSSDPLDRRGSLRGPAPASALLEGRPASELRRERPISSCSFQQRPERSPRPLQLRSLSRLQCFNMSESCSSP

SEQ ID NO: 982652 - protein, 64 aa, Homo sapiens
SSSLYYEEDAETVGVVQRLKLPRPVLTTRHTYTPNPHTSNYETISLLIQPIALAIQRLRDIQRL

SEQ ID NO: 982653 - protein, 69 aa, Homo sapiens
MEVAIPCLHCETNPSHISSTQQLPNACTAVAIQRLRPFNASGPFNASGPFNASGPFNASGPFNASGPIQ

SEQ ID NO: 982654 - protein, 51 aa, Homo sapiens
PLRTLSPEAPQDREQRQPWYKIRMTDGVTHTDIQESLPHCASNLVHSRPKV

SEQ ID NO: 982655 - protein, 62 aa, Homo sapiens
LCECCLLVLDHAWPFNASVTISTPTGPFNASGPFNASGPFNASGPYNASGPFNASGPIQRLR

SEQ ID NO: 982656 - protein, 145 aa, Homo sapiens
QVITFSPVWDEEPFDIPEVVLPTACIHFSIAAFEEGGKFVGHRILPVSAIRSGYHYVCLRNEANQTLCVPVRMFIYTESSDYIPDDHQDYAEDLINPNLARQPDETEGPEVGPALIGESEAQAGQETCHETRSQQLGSQPVSKPI

SEQ ID NO: 982657 - protein, 38 aa, Homo sapiens
LAAPVDEGGSIIVDVVNEVVVVGDGVLWAWLCTGEART

SEQ ID NO: 982658 - protein, 131 aa, Homo sapiens
PLPDHTLYDRIPIVLRVPLEASVTLLEATTPVKLPTVHWARNARVSSQIVKGPYFNSDSKTTGVAHSQSPAYPTHLIPGYNIKLSKGSRGLFVPLRVIGIFTDTTISPSSRLRQCPDRYTIRVWTGSGVPS

SEQ ID NO: 982659 - protein, 71 aa, Homo sapiens
KGLWELRKGFLEEAAIELEDGWEVDGEENGTWRAQGYFACEVRVQKSMECLRGEPIYLDNIIGSLKLCVCV

SEQ ID NO: 982660 - protein, 53 aa, Homo sapiens
MTNTSFQQVWDNPYPNLDQITSKNPTGKEQQVRIYQEVLEVRPSLSALYLNHL

SEQ ID NO: 982661 - protein, 125 aa, Homo sapiens
SASLASGREFDNLNQSALWLRVDCSIHSGLLSFQVRKLELSRALAASRIPCFGQQPELLCSCSTADVRMWREGWSSVRQMPDSQLGSYHYVLFRHGSLALQEHVSQLKVTDNNLGPCVWRPGNST

SEQ ID NO: 982662 - protein, 43 aa, Homo sapiens
LGSGYLENTIQPSMCLFPNSNETQDGEQQENPVQDPASSLRVP

SEQ ID NO: 982663 - protein, 40 aa, Homo sapiens
VLRRSRGPPPKHEELMTDHIGLQIGFSKMSRKLDFYVQKF

SEQ ID NO: 982664 - protein, 41 aa, Homo sapiens
EPRPRDEKVLMARTASMSHHTWRILFLILCMWWITLLNSDS

SEQ ID NO: 982665 - protein, 57 aa, Homo sapiens
HKELLYLYLHVKHLLIDLLHGHPDHGRTAATCEVSAVREVLPVAVMYAVAWCSRTCV

SEQ ID NO: 982666 - protein, 69 aa, Homo sapiens
MDPALPSHCTRLSAHPHSHKTSAPYLSTASAQNEEPGNSDPETLSNPRSSASPIMTKEYHDLQRLDNEG

SEQ ID NO: 982667 - protein, 60 aa, Homo sapiens
MQRDIACGEYHRDMPVLAGPCTGTSKVAVQAVQAMNRICVLAVDLQRVRHIKATDLRPIY

SEQ ID NO: 982668 - protein, 54 aa, Homo sapiens
MDILDDSDLRELGGLNRLSLMATRMLWNSSNLQDVQMNSSSSFYSPAKNFETYD

SEQ ID NO: 982669 - protein, 43 aa, Homo sapiens
HDCDDLLGEREQFDLHVFLHAELGEGLLDVRRAVQVGWRLLEY

SEQ ID NO: 982670 - protein, 76 aa, Homo sapiens
TSPGGAWSIALRQELIDNQTRITQEAGSVSPAYSSQVAATHIILLLDTGSEAYQACLAASSCQQVSWLYPCKRHAT

SEQ ID NO: 982671 - protein, 46 aa, Homo sapiens
GGVSVVVVVMGVMVGVCVPVGVGVGVTVVVVAMGVGIGVCVPYRGV

SEQ ID NO: 982672 - protein, 54 aa, Homo sapiens
PLRDTRYGHPHTVATVHPHTVATCHPHTVTTVHPHTVTTVHPHTVTTAHPRSGG

SEQ ID NO: 982673 - protein, 55 aa, Homo sapiens
QNSVHDSGYEVHHQKLVSLQKMWVQTKVQSLGLMDGRCSHTDSDRSPLVIAEARN

SEQ ID NO: 982674 - protein, 67 aa, Homo sapiens
ESVPELKNSDSTHGNTQQAQLVENVKSMKNQSVKQNRVGVKRRQEGYVQTCVFGRLQELLESLSDPA

SEQ ID NO: 982675 - protein, 35 aa, Homo sapiens
NLLDLIELKHKARDKPYDSKKFADCTSEGDHNALS

SEQ ID NO: 982676 - protein, 93 aa, Homo sapiens
SAGGEWIQRHPLDGHLGPHLHDTLISIKCPVSRWQPEVCNFDMVGTLDQDVPSGQVPVYEPHILQVAHPLGNLHTPVQQVLGAQASAVFPDMV

SEQ ID NO: 982677 - protein, 86 aa, Homo sapiens
SPSRVEQAQLNDIWRSALVLTCRRELVQCRHAPADGEYTSDQAPSLRILGVSARCSLCRRNLSSGGMHRSGEYTSTWMHACMLGYC

SEQ ID NO: 982678 - protein, 99 aa, Homo sapiens
KGVRQRRPHVGVTVGRCQSETSLIDWTLREIKRIMIKFQSIVNMISDRIAWSSCNHLSSFSSHFFSFLPYDQNIDSEASLESINVFHSDARYDYHTIGI

SEQ ID NO: 982679 - protein, 49 aa, Homo sapiens
LRIPDGCDAWDSYQASWFKEALEVPICQTPMARDEGLQNGPPQHPLGWC

SEQ ID NO: 982680 - protein, 52 aa, Homo sapiens
MALSALYDPANFSSASALLLLSFLCDLVTTEMGVMWGRATDTTVLCLAFHVV

SEQ ID NO: 982681 - protein, 34 aa, Homo sapiens
RCLEDPFRCVENEEWCVGAGVPGRQACRKGRYNL

SEQ ID NO: 982682 - protein, 61 aa, Homo sapiens
MTDVRWLASKYSFSLSSWLPTGCLYTLADIAVGATDMVTYRQPSAVLDATQSALWNGSRYT

SEQ ID NO: 982683 - protein, 32 aa, Homo sapiens
MTAAPELQLAPELVAARPELVAARPELAAAPE

SEQ ID NO: 982684 - protein, 60 aa, Homo sapiens
QTVPGSNSSVAFGFLIAMLAALSPKNLSFSFRVAITGVFLRDSLFKTIYNFHRSSPLSCR

SEQ ID NO: 982685 - protein, 53 aa, Homo sapiens
SSPALHAQDRRPPHPGRRHEVRVLRLCTVTQRGGDDPSCTLAPELAARPWVSR

SEQ ID NO: 982686 - protein, 38 aa, Homo sapiens
SSRWADLASGVDLGYDAEKLMELCQEQKAMLRIELKEP

SEQ ID NO: 982687 - protein, 56 aa, Homo sapiens
LYGCIGGGAGLLFATTNLGLGANLVASLSLAAEVMIPLVQLAPGVQQQLAPELGGA

SEQ ID NO: 982688 - protein, 56 aa, Homo sapiens
RLIATCPVDPSDSAQTHPSSRGVPGHPSYRSSGLYPRPSHDQLSIVSNLLKGRPAC

SEQ ID NO: 982689 - protein, 34 aa, Homo sapiens
MLLQPRHCLRTVLTVSGLGISVISKYCSCSCTSA

SEQ ID NO: 982690 - protein, 47 aa, Homo sapiens
GAEAQDIPSLRHIFFVVLAFFAATLALSARHSHSASDHSASFPGHST

SEQ ID NO: 982691 - protein, 75 aa, Homo sapiens
MRCLTVLHGSWRWLMAGAGAPRFFRIFQHLHFSFIRDRRAPLRPGYHGLRVVSFLISHPTHLSMSETCPEVPVSR

SEQ ID NO: 982692 - protein, 53 aa, Homo sapiens
GNSSREYFQLCWPRIHYAPPRRLVVPAVHSQSLRGLTLSSASLLLRDSGIQSL

SEQ ID NO: 982693 - protein, 97 aa, Homo sapiens
SRTNLSRPFNASVNGSGPFNAEALNGLQLLQVAAKGIISYLFVAEEYSMVYIYHIFFIHSLLDGQLGWFQIFAIVSCAAPDIIFNSFAFSKYISKSW

SEQ ID NO: 982694 - protein, 51 aa, Homo sapiens
GSPHVGDEARAREASQPESNPLETRNRHQTGTDMEKIWHHTILQMSCNVAS

SEQ ID NO: 982695 - protein, 42 aa, Homo sapiens
VGQVSSAVFPRSVLSDSVGTFMLHCQPSQASEAYQCPAENGS

SEQ ID NO: 982696 - protein, 69 aa, Homo sapiens
AILHKLGSLVENNERVFDHEQGTYGGHFSGDQNDGYRINEGYMRCGGYRQSQSQTATELSTLSPALAIR

SEQ ID NO: 982697 - protein, 55 aa, Homo sapiens
MGLRSKIIPSPFRYSQRGHRTPYLSSYYRNHQPTQFKSIALVRTPNRYTLLQAIQ

SEQ ID NO: 982698 - protein, 65 aa, Homo sapiens
MARMLYSHEKLVGQYIELLQRPQRLVGPYGLLQPFADAIKLFTREPLETGTCTISLYINASGPFK

SEQ ID NO: 982699 - protein, 85 aa, Homo sapiens
MRSGVREPAALFSISSVCCRPFKVGHACEAGQVFKTSSTLDPPAAPSFAEAHSYSHPRNPPAPAGDSSGLWARAIQRLRAYSTPP

SEQ ID NO: 982700 - protein, 61 aa, Homo sapiens
VRLLWNSMCRNWTCHVKFTWQQNDGTSKEKAQALEDLAGKTPALNTKIACNISTMTHVDTP

SEQ ID NO: 982701 - protein, 49 aa, Homo sapiens
MRKLVYNMDSSPLFELSKICPMLNALMYNSKRSTSYGFHIPSWMAIQRL

SEQ ID NO: 982702 - protein, 55 aa, Homo sapiens
TDDSRNPLKKLAIAEEAIGVCRGGRKVIIEGDLERTEERAELAESRCREMDEQIR

SEQ ID NO: 982703 - protein, 64 aa, Homo sapiens
CRVPKTSPSSPGSTATREVTRVAGRCGTLEECTPAVHMTSSCRGHHHGPFNASGPFNASGPFDA

SEQ ID NO: 982704 - protein, 135 aa, Homo sapiens
HKVYPELHITNLGGANQPVTIQNWCKRGLKQGKTHPHFVIPYRCLVGEVESDALLVPDKCKFLHQERMDVCETHLHWHTVAKETCSEKSTNLHDYGMLLPCGIDKFRGVEFVCCPLAEERDNVYSADAEEDDSVV

SEQ ID NO: 982705 - protein, 37 aa, Homo sapiens
AVVAHAPEHQPGEGGLGLGHQDEEEDWGSFSGDLGGE

SEQ ID NO: 982706 - protein, 41 aa, Homo sapiens
TRTDAGLLDCDYSIISTGIIILVSSTCSKPRLTVPWSIPAP

SEQ ID NO: 982707 - protein, 54 aa, Homo sapiens
YYIFCLVTFTFLVTVFYIHVLAFPGPFNASGPFNASGPFNASGPFNASGHSSPR

SEQ ID NO: 982708 - protein, 51 aa, Homo sapiens
VELRAFMAQRIALKILQAALISESKRSVRWPFKRIVLRQSQVLAPRAFNAS

SEQ ID NO: 982709 - protein, 57 aa, Homo sapiens
MARSLRFGSSAVLLSPYSDSLSLRRSPLGLTSQHTANSQAHSSKGTQSREWSKLHSD

SEQ ID NO: 982710 - protein, 38 aa, Homo sapiens
SQLGSGRSDSHQQSESSFPGSPLGDSLCTKAPPGPLTT

SEQ ID NO: 982711 - protein, 36 aa, Homo sapiens
CSCSYSASSCCSLLLYLLLDFDDAIYLDASCQLLLQ

SEQ ID NO: 982712 - protein, 49 aa, Homo sapiens
RQCELRQSPLKLQFAPESCSYAPELASPINSGRAAGSFSAWCQVHQFQV

SEQ ID NO: 982713 - protein, 55 aa, Homo sapiens
VGSVSPCRHARQQAQAPPRPSVPLRADRAVRLWVVASLKEQPHHLNVALGSSPLS

SEQ ID NO: 982714 - protein, 39 aa, Homo sapiens
IPITARLGRPSSATEEAEESFEFVVVSLTGQTWHWRGQD

SEQ ID NO: 982715 - protein, 78 aa, Homo sapiens
MSPHVEVSRIFFCVAKPSHIAQTATESSPPHKTAGPCGEHSKLSSLAGSGRPHVNAKHDNASLHFTSSSATQRAAFLS

SEQ ID NO: 982716 - protein, 34 aa, Homo sapiens
LAAQCWGLVCVICHLTVYTGEAEDTGEARTLARL

SEQ ID NO: 982717 - protein, 30 aa, Homo sapiens
RCAVVLAGFAVRSSLPGSRTGAELLGSPSP

SEQ ID NO: 982718 - protein, 65 aa, Homo sapiens
TGDSRRETQTDLLLEEGRARRKVFHVAKSSLLPASYLFSPFVNLVTSMKTQALLPTVVLNGGSHV

SEQ ID NO: 982719 - protein, 67 aa, Homo sapiens
MATGKFTVASVLMDLLVIATLTVSSMSLPSILIIFTILMLLTILEIAWRLFLGYVCTLLVGLYLRAR

SEQ ID NO: 982720 - protein, 68 aa, Homo sapiens
KPDSVITLPESLGFYEDSCLELQRHCEGGPLLSETSFPEGDMQWKLSVLCPAVPSSIQESTPVDERRN

SEQ ID NO: 982721 - protein, 45 aa, Homo sapiens
MMKVSLAVREVVQITALGFRRLCLITSEAGIHHKPISAIETSNDY

SEQ ID NO: 982722 - protein, 40 aa, Homo sapiens
QSATQQPVTADKQQAHEPVSPRSLQRGGAGEVHHPGPPLT

SEQ ID NO: 982723 - protein, 50 aa, Homo sapiens
MFMIHRHGSFGVAILTISMRTVVIGVLRLLHRKRDHVVARNVDVLRRDRV

SEQ ID NO: 982724 - protein, 53 aa, Homo sapiens
MVEAQARILPDSSHLGVCLWSLVSDEVLCPAIGSSGLPELMGQACTGAGWSLL

SEQ ID NO: 982725 - protein, 68 aa, Homo sapiens
STGDSIARSLPPVRNACLLLPLIPLLHPLNHALPIPLYSCTPDPCPPAPPNPALLRPPHPCPDQLTLR

SEQ ID NO: 982726 - protein, 67 aa, Homo sapiens
RGAASKTKTKAEQDTKRQEDKTQGARLDLQWPKLSPALHTLRALGTPRKSASGHLAGLGCRAVYFLL

SEQ ID NO: 982727 - protein, 70 aa, Homo sapiens
QAPGWQLRFIEESRLREQHEGVVGSQVLLQGPFNASRAIQRLRAIQRPPGIQRLRGHSTPPGPFNGSGRR

SEQ ID NO: 982728 - protein, 67 aa, Homo sapiens
MEFWQFCGQLAQHVSSHRPGGGWCPRCRKLLGAEHVARDGQPEFMLVAGHCTPRIEYKTEVTDIPNA

SEQ ID NO: 982729 - protein, 42 aa, Homo sapiens
SVCAPLSQPDASANTLFQFPSVLNSHGPFNASGPFNASGPFN

SEQ ID NO: 982730 - protein, 42 aa, Homo sapiens
MGCARTNALILFIQLSGNLSNYNKLSDGNQWHYYLVFILSLL

SEQ ID NO: 982731 - protein, 61 aa, Homo sapiens
MAPLVLGNLEKEAETTEDRLAGNTEDLGWKRGELGSRASEERGGRVGILGGCRCMRKQHSF

SEQ ID NO: 982732 - protein, 56 aa, Homo sapiens
HCEHTANLESHKLLSRSYSSDSQNGRIIWTEKSQIAQQGPTPVPPSHPKTELFKEG

SEQ ID NO: 982733 - protein, 66 aa, Homo sapiens
VDSIWKEKAVVLRAVEWTVCVPEEEGREREVRALSLTRALEEEQEAREELERQNRALRAELEALAE

SEQ ID NO: 982734 - protein, 58 aa, Homo sapiens
VLLQLHWAAVDVVDSSLRPKVVELAEKWVVGVELGLPWEVVDSSTKADVVEELQLAPE

SEQ ID NO: 982735 - protein, 34 aa, Homo sapiens
SGASCLLSVRAALSERAADSGVGSLRNGYHINGK

SEQ ID NO: 982736 - protein, 44 aa, Homo sapiens
YLGPVAWSCRTGFLRQSGIGLDSRGSMPVMHMYARTCGRMRVGR

SEQ ID NO: 982737 - protein, 41 aa, Homo sapiens
LVKCNSGEPGAPGSKMETLVLRESLALLVFNGPPGPAGEEG

SEQ ID NO: 982738 - protein, 112 aa, Homo sapiens
CLPSGHSAILSPLAGMAAPFLPGSCYHCFAWVWLPSCRGVVTALAGVTVFWAGVAAAFLPWSDSCFSWLVWQLLTLLVGETTTFFAEAAAAFLPLLLRYDDLFSTAIIFFIF

SEQ ID NO: 982739 - protein, 70 aa, Homo sapiens
MDSIIAVVNRAPALTAQGESGSNDAHAWAMVGWEDSSHLTVEGLGPTLMLRMGGVSLLLSRRHHQRRPLL

SEQ ID NO: 982740 - protein, 57 aa, Homo sapiens
PVPDKNKHQKDMNEKWVTRWHTSRSCPSGVCSVSDTPSGPCEPIIQNFCHDVADNQI

SEQ ID NO: 982741 - protein, 110 aa, Homo sapiens
VPGSIIANVPGPSTIIPHRDYLNKGAIACCFHRKFLNDYSQGKILFRAEDSSVVKGLPIPYKDQRDVSSCYPADIISFLSLFFILLKSQLYFIPENMLWMLSPQNIYTLT

SEQ ID NO: 982742 - protein, 47 aa, Homo sapiens
RYRRQCDSTREHAVTNGGDIATSFQAIQVPGSPWDPDRYRPFRAATS

SEQ ID NO: 982743 - protein, 47 aa, Homo sapiens
RYRGMATPCCGYNGCPCLILLIIMCEQIPTYSIFLGKILPLAYDMDG

SEQ ID NO: 982744 - protein, 33 aa, Homo sapiens
MVPAPVTYNSLVVNQLLQNQEPTGSWVAKSNLT

SEQ ID NO: 982745 - protein, 55 aa, Homo sapiens
CRYMDSIIAVSSDSECIRLLLSNKAFLFDACSGGWLQSPGFPDPCASRYLVTCFL

SEQ ID NO: 982746 - protein, 113 aa, Homo sapiens
VWVTEWYQEPKILSCTGLLRPGPRRAGKHLCTAPHDSRPYTRFQFPRGAMAQSHKVLSGNFHVHIKPFHDGLDCLCFPEAGVLSVTLKLSLAPSLRASPRHPDCQALSIHLRD

SEQ ID NO: 982747 - protein, 50 aa, Homo sapiens
RRLNFSTRPAVSHLGLACIERVAGRGDVDVDDGVSIAVLPLDLVELVTVD

SEQ ID NO: 982748 - protein, 71 aa, Homo sapiens
VDSDHRTQRERSQLYGERYVHTHVYSSTIRNCKNVEPTQMPITQCVDQVTVIYIHTMEYSSGHNRSELLAF

SEQ ID NO: 982749 - protein, 35 aa, Homo sapiens
RYLVRLAPVQEFHPYAAQRTRAKAFAKNVFINQEL

SEQ ID NO: 982750 - protein, 54 aa, Homo sapiens
ELAEVREGEPGLGQLPKEELQGSGDNVDVLQAPVIQVKALIVVHLIAELLDGGQ

SEQ ID NO: 982751 - protein, 60 aa, Homo sapiens
PKGKKLPLHLLPAESWDPIFKDASDCDHVISMKRARLCKHWIRRNLVTVNNWHKRRYTGP

SEQ ID NO: 982752 - protein, 132 aa, Homo sapiens
SSARVQLRQSERCRVSGTEEDVTTGWILDDVLEQRKDVGKKLRNLIRMCVLVNNVSNVLETTVPHKGRMLMMGDTGVGHVFKSKKVASSESSERFNKTLETSEEKIPELKAMETVHSDVQGEKGLQKLCRSL

SEQ ID NO: 982753 - protein, 63 aa, Homo sapiens
MIEPSVFGYYEYAWLIELYKSLFQMLLLVLLWYIVEEYKWLDHMIVLFVIFVEKPPYCLPKLD

SEQ ID NO: 982754 - protein, 51 aa, Homo sapiens
PVPGLNGTDGPGPDMVESVQRDSSAADAEPTGTVCGFHLGLPRIGDGGTLV

SEQ ID NO: 982755 - protein, 38 aa, Homo sapiens
SLLSSTVTAEMEGLSPHRLGSSWIFIWSRQVGTAIQRL

SEQ ID NO: 982756 - protein, 44 aa, Homo sapiens
TDIYNTLVAKERVFVIDGNKHALREKDLLVLYTLQYETFPPRRF

SEQ ID NO: 982757 - protein, 57 aa, Homo sapiens
MHLVQPAIGYNMNIISDSLVSTEDLRESGAIGTCKTRFSPNAASAIAENSPESASVL

SEQ ID NO: 982758 - protein, 47 aa, Homo sapiens
PKYEKLTQGMEWILLHPSCLGAPSIMPAVAGKGSELLGSVSSKVPFS

SEQ ID NO: 982759 - protein, 38 aa, Homo sapiens
MLMNDVGIRLLHTHQLDRDSVVSVHTQSSDCPQPSTPG

SEQ ID NO: 982760 - protein, 59 aa, Homo sapiens
MAEALVPPNETTLLLPGGCGVSQDLVTVYDDSIGDSATQQSFHLHGTGQPNFHLSSFQL

SEQ ID NO: 982761 - protein, 48 aa, Homo sapiens
VLRCSLHVQLHLCIMPEDGVAQGSSEKYARRYYPHEWRAAIRSSPHKY

SEQ ID NO: 982762 - protein, 34 aa, Homo sapiens
MSSAEDKYAGWVGPEPGARSGELGTESSDNLDRA

SEQ ID NO: 982763 - protein, 71 aa, Homo sapiens
GVELLPVEVVLCGWSGGVCPCCSALLLPLQHTQEHLSVSKVSFSCLQVLKRTLSSSSGGQCLLMLRLGLRL

SEQ ID NO: 982764 - protein, 51 aa, Homo sapiens
VGRASACLIAARHTRRQVTMDDDSPRSSSTTAPECKAGFAGDDAPRAIQRL

SEQ ID NO: 982765 - protein, 109 aa, Homo sapiens
AGYGSLDSHTDCGDHRIEPTALENLALQLAREMLGSLVQNNERVFDRQAVAPTGRYFHDQKDGYRINEGYMRRVGYRQQQSQTAYLSSPLRFPPGPFNASAEALNGRGL

SEQ ID NO: 982766 - protein, 50 aa, Homo sapiens
MAYAACEDQRIKPLTHRGPQYPWAIQRHGPFNASGPFNASGPFNASGPFN

SEQ ID NO: 982767 - protein, 79 aa, Homo sapiens
GVECAGDALSGPLRALCLLGLLLSQQQRAVRPSSRSPAMLAPKTDKELEVQYLNTFYGCPKESCNLYVLKDTLKKMQKF

SEQ ID NO: 982768 - protein, 35 aa, Homo sapiens
SKGQRPLSKQTSFSANDANTTFLQQYKEETVNIIG

SEQ ID NO: 982769 - protein, 56 aa, Homo sapiens
TVSRDDGLNVPYRHLLLQFSFPYIPSLAPKHKPELGPVGQQGTPAGQADRANASTL

SEQ ID NO: 982770 - protein, 33 aa, Homo sapiens
MQQQDYSASSTTSCDEEPIVNRVLSAALLLCRN

SEQ ID NO: 982771 - protein, 38 aa, Homo sapiens
IFPTAAPLCTVPAVCWCPAPCSLLVHSTMQSDGAQHTV

SEQ ID NO: 982772 - protein, 57 aa, Homo sapiens
TAQSSHQISVDQGEMGWHVSQRWSGSSVQWHQRPYTELRAGIGLVSGEVFLRVALLQ

SEQ ID NO: 982773 - protein, 61 aa, Homo sapiens
FELLEGESDVVCRLRSSKYAAGPFDRMLHSRSTTNIIIINALTTTIFLGTTYDALSPGLEW

SEQ ID NO: 982774 - protein, 49 aa, Homo sapiens
RHASPMENKKRVGDGWRQTMCPLRSADPEREGKGRRQVGFGTGGAGFIH

SEQ ID NO: 982775 - protein, 39 aa, Homo sapiens
MAIFSMNWNAITDRQMTGDWRHAVDNTTHYGLQKLQCPS

SEQ ID NO: 982776 - protein, 43 aa, Homo sapiens
MAISDIAYPNKDVLDTVWQRLSQGYFNEFRHLACGYFSILKKV

SEQ ID NO: 982777 - protein, 55 aa, Homo sapiens
MLTPSQSLISDSTSQLGRQMFVERIQNEGPILNRYSELEVGPVNARITREIRLVV

SEQ ID NO: 982778 - protein, 76 aa, Homo sapiens
GERIITRENAYTTDSADDDNDTSLKNGISSLDKWSKESKCFRNELLENSASIYHRYTFHKNGMNEHSLQYIKYGND

SEQ ID NO: 982779 - protein, 54 aa, Homo sapiens
ASCVKVVSETWASNWLQNIDSAAIVIGDRQKRREICCHSMSSLLKHTSGTYKMP

SEQ ID NO: 982780 - protein, 55 aa, Homo sapiens
LPGSGCGDGLEWPGGQHAWFPRMRAACGSSWSPLWPFNASGPFNASGPFNASGPF

SEQ ID NO: 982781 - protein, 52 aa, Homo sapiens
MAMVCPAYHFTEKIKAKYPDYEVTWVKRLATVALPRPGACVPPRGHFKRLRG

SEQ ID NO: 982782 - protein, 157 aa, Homo sapiens
SYTPFSSVNFSTGLVPRGFPRTRAFTMKLHELPQFKLGLLQHFNFPTEDFRERITEMGSLFYVFPKAVGNQFMDHFFQVIGLDLWGHDSHHLLRDGGDLWVLSIRGLRNLMVAFLSKPNTEQPTQVPMGSLDITVSSNHGLAILGPGTPFGQDFPEG

SEQ ID NO: 982783 - protein, 46 aa, Homo sapiens
MRSAGWRACSPVPCEGLLDLGVPSAHDPPACCGNSVVGDHGRPFNA

SEQ ID NO: 982784 - protein, 122 aa, Homo sapiens
MLMGIHTESHPRTDHKILGRVDGKEATSWGSSYYLHGADKNPSVKFGNHELVQGAPKIEKYIPVGRTVLLGTEAGPASKGGERVPVRQNGFSVVGVSLEVSRHRSHNGTEESFQLFLDSRRV

SEQ ID NO: 982785 - protein, 35 aa, Homo sapiens
SCLTEVSIAQELNGRYISNEFKVEVNVIHTAIQRL

SEQ ID NO: 982786 - protein, 153 aa, Homo sapiens
PSPALAKQSRSDTKAGKAMSTGGLRQVPGVTRVTIGKSKNILLVIQNPDVYKSPGTDTYLVWGEAKIEDESQQAQLAAVEKFTVQGEAVSNFPENTQTPIVQEERDEEEVDNPGVEVRDITWVMSHANVSQAKAVRALKNTSNDLAPAIMDIP

SEQ ID NO: 982787 - protein, 58 aa, Homo sapiens
MSCGACGGPWALSARCGRVLVQEEALVVVPDTPSDPSGPPCRRPPAVSGRRCCPRDWL

SEQ ID NO: 982788 - protein, 70 aa, Homo sapiens
ARLVNGSHGHDAREQVESKVPSFYYRPTPSDCQLLREQWIRGFNGWGFSKIELEGMCKACGTGPVGFTNG

SEQ ID NO: 982789 - protein, 44 aa, Homo sapiens
MLAGVVETQRAVLVCKRIHLWCYCEGINTGAWIKSGDPIKDFVL

SEQ ID NO: 982790 - protein, 57 aa, Homo sapiens
MLPTQHASSCLLLPSAACMPVSPSQPSIMHIGCMPAHTVWHPSSAVCSLPVPCDCVV

SEQ ID NO: 982791 - protein, 45 aa, Homo sapiens
VALSSWIRFMLAPRADLEEYDALALVLQHQFRDLRVAPQRPAQIA

SEQ ID NO: 982792 - protein, 39 aa, Homo sapiens
GVCVIRGHRQYLTKYEVADLHYIVHGNERVSGERTSKIG

SEQ ID NO: 982793 - protein, 41 aa, Homo sapiens
RRQSIAQPVERVIQRVLSSNCHRVSQAAVRYSITLVSGIAS

SEQ ID NO: 982794 - protein, 72 aa, Homo sapiens
GNRCSSKIRHRDTPRIKAGNIAWDATLVQHTQINHVIQHINRTKDKNHMIISLDAEKAFYKIQQPFILTKSQ

SEQ ID NO: 982795 - protein, 37 aa, Homo sapiens
LIPLLTATLLRHKMINVRASMRGVLSSSTQNELVMPK

SEQ ID NO: 982796 - protein, 105 aa, Homo sapiens
MEDGGSGTWREHRDMYGCCRVGGDQTTHKECLAKKLSWKAIKYIDQRFSSGDHSVPQGHLATSRHILLMCHNLGEGDCYWHLVQGGQGCREIYASKAQDTSQPRE

SEQ ID NO: 982797 - protein, 38 aa, Homo sapiens
LDKITVPARCCRSTQVVTQTAVMTISAEAIHVARFLQR

SEQ ID NO: 982798 - protein, 51 aa, Homo sapiens
MARISVRVVRHSRRSIVRRSARYSTRLIGQAAVRLRAGMPRFCSPYRCARR

SEQ ID NO: 982799 - protein, 61 aa, Homo sapiens
VETPQGKSVSMTTYEYVPGPLSKCTVYLNVNADGIIYGSRFETGDRDSCDMMKARCRSSKL

SEQ ID NO: 982800 - protein, 52 aa, Homo sapiens
ADVLFTKEQQPEHYEVSPRSSLERYDGIGPPFSVHLQDPELGLVPHPRDDDE

SEQ ID NO: 982801 - protein, 31 aa, Homo sapiens
MVDWNDRTTCVLFGDGAGAVVLKADEDTGIL

SEQ ID NO: 982802 - protein, 67 aa, Homo sapiens
KFNSSTTHTISSPPEHTSALVEEPTSYYSSPGAVAATHFPESSTTSGRSEESTASPGSNVLLKLLKL

SEQ ID NO: 982803 - protein, 109 aa, Homo sapiens
SSAQVLHEQISPMCCCATMALLAERLMLINVRKGNRICFILYELLTVDVLADHVLNPMLVQIYCCTGFLGYYTSVASCYILIYLAVGFVNDNYPQSGLNGRPEKLPDVC

SEQ ID NO: 982804 - protein, 38 aa, Homo sapiens
VLNHLRVKDNPSIALVIRKRQKESYQAVTHACNSRYIW

SEQ ID NO: 982805 - protein, 91 aa, Homo sapiens
YGKSSGQSCGMGIFSGEPGQKIQGCRSRWVITPILPRLAPPVTVHRLPVSNLMKSVIWRVSKSICRVSFTFDEGIGVAEGAGIMSHQMRDS

SEQ ID NO: 982806 - protein, 37 aa, Homo sapiens
MNYSRCIPSYKVLTLSKPFGVCRNMIGHKPVLSGEEV

SEQ ID NO: 982807 - protein, 34 aa, Homo sapiens
MFTRNIIGKGGANIKKIREEMQHQNLSFQQRIAI

SEQ ID NO: 982808 - protein, 67 aa, Homo sapiens
KQGSKHKSSMTGGSVWNMQLLITFTPGKEGCLLAVHGALVDKHLFTADVPSSRIICCGLLKLLMLDD

SEQ ID NO: 982809 - protein, 76 aa, Homo sapiens
SYCLGTIYFDFWDKLRVLESTSSDIIGRSRWAVTRSRKGRRASLSGGDSPRALAGASDPTGFKNVNKGSALSQRLG

SEQ ID NO: 982810 - protein, 41 aa, Homo sapiens
LLRIPLPSDEKVVVRTGQMHKVIQVLQIVHNQQSIVTQVQF

SEQ ID NO: 982811 - protein, 110 aa, Homo sapiens
SSARLTVIQDAILARLEAYLICSVCSNYAQYSTKLIFAISPRKLAPYFTVSVMNVQLRTRTVTGRTLIITELGHQRTDTLLRRRTLACFTRVVQFQLGTIDYFQDQEVSD

SEQ ID NO: 982812 - protein, 91 aa, Homo sapiens
RRLTQDTALLGYQFHSAVCLDRQNPAFPPRVSVTTVLPLLRMCSATPARSSSSCATRPWSSPYSRALCCCSSCTFCSSWARACSISSCRVT

SEQ ID NO: 982813 - protein, 43 aa, Homo sapiens
PYEESCARIYDYLYLEVLHQIFLNLAQLEDFTFTKNNQFSSFG

SEQ ID NO: 982814 - protein, 65 aa, Homo sapiens
VIVAEIKAERETHDAFRSSLQLCQADFNQLCELCRQIKSFRVASNPYTWFTMEALEETWRNLQKI

SEQ ID NO: 982815 - protein, 79 aa, Homo sapiens
NCQPYNPILESTVPCFWLLQSYCVAARTAGPLINTLVDAALLCNEPKWAMYKLDFHITWQLFGKSAPSHFRTQDIFIAI

SEQ ID NO: 982816 - protein, 70 aa, Homo sapiens
VSKQTTVSFTWRQYGRVTNAWYTGASPSAIFFPYGNLLQRVFSNYFILTLSKFTLTHYGFKIHLELEYLS

SEQ ID NO: 982817 - protein, 34 aa, Homo sapiens
TDFTPLDSQVLTCLLSCSAMACGPDPWGTNPMAS

SEQ ID NO: 982818 - protein, 100 aa, Homo sapiens
GSLFTVVWPSCRAESAASPPLGSCLDILKPTELACLNIRHLTTGKTPLLAVPGSYRPLDGDGLGESFNQQCIHRQCGAHGLSMVSSEGAGMACPQRRLTQ

SEQ ID NO: 982819 - protein, 49 aa, Homo sapiens
MVVNNEAAQEEHKEKTEISEKSQEPLNEVNSFPQENQRIHRVSQSLRSG

SEQ ID NO: 982820 - protein, 69 aa, Homo sapiens
MTSPCVVILLGQLSHLSLIWSKQPATGITTGSYSFCFQRHSIALSIYGMSGLRLHARGPVLTVSSAFFN

SEQ ID NO: 982821 - protein, 62 aa, Homo sapiens
MWQSRLQAGFTSSSTWYSWFLRSRSARISDNWSSKLLMRLCIWGQLCAVAVLRFHTGSSADS

SEQ ID NO: 982822 - protein, 62 aa, Homo sapiens
MHQIKMSGDSLLFAGGIIPFTWGKQLSGSLIKEDAELRCQGYKDALWLQLPKTTTITITTTI

SEQ ID NO: 982823 - protein, 60 aa, Homo sapiens
TRDADNNLLTEKEKLCVKKIHENENAAWRQETYPVKLLVQLSELAVYREDVHVIVLLEVP

SEQ ID NO: 982824 - protein, 71 aa, Homo sapiens
SACYLCRSRTRMPVLWRCSGAGLVWGGHAPPVSGRRFLALLLLLLSLSLAALNSPWAGALWDTISDPASAD

SEQ ID NO: 982825 - protein, 41 aa, Homo sapiens
EQLIDLDTKGLAGSVNEFPTFVRLVADVLYSLIKQESDQSI

SEQ ID NO: 982826 - protein, 41 aa, Homo sapiens
NALSSGSDVGAEEHGAVSDEAASGAHILALTPQDNLVPHPI

SEQ ID NO: 982827 - protein, 71 aa, Homo sapiens
VLLEIYGCLFRCINLLLRRNALKFFCMITTQERTFLYCFRAKQPKTWARITMAAVGHFLFPSDSPRILILG

SEQ ID NO: 982828 - protein, 34 aa, Homo sapiens
PNDEEIDPLEFDVYDDYVMMGIKEKGTDGNAGRN

SEQ ID NO: 982829 - protein, 34 aa, Homo sapiens
GSPPKNEELKTVPSSSTLIYIPCWVLMTHGIIEF

SEQ ID NO: 982830 - protein, 40 aa, Homo sapiens
YEELSRLGSDSLCTFFFMLCQLAVHDAYFLLVVQPLFIQF

SEQ ID NO: 982831 - protein, 72 aa, Homo sapiens
NQDAALRYDLTAAAGMMAACESRMLTGALSASHGPHRTDYGHASEVTCTVAKTDVECQLLIRVFREDYTVVA

SEQ ID NO: 982832 - protein, 34 aa, Homo sapiens
LRTSRRSSTLSAVGRTAYSTGATLTAANYCILRP

SEQ ID NO: 982833 - protein, 99 aa, Homo sapiens
PILHKPYDGSSIQLRYLLRVVLKTLWKHQYAWPFQQPVDAAQLNLPDYYQIITPPMDLGPIQTRLDHNYYWHAHDCIQDFNTMFTPCYIYNKPGDDIIQ

SEQ ID NO: 982834 - protein, 45 aa, Homo sapiens
GTLQLVFTLVMYTSSDLMILLLGVRPKELFLDMNSHLLTRRLTTC

SEQ ID NO: 982835 - protein, 44 aa, Homo sapiens
RVWGDVGYGRKNMWNGQTADGEGAHHDNHHLTTWQEGETGETTR

SEQ ID NO: 982836 - protein, 77 aa, Homo sapiens
CELLDKYPSIQKRGDCKLQPEKRSAPMDFPGARPLPLQGKATPQGIPPGVTNDLREFWRFAHLLDGVNLERSHCNLV

SEQ ID NO: 982837 - protein, 52 aa, Homo sapiens
DDAWLVMDRMCTEMRHDILNYDRYMRNTSKQQQQKHQYQHASPAVRICMRHE

SEQ ID NO: 982838 - protein, 35 aa, Homo sapiens
MWIPGNTHTHIIIIIIIMVVVIIWLSHHHHHHQNL

SEQ ID NO: 982839 - protein, 33 aa, Homo sapiens
GRRGSRKITDIELNVEHFKNRRKLKKPPPELSP

SEQ ID NO: 982840 - protein, 59 aa, Homo sapiens
VARLRTPERCIAGINDKLCRLTGVAFVTALTRDPKHDWASPTFRPGLTHQPGHFFRCPD

SEQ ID NO: 982841 - protein, 93 aa, Homo sapiens
MRGGDVGTGFLSVTCPFWLLVILLTDRTLSCRSVGIPCRVRCQCAPAGGCLPVRLLGGQESGTHLRRQSARSQISSCVLGEPLLLFKAQMEMQ

SEQ ID NO: 982842 - protein, 55 aa, Homo sapiens
DGGSAVDLLGAVRKIQPRTRSMNSEPRIKPSSGEMKMNAMVFSSPSMFSELQPDL

SEQ ID NO: 982843 - protein, 77 aa, Homo sapiens
ALGIRELWCLQAPCPPALPSLPLTPKSCEAWEWQEPLFPRVRTCAAVVSKPDSCLHENLHGLVEPGISEAPACKPPV

SEQ ID NO: 982844 - protein, 65 aa, Homo sapiens
MRMSSIQASMSSASDWNWCSREATYQALLPNGQRAALGTAHCSRDVNDPLHGSISDPQVLLRRSC

SEQ ID NO: 982845 - protein, 83 aa, Homo sapiens
EEEAARKSILRKVVDPETGRTRLIKGDGAVLAEIVSNERHKEINQQATRGALLDLQMALGCFPAGPPLAKACETKLADPDWAG

SEQ ID NO: 982846 - protein, 60 aa, Homo sapiens
LISLVLPDSGPPPSQDDALRDIHSSLVMGYHGLDSGLLLIRQDWDHSSSSPADRMSLAQR

SEQ ID NO: 982847 - protein, 74 aa, Homo sapiens
MMPLMPSRLNYRTHALPYSFEYHTDEAAYYLALHTHTSQSGRFLCQLSRQQLRMAMRIPVSSEQLKRAQLRVHK

SEQ ID NO: 982848 - protein, 49 aa, Homo sapiens
GNTMRVEGTGIAVPHGRPLTGKIEALWVTSTMYNVVVWLAPYHSYTARQ

SEQ ID NO: 982849 - protein, 45 aa, Homo sapiens
GSVRGMAVVVKITVAHNAVADSHGLGPRCPECPELNVAQLSKYGL

SEQ ID NO: 982850 - protein, 45 aa, Homo sapiens
ARRSDEVWPEPWNISGLDKPDFLLCIEKLSTLGTKKGSPDTAENS

SEQ ID NO: 982851 - protein, 98 aa, Homo sapiens
REIEPSKPPVKQGLLVVTQVLMLRPAGWSGSVGKPSGVVQKNAGSRGKDPNSVLLGILAIVPAQRTKILIVAGVVYLRAGLMVIVPVYWTAHNIIQEF

SEQ ID NO: 982852 - protein, 47 aa, Homo sapiens
KSAQVCGTLIALVMHWPVRQLVLFSSEELEAAVAISMLEVQWRRSTA

SEQ ID NO: 982853 - protein, 83 aa, Homo sapiens
MLAGKGISDVNGPPQVCSLHSAERPWNSYPREPRIMSPTPVGPPEGPQPFPRTMLGPLSSSSMSTSESEGSPSAASITLHQNS

SEQ ID NO: 982854 - protein, 84 aa, Homo sapiens
VVYGSLVRSFTKCHTFAPAEFIISYPRMQAMVVLRLSIEGPSKVDINTAEQEDWDVQGHLTAPHEPGNYIITSRTSAEYRARLS

SEQ ID NO: 982855 - protein, 36 aa, Homo sapiens
YVGTRCFHNSGPRTLGLAAGTDGQGSTHLVDRTVLL

SEQ ID NO: 982856 - protein, 51 aa, Homo sapiens
YHSSGGQVLHFLQNSISSLKYRQEAREYKCNGQHSVQHDWHRDRVGMRDSW

SEQ ID NO: 982857 - protein, 52 aa, Homo sapiens
EREDRVEMSEVGVSVVVLGDVAVERGECSRDLWLYVARGGMKVFPSFVNVVN

SEQ ID NO: 982858 - protein, 89 aa, Homo sapiens
MGIKIGARIGRIQVDGNSQSVKSVYVGSCTGLRDRNTGTAERLNRIVLEQLLYSSPSFSPDDVPSGIIRRLAVKIVLPIAIELRCCHIH

SEQ ID NO: 982859 - protein, 43 aa, Homo sapiens
GDNLAVRQIDSSSTSGGAGSRRGHLLLEVQDDVTQLLLGSWPR

SEQ ID NO: 982860 - protein, 44 aa, Homo sapiens
LTLLRLLNLDLLFLLGLWLTLVVTGQASSSKDPAHFSAVSGPER

SEQ ID NO: 982861 - protein, 55 aa, Homo sapiens
DSKSPSARHITADRTIGDHSVKDSYLPKTGPEVAIKMERMMSQGATLYSVTCLED

SEQ ID NO: 982862 - protein, 74 aa, Homo sapiens
SHRVRSWRGHLSPHNRYQGEGTLLSLSSPLGSALTHICSSARTDWGGDRSLNPRWLTLPTQTRTTLGTTKMTLW

SEQ ID NO: 982863 - protein, 38 aa, Homo sapiens
MPWYTRARGRGTSDDLEHMNVLGRATLTASLATTTAQS

SEQ ID NO: 982864 - protein, 60 aa, Homo sapiens
LGTLGGQQMCLPFIIIIMRPSFCTRGSPARGTIPWCHLNKTKAEGLRKSTKNWEGLTYRS

SEQ ID NO: 982865 - protein, 95 aa, Homo sapiens
MHCSLYCKASLSAVALDSYFPTSMLILSALLLHSSKVMVRRSFWDLRCSIRLFSRSVSTSNSLILLSEMEIRVSRVFGKSLGYWSSPEVSGPGVQ

SEQ ID NO: 982866 - protein, 49 aa, Homo sapiens
MRRCMAIEDNCRMTKERPQKAENELKELEQKHSQLTEEKNLLQEQLETR

SEQ ID NO: 982867 - protein, 65 aa, Homo sapiens
GSFPSNSKQQWPTVMQHRLQHQQAAEGCSHAISGTITHAINIIITFRTAFISTAQEQHQHTHGTT

SEQ ID NO: 982868 - protein, 38 aa, Homo sapiens
VQAARIPRLTDFVLSRTTSAWWGAGLGPGYRRSTLRNS

SEQ ID NO: 982869 - protein, 49 aa, Homo sapiens
IRKELESVRRQLQCCGGKQSDVESPEQDDRRRGSVTQRPQATVNTDATR

SEQ ID NO: 982870 - protein, 118 aa, Homo sapiens
AQLSSLKSYDTIQQQAIKQYVALPLGLGCIGKSILVYLENLLKVKKHFFTEPYQGAIQDPEEFVEGMALGLKALLVELLVDWLVLSPKFTGAMAKGVAAMTDMKTTKLEEMRIAMETY

SEQ ID NO: 982871 - protein, 80 aa, Homo sapiens
SDSSRIPRRPQLSWCLRSPARDEFSIFFDHLAPITSSLMGDFEEINWTNWTRSRGLRRRKKTRYAKRSEAGRGTRRHDED

SEQ ID NO: 982872 - protein, 125 aa, Homo sapiens
SKDPPVAQLLKDGNSPIGYSYAFDRALCPAFMEPSIDKGTGADFDYHAASLMSQPAISTVRGGSHGGFDSPQEIIMNSNIDEKFSAHYDAVEAELKSSTVGLVTLNDMEAMQEALVKEREKQLAY

SEQ ID NO: 982873 - protein, 75 aa, Homo sapiens
LRRSTASATQEWLEKQAHAEKELGATPCRTRNALKRRTKSFRGKLSQLEEHFSQLQDNPAQEKGEVLGDVLQLES

SEQ ID NO: 982874 - protein, 106 aa, Homo sapiens
MPDVRACRMAQLPVVGCQCAQAAFRGCYVGQGNSESGRGGPGVARGSPGCWFGKVQCPGVKDLGRVVRFRQLVLRVAESDITEEGVLVGTCSLFPEGALWELTVQC

SEQ ID NO: 982875 - protein, 38 aa, Homo sapiens
RHSFSASPGVGSSQLSRVGVVRVCSSAEGYACHGEVIT

SEQ ID NO: 982876 - protein, 41 aa, Homo sapiens
TRGSPGRTASRCNCHQYTRLLMNDRNRCRFLRLCGDIFIRP

SEQ ID NO: 982877 - protein, 38 aa, Homo sapiens
DTASEGRAIAARTRFYAASLNGAPQGGASTTDVILYGL

SEQ ID NO: 982878 - protein, 122 aa, Homo sapiens
FLALLKLHEDRDRLWAPEPALMYFRRLGEHIFLIFMVLGAMSVISFCILSAMPRYIVVPPERTLLAYYFFTDVYVALHDGIVGCLMNSSGLHAHLRKAREEGLRVPEAAFANGYYLAHLAAL

SEQ ID NO: 982879 - protein, 49 aa, Homo sapiens
MGSGYHPEYEAIANGRKNYNNVALCYSPTLSFFFIPLITTLQGRNFYLH

SEQ ID NO: 982880 - protein, 57 aa, Homo sapiens
CGYRSPTEPRDPTYPTPAPAMEAYTKKMQILKKDKGECHTTGAQTGRRRTEDKPARG

SEQ ID NO: 982881 - protein, 68 aa, Homo sapiens
MLLVVSQDPPSWGLVFSWSRAQATDHVITVQNPSLDVGGHAVCLMKSSCLGFMECGWSLAFQLEMNRS

SEQ ID NO: 982882 - protein, 109 aa, Homo sapiens
GQERLTHSRFVASAACTVARYVIVEYKNGWERKEYENKLIAYFTALCFKLRSALDLSLFLVFLVINKEMGQVVSKLRTYVPYLLGRILVFNTAQGHNLACIFILLHISI

SEQ ID NO: 982883 - protein, 65 aa, Homo sapiens
TILLGALRSRDACESVSEYGGGAGGYVGLFLLLLDGVSIHLLRPHIFHHSTPPSSRPLIRGPVPW

SEQ ID NO: 982884 - protein, 52 aa, Homo sapiens
DDELISCEWMLEKRSMVLKEELFYMKKKHEEEVIDGLQAQIASSGLTVDWTS

SEQ ID NO: 982885 - protein, 142 aa, Homo sapiens
MGFWSIGLVYDLARSPHSLDLSSPNMANYSIMLALIAFAKYFPGIVNQPTEPFWSAQSASSHVTMSEQDAQGASQDSSSNQQDPGYPGDAEVPDEDLMYFHSMTEVADGDFIDWEAETDSVVIAGPPEVLRSPEMHVENVLE

SEQ ID NO: 982886 - protein, 38 aa, Homo sapiens
CGKESGPDDLRWRTDQRGARGRHPVLDYKKLMIEMDGR

SEQ ID NO: 982887 - protein, 67 aa, Homo sapiens
LAGAVLIMRKVSSTLPSLTAPPIRSSLLSDTALSSIYSSEIRMLHRQLRQLPVLCATGSAPVVAATA

SEQ ID NO: 982888 - protein, 40 aa, Homo sapiens
TSSSTQQFQNELASVVLHVPNTSCIAADLPVNACNPLGSS

SEQ ID NO: 982889 - protein, 33 aa, Homo sapiens
LRRSCAKPHPALPVPVFLSHLLRERWGRDWMDE

SEQ ID NO: 982890 - protein, 33 aa, Homo sapiens
MNDKTRVRRLITPADSSLITPWRLFISACWMDE

SEQ ID NO: 982891 - protein, 40 aa, Homo sapiens
LITDPPLWFLEMSSGFENAWSGLFTVALRKGQSSIGCAGA

SEQ ID NO: 982892 - protein, 69 aa, Homo sapiens
CAAQYVSKQAADMIRLDDKLASIVLEYEEGRLIFDNLKKSMAYTLTSNIPEITPVHDIYYCKHTTTTGD

SEQ ID NO: 982893 - protein, 44 aa, Homo sapiens
MPMCSPTRDLECGASSDVWCLMNLTVNIMVNCFSLMDVMNACMW

SEQ ID NO: 982894 - protein, 41 aa, Homo sapiens
MGQKDSFLQGSTWPPAAWQGTHVGIDVAAENAQVPTTMARG

SEQ ID NO: 982895 - protein, 133 aa, Homo sapiens
MGQVARTAIPYIVPPPRSVAYSFTLCQHLGDVGLKGLAHHDVHLLQVQVHRVVVLHEEHLHLMLQDLRPFLLRIEHCSFLAGPPVLQLWARLDCSVSSGWGRLLEAVCRNTPSPSSPSALTSSPASQCRSSPP

SEQ ID NO: 982896 - protein, 87 aa, Homo sapiens
PPSWGPGGSCIALLTVTLSSAESSPHGFGWGHQTSLSWSTLRLICHFCRMGTDAAAGSWNMILRYNPMHGCYVTLVRPGDRCGDACR

SEQ ID NO: 982897 - protein, 47 aa, Homo sapiens
PGIAFDSSPLTFALCGCKGKSQSIIKMKPITSLVFACKLLRVIRCNH

SEQ ID NO: 982898 - protein, 118 aa, Homo sapiens
QHNHMYIMGIPTQGILAISTRVKRPIGRIILTISKGYLPGHQYHSPRSAVSFQAIGSVLKRALVSLNSKPSLVILWLDLRHSEQNSSCILSPHLHSYSDVPLSEELVAPSASIASAWG

SEQ ID NO: 982899 - protein, 34 aa, Homo sapiens
SREEGRRMRVPVRVIKCTGLPSTGSDFDIGKVSH

SEQ ID NO: 982900 - protein, 86 aa, Homo sapiens
SREEGRNKKSGLGGDFVLLLHPLVIQESCGSISRGFLKAPEELAVVRCKCQKLEELKAEEPDNFSSKVVQRGREFFDSHGKYLYRI

SEQ ID NO: 982901 - protein, 32 aa, Homo sapiens
FLAGSDVDFCWNSMLGGGISHVVNLLRWMGAS

SEQ ID NO: 982902 - protein, 114 aa, Homo sapiens
DSTGSPPPVANQASTRINSVTASTTTPGLSEESTTVYSSSPGSTETTVSPRSTKPQFVVKSLRSSTAGQPLLTQSLSTEDSSTSGLTDESTAFPGSPVSHQNRVTCHTHNRRPR

SEQ ID NO: 982903 - protein, 92 aa, Homo sapiens
SWGLESKVMVGSCFTVAQLENVVSEIVGFLVSLTSRMKPWIFVVLQFLKMVCPEVVPSDVQTCLEFLPFGGFVGSLASGVKLQTFVGECYSA

SEQ ID NO: 982904 - protein, 107 aa, Homo sapiens
MGFWNLPNQEVSIRLGSSGWPRAPVLPPLAFAMAVPLPVSSFLRSTLLPRPSSFYDPSLRPQRGLGAEIRPELTSGVPLLPYTEPGAKVKSSYITLYTSDLNSGSNN

SEQ ID NO: 982905 - protein, 38 aa, Homo sapiens
RFPGSVVLCVPMHYGYCIVVQNAPHYGKDKVGSLFLRN

SEQ ID NO: 982906 - protein, 101 aa, Homo sapiens
GSGSDSMMTVLMTVTSDRTHDWRRVTGMNLCTVDNGGERPQMNEKKSGLSVRLGDMPGISRNKKKNMKEQSPLQAVMLRMGSQEIPEEGTGSDRKFFQRND

SEQ ID NO: 982907 - protein, 37 aa, Homo sapiens
MPGEKMFNTVIQSGPQRHNYGFKIPHSSPVRAMSSIS

SEQ ID NO: 982908 - protein, 73 aa, Homo sapiens
IIGVLEKGDRLPKPESLSTGPLYRSCSRCWDYCPPVIRPRFHQKLRVQPSVIVYRDGEKDNCHVSGIRRCSRT

SEQ ID NO: 982909 - protein, 64 aa, Homo sapiens
TAARHQSRWITLVCYSPPAELSCSPPRVVTVLTPARRTVCLFVGTSPFASMPSSRPRCQQISDF

SEQ ID NO: 982910 - protein, 47 aa, Homo sapiens
VGGVHGPQKKVKLLLMKIMTMIMKRMMIKMMMMMILIDEEAVRKSAR

SEQ ID NO: 982911 - protein, 57 aa, Homo sapiens
SVPTSTLPPVFDDFAHYEKRQEEEDVVRKERQSETNNEGEPAFLHVANDLYFDKQVY

SEQ ID NO: 982912 - protein, 139 aa, Homo sapiens
MMLCQLTVFGSVPDTPEQSIRSTYGWNPICDAPVGCDTKRPTGPRFDIRSLGIMAIEMIEGEPPYLNENPLRALYLIATNGTPELQYTQRSCQSIFRDFLNRCLEMDVEKRGSAKELLQHQFLKIAKPLSSLTPLIAAA

SEQ ID NO: 982913 - protein, 67 aa, Homo sapiens
MHLPMDTNLWLSMAQGSRSEFSCTPTTRLQFFLPVPMHFGTLLSSIAPYGRPLAAIILELCNSDVHE

SEQ ID NO: 982914 - protein, 104 aa, Homo sapiens
MVPDMMDLTVEDRTDHWYWIGTVYAVDNSVTMYYRNENILLKRMEERTRTAIDISSSAELEERNNTLLTHHLSEQKVTSDLEENTFFFFVFFETGSHSMVQAGV

SEQ ID NO: 982915 - protein, 130 aa, Homo sapiens
NWTADKIGHRQNDCRLGPRRGIGIGELEVGGGVERWFQTQATVLRSVALTGGQEDMGSGQEVLLNVTRPGPLPKWTLVLGPSLQGVVHMRKQGMASLSGFPGDPGGVSQTEPELNLRDSDSSSPGPWVAR

SEQ ID NO: 982916 - protein, 72 aa, Homo sapiens
MEHRTERFTRVGGTCDFSPSTPPGLSRSVHVGGVTQDITGTANKKHSCKGDGNQAHQQLMEEEKEFLQGIPH

SEQ ID NO: 982917 - protein, 40 aa, Homo sapiens
NLSPGPVLLSKPMMKEFRLEPSSQIIEVARNGQNLIDHHS

SEQ ID NO: 982918 - protein, 58 aa, Homo sapiens
DCCFSLAKCPEHPGHSLQASRGVWLAIGATQLPHLEERQGLNLSPPVAEVSQGQAMVA

SEQ ID NO: 982919 - protein, 38 aa, Homo sapiens
SSSYPQERLCCPFSKAGNGIWAVDVFSDFTLDFLAPNG

SEQ ID NO: 982920 - protein, 35 aa, Homo sapiens
MPIITVWAQKLAGLSDLIVQVTTCRQLSSCRLTRG

SEQ ID NO: 982921 - protein, 80 aa, Homo sapiens
MTRSKLAKSELRKHGPFTNATFLESSELILTMVSRGLHVNWDLQANVSLRKSPPERFKKLVRNNGQKAVGRKHSRAVGGR

SEQ ID NO: 982922 - protein, 42 aa, Homo sapiens
ITCIVDSWRVLLTHTSRRRHWRILLVTTHPAVDTGESFSPHT

SEQ ID NO: 982923 - protein, 97 aa, Homo sapiens
HDSHLLPATQWIYSPSLRQQVPKPCLPEASPRPQVAVTLVLQTQPPGRLLLNPDLPGLGLTALSLRLMSASLRSAGTTDLHLHIFRHTWCCSVISAQ

SEQ ID NO: 982924 - protein, 82 aa, Homo sapiens
MPSVIRAHAIISFGLAVLTARGSGPEEDSSPGGDSSKCVRTWLSGKNVHHCDVRSLHIGTASWVAAYVPNELANVFEGLRPI

SEQ ID NO: 982925 - protein, 127 aa, Homo sapiens
DPRRLLGTGIRVLAPGCPLCSLQLLFVEHGSALDPPTHVVQPLSTEVAMARPGCPWCALLAGCRTRASAAKGGPACAVDPALTPEIRCSVTMGCAVEAATGVIHLTRYSKGRLLFESNLVTEDKLWR

SEQ ID NO: 982926 - protein, 38 aa, Homo sapiens
GGVEQDLKDLNWPLALATMRDPVEFPTYSFVITRPNIL

SEQ ID NO: 982927 - protein, 41 aa, Homo sapiens
SSIPSNAEASVRVSVPVRLNREGVRKFPAVRIRSGDDVAAP

SEQ ID NO: 982928 - protein, 71 aa, Homo sapiens
SRGPLRTGTSLCQALLHRHSLRRCHHCFTLQHLDTGWSTTLHPVPLSLYTVPWPWTQGHRVDPEGDTMARG

SEQ ID NO: 982929 - protein, 76 aa, Homo sapiens
RKILALLAQALECGGDETRGSTTDLRPPGSPVILLPLPPELLGVSAERQLIQLVSVCLVEIGFHHVGQAGLELLIL

SEQ ID NO: 982930 - protein, 48 aa, Homo sapiens
KITQYIDFDHVFSRETEEIIPGTVWLICYNELRRRLRGVSTLTVGLPT

SEQ ID NO: 982931 - protein, 40 aa, Homo sapiens
NGQPGTDYLSSICPLLVVMHFKRWISQTVRDTVDWALTAL

SEQ ID NO: 982932 - protein, 110 aa, Homo sapiens
ELRQRVNGPCGVAVRLRREPGESTSDGASVPVPGRCGQRGLQLAALLLLLMDEFGDGAGDAAYQGPVLIEADAPIMIGIQVLDELIRRLPVPCVRQHVVQLFLEHLAEAD

SEQ ID NO: 982933 - protein, 49 aa, Homo sapiens
TRTAVKGVSGTHCLAIGDSLTLSDRQWSHRLAIGNSPIWVTKNVSRNLV

SEQ ID NO: 982934 - protein, 34 aa, Homo sapiens
DHVHGDEHEVGIILLVPFGCPRGGNSTNPICQNQ

SEQ ID NO: 982935 - protein, 54 aa, Homo sapiens
MDGSVGLQEQVEVLMNNSLQTTALAFSKATWDEAKGQKATKTNDAVEFAQLETR

SEQ ID NO: 982936 - protein, 73 aa, Homo sapiens
WYQRIPCIVQHEEFSPSPHLRWERLPATIPIVGIIAGLVLFGTWVRWSCGRCCEVEEESSDKKRRELLSGCKQ

SEQ ID NO: 982937 - protein, 38 aa, Homo sapiens
RHVHCVDVGLCCRWLIQGLHSTLSRAETQASEASQMAV

SEQ ID NO: 982938 - protein, 79 aa, Homo sapiens
TVNSRFTMIGRDAASEGSKRQSAIKLERHKAVIPVCNFSRHLSVLKTTKVIEGSVKARVSRSRIRTEKSRYKRSFWPYW

SEQ ID NO: 982939 - protein, 129 aa, Homo sapiens
EDPPAFQSTLDAPSSDYEQVLENLNLRGSSVVDSRSQGRFLGTEAELYAVGLDSGHIRGDDKMPIMDFLTEDGSTEKGQKSLRALFQIKKVDLSESFIGMVARKVTACHVALAAYLCGKPDVAVHNGTW

SEQ ID NO: 982940 - protein, 73 aa, Homo sapiens
KDPAWYLQISCSGRNDLEDKNRLFNNNWHSLQVGGLICAGVLCAMGIIIVMSAKCKCKFGQKSGHHPGETPPL

SEQ ID NO: 982941 - protein, 47 aa, Homo sapiens
MMIAHGAPEPSADKPANLEAVPVIVERTVFIFQVIGVQDRKVCKEPT

SEQ ID NO: 982942 - protein, 50 aa, Homo sapiens
SYAYSCGRALLQGQTAGRHALSDTELQPRYTQVSQSIFRNWYVGRNWYGG

SEQ ID NO: 982943 - protein, 65 aa, Homo sapiens
GIKIPFAAESSIPGVTAAHGNATEHDSMASDIRNVSCVMQALRVHRLNMFAMDQGTATLHLQGNH

SEQ ID NO: 982944 - protein, 43 aa, Homo sapiens
LRTRVVLAELLKESQDPLKGPEPHFENRLNLEEEVAVSRDCTI

SEQ ID NO: 982945 - protein, 57 aa, Homo sapiens
EAESVLLVLRGKKMSSEAEDRAGAPGQLLHCRANGETVTLPTSPSPVGISLGLLKRE

SEQ ID NO: 982946 - protein, 40 aa, Homo sapiens
EVESAAGYVQCAVGCLDSTAHLFLSGVRSSDKTLLSAGPT

SEQ ID NO: 982947 - protein, 52 aa, Homo sapiens
LVLAEQTQRIGLWEGECQDEEEFFQTTLYSTSPNQEAGPTESGISGISSYLG

SEQ ID NO: 982948 - protein, 69 aa, Homo sapiens
TDLISACGDVMWLGRTYNARCSRSGEPKSDEMNVKVVGFVSIFLPMLQTVAKNKDQTYDGLCRMDSRVS

SEQ ID NO: 982949 - protein, 118 aa, Homo sapiens
SGFLQNSTTTMVYQQVGTAYTQTALKWLGLCLNLAVQSPPVFKHKTSKNSRSRFSSRSRFRSRCRYSSPPQQVSAQLYPKINVHQPTEQPIQVQVQIQGQAPQSAAPSIQTPSLQGTH

SEQ ID NO: 982950 - protein, 42 aa, Homo sapiens
DNCADKYGMLQETGSLGARKWCRCRSKPPTQAPAFNLGPTGS

SEQ ID NO: 982951 - protein, 44 aa, Homo sapiens
VLFALGCQRTTDSVVLLSVSLAISYTATLIQSSAHSSPLDLAAV

SEQ ID NO: 982952 - protein, 37 aa, Homo sapiens
TLRIRVVSNLCLGSKVQDTGVACAQSSISCLQEPRGY

SEQ ID NO: 982953 - protein, 45 aa, Homo sapiens
TVCDSPSDAPNPSSCFLCQLLVQLRIFAESLMAPNDLPTHLGLLT

SEQ ID NO: 982954 - protein, 89 aa, Homo sapiens
SKDPLRSPAGLIDLVLLHLKGFQARNQAVKVGGSCPSEQNDGGLKVTPGGMGLEVFLVQWLLGASSSSSLGLFPNQEEELVPEILEGTH

SEQ ID NO: 982955 - protein, 93 aa, Homo sapiens
PVVFKTRAGVRMTGEQSVRKTSPEEGEICCTISATEDLSEEEQEELRRELAKVEEEIQTLSQVLAAKEKHLAEIKRKLGIHSLQGTHLCKEPT

SEQ ID NO: 982956 - protein, 75 aa, Homo sapiens
YLVGLSISEAGPEHLVPQLSTPSNWMTHRVIFPAETLALDNPYIPAANLYFPLDALNTQHDTARARPSSLLQGNH

SEQ ID NO: 982957 - protein, 105 aa, Homo sapiens
VCCVCVCMSHGGVCVYPMVECVCINVGELYFYINGRVRAEDVCVCTICLCIMCTCLQICVYRGVNRCVYICMSVCDSVCMIGVCMCMCPSGECRYVCVHASLILE

SEQ ID NO: 982958 - protein, 61 aa, Homo sapiens
MLSVSLIEDKVSGDPFGRQRLKAEEMDTEGRPERDVGWTLSQGQEADEANYYSRSGSQQLE

SEQ ID NO: 982959 - protein, 101 aa, Homo sapiens
RHARVERPSGLSLPSSGITGTRTTPSQFLVFSIETWFHHTGQAGLKLLTSNDPPTQAPKARGLQASATSPGPGHFVCVCVRVCVCMLETRTESVAQAGRAW

SEQ ID NO: 982960 - protein, 55 aa, Homo sapiens
VCEELDGPKDRAGMTHWTAHVTQQGAHGPRGSSEVTVLNEGPVMNDDACPSECSV

SEQ ID NO: 982961 - protein, 108 aa, Homo sapiens
RRRDAHPRGHSVAVGASSSGKVSFSTAARFMSGMGFVGVESSVCECVFSYVVSSMGGGSEASLRFSQREVFHRAKVFHFDEVRFISGLLWIVLLVLCVITLHLALDLN

SEQ ID NO: 982962 - protein, 47 aa, Homo sapiens
QVERRSSVNGCGVVQHAHSSLYPGQVSTRGTTDGRLVETWPGYRELC

SEQ ID NO: 982963 - protein, 43 aa, Homo sapiens
ILYSCAHFSTTSDSTLNLLMSPAFLMLQSEMDLGVISQELELC

SEQ ID NO: 982964 - protein, 130 aa, Homo sapiens
DNYAEFGYCCRAGSKPTGFRWDSRQVDCRAPERPSRVSRRALLVWPLTGCVTPGRSLVLSGKQLNNEQLGFSQAGFSLQSRGKAFWGPAMEGHLSSLQLPRPALNGFLSLPQERWAKPALHQLDAFQEKL

SEQ ID NO: 982965 - protein, 33 aa, Homo sapiens
RTTRSMVTQEQLHGLVTGAAGWCGSQAVLQVPL

SEQ ID NO: 982966 - protein, 118 aa, Homo sapiens
PDHYHHLTITTTTTHLPTTTIISLTITILTTTTTTIFILTTIVTIIITIFITILTTIIPNTTIITTIILTTTTTVTITTITITIITITNIITTIILTTTITIKIITTIIILIGDRGVV

SEQ ID NO: 982967 - protein, 111 aa, Homo sapiens
EDPSLFIGTQWMHAVSQVPRLRASTQFAWHDISTVAFTIEGIQYLRDFLHLPPDIVPATLRRLRPETGRPRPTVCRVSDLRDSQDVKLTEIPTRPSARVHLGVTMNSEGTD

SEQ ID NO: 982968 - protein, 95 aa, Homo sapiens
SLFIGTSLIIGSSLFFGASLFIGTVAIHRPADWYVTGPTMADHVVTVIMVRFCRRSLRNGSHIPREPECAHITLSRTREGRDNAMRISDSFREPY

SEQ ID NO: 982969 - protein, 63 aa, Homo sapiens
LEDPAIHLAPMRRGAGKHVPRAVSVTCNPTVIDKFALAPTASSSTLSMLITGEENAANNYARG

SEQ ID NO: 982970 - protein, 98 aa, Homo sapiens
RYSFGTSLFIGTVAIHRHLAYSSCTSPILRNLAYFIDTLLFIGTSLFIGTSLFIGTSLFIDTSLFIGTSLFIDTSLFIDTLLFIGTSLFIGTYAIHRK

SEQ ID NO: 982971 - protein, 133 aa, Homo sapiens
MYLSENSSKKSNGIAIPAYKVRSVYYHVLTAKTLATKAKIDKWDLIKLKSFCTAKETTIRVNRQPTEWKKIFAIYAILQRANIQNLKELKQIYKKKKSNNPIKKWAKDMNTHFSKKKDIYAPISLQVSDQGLG

SEQ ID NO: 982972 - protein, 72 aa, Homo sapiens
VVDLEDPVYLTRVAKSSSRRPLKTEHVIYSSTVVLPTVQVGEAKKRAFLKAKHKLHCVGAAKTKNCVLSIIN

SEQ ID NO: 982973 - protein, 44 aa, Homo sapiens
RGILDSHSRNEVISRGLHFCLTRSVLLAHLIKLDSIQVSISSVF

SEQ ID NO: 982974 - protein, 61 aa, Homo sapiens
LEDPYSAWGFQRHSHAYFEPVAPAQDNVVDADDVEGVEHTGNGSIFATAFYHVLIGTHSGS

SEQ ID NO: 982975 - protein, 85 aa, Homo sapiens
CKGPAAFHEQRRSLERVRTEDYLKRKIRSRAERSELVRDAHFGRRARVEPFLPGQAVEAEESQISLDDLNEKDGPGGLAPMGGWV

SEQ ID NO: 982976 - protein, 62 aa, Homo sapiens
RSKDPPQCRGFQRHSHSVGAVSPAQDDILFDADDVKGWSAPGYGSIFAQLLPCTYWDKFGQP

SEQ ID NO: 982977 - protein, 57 aa, Homo sapiens
GEYGDLWWTIITTQVTIPKDLAGSIIGKGGQRINNKSVMSRRISDSKIDEFRRIRRS

SEQ ID NO: 982978 - protein, 64 aa, Homo sapiens
HRARSLLSRVNRLLVGDSAHHEQDLEWLQQADVVVAEVTQPSLGVAAMRLGRACEPLTTRILLP

SEQ ID NO: 982979 - protein, 42 aa, Homo sapiens
MNPDWSGCDPYAGPVVGSQMTRQARRLYVGNIPFGITEEAIQ

SEQ ID NO: 982980 - protein, 46 aa, Homo sapiens
DWPGGVNWPGMRDGPEALNGPPYYRECTYTELGDQVDTAGRVWPFN

SEQ ID NO: 982981 - protein, 30 aa, Homo sapiens
MRDFRPVVVGRWQLAYNYALIGIVQGKGER

SEQ ID NO: 982982 - protein, 38 aa, Homo sapiens
ASAPAIGILPHIPLFQPDTRLDKRPNARGPVRMAIQRL

SEQ ID NO: 982983 - protein, 62 aa, Homo sapiens
YGLCGSCCFFVAFIVFAEDGWYIWLSKMVVTVDRGFIDYRTVLLYAGYDSTASVLLSFNACG

SEQ ID NO: 982984 - protein, 34 aa, Homo sapiens
RESSGYSRANPAARCPMKCLSTRVCPSTVYQCLR

SEQ ID NO: 982985 - protein, 44 aa, Homo sapiens
HNGGVPRSAIRCTPFGLSSGHFPSLCVLLVVQLGCMVAVPLGRS

SEQ ID NO: 982986 - protein, 40 aa, Homo sapiens
MAIQRLRAIQRLRPFNASEPFNASGPFNASGPFNASGPCL

SEQ ID NO: 982987 - protein, 138 aa, Homo sapiens
YPIGRRPRVTVHSLSRGGTGRQLSSQLRRVLHHREWAQAWKIFGFVILSVQCHPDGPEAAFEANECHLLFQLETPVCPGLFQHSGPWASGDVSSLCCHKHYGIVRDGRHIVQKLPWYALQNGVPEARVAHHAPLVPVN

SEQ ID NO: 982988 - protein, 35 aa, Homo sapiens
MRDRTWIRDRPGVASDRIRDRPGFANRPGLRERRI

SEQ ID NO: 982989 - protein, 54 aa, Homo sapiens
MRCIYHCRVSPTSGAPSHTAALRVQPGYQTEEIHRRRSPAWQAQRRALAAEIHA

SEQ ID NO: 982990 - protein, 80 aa, Homo sapiens
LQPTITMHVKYVNRSGTVVHAWDPTYYMGGQGEVDVPERPKVKKFESSLGNMVKPHLYQKYKKLAGRGWVGAGNPSYSGG

SEQ ID NO: 982991 - protein, 72 aa, Homo sapiens
YNPTITYTFILTEMRVSSGTSCSGIKLNHDSQSSVDHHRPLTSHCEQCMSVMTNDQTRMLPTCQLWHALLCT

SEQ ID NO: 982992 - protein, 47 aa, Homo sapiens
MPSYEASLGKSSFFRTSKKIARFSSWGHHGPGAGAAALAIRDLDSRP

SEQ ID NO: 982993 - protein, 68 aa, Homo sapiens
AVFWPTASIATPCSGSPFTGEDTVTDYEGKFILRGLLPGCVYHVQLMAEGYDHIERALPHHRVIEVVN

SEQ ID NO: 982994 - protein, 80 aa, Homo sapiens
IVKRYHFHYPLRDSSSCGMFRGSSVCVHKILYAILLGLLHTSSFFWTSTKIARFSSWGLHGPGAGAAARRRYPGTWIRDR

SEQ ID NO: 982995 - protein, 98 aa, Homo sapiens
MCQGCIFTDSVHATILGAHSRGHKRSTCLLSVTHATALGCAAGDPQGSPHQYVVAVLAAPVSWVSQGGYGAHQGDSAMLHIILPCVGDGNCGGGLVCS

SEQ ID NO: 982996 - protein, 92 aa, Homo sapiens
MCWYAYITCTQGTHGIVSAPDDLRSCIMYELVSDDCYTSARGCTANLDNFDKATFDAITKTYRHTWIRDRPGFATDLDSRPTWIRDRPGFAT

SEQ ID NO: 982997 - protein, 96 aa, Homo sapiens
RQHNSINKKVLTKTPSKGHQRPKLDKLMKMRKNQLKNTEHSQTQSASSPPNDRNTSPARAENWAEAEMDELTEVGFRRWAITNFTGLTEHVLTQCK

SEQ ID NO: 982998 - protein, 79 aa, Homo sapiens
LAGPSEDTKGFFDPKTALRTSRNCSYWSAACEDPRDGPVPFCHSRYKAANGGELGATLTPRPGDVFEKCHRVLRLLGRS

SEQ ID NO: 982999 - protein, 39 aa, Homo sapiens
MEQIFMNVAIFEDEVFAGVTTHQELFPHSLLSVIANFIP

SEQ ID NO: 983000 - protein, 71 aa, Homo sapiens
RDLIVMNQYHQLARIHGFLPVKYTISPCSRVQLKSIKNQLCTGRTTVVVSRTRVTLCPNWVFGRLQELLES

SEQ ID NO: 983001 - protein, 40 aa, Homo sapiens
ECLNEIVEYLQTNQVHSRKLEVQRASRSNSVSNNVVTRRK

SEQ ID NO: 983002 - protein, 38 aa, Homo sapiens
RLRRYPKIVTSLNKPLMISTTAPIAWRPSVTLLHTVFT

SEQ ID NO: 983003 - protein, 94 aa, Homo sapiens
RLRQLRETMGMTTVFKPPVQEKWWRVCNQGAGDKVDSEAEYVSGHIDHDSAVGLPRQRQPGEDGNEEDKENQGDEDPRSAATSTSVFFANWYGG

SEQ ID NO: 983004 - protein, 56 aa, Homo sapiens
RHQLTGYGRKYSVAVCQESEEISSSGLPLGPGAGLRAGTLRMGLSDEVLIYATGTA

SEQ ID NO: 983005 - protein, 76 aa, Homo sapiens
MVVSHVIFDNSWTAPEEALFSSRKLAGGSQKWLIGRGQASFQGSAVPSWFSDGRAWLPLALSLSPCLSITTFPPEA

SEQ ID NO: 983006 - protein, 81 aa, Homo sapiens
PQIGYRRTLETLLLESKAAVRNLFGTRTGFVEDSFSTDEEDDGYGIKLFHLRSSGISYDSHEELRILVSSHTQLTTGFALL

SEQ ID NO: 983007 - protein, 88 aa, Homo sapiens
MAYGSCRHSDTKMGVTYFHEEEQRRTCKRYVGLPFILDMTTSIMDGFNVLYNKKPVIYLSAAARPGLGQYLCNQLGLPFPCFVPLGRS

SEQ ID NO: 983008 - protein, 77 aa, Homo sapiens
MYIGQCLKDVLKLARPLSPPVVKLEKRVDAEYGLPSTHVMATTIFFTLLLSAPSRHVSAMQHPEPLGSPMLLLLSLG

SEQ ID NO: 983009 - protein, 43 aa, Homo sapiens
MRHHCAGNASGGLDETGCYYEGYVADEEYVMSDFRSVCREADL

SEQ ID NO: 983010 - protein, 65 aa, Homo sapiens
MDGAVVDEVPLLWRQWPLSGGWGWACALLAVSVITMLLLMPSPRPVRHLSRFRPDLEWDPTQSQT

SEQ ID NO: 983011 - protein, 122 aa, Homo sapiens
GTCLRQMETGLHAAPTWMNRTACGDSHCEFLLQEPPQEHTGKTKRIQDPLKQVVCHCKFCETAKNCEFPKCEREKCLPPNTHPLWEPENSDHGRRISPYLELKWISGAKQNIIVPRKEAPGR

SEQ ID NO: 983012 - protein, 51 aa, Homo sapiens
DLYYAKLNSEVELNHKLTGWIRMDKDGGCGEPMFHVPQMALSTCGDHVNWY

SEQ ID NO: 983013 - protein, 56 aa, Homo sapiens
SRKEDVGRHGVQRKCGPFNASALNGPEALNGPSPPLSQHKNTSDYSCHHDPWPFNA

SEQ ID NO: 983014 - protein, 146 aa, Homo sapiens
LQDPYYAPNSVLRLNQRSYRLQCYSRHHHSQQSQYNKPKRAVLVCTNKSEKWGQGIILYMHKPYGGLEGGGGVLIATSPHNSLPCRERTSPIIQTVKTHGRVGPFNVSPASSISGKGLTSGGTILRREEGKAERREEEKPEGGGMF

SEQ ID NO: 983015 - protein, 59 aa, Homo sapiens
IAGGSMAGGVEWPEALNGPEALNGPKPIFRKKAKTTKTIVLLAAMCRAYLQIQEDPGHS

SEQ ID NO: 983016 - protein, 112 aa, Homo sapiens
RIINAPNSSLSCDPGSQTPACATGSWTLTGHPQVVKVGNNISILLILNTGAPQGCVLSPLLYSVFTHDCMAMHTSNSIIKFADDTTVVGLITNNDDTVYREEVRALGVWGVK

SEQ ID NO: 983017 - protein, 103 aa, Homo sapiens
SSLSSRPGSRPACALGPGLSDGPPQVVRVGNNISTPLILNTEPHKGAFSALSCTPCSIMTAWQCTASNSIIKFADNTTVVGLITNNDEMAFQGGGEGPGSLGR

SEQ ID NO: 983018 - protein, 78 aa, Homo sapiens
PRHVRRRYGPEALNGPEALNGSECVNGPEALNGPEALNGLFKENYKPLLKEIKEDTNKWKNIPCSWVGRINIVTIAIQ

SEQ ID NO: 983019 - protein, 181 aa, Homo sapiens
YRTHLTPNSRIELYKKYLVHLTIMTDILPIFFWIIQMLSSKLQKGLDMYWLKQWDTSGNAGFESLAAYVTDGRLFFTLVQLSAGHSIRSPRVVLGLLLTVLVIILTPRGEILRGAPDRGRLSVVFYVFHFLIIAPTVDFFKPSCLPIADSVFPAWCRSTILFLVSFDSSLVLAIVEFGASR

SEQ ID NO: 983020 - protein, 57 aa, Homo sapiens
MAATLRKMVKKIETRPFNASGHSTPPGHSTPPAIQRLRPFNASGPFNASASGPLNAS

SEQ ID NO: 983021 - protein, 96 aa, Homo sapiens
TVPGAFQRHSHAYWSLSAPAQDNVCDADDVEGVEPHPDMEAIFATAFDRCTFIGTRFEAAVHGLQTDSVVKLSSDYHVAHKSGKLILLPFFRPRSK

SEQ ID NO: 983022 - protein, 114 aa, Homo sapiens
MAGHEVLLTSQMACQLAVGAPHFPDGVAGQRCFPFPRWGSQVEALPTSQTMGGQAEALPTSQTGWPGRGVPHFPDRVAGQRRSPLPRRGSQAEGLPTSQMMGGRPFNASAEALN

SEQ ID NO: 983023 - protein, 45 aa, Homo sapiens
CTEAFMARWIMDGWMDDRWMQRLMHGSMDWIGLDWIGLDWIRLDA

SEQ ID NO: 983024 - protein, 37 aa, Homo sapiens
LTRGNSGLGAILDSGQFWTRGNTGLGAIWSRGNSRTR

SEQ ID NO: 983025 - protein, 40 aa, Homo sapiens
SLFIGTDRDRDTAILPPPLPQPGWGVGPAPQAPYPSEVAS

SEQ ID NO: 983026 - protein, 46 aa, Homo sapiens
YEDLSGHSGLSLYEGTSQDLTLMGKVRTTEAPLHTLPRALVGVCNL

SEQ ID NO: 983027 - protein, 53 aa, Homo sapiens
MSVWTTSSYCTMQYYWTVVFTRTGEAEIGQNCSRQVMKSSCKFLSSAPNPEHG

SEQ ID NO: 983028 - protein, 112 aa, Homo sapiens
WGGGQPRRLREPFAAAGLRALPQLGPFPAEDVPLLSSRDHRTPLLYAGFSTSSIYQGSAVCVYSMNDVRLAFLRPFAHNEGPMHQWVSYQGRVPYPPPGMVRSPRTPATTHF

SEQ ID NO: 983029 - protein, 100 aa, Homo sapiens
MRYGLQARDLQLLVSAAPPGSASDAGRLAFSVVSSTVTQLSWVSLAETNGEITAYEVCYGLVNDDNLTYWPMKKVLVDNPKNRMLLIENLRESQPYRNWY

SEQ ID NO: 983030 - protein, 42 aa, Homo sapiens
DSRDPLLFIGTTGVVEPSNSILSTHTTLEHSDSAFSGRQMRP

SEQ ID NO: 983031 - protein, 69 aa, Homo sapiens
HQSASWSNDPLKACDRIYMMPWILYRTDTLTEYAKWEDYVACRHTNTYSLPNQFYDTGFFVYDNAVFYN

SEQ ID NO: 983032 - protein, 34 aa, Homo sapiens
SENKRQRQQLQALSEPQPRLQAAGLPHTEVPMNS

SEQ ID NO: 983033 - protein, 68 aa, Homo sapiens
MSRDHATALQTRRHRETVSTTTKKKLYSKAQGPTSLNSKLKIKYYIKDFIFYAAIFCSQYAIHQWIEL

SEQ ID NO: 983034 - protein, 43 aa, Homo sapiens
MILPRTVAQGKMLMTVRMSSMLRDHTPAHRREPSAGSWVNAII

SEQ ID NO: 983035 - protein, 127 aa, Homo sapiens
LRGSYRVQCAEGILGASRFNFTRNPPPPRKACCWRCNDVNTAYKREDCLIHDGLVEFAKLQSLRQAAKPILVCLLPNCDEPMYVKWVEALCAEHQINLIKVDDNKKLGEWVGLGKIDREGKPRKVVG

SEQ ID NO: 983036 - protein, 63 aa, Homo sapiens
RGSSCVQLRLPKVGTFGSAFHAWSCQRAGFLTHLKLRIGEIVRPKTSNHSLYWIKLRGGGASG

SEQ ID NO: 983037 - protein, 82 aa, Homo sapiens
LEDLYTNSVGMFLKSMEGEDEITANIAEGGHPFLDVPNIRVESMILIPISLYTPLFDIVPNIPWGRGVSITGNITGCVHPPL

SEQ ID NO: 983038 - protein, 70 aa, Homo sapiens
KDFRVQLRTPYVRDHSIPTLKPPCADGHFMALRATGCGRPPQALCLRAVATATIRSRSRTRRRSPQLVRP

SEQ ID NO: 983039 - protein, 33 aa, Homo sapiens
RVPWPPVVKNPPDPLSPDSPRTVKYGRVLRSQA

SEQ ID NO: 983040 - protein, 117 aa, Homo sapiens
ASYLQQEHVLKAQIAHGIVCGLRMALSGFPPWVGQVFLALIPVNPQPSSVDVMTIMNMSQCCRDFVYGQFSGPVYGQMSGGLFPTGNLQSWWKAKRKSGTFSRQQDEETSEAGESPL

SEQ ID NO: 983041 - protein, 63 aa, Homo sapiens
IRLRPVLLFDLHCPDLVVQAALCMIWSHAESHSPVGDFDGCQALLASAALSAESTPWPCMHGS

SEQ ID NO: 983042 - protein, 64 aa, Homo sapiens
MTCGDYRAIGGLTQGETSPGNLGSFRRTTGYWRFYNNTLVDTSLLSFTMYWAKMVFGVTPEDQI

SEQ ID NO: 983043 - protein, 104 aa, Homo sapiens
SYAQFIQTYTHTHPQTHTHHTLSTLFLHTSIGSHSQQLAIPEAHSRKVLIYERIYSCSCMRRPAKIVQTIKWARTWRDFINPSHVLNDGGQMYTFVLLHLHCLL

SEQ ID NO: 983044 - protein, 107 aa, Homo sapiens
MIHLDISLSDDISQKGDCRAVELTLLGFHEKLVLEEVLKDLSDMKNVFLGRPGKNQDVVKVDEHKTVEHVPEHIVYLEDGIQNQVVGQLGTNGDPLERSKAGRECMG

SEQ ID NO: 983045 - protein, 128 aa, Homo sapiens
MVILDAVIEAKSLPQGTSARKTKLIALILAFELSEGKTVNIYTDSWYAFLTLQLRGAFYKEKALLNAGRKDIKYQQEILQLLEAVWKPQKVAHALQRTPASFYLIALENPQADSEARKAASTHYQASV

SEQ ID NO: 983046 - protein, 58 aa, Homo sapiens
KYGIVRLRPNFLALCDPDWSRVNCSVYVQLEKVCRANPADVTEAQVSFYSGHSSFGMN

SEQ ID NO: 983047 - protein, 33 aa, Homo sapiens
GGMRHPLTPASAPLVEERGNEKATLHLCHMLMC

SEQ ID NO: 983048 - protein, 65 aa, Homo sapiens
SSCLHCAVGHISLDGPLTGVTEGGTARQYGQCSSMCSVVRNSLAHVGTKLCPIHATRWHPLSRTC

SEQ ID NO: 983049 - protein, 33 aa, Homo sapiens
VCWGEKSVTSGTLQALLLAGCFLFISRSKPQRP

SEQ ID NO: 983050 - protein, 34 aa, Homo sapiens
MVSIRVDLGLHEGHNALVLADTGLSGQIVGIWHD

SEQ ID NO: 983051 - protein, 57 aa, Homo sapiens
VPGPASPHDEVSRFHLDLEPSGEGCLFLGVRDPVLGSALSSLTKAIFFPRLPVLRGL

SEQ ID NO: 983052 - protein, 34 aa, Homo sapiens
LLFIFLLLLLLVFFLLAQFLFFFFLLIFLLVLRG

SEQ ID NO: 983053 - protein, 77 aa, Homo sapiens
LCLSEVHVFSESSYKRAMAVDVDVMQRSCSSFRVYVKRVSPVRAVAMMSALHTRKSVSVDYAMFHVRAMTDMLLCVG

SEQ ID NO: 983054 - protein, 60 aa, Homo sapiens
ALWARTCGQLGTGLPPGISNIFLEDQNSPSEAQDSSDRVLHAFCWDTEKRSPGRCDPGPC

SEQ ID NO: 983055 - protein, 99 aa, Homo sapiens
RTGFSQRTVLGQRTVLGQRTVLVDGAAETWWLWWTVLLRHGGRGGWCRDMVAVVNNAAADMVAVVNGAEYMVAVVNGAAETWWLWWTVLLRHGGRGGWC

SEQ ID NO: 983056 - protein, 92 aa, Homo sapiens
ACTLMLLVVSRVPRYPIDRIAYHSVIVIHYHFQHRITYRNVFCVLSPAYFVILLRLVTAHLFSMASLESILSPICLIMGTLTRKQTRKVQLV

SEQ ID NO: 983057 - protein, 128 aa, Homo sapiens
MIPQSTITIWTPVVAMYLRTQWLRLMALRREKYVRVRGVHQATSVDLVLDIEPVSMLNARQAIIYYEGYLVKVLMTAVMIETEFTVKNAQVRGGYVLHIGTIYGDLKCGDQVWLYIDKPRRRPIMSNH

SEQ ID NO: 983058 - protein, 92 aa, Homo sapiens
MSSWSPEDKSEISVMTGFLYLSDWCYSEGVDPNKHCGVQDPEGKRSCTRSLTCKVKTTDLYTSLPIGYTAYSDHQFAYLYLALCALYSLIPG

SEQ ID NO: 983059 - protein, 60 aa, Homo sapiens
DFDHKVVEDSSADLDANIGYGSTKKQSTCCHVVPEVLGHNVMELEVLLMCNKSYCAEYAA

SEQ ID NO: 983060 - protein, 45 aa, Homo sapiens
MVGQLDEDALISFLELIHIFLGIVHQCFGDGLTDSINLVHVTTTL

SEQ ID NO: 983061 - protein, 59 aa, Homo sapiens
VSVACSPVRVNSRMMSGVTSELPVLHLDPGAGPVHIGSTLVPLMSELSLQCSLSTSTSA

SEQ ID NO: 983062 - protein, 92 aa, Homo sapiens
DYRILCRDWHVRNRRCREHAWQPMLGARGLQLLLEKAKGHCFIAQVGSQEVSALRIGGVGDGRWACQQAGGSGGGSGTGKASKAKAMLEAWT

SEQ ID NO: 983063 - protein, 79 aa, Homo sapiens
CLLYLRGHQFHHNYYHYKTPVHNPYTKLPLFVVIRSYITCCPTISLSLPSPSLLASPILTKQTRNVVRRGYRSSTFRTS

SEQ ID NO: 983064 - protein, 100 aa, Homo sapiens
LEDLNAADSAAGAHGAAGAHQTYRMRSRGRCWCWMKERQELRCITKLVTAQFGSIFRTFHNPELLLKAPRAASLDFYMASVSCLVNYRVDFTFYPCRVRC

SEQ ID NO: 983065 - protein, 74 aa, Homo sapiens
GIGCPVVEYLACQAWRPVFDSRPMQERIEHVISTSIQTPDEETLCTIARPPEISGLGRILNVTLEQYDFAYIYS

SEQ ID NO: 983066 - protein, 48 aa, Homo sapiens
YRQVCASPIHVKSIDCTPGGLQSSSQNISMITGTGCTEINLSLIATVR

SEQ ID NO: 983067 - protein, 37 aa, Homo sapiens
GLTGSRHGYASRSITMVSRVPRLLRMLAHADAVSVAR

SEQ ID NO: 983068 - protein, 40 aa, Homo sapiens
RVQLRIAVEYRDDAGLLVVAGALPAVQDLGVRYSSTVPDT

SEQ ID NO: 983069 - protein, 61 aa, Homo sapiens
MAACLSSQQCGLALRLSIGRIAVESAGLSRSTIHPQHTTIKEIPRCSMRVADWYELESIMS

SEQ ID NO: 983070 - protein, 39 aa, Homo sapiens
AIDCATWIDCIKQASEAVWCDAIDFCQCLNVKENSCSAV

SEQ ID NO: 983071 - protein, 48 aa, Homo sapiens
MIHLGHIPQRMIYPRKEIVERWHLHFSATTTVSTPEVLKGLSDMTNVS

SEQ ID NO: 983072 - protein, 53 aa, Homo sapiens
MEASLHNFYMYLLAQIRAASRASEDSCSNSSDTIVAIKRKLIHFYLLSPGQKC

SEQ ID NO: 983073 - protein, 74 aa, Homo sapiens
FRIFPPYSCGLPGTQCTGKAQDSAKKAGYRPRFLSTEDMLRYGLMGMERPDRPPDTHKGSVLRRISERGSALCS

SEQ ID NO: 983074 - protein, 108 aa, Homo sapiens
MIYPQKGDCRAVELTFSAFTTVVLEEVLEGPVLDIENVFLGRPGKKIRMSVTEMNTKRVEHVPEHIRFTWKKVSEPGGKVKHGKMVTSGEVKTEERCMGYDLNHNVLD

SEQ ID NO: 983075 - protein, 103 aa, Homo sapiens
LYRIYHSAWGYPKATRILVLEPVSPSYRTTSCLMRMTWKGWSLHPDMEAIYSHNYLPCTYMEQIRADSRASEEQLLKFICHHVAIKAETHPTFTYLPTHVKNA

SEQ ID NO: 983076 - protein, 66 aa, Homo sapiens
LGDLEDPVLQVKKHRPTWPVSSRRQGGAAHAAPEKVKVEVKKFVKIERLGYKVTKQRDSEMWQQSL

SEQ ID NO: 983077 - protein, 110 aa, Homo sapiens
SICGVYDVYCLQRSEDCLITMAEHVIGSAKLRQRKPSCVLAPTVMSYYVSGEAFVLNTNQLLGCDTETRRMVGFVNDREGNPVSVGCSWVTAALYGGDELESNLASVLVM

SEQ ID NO: 983078 - protein, 60 aa, Homo sapiens
YSDGDGDGDGDGDGDGDDMVMEMVMVMEMVMEMEMVMDMEMVMVMEMVMVMVMVTQLVRR

SEQ ID NO: 983079 - protein, 58 aa, Homo sapiens
YAPNSVITVPSYIINTSKRTVIDCSIFNDKKETRDSGIHTQVTLAPVSTPVMFYIHVP

SEQ ID NO: 983080 - protein, 110 aa, Homo sapiens
MHATGLILCRSHTLSLSFDSRGHIFFKLTTLFGYVSGNDVPDMLTVFVIYLTNPDFFPVWPRTRSSCQTGPSAPPREPTLVKAEKCKFHRSTISFLGYIIAEGNVQMDPG

SEQ ID NO: 983081 - protein, 97 aa, Homo sapiens
MSAAVGISGWEQTLRQRQVNVLVSLSELFASTRPGFTGGSSEVDETALDSDDPADVKLDSDDPADLKLDSDDPLDLKLDSDDPADLKLDSDDPADLK

SEQ ID NO: 983082 - protein, 182 aa, Homo sapiens
INKHKLRADRMDRMGAVVNQCFSSTKGLSSVETCEWYLGEMSARGGPQGDVTQMKGGEKLAKPRKRFNVDVILRQSTGAFTRIHLDISLSDDISQKGDCRAGELTLLGLSRKLVLEEVLKDLSDMKNVFLGRPGKKSGCRQGQIEHKTVEHVPEHIDYLERRYPEQVVGLAGKHGDLCAVKS

SEQ ID NO: 983083 - protein, 96 aa, Homo sapiens
MLSVEDKQAKRSQKGAPVHPSINRVQEGDLRDQCRTGRPRRVAQGLLGRCMDLDLQGRSQDSKSQKTQVKGGRDKCFQMKQESTADLQGPEAMRSA

SEQ ID NO: 983084 - protein, 60 aa, Homo sapiens
GAATAEFPDVDEDGSTIPTFINPEKGNELLQGVLDRPILLLVDEHHTDTELEFTVVPCDV

SEQ ID NO: 983085 - protein, 82 aa, Homo sapiens
QEQLVRLGVASDDCQSELVGVSVKACEDGVRLAVPAGDLKRGGDENGAERRLDGEFTSTDVEEGRTRTVVRQLSSQTSQLIK

SEQ ID NO: 983086 - protein, 38 aa, Homo sapiens
RATLEAIALCSSLLEYTQILKALPTRGLCAQFITEAER

SEQ ID NO: 983087 - protein, 37 aa, Homo sapiens
MPNVTIPFREVCPNCSSPHSLRLPAPPTQHVSQQINL

SEQ ID NO: 983088 - protein, 43 aa, Homo sapiens
PEDSQPWRGAKKQPARERGQRALGRTANEADTGPGPNLQHQLT

SEQ ID NO: 983089 - protein, 67 aa, Homo sapiens
IYTQKLGHYKPALTKRITKGCTSAEESGLREDPGTISRKQKKTDTLGNKKLRAKCTNLEENWKIESR

SEQ ID NO: 983090 - protein, 70 aa, Homo sapiens
FGPLSRYGCIGLLAIAAVLASALAVSSELMSTEGYISYALSADEHAWNRLLAVTKISYGTSEDKLILLTT

SEQ ID NO: 983091 - protein, 35 aa, Homo sapiens
DPIHKHKNQLGVVVCTCTPTYVGGRARIIALNPGK

SEQ ID NO: 983092 - protein, 108 aa, Homo sapiens
MHLHAAGQLYEIPCGTPIIRRAMLLDENECTLQLKSSLKVVGNYIIISKCDLVKTDKFITLKVWKQIYKKKASDTNMLRCLMYDTSEDKLEDRKPDMQNDYFVDQFQY

SEQ ID NO: 983093 - protein, 146 aa, Homo sapiens
MGTAGARLNLSPDLQAARVTDARNRAFKQGPLSGRTIQGAWPSQERELSRGSRRLLRDRSRYRTGRLAAPIFGTPDSGDLNPTTFRSGEGHGGHRPVPSERRSPISQERLTHVQLLYTWNPSPLRPSQFSFEYLLLNTKIRKWYGG

SEQ ID NO: 983094 - protein, 72 aa, Homo sapiens
ILHREGHSAVDVPKATPKHSNDQGRPCGDAGTAAAKRREVIGMGAMSKGSRRGELRSCRALWATAGTLSFSL

SEQ ID NO: 983095 - protein, 57 aa, Homo sapiens
MAHGVTYLHYYSDYAETNYERTHETHHKSSTQETSNVYYPLNSFLDDFYVRLAKPQP

SEQ ID NO: 983096 - protein, 70 aa, Homo sapiens
GDLFTSEPFLVYRILITASLRINHHNVWPLSVGQEWQLVTMTAIYFSLWLIYSASQQPIDVGVTTPIITD

SEQ ID NO: 983097 - protein, 46 aa, Homo sapiens
YFDTRCYNDTTVLYDTTVLYRYHGAITDTTVLLRYHGAITIPRCYN

SEQ ID NO: 983098 - protein, 68 aa, Homo sapiens
VFSDRVSYSTVGISFFYSGSGQVDIKLLMGFFFKTEFQLLLPRLEYNGAISATSASRVQAILLPQPPE

SEQ ID NO: 983099 - protein, 101 aa, Homo sapiens
GLLKEVSLYFLVWQKKRAKWVAFGGLAKETKSHILVRLLRLFFGFNLSWGCSSSRSSCGGSSHRGSSHKGRWISQEGLDLFSRGEGVIRLHRQGQDSFVPV

SEQ ID NO: 983100 - protein, 53 aa, Homo sapiens
AKARIMLLTARCETLIDDECYEAIFKPGMLKELETAEHERVTITVTRTLAIWL

SEQ ID NO: 983101 - protein, 40 aa, Homo sapiens
MTVLKLPSGSKKVISSANRAVVECGGWMCGRIDKPVLRGL

SEQ ID NO: 983102 - protein, 65 aa, Homo sapiens
LSSAVLAKPKQDGRVRRRRANDPDAALSELAPTSKEPFSWSSRNAFELKLGCHGGPVNSMRGARR

SEQ ID NO: 983103 - protein, 36 aa, Homo sapiens
DSLHVVRIHPPACHPASITAAFHGPDVGCYQDDFLD

SEQ ID NO: 983104 - protein, 48 aa, Homo sapiens
SRERRYDPLQWVTDDSDTRMPVFKSQVYIIQLCGFSAITLTSLCLGFL

SEQ ID NO: 983105 - protein, 136 aa, Homo sapiens
QRTASSFYYPEIKPTQPSNSQNTTNNNASANLIWSPAQVRSGHERLYRNSVIVRLEAFAVDNGGAELVVLLLADPHLLYVVYSEARMEPPIHTEYLRSGGAMILIFIVLGARPVISFCILSAMPGYMVVPPDSTVE

SEQ ID NO: 983106 - protein, 93 aa, Homo sapiens
HSQVQVVGLSSSVKRDSLLWLPLGQRTLGCLLHGGQDLVLLVPRPAVRCPTTLRPHHRQAYKHCSWPKFSPMRPYHDEMCSMLHIVLSGLGTP

SEQ ID NO: 983107 - protein, 38 aa, Homo sapiens
LATVGLSSLLSDLLLQLRDISMQSTVAASGKDLTVRWP

SEQ ID NO: 983108 - protein, 94 aa, Homo sapiens
GPCWPRTVAHACIPALWDAKAGGSWGQETETILANTVKPRLYYKIQKIEPGVVAGACSPSYLTVRWPNVGQRTVITIIITITTIILTTTIITIS

SEQ ID NO: 983109 - protein, 126 aa, Homo sapiens
QVPLYNPHDHGSPGSACVGVALLCMPYCRHHGRQLVESHWPRWQPVTAKPKGTSSTDTLPTGLFTETAECPLVAALAVLDSLWGQSHSSQGHRGHSGAQPLQACTGTDHHEGCTQNSVNLGDRGVV

SEQ ID NO: 983110 - protein, 56 aa, Homo sapiens
LFSAPCYGIDTKIAARMLWRILNGHSLTRRERRQFLRICADLFRLVPMNSEVPMNS

SEQ ID NO: 983111 - protein, 126 aa, Homo sapiens
KRLRLPRRPRLVDDLRCKWRPTGDPDSVNYALVAGIQRVPRRSSIYCFHLFGYEVCQVTRPFAKRFARQQKNIALSHRSSHAEDARQGEDGGVDAAFAVARTAVATADHCGSQRRVFTARSRATEL

SEQ ID NO: 983112 - protein, 70 aa, Homo sapiens
PFYRFPLHLIRIIHHHNSTWPPRTRSLRLISLPIITTTSGFSLSSISAFFSSTFKRTSPRNIIGFAIKIL

SEQ ID NO: 983113 - protein, 83 aa, Homo sapiens
SRSRIKPTRENGEREVLGMKRDKSEQPCHFSYVSIEPMVVDVEDYYPVFSCDMVAELWWSGNDRLITSMTDSSDGEMFTDSMP

SEQ ID NO: 983114 - protein, 36 aa, Homo sapiens
YNPTITQVCSRTLGWEARLGLVLGHLQWVCGSSRGC

SEQ ID NO: 983115 - protein, 118 aa, Homo sapiens
ALDKALWALLSRSVMSRLFSWVGKTDAAVWDVTSPHIPNRSLHPLSVTSCRLPIPFPPLTTQVMKTVSHRLIVCDPNLPKTIHCPEYGSCHKRLHKVKGPCVFLGCCAFQQSVSFQLL

SEQ ID NO: 983116 - protein, 70 aa, Homo sapiens
LQPTITRSSPTIGLLQVEEQGSQLVDQSKSQSLKSREADSAAFSLWPKAREPLANHWCKSKSPKAGELGV

SEQ ID NO: 983117 - protein, 40 aa, Homo sapiens
MTKHKTLQHDRCCNEHQTDGLTSHFLSPRAESPLLDPEHR

SEQ ID NO: 983118 - protein, 115 aa, Homo sapiens
MAWSHRALWVFFFWQIGSYWFLKKILFRTGSKLKRGTSQRGQPGSFRNWPRGLLTLLNSLGQRFSIFCTLSLIFLKRRLLQTNPPLFALQDLWGDRPPNLGCFDPRLFTYLVKGL

SEQ ID NO: 983119 - protein, 105 aa, Homo sapiens
TNLLDIVLLELVAGLPEGYMFIWNGEVSPNLFDEIDKDGHGEGLLEEFSEYIHAQVASGKGKLAPVFDAELIAKNMFTNQDRNADGKFTAEDYKLKDQDAKHDEL

SEQ ID NO: 983120 - protein, 88 aa, Homo sapiens
IANEDRSSWTAADTAAQITQRKGEAEPKAYQLRAYLEGLCVEWLRIHLEIGKETLQRADPPKTHVTYHPVSDHEVTLRCWVLGFYPAE

SEQ ID NO: 983121 - protein, 44 aa, Homo sapiens
SLPGGSKRSPNPQSHLIFNDALLTGYYADGPISQGMIALKDSGI

SEQ ID NO: 983122 - protein, 59 aa, Homo sapiens
KYLGPSAESCCCYTPDISAPTTGLNFQPFAYGVTIFLLVITRAVALFTSDFTALYHGAI

SEQ ID NO: 983123 - protein, 117 aa, Homo sapiens
KPGDPFIAPMVCGPWQSQQGGIQMKKYEKHLRLCVVAYTCNPCTLGGRGGRITRSGIRDQPGEHGETPSLLKIPKKKISWVWWHAPVIPATQEAEAGGSRGQEFETSLANTVKPHLY

SEQ ID NO: 983124 - protein, 99 aa, Homo sapiens
MRRLHSAALSPIDYRGPQLLMHRGFTQYKAGAARTGPAKQPVCQRQVLQYEINTPFATAGYVCFETHSPIVTKALALGISLLCGGREDLTLVEGMKGAS

SEQ ID NO: 983125 - protein, 37 aa, Homo sapiens
REPPEACSDIGRLELRGKCLAFELVEAVRIKDVFYFY

SEQ ID NO: 983126 - protein, 108 aa, Homo sapiens
ARYWGTLSYTLYKNYSRWIKDLNIDPKTIKTLEENLGNTIQDIGMGKDFMTKTPKAMATKAKIDKWDLIKLKSFCTAKETTIRVNRQPTEWKKIFAIYPSYKELISRI

SEQ ID NO: 983127 - protein, 37 aa, Homo sapiens
SRGSLELCQEGLRGHFSQAGDPKIQKDLKIKAHVTVS

SEQ ID NO: 983128 - protein, 58 aa, Homo sapiens
MPVASEDLGGRQLVVVIFWSLEQAAVGGNSRAPAGDWIVHGAGGYSLDLPLTYQIRRN

SEQ ID NO: 983129 - protein, 52 aa, Homo sapiens
KTQGNLMRDDKKQYRATGKKSYWPNEDEHITYKSRGALFKHYKTKRYGFIEN

SEQ ID NO: 983130 - protein, 70 aa, Homo sapiens
LKIWWKGSHIQGRHIVLKSGDRLLQHIGPNFIIFNYTLVLEVPKFGIPGELVKMSPRLSRRLEWLLDALL

SEQ ID NO: 983131 - protein, 39 aa, Homo sapiens
AQQDNEAVSRRGVTPGNDEASTNFSFTSGTRLAGNHLAN

SEQ ID NO: 983132 - protein, 36 aa, Homo sapiens
LGNRLHSHFLELTLTDGSREYSGQHRLSQKEDGKLT

SEQ ID NO: 983133 - protein, 50 aa, Homo sapiens
AKAHLRGSSFRKGPKAMQERGFKVIKQHWGKGFQCKAATTATEAGARAGP

SEQ ID NO: 983134 - protein, 53 aa, Homo sapiens
GTPRRGTYEWGVRSTRKSEPPPHGSGCTEIPGLEPITFAGKMHYVTWSSRPIF

SEQ ID NO: 983135 - protein, 115 aa, Homo sapiens
TNHSWHVVIGKTLMTKTPKAMATKAKIDKWDLIKLTELLHSKRNYHQSEQATYRMEENFCNLSILQRANIQNLKELKQIYKKKKSNNPFKKWAKDMNTHFSKKIRYLCFHFFRGD

SEQ ID NO: 983136 - protein, 80 aa, Homo sapiens
PIYGHSTTYAEIQVASTADMVVKSPDREDPEITSRGSDDVDLETCSSSGREHLARWHEGKTSLKGSLPVSFRPSMTIRAT

SEQ ID NO: 983137 - protein, 55 aa, Homo sapiens
TLVCQRLVTPYVALALGHPDDVDHTTSCPNTRFTGTCCSSLSRAQSSFSATVPPF

SEQ ID NO: 983138 - protein, 133 aa, Homo sapiens
WTQTSPHWSADKSHRHSLPRGGTGAAAVLTTSYFFTTGMWHNIMEDFGFVILSVQCHPDRPEAEPLKPTNAISSFNYETPVCPKLYQHSGPWAIWRHIYPLMPKHYGIVRDGRHIVKKLPWYALQNGVPKARV

SEQ ID NO: 983139 - protein, 95 aa, Homo sapiens
STQRHEPTSPGHKVKTHPESLVARSPAALDLQSHTLLWPWENIKHGDVTQHKVYTREQQDFPKSLKSLWVFEWNLEAPRWQWIDVQFLSEEPCEK

SEQ ID NO: 983140 - protein, 108 aa, Homo sapiens
MAVNYFGYPLSGGILSEPFKTGLTSLILHHDETEALYRLKLTQVTRLTDGRPTVLIQSIAFRGPVLVPPGHTACHHYTCLSCRLVYCITVPPSVKNGPGTERPLPILP

SEQ ID NO: 983141 - protein, 83 aa, Homo sapiens
KLHNLSQPSIYFSYLLNHSNAHCAISERVTRILVSVFLQITQLFGIERSPFFFVFITELHLRTSFTFNQSKCYQHRCPSQSCN

SEQ ID NO: 983142 - protein, 85 aa, Homo sapiens
TRHNKLEEHILRTGEGPLQPWYSAGPQPRQAPHSVSSGSSSLPSPAEILIPTAPASRVHCPYLLEPGPSFPSPDIEKLVQHERKL

SEQ ID NO: 983143 - protein, 49 aa, Homo sapiens
QQGTDSRRKEVQASPRKSREAILGPSPVDTYYHLPPQTLSHSLKIDWTR

SEQ ID NO: 983144 - protein, 40 aa, Homo sapiens
GPTASSQLIPDLDGEPRGKVEHCGRPRPRTRLTQCEFTLQ

SEQ ID NO: 983145 - protein, 43 aa, Homo sapiens
MNIPYQTHAGQLPRYICAVRDKIGAATLRGYPHATHDLDSADL

SEQ ID NO: 983146 - protein, 77 aa, Homo sapiens
LRHSCVSALRFLAFHDIHCAGLGYVYRVFYQPVGPKQYPYNYLYLERGVNPSKEPERVVHLSDLRRLRGLLCPVLRL

SEQ ID NO: 983147 - protein, 57 aa, Homo sapiens
REPLEATYSCTYRWKRHPININHEPSLYTDHLHNANATDDPKQRWRINPSVRIHTSS

SEQ ID NO: 983148 - protein, 75 aa, Homo sapiens
PLEANKLISMSAEALSSPKREYNRGQLQLKAGTSPQSQPHLQANTCCWDVLSPSTTLQAANTVCAVRYDCFQLIL

SEQ ID NO: 983149 - protein, 60 aa, Homo sapiens
DVDGSTCLCIRDVAIKEPLDGCRGAQDSWSPTRCLKKEVDIYTRQGGQTCTFTYPVLHCK

SEQ ID NO: 983150 - protein, 43 aa, Homo sapiens
ARRRSAGHQAEEQAVSSAMQGPLKSKKKESRLAIQRLRAIGGV

SEQ ID NO: 983151 - protein, 52 aa, Homo sapiens
STHAPNSTRDASSINSYNACLYTYHLDTSLILPTILEIAGALIQAYVFTLLV

SEQ ID NO: 983152 - protein, 45 aa, Homo sapiens
EALNGLFNLSSCLPAFSPGPSGPFNASGPFTASGPFNASGPFNAS

SEQ ID NO: 983153 - protein, 58 aa, Homo sapiens
NAAGGPNGVGTYAVVHSFADAIKLFTKEALGRDKSTITNKPPVYSYELILRPVAAPGG

SEQ ID NO: 983154 - protein, 44 aa, Homo sapiens
ALNGHTEKARVITEEEKNFKAFASLRMAIQRLRAIQRLRAIQRL

SEQ ID NO: 983155 - protein, 63 aa, Homo sapiens
PHRPPSCRLLRYEAEPAEGLRGPALAKNSREYVRPGLPVTFIDEVDSEEAPQAAKLPYLPHPA

SEQ ID NO: 983156 - protein, 50 aa, Homo sapiens
DSREPPEALNAIQRRRRLNGHYNLTANGISLCLSSVSLFAGPELTSTRPP

SEQ ID NO: 983157 - protein, 34 aa, Homo sapiens
THDEPRSLGTQLPNNRPQTHSHYFQRILRPLAPP

SEQ ID NO: 983158 - protein, 89 aa, Homo sapiens
EADHLRSGVRDQPDQHGETPSLLKIQNSAGLGPFNASGPFNASGPFNASGPFNASGPFNASGPYNASGPFNASDGMAIQRLRRNGHSTP

SEQ ID NO: 983159 - protein, 116 aa, Homo sapiens
PLEAPRQMSRQRLGLCFIYKDSDTSGTELRRRPKVRWPVAGSPYKSVLLAQHNPSPTGQQQIPTQAPVTTLYALRRTAKVWLSLRQGRLECDRSPTLGPAFACACKNHSVEAPEPC

SEQ ID NO: 983160 - protein, 95 aa, Homo sapiens
SVCRLSLLLTLAYVGPDTTSRQSTQNSLLPHSSIQRDGSIVDTALYDPADASSAFCPGLALSDVELTSPSSCFFAGSPGAAPASCWPLQAQPLTP

SEQ ID NO: 983161 - protein, 52 aa, Homo sapiens
HPTTEFPCQLGLSAAQGEDNRGQLRRKAGTSPKSKPNLQANTCPWDGPGPSS

SEQ ID NO: 983162 - protein, 55 aa, Homo sapiens
VQPPHEEWDRHSALTQRPQQPPHEEWDGHSALTRRPRQPPHEEWDRHSALTQRPR

SEQ ID NO: 983163 - protein, 72 aa, Homo sapiens
NVPRVLAIDDYNPNSPSPPASEMVSQGVELMDNATQARKQVSVSVIWERNSSLSTAETSERRLFFISRTIES

SEQ ID NO: 983164 - protein, 102 aa, Homo sapiens
MLYCRACGRRVSGSSLTNIATRCSQHNMERSSNTWQRLTEEIQVPMDRASILWLIGEYCEHVPGIAPDVLRTMAKSFTAEEDIVKLQVINLAAKLYLTNSTQ

SEQ ID NO: 983165 - protein, 72 aa, Homo sapiens
GTILMKLVVSCVSVPVMPFASILPLQVEESALPSAVLVHMEVKMPFTMPESFLDDGDLVLGDELYDLLDSAS

SEQ ID NO: 983166 - protein, 63 aa, Homo sapiens
SIKRGAGEGKIIVDELKHEVISTSSKAQAPQCTYLDCPVDGDTLQAAYTHIQKLGTCLTLAPL

SEQ ID NO: 983167 - protein, 88 aa, Homo sapiens
MKHYQVRDSGRTDKGESVLRLGRPKRYTWVLFYKRFLAELSQENLITCIRELEKARVIQPGYGVQYDYLHPRQITPSLETHLVQRLFF

SEQ ID NO: 983168 - protein, 85 aa, Homo sapiens
TKLTSLIFLSIQVDNPHASVPAQNCTTVLEEAQTEDRGCHKSIDLTSSRATISKNILQGCEMGHELPCIIWDSADPTVLLTAASP

SEQ ID NO: 983169 - protein, 86 aa, Homo sapiens
TAESDGAMYALFLQYYISGIYLPYGFLDDTGLVIVTQAAITASSFKRSSHHRFPKCWDCRCDSWHPALVLPYLYMIQAQNPNSGTV

SEQ ID NO: 983170 - protein, 106 aa, Homo sapiens
PGAEGGEAHCGEKADRSRCIPGSAVCSLVPHRRCGLLRAGSLMVPVPKTSPSKLETTPRDEICPASSEPPGWSPRTLPRTKKNSGDRSSFRTVLLPCSGMQSPASS

SEQ ID NO: 983171 - protein, 139 aa, Homo sapiens
RSAELLHEAASGSAEEYRWASSSWWMKAFVWYDHEVHEGLWDEVADGLVDYGHVGVHQVANGLQLPLQLGVHGEGVLLGPILVFCLVLLGVDASSEDRGLPAVHVFLGVTGQLDLPHVLVDVSLLRVEDGEYVLVGREA

SEQ ID NO: 983172 - protein, 47 aa, Homo sapiens
MPTGRGLTEAMMDPVCNDAVQQYLTEDALAEGGGACGAGSSTPDTAT

SEQ ID NO: 983173 - protein, 35 aa, Homo sapiens
MLRLGPDVYVYGRPIRNTEVDSVESREDSSSIILG

SEQ ID NO: 983174 - protein, 39 aa, Homo sapiens
RYIDEELLPLSHHLEPRLSPLASPAVLRLGRLQYPAFRI

SEQ ID NO: 983175 - protein, 71 aa, Homo sapiens
KESKMRQDRRQGSPTDGNESRNISHMESSHGEQQGHITHTSASRKNFESLSYTAIHTQGNSVDPETPPIQR

SEQ ID NO: 983176 - protein, 127 aa, Homo sapiens
TGTAMREIDHNPITPTGPPYNIMGITIQHEIWVGTWSQTISPNSCDFSDISSTMNSKYSRISNFVIASIQPPKYYALNTGQVKNNHSSRVPRNPSHTRRNVFQRYQVLTFAPIKKVSPDALEVFQIS

SEQ ID NO: 983177 - protein, 47 aa, Homo sapiens
LLSFYQYSLVCNRNAPYSVAGGNTDMGHETHAIMGTPLYVVPPPRYS

SEQ ID NO: 983178 - protein, 64 aa, Homo sapiens
MARNLYIHDELFQISQLKEADNQLGSTYWTQVPKNWMQCPNKELDLVYPITEYEAKNPGPETRI

SEQ ID NO: 983179 - protein, 88 aa, Homo sapiens
PDTAGAERNPRHTPPPQPYPAATKRTHGATRQNVVPRPGTQKRRKECDVLATGPLRRGAPTGNAHPSQVRSPQNRRDTGSNKGAAPAS

SEQ ID NO: 983180 - protein, 64 aa, Homo sapiens
MRAEWAGLTEPYSKNQVPGTLAVHSVLHPKVTSSAVHQEAARGTEGAEAHTPQSLGAISLGPTQ

SEQ ID NO: 983181 - protein, 58 aa, Homo sapiens
CLILGGKRVLLEILADAIIHECHYCRSMPTPSHSDDAAPTPQAPPTPSHLRTCTMLPT

SEQ ID NO: 983182 - protein, 47 aa, Homo sapiens
QALRGLFSLQHRLGIQIFEEEPERKRKKGPAPKMLATACRLWDKASS

SEQ ID NO: 983183 - protein, 53 aa, Homo sapiens
MGFHHVRQDGLDLLTLGSARLGLPKCWDYRREPPHPGDEVRHSKSRDETGSQH

SEQ ID NO: 983184 - protein, 68 aa, Homo sapiens
PYTCPGLYPCRGFLDDFPIVIKHQSSPNLRRYLTGRNGDIIKPPKCSSSTPHPLPETSDEIHPIVLKL

SEQ ID NO: 983185 - protein, 37 aa, Homo sapiens
ECQNVTLKHTHPHRRAAPTPQAPPTPSHLENSTSSPQ

SEQ ID NO: 983186 - protein, 107 aa, Homo sapiens
EAEEHGEADVVTVVGPHLPKPRHEARFRPRDDVNEAQDGEQEGGLGVGHAQVLGVAHHEHGRYEEPQHHDRGGHGVKHKAAVPEDAQVYQAPGGSRWPRARVSRDHQ

SEQ ID NO: 983187 - protein, 49 aa, Homo sapiens
MGNVLTTEFTLTPQILEVVSPEAESKWRLSELQLIAVNPTAAGLASAQR

SEQ ID NO: 983188 - protein, 94 aa, Homo sapiens
MVMLHTVLSKGQQWVEYVLSSFWYEASSFSIGDRSRMVVFSPVFILLLEEKSFRDRVTSWDTSAMCLWRSAIHRSSSSSRSTSFTRAPPIQRPG

SEQ ID NO: 983189 - protein, 99 aa, Homo sapiens
YPCRGFLDDFPIVIKHQSSPNLRRSVAGRNGDIIKPPKSSSSTPHPEPETSMRPIPESLSFRSTLVAPASRLFSTIFFIQCLDSVPPAQSKSDGLTSDQ

SEQ ID NO: 983190 - protein, 67 aa, Homo sapiens
MRLETELSSTNGSRHTALVTDHLKQNLPHRGSLCAPIQTTSCYSDTPRITNIVPFLRTLKHQAPLQD

SEQ ID NO: 983191 - protein, 54 aa, Homo sapiens
MDVVSTTSRHCVSLPPVSCPPAAAANDCHGDSHMTSQVACLSCLLGAQAVVVAP

SEQ ID NO: 983192 - protein, 52 aa, Homo sapiens
NRRDIRRSCDTIRPGLQNKRWTQAAIQTSSLEKSYETAMTDQVITIENERFR

SEQ ID NO: 983193 - protein, 77 aa, Homo sapiens
VYGRVREPDTPLRSTLRQSETLSQKKKNFLAGFGGPHLGPWLLGLFKHKITLTPGGSFERGNGPLMSSWVARSRFFL

SEQ ID NO: 983194 - protein, 71 aa, Homo sapiens
GSRSRPAGQEASICRSVCWAREQGRGFFSTRKPESEGGETRIWGSEHELCLRAHLSSSDRVTRAELPPSLT

SEQ ID NO: 983195 - protein, 42 aa, Homo sapiens
AAWLQGYLGPRLYTCSKATFFVLFRLKKCESKRSTKLPDSDW

SEQ ID NO: 983196 - protein, 66 aa, Homo sapiens
KWWPSDACYHHTYLMSSYNGRLYIDSRSGPPLNTLAVEDTEEAMTSDASRISSGDDLSPQTLDSAR

SEQ ID NO: 983197 - protein, 44 aa, Homo sapiens
YVVVEGMPAPASKVEEWVSLLKSEETTKVLSVAQRCPIRGALRT

SEQ ID NO: 983198 - protein, 49 aa, Homo sapiens
LSLTITVVEGYASPKVNRLRSGCRCLKSRGDHLVLSVAQDALQGALRTP

SEQ ID NO: 983199 - protein, 97 aa, Homo sapiens
SPTHGELLCDPVIIPVRVFMLHHWTCDLARIAFFSSRDLRHLGTELGFERMTIAYPGDVNMQIFIFDLCGVDQMTVQCTQTEAARPARHSRSGPGME

SEQ ID NO: 983200 - protein, 58 aa, Homo sapiens
LHLKRVIRSVSTVLTCRRNLYRRGMHRMVNTRRPGSIFADIEDVRTVLTYQRNYVQEG

SEQ ID NO: 983201 - protein, 40 aa, Homo sapiens
PANSGRAAGIMIWVSRSFFLSDIHCHAVVVKTSKMQLAPE

SEQ ID NO: 983202 - protein, 92 aa, Homo sapiens
RILTIGTFSGAIKLYGARSVYFMGMHHENKLCDQIHLLPGQCQLITLLHDNSLHLRSLKGKDATSELQEDESFTLRGPPGAAPSATQITSAL

SEQ ID NO: 983203 - protein, 65 aa, Homo sapiens
NFEGELQSVQVFGRKKTATAVAHCKRDNGLIKVNGRPQLRDSRREAERLVRQAGGGGGTGSSPLS

SEQ ID NO: 983204 - protein, 67 aa, Homo sapiens
SATDSAADQEYPNLVHETDLEYPNPTTRLTRNTPTQPRDLSGIPKPIHETDQEYPNRITRLMWNTQI

SEQ ID NO: 983205 - protein, 41 aa, Homo sapiens
FHQEIYSTYQKSSNFMRSSGTVYPKRPEKPGPPTTPQLAPE

SEQ ID NO: 983206 - protein, 42 aa, Homo sapiens
RSFYAARSDYAGRSDYTVRSDYGRSDYGGSIYYAARADYAGR

SEQ ID NO: 983207 - protein, 119 aa, Homo sapiens
CSRGARPLQEVGARRGAARAAGTVHAAASRLAACCNVWWRLQHPVRVCSWGNLGPAEERVWLVGPAAGGCWHLASHLQLRVQPQVSGARDITASVYPTGLGKKRTVPEREGDPSSSPLS

SEQ ID NO: 983208 - protein, 38 aa, Homo sapiens
NYYEDMLRQKSLAERREKVDYDHHVQHEQDTQQQSAHV

SEQ ID NO: 983209 - protein, 33 aa, Homo sapiens
IPLLLLPRINQICAGDLLSSQKAVIKWISSLDK

SEQ ID NO: 983210 - protein, 113 aa, Homo sapiens
ELDSLSVSGVGMARSFETAVTAVLAALAVQAEEMAAVAADVACDEASVVFLVSKDARIRRQMSSNTFDRDILNKLLPPSTIHGFGGPFLYFKFAHTSCEIHHCYCYDLWFPLQ

SEQ ID NO: 983211 - protein, 37 aa, Homo sapiens
EHLLWTLDLHKVDWLHECVAGLVSTLARGSAVPLGRS

SEQ ID NO: 983212 - protein, 126 aa, Homo sapiens
SRVIPETLHPARPDGDGAAQASGAQTTRYVYDDATGLQLRFAVSAEGRVTEYRRNAYGEVISTLQHQVARYGAAAASTEAALSAWNGQQNLQQLQRTDYVLDFRGQAQVTTTYSATDAAGKRAGGG

SEQ ID NO: 983213 - protein, 45 aa, Homo sapiens
RVIPRELARSMRASDGAQYGTEDASVNASMAEHQRQADQRYFVIE

SEQ ID NO: 983214 - protein, 33 aa, Homo sapiens
SQPDHATPSTKTELCSTFHTIGIYAPYGAPTDT

SEQ ID NO: 983215 - protein, 135 aa, Homo sapiens
REIVCVLDLDRFLVTGDSLYGIFVESLKSWDGDRLRLTCEVRDLDLRRLIKRVLDLDRRGVAGEARDLERFHGAGDVRERENASDWLGVSESGLFGVERRSGNFPGGQVTLSDNQRLPSGGEYTRELDLVRCLRR

SEQ ID NO: 983216 - protein, 38 aa, Homo sapiens
CELGGEAANSHTCGLPLRDQPSSSPLLQTAPEVKGHQR

SEQ ID NO: 983217 - protein, 59 aa, Homo sapiens
MYTNLLREIEYMGKEIRPTYADSKSAMELLKRGIIHAQALGRECLAETERNARTYRKRL

SEQ ID NO: 983218 - protein, 58 aa, Homo sapiens
MGMVSDESLADHQYVPPGSLCAARACTEVLVVAWTGTGPGTRRVHEEQTERSRQRSSY

SEQ ID NO: 983219 - protein, 69 aa, Homo sapiens
RVTLEAPVELLLKKWPPEHCRSTHRAGRCTFNLGLDTADTHTSRAWTRTLGSWWMGLGLLSAHHPLSPQ

SEQ ID NO: 983220 - protein, 43 aa, Homo sapiens
LDSVIPESLKKEVFSRPETSVLGCTVTSHGGNGTYHGQQLAPE

SEQ ID NO: 983221 - protein, 56 aa, Homo sapiens
LKITNHSPLTLYNSHNFQNLFFSSHLKHILSARLLQPYSLFIEIPTITIIPGTDFN

SEQ ID NO: 983222 - protein, 35 aa, Homo sapiens
QFIYQECRGPPQVLGRITLKFRVALVSTVRSSPLS

SEQ ID NO: 983223 - protein, 107 aa, Homo sapiens
ARIPYLLCPCTARSQAICLPTTPFSSCPPRSSPTVLFLLLSQPLGFCTGCSLCLNTLHWAENNSLRPLSAVASFGTAAAAVPLPAPRPAEPPVFFSSHAPSTSSWPL

SEQ ID NO: 983224 - protein, 51 aa, Homo sapiens
STVTSTCLCQYSHVGLESPSGPEMLFLKLQLVLHREGMESSVDFPLACIIS

SEQ ID NO: 983225 - protein, 85 aa, Homo sapiens
ILFRALSSVQFTFYQRKPLGCSHWRGPPSQATTLPSLVHYNSSCSQEGVHLTLIADLINAAISVMQLKHICDPLTAPTPKVFLVP

SEQ ID NO: 983226 - protein, 114 aa, Homo sapiens
PVPLRFFRQSYPTSSWTSSLTRWAQHFIIHHLLEGVPRGAPLATLLILGVGVTAGRDLSRNLAPLTEPRLRSAHGLLLDTDRIQKSMLSILKPRRSQEQRTALRRYCGPTDLQA

SEQ ID NO: 983227 - protein, 31 aa, Homo sapiens
MVSILHAVNLKNTEVMIYILGMAQPLTKSTG

SEQ ID NO: 983228 - protein, 67 aa, Homo sapiens
MSKESPRSAHSDTYQAFHVRRISLSSSCLESPTSPRLEMDPNCSCATGGSCTCTGFWKCKQRKCTFC

SEQ ID NO: 983229 - protein, 40 aa, Homo sapiens
CSVNSDGLTPCLTLATVQTTLNQAYTGHATRVCHRHHWLG

SEQ ID NO: 983230 - protein, 67 aa, Homo sapiens
DTCPGLYPCRGFLDDFPIVIKHQSSPNLRRFLIGRNVDIIKPSKSSSPTRDPQREAVNEIHSIVLKL

SEQ ID NO: 983231 - protein, 35 aa, Homo sapiens
FLKSGDAAIVDMPGKPMCVESFSDYPRGGRGAVRD

SEQ ID NO: 983232 - protein, 57 aa, Homo sapiens
HNSEIQMLQSLKLFECQHDTQRKCLLGASQTQVFEFEMLNRVSNSAIYYRNLRTQSQ

SEQ ID NO: 983233 - protein, 45 aa, Homo sapiens
DIPSSSRSAVLKWISSLHSSIKVDHPAMHSSIKVYSSGLTSSIEV

SEQ ID NO: 983234 - protein, 39 aa, Homo sapiens
RLYRSLIHFILLCRLDIHFNTPRYATRYVQATSSRPDEQ

SEQ ID NO: 983235 - protein, 65 aa, Homo sapiens
TATCVVIDNFHNAFRGGGSLPESLRGVQELTGRSVEFAEMDILDQGALHASSNKYTLYWRSSLCG

SEQ ID NO: 983236 - protein, 46 aa, Homo sapiens
MEFDNGVSNPALLWPHDLTRHNRRICIPSVLRAEYASDSPSAIRYS

SEQ ID NO: 983237 - protein, 66 aa, Homo sapiens
MWCFAEASGPHRRDSRGKTQAQEREVIQKGVCHIPVLLPRREPSAQAPAAWPKLLYVHMLGYPHPP

SEQ ID NO: 983238 - protein, 46 aa, Homo sapiens
QRRAAYEDLEIVLLRTPHVSGDGCCFSTSPKPASVPCCVYPDSETV

SEQ ID NO: 983239 - protein, 83 aa, Homo sapiens
MCETGPCPSSTWLFLISCQDYLDPRTFDSPTSLCLPSGIGQYDYDEYAVRGYPVADLLVIADKYDPFTTTNTDCLCKEPRRLP

SEQ ID NO: 983240 - protein, 90 aa, Homo sapiens
SGRLLGGRTTAGVHEMWGSEMCGSGDVQSRRKDELIGRCPGPGIHRVRRQRGSGECVGSLQTIAPPGNISGPAHLPSTHSSDLHIFGAAH

SEQ ID NO: 983241 - protein, 91 aa, Homo sapiens
CVFTETVGGSGDCGVQRCGGRRCAGLGDVQSKRTDELIGDAQVRGSNGVRRRAGPEMRWVPCRLRSARDILRNLHISHPHIFRLAHLWTRT

SEQ ID NO: 983242 - protein, 63 aa, Homo sapiens
IVRTELLDHLSYIKTQSTYKSPSPCLQAQYSTSNLTYHTSICKLQTPPHHPHRIPTNNLCTGA

SEQ ID NO: 983243 - protein, 64 aa, Homo sapiens
MKTDGTNGHTDRRTDAPSGSWTAKTTFEECLERMRTEPLLRNQNHMSADDSDMMASLLDYLMTG

SEQ ID NO: 983244 - protein, 87 aa, Homo sapiens
VKPQHFQCQHANGLLIGQQMPSRTFIADEEKSMSQCPKDRLTLVLRAHAASKFKLNPLLISILGPLRIMLNIPLSDAFLMEQQSLAG

SEQ ID NO: 983245 - protein, 35 aa, Homo sapiens
MTSTYQLRLWKSCTKKATEIGPSGCLEFNPFRRAP

SEQ ID NO: 983246 - protein, 40 aa, Homo sapiens
MFTCPSSGMKDPELWLQMYAGADWHGIAYVGLGLWNALFN

SEQ ID NO: 983247 - protein, 35 aa, Homo sapiens
MVVRRQVTVFLVLKESFTDGRGSVLCGRWLTVWRA

SEQ ID NO: 983248 - protein, 79 aa, Homo sapiens
RRCGGSGDAGSEMWDRNVRSVDVQRKKDELIECQVRDPRVRRARVGDAWVLADFAPPCTSPDLHISHPHIFRAHLWTRT

SEQ ID NO: 983249 - protein, 48 aa, Homo sapiens
RRELLSTVSPTDISTIHHPCITRDNSAGISVKSATLQTKHDTGKCSER

SEQ ID NO: 983250 - protein, 103 aa, Homo sapiens
RSSLRFPPVTLPLSLLTVLRLYRPSATEPGPDAFFSKVLSVILIFVILLLLELTDLLYGEPHALSVCVEHQFFHTNARIDGIKRKMYPQGDLSQCCYHFSSLT

SEQ ID NO: 983251 - protein, 86 aa, Homo sapiens
ALEDTTYALTHPVVSVISRCLEKYLSSTPQRLKVLVANLQYILLTGALQFGYCLLVETFPFNSFLSGFISCEGRFILAGNTGSGKV

SEQ ID NO: 983252 - protein, 62 aa, Homo sapiens
WSNQSGLDLNWKTEHHFGILLIISPFLPSDNANSKSLGMGTVVSASFPAILDPILDSDTSLE

SEQ ID NO: 983253 - protein, 56 aa, Homo sapiens
MISGTYSQCESNFCKYTQHSYKFPPDDLPSNIFIFIFHVCQQCWDHSHREYLLTSG

SEQ ID NO: 983254 - protein, 62 aa, Homo sapiens
YGICGTRDTFNSIMKCDVDIRKELYANTVLSGGTTMYLQGIADRMQKEITGLSAHAPEKIKI

SEQ ID NO: 983255 - protein, 46 aa, Homo sapiens
VRCLAAPQYTYLSDCNLVTPVEVFISDSLRVDDTFGIYQSCDTPQG

SEQ ID NO: 983256 - protein, 81 aa, Homo sapiens
RAVSALHKEAAIECTRTTKKSAVNITKTLYANVSNKNRNKTEAMGLNNYCFNAKTQMYIHKKQQQTRNEDLPKQTKQRTSQ

SEQ ID NO: 983257 - protein, 56 aa, Homo sapiens
IPQESCPHNDILASREDISYEWLLSIRCNAARTIAAFFRFSELAESDSVNYYGPRP

SEQ ID NO: 983258 - protein, 88 aa, Homo sapiens
NQKGEVSGHAAPLGLWKCAEMRASHKAEVTYSHHQSLFGRTVALYRTERITHAPDYLVTSCWMGRNDWDSQPHRTTLFLYISEDVYLV

SEQ ID NO: 983259 - protein, 69 aa, Homo sapiens
SVIISGYRTTVRDSVSRYLGITARNKADKFSVCVGYSYLENAECVENPRFLTDAREMSHYCIWEVQIEF

SEQ ID NO: 983260 - protein, 38 aa, Homo sapiens
MVAAIPAMPQNLTLLVKYSFTLAIANAALMLSAGPPGD

SEQ ID NO: 983261 - protein, 37 aa, Homo sapiens
AAPPLEQPGGPPAPVEVTILDAATYVRNTQSRHKSHY

SEQ ID NO: 983262 - protein, 55 aa, Homo sapiens
TLQPGMVAHAYNSHVTWRALRQENSFEPGTAEVTVTPRSRRCTYRLGNKNEPPLR

SEQ ID NO: 983263 - protein, 43 aa, Homo sapiens
MDLAGLHIPRSGSLFCRSINTSKYPIHRKYPIHRKYPIHRKYP

SEQ ID NO: 983264 - protein, 92 aa, Homo sapiens
MHRDAAHEGSGLLLANTTGMGPLTQQAHFKEPIPESLGQTHMQGSLMPYGWIHERSEMTRMSNNRAQSNKLGGSHVRERRAIKRFRSRAQPR

SEQ ID NO: 983265 - protein, 106 aa, Homo sapiens
RRSRHEILPLRVPLPSWSASVCTDLQQLHFLIVFSSAADAFFFSSSFRFPLQTELFVASQVCTVIFSLLSYFHNPPGDLHYRRLLPHSGARSRNFAHVSCSRLLTR

SEQ ID NO: 983266 - protein, 79 aa, Homo sapiens
VSRNLLGRRRDHQIGSNSKVHCSRESGMHIAGPSPSGRKELILSCSPPVLVNNIHIKSKLKEKADQRRKSAIMVTHLAW

SEQ ID NO: 983267 - protein, 145 aa, Homo sapiens
DNLPSLTTGGLEEDGGEEILQDLRKFHSASSCGKGLLGRQGVLLRRRRGLQLGLCSCCGSCQCYGCGVRLLSLLGARAFALSCAGSDSGFRVRVLRREREPDRDRRSTLRRTAFAGCHFGLLLCDGNVCFESESLNDSGFWSRTG

SEQ ID NO: 983268 - protein, 37 aa, Homo sapiens
CYFATLNRVRVLCIGQLQPGTTNCTPGSWVEITSVGA

SEQ ID NO: 983269 - protein, 147 aa, Homo sapiens
CGDALASYKRKESKMHQVLVSLGRGAEWLMPTELVDREGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDE

SEQ ID NO: 983270 - protein, 76 aa, Homo sapiens
GAGYVHRTQSLPLDLACLVSVSPENCILRYHTVPNYTKQKKESLVPELDSTRSRLPREQEGVQDYLYDTVRHACYT

SEQ ID NO: 983271 - protein, 43 aa, Homo sapiens
TAILYTIFFIFFFICSIVQDSDELLCGIAQQPPNTINNPPVPL

SEQ ID NO: 983272 - protein, 37 aa, Homo sapiens
MRTRLPWQYWSRMVLQVHLGPHGPVDPAGKHGYREWS

SEQ ID NO: 983273 - protein, 33 aa, Homo sapiens
RARYVLGYIHLAYTVYTLLLLGYKIPVQHVTVL

SEQ ID NO: 983274 - protein, 64 aa, Homo sapiens
HVPRERSQRAPAPGGDAQFDDPKVDLKGPQVDITGPNAGTYKVSKDGSHSPLMWKVSGGSSSTR

SEQ ID NO: 983275 - protein, 127 aa, Homo sapiens
SVHRNSHYFWAVSAHLWPATLQSCSTCCVAYADPVAHGLHVALNPPPAPPPAGRSRASRRSLLVPRSAYLPDRLLDSSSASSSFSRSACMRALSAVARSSCSCMRSASKLLAFFSFSLAVAKISSLE

SEQ ID NO: 983276 - protein, 36 aa, Homo sapiens
AHQLFLYCSPGLMLGPLIPAAHRQPALILTLLPIVN

SEQ ID NO: 983277 - protein, 62 aa, Homo sapiens
MLPGCGPGSCVRILSANNHAYGRPGVVLSSGIAVSGDHSDHDSRRTDAHVVSTDDLMPRLRY

SEQ ID NO: 983278 - protein, 76 aa, Homo sapiens
GWDRAGSITKLKDTSSKVIQSVRVSECEAPDALELPAARSRLQPCDLDSWLAVEPCWSSRPHMGPLTACAGSSTDV

SEQ ID NO: 983279 - protein, 54 aa, Homo sapiens
MCVVQVTAFYERVNPYAWITAKRFLGYVSRTTTCEDYHVYEEKVNWLILLGWRL

SEQ ID NO: 983280 - protein, 63 aa, Homo sapiens
GPPCAPPGRGGTDGLRGTYVVTKVQLAELETWVQLVPLASLVRRVPLEEAGTSCNSCSTPGPT

SEQ ID NO: 983281 - protein, 42 aa, Homo sapiens
MYKLRTTTGLDFTQTVASCEVFQERLVLTARPHYWGCRRTCN

SEQ ID NO: 983282 - protein, 94 aa, Homo sapiens
MGYKCERGMAPGGVDPPIGDVEELTAFRTVVMPIDHDVSPDVVLVTAGLDAVEGHLSPLGGYSVTEQMSRPLDQAADDPGRDAELVLTLHGGDP

SEQ ID NO: 983283 - protein, 79 aa, Homo sapiens
MWREHYRKLLEGEESRIISSIQTYSALNFRETSPEPNGVLTGPYQARRLIIKTIEHTGLEAGRQLRPHTQQHEHALTDR

SEQ ID NO: 983284 - protein, 94 aa, Homo sapiens
SKSRKTQRLIDWSPVYCEDLHDLRVDHATDTSPENKVVGKGLPFRSDYNRDGDSSEVTTGVTTYDPSLERTGAIAVSIGLRNAGRPARRDSSTS

SEQ ID NO: 983285 - protein, 38 aa, Homo sapiens
SGLSRVFSSAASAWQLPPPPGCSSRSSIVWAIFFLSDL

SEQ ID NO: 983286 - protein, 81 aa, Homo sapiens
VFIAGQTEAQRGRHTGLRSHRKSVGLGDRGYGQTGSPVIQPGQSGGFHGLGPEDDVPPHRSGTSLRHGILVTADDWAGTTA

SEQ ID NO: 983287 - protein, 56 aa, Homo sapiens
GSDGSPPPQGAGMSTRPDDLPADSAPGSAGNSWSSRSSRILFNIVFSGGPRGAIPV

SEQ ID NO: 983288 - protein, 114 aa, Homo sapiens
MGLDLAGRDLTDYLMKILTDRGYSFVITAQIEIVRDIKGEAMCYVALDFENEDGHKQLPLTSLGGRAMRLPDGLGYYPIGNETLPLCLSTLLPDLPLFGMDVRCEFYETNLQFP

SEQ ID NO: 983289 - protein, 99 aa, Homo sapiens
MTHPGGEHQIFKGRSWYFPDQTANSLTARHPVLFMYYYYIFREGLTLSPGWSAEVRSQLIADSTFQAQVILPPQPPKYARTTGACHHAQLIFSFIFSKD

SEQ ID NO: 983290 - protein, 36 aa, Homo sapiens
EPVLTLEALPVYRCEGSCPHHYLHGLDLYSHQSLAW

SEQ ID NO: 983291 - protein, 49 aa, Homo sapiens
RTAAVYEVLQARGPGAAESAGELQASIAPASVGELQGLSGTAWNEELRP

SEQ ID NO: 983292 - protein, 114 aa, Homo sapiens
NPGPTVFCCLLSQGITYISLPRVISPLTSHVPDVKMKEEYNTYSSLSLYSCHTLGTRLFWDRSLLSDWPSLTPEVNRTRTGYYKLQTIVSSPTFAMFLFASNTLPLFHFFLIRL

SEQ ID NO: 983293 - protein, 89 aa, Homo sapiens
GAQETLEQAEKGPLTAEADVASLSRRIQLVEEEQDRAQERLATALQKLAEADTAAAESERGLTVIENPGHDGGGERWNCRRMQLEVAPR

SEQ ID NO: 983294 - protein, 45 aa, Homo sapiens
WHILLRSSQASEERGWPVSPPLMTGSWLAAKKQELEEILHEMGAA

SEQ ID NO: 983295 - protein, 90 aa, Homo sapiens
CGSLAHHAPQQGLECEAALMGTVAREISTLNLRMGNASLAESGSRSGIDQVVSASNTSLLPPFLQPPLFPSVRQGKGQYAQPYLGILSKA

SEQ ID NO: 983296 - protein, 42 aa, Homo sapiens
SPSCVPGALKKLAQLSDFILATTDDRIGVAVDRGPASTVQTR

SEQ ID NO: 983297 - protein, 44 aa, Homo sapiens
SVVLCTFAALGRAAAPLSARTCSSGFTLVNSRHHVPVSQLEGAA

SEQ ID NO: 983298 - protein, 73 aa, Homo sapiens
IGSCEQSEGRSKDEGRDRGREERILSKRMGQTEGDRKTCSGHKGNSQVVECHSDRGAYIAGTHIPISATVGLR

SEQ ID NO: 983299 - protein, 55 aa, Homo sapiens
SISYRIPAFLDLGGRDLTDLPHEDPHRERLFLCDHCLKEEIVRDIEEKLCGRWYQ

SEQ ID NO: 983300 - protein, 44 aa, Homo sapiens
DTPIIDLDMLYHVICGLQLLDFLFVEFLQQTGNLFLQRFHFDVQ

SEQ ID NO: 983301 - protein, 64 aa, Homo sapiens
AADAAGRSTGSPSSTITVCVPVSLGLPGLGYFPEPVTVSWHSGARDSCWRSHPSLSVPIWSFMT

SEQ ID NO: 983302 - protein, 62 aa, Homo sapiens
LAGSPVILYSNGQAVSASSPRPDPEFGLLSIFCSLQAMLPAQYLVSSPFPYGLHGDLNGAPR

SEQ ID NO: 983303 - protein, 41 aa, Homo sapiens
MKLQLHNFPYQISCVSRNSHASKAFPYSSSPPVPLQLVYCS

SEQ ID NO: 983304 - protein, 45 aa, Homo sapiens
CGPTKTQPHFSHRCRSQLDVRTWSTGVQGVRVAIPTCACGSPCGD

SEQ ID NO: 983305 - protein, 123 aa, Homo sapiens
FSHCRLCRDKKSSNIGVPGYTLTHCGKVESGTAIVDKAKQGLLSSELTSIPDQEVELTNCEIRRHQVSLLVQVSYPRFGRLFYYHRHPVRVFLSALLALRAALLERLLFFVHALPPPGNRAGP

SEQ ID NO: 983306 - protein, 95 aa, Homo sapiens
FPVCVDGVVPQDPLVLLGPPGSPCVLRWERTGFVVLVVTQGPRWPTLETSVPLVPLASLVTKGPSGDGWYCWTLLALHGPQGLLGAPGILGLPGS

SEQ ID NO: 983307 - protein, 30 aa, Homo sapiens
MWAGPLRQPGSEGMYYTHCLACTTGYGTRT

SEQ ID NO: 983308 - protein, 85 aa, Homo sapiens
ALHRAQERLDTALQTLAEARQAADATRERTLQVTRQNRAMTAEEQMELQEMQLEGAARLLLLTRLTMPSPYLAWSPSPIAGCGAA

SEQ ID NO: 983309 - protein, 44 aa, Homo sapiens
YPGSDTVQARARRHFKQSFLTFILSSHASTGKQSKKPTLDGGRA

SEQ ID NO: 983310 - protein, 88 aa, Homo sapiens
NAVWCLFTRTRVNFDAVARIGGPPLGDQSPVSCSSLHEKDPPTTLGPQTNQPKKHLTNFKSSKPLLFTLFSNLPHYPSISFSFQPWRP

SEQ ID NO: 983311 - protein, 39 aa, Homo sapiens
SSHQTSLTLDISCRALKMTDVGWAWWLTPVIPALWEAKA

SEQ ID NO: 983312 - protein, 41 aa, Homo sapiens
DIDQMYQVEFDDGFQIAMKREDIYTLNEELPKRVKARLTTD

SEQ ID NO: 983313 - protein, 139 aa, Homo sapiens
MNQPTRSQRGRRCFYSVHNSCPRHLCGLQLVHEVKRVDGNRQIIGYVLGTQQATPGPAYSGREIIYPNASLLIQNIIQNDTGFYTLHVITSDLVNEEATGQFRVYPELPKPSISSNNSKPVEDKDAVAFTCEPETQDAT

SEQ ID NO: 983314 - protein, 34 aa, Homo sapiens
MLIPSAVVGDERGFSQNVVPAGCSIVEASYYEST

SEQ ID NO: 983315 - protein, 96 aa, Homo sapiens
KSTTTGVSVAWLECSGTISAHRNLRLLCSSDSSASASRVEEQFLQPPETWLTAHLVVRAFPFLSLCPSHSLFSITSFRLFQNGNSIEMDSVYRLRV

SEQ ID NO: 983316 - protein, 112 aa, Homo sapiens
MTVLSSDSGYRNGQPEDSDVRCGIESSRAAPVRYSLEVPAPMSVTSQMLLRMCSAAVRTRPVTCLMFLPLQGRAAELEGDLEGRFLLWECILKRGQLHTQHTHTPPYAHVYR

SEQ ID NO: 983317 - protein, 78 aa, Homo sapiens
SVDQYTGADVITGWLIIADACFLTGPVFIHRSESLRARKVAGWAEITTFSQDRAFTLPVSPAGHAVLAILAAHSLRHA

SEQ ID NO: 983318 - protein, 44 aa, Homo sapiens
MLIRNGYKNVQRHSANLTPPVYQNTSPLDITRYETAPHCPRDTL

SEQ ID NO: 983319 - protein, 72 aa, Homo sapiens
MHTMARVVLSECAHVPTQRRLQVRAQRDTELWCRQEHNLQLPSGSSEATIDYALRDTSTRAYEGCAFLSWSH

SEQ ID NO: 983320 - protein, 150 aa, Homo sapiens
MTPGGRATMDVNSSSSNHKDMQQLMRVNPDVILCQEQSYGAPGRIQGSSCDVAAGHQHQPAYLPYGGGLKAPLRDGIVQGRNDSTQARAQTHSCSYSPLLRGGKHVPLGDSNGCNAQHTDANHVDVVSYVSHATQQRLQNLVEKISETAQ

SEQ ID NO: 983321 - protein, 86 aa, Homo sapiens
PRIASNQANNITYIDPVHPNKARLLTASHNLHATEPGNQESRYIRLKYSRLIFEAHQLILRTSCTTMEKGFPSLLLTKYPRRYDFS

SEQ ID NO: 983322 - protein, 71 aa, Homo sapiens
MNCGPKIYSVTVRGEAEEQLTLPKLSLSPLLSPYEPLRSIGMPRLDGSIATLVFLQCYQASAKAPGTVVSG

SEQ ID NO: 983323 - protein, 32 aa, Homo sapiens
MRQKHAQAVEELTEQLEQFQRVNAFMVIAFLV

SEQ ID NO: 983324 - protein, 77 aa, Homo sapiens
RKKLTFLRSQSEVAAEQLSPLQALDFPWTKHSWILTSTNRFFRSLLEIGERITFSNLPYSEPCLHWHIPEKCKAVWD

SEQ ID NO: 983325 - protein, 87 aa, Homo sapiens
SVFIFHMPQEVGSAQRQGAVKSIWGMCYIHYHTSYAQGVQFLNYNTGAIHFICWVSHYPPIMSSSGTSQQQTAAFRPSTLGSAVGRA

SEQ ID NO: 983326 - protein, 43 aa, Homo sapiens
MRAGVGEREDDVDTLLSSLRGNRHIGGTDLLTGTLRPLTTASD

SEQ ID NO: 983327 - protein, 67 aa, Homo sapiens
MSPFQIIAAPSPSTLTYCTHMYINQLCLPTYDSSEEVHRMLQAGPQRRVATGSGLLCPSSCPSPGTP

SEQ ID NO: 983328 - protein, 32 aa, Homo sapiens
MTALPPLLTLTFCLLVTRLQRLVLTYFRMWTV

SEQ ID NO: 983329 - protein, 41 aa, Homo sapiens
VGDPPISAPSSGDYRHATLCLAHFVFLVDTGFGHVAQAGLE

SEQ ID NO: 983330 - protein, 33 aa, Homo sapiens
GTLIIQWNRTGKHPYGETQVNLPMNHTIRSRIP

SEQ ID NO: 983331 - protein, 32 aa, Homo sapiens
MTSSICLRQTDLDSFIDTSLQSATWRRTPGVI

SEQ ID NO: 983332 - protein, 112 aa, Homo sapiens
ESALLFSSSHPSCPFTSLLLGDQEGRSNLVRMAKGDPKKPEGKVSAYSFFVQTCREEHKRNPEVSVNFAEFSKKCSERWKTVSGKENPKCGEMTKADKVCYAWKVQDCEPVK

SEQ ID NO: 983333 - protein, 48 aa, Homo sapiens
MRNEERRKRRREKNKVAVALMPGTRKKERTEICSGNPERVELMNAELE

SEQ ID NO: 983334 - protein, 88 aa, Homo sapiens
SSSAGLVLAVLTPSRLRYMLISPSSRARTVCSTWYSWFLRSTVSPDLSTLGLNIGDHALHLVQLGAVAGAHSPDSVFSRAVPLKERKT

SEQ ID NO: 983335 - protein, 49 aa, Homo sapiens
DCEAGGFAFARACECRVWLTRYRDTVEYRNRFHLTQCSRGYGTLVLGPI

SEQ ID NO: 983336 - protein, 77 aa, Homo sapiens
CLQLTTRGGADCCSLRVMQLRTSGGADVVRVEGLSEWSLRDALSILTEVHGELVTRTGADVLASGSSSCRPREELMY

SEQ ID NO: 983337 - protein, 142 aa, Homo sapiens
YCLLGDWGTHALPPPRGSRVRERGEWRIRWLGDGEEQQLGYLGWGSRGRTTDEWKGCGGRLQILGAQVLGKEDVGGGTLPPTSDTDPQPITGWVQVAMETTHTGGNVISRERSEFLGPPGENQKTAIVTLLRDIQPVPLAQV

SEQ ID NO: 983338 - protein, 77 aa, Homo sapiens
YTSVGLVDADSTTPMSVALREQDCSKISENNQKHNSCFYEDGRDMLNVNRNCTCQRGKIQFRELEKSRPTLLADARD

SEQ ID NO: 983339 - protein, 62 aa, Homo sapiens
LVSTSNNVESNRRNRMENPDGSPIHVRQAIGCDTTKVHPRILTTHSSGKITLYLELAHFLEF

SEQ ID NO: 983340 - protein, 39 aa, Homo sapiens
MREELPGMDPTISAPYATARCWPRWASQPLLLRPTPILG

SEQ ID NO: 983341 - protein, 102 aa, Homo sapiens
MNRPATVEISIENMRLSDNSQPYHCYSQHVHSEALKKYGVTPLVRVCDATLLYSSSLKNDTELTVLDLSHLTDWSIITNKSDYVTTWYNTCIKPNFRDDEGP

SEQ ID NO: 983342 - protein, 161 aa, Homo sapiens
GTLEDLNGNRCGVGNIPCLNAEQLREVSGALPLFSPTIHVDVDSVSLCSLPPSSVDVGSVSLCSLPPSNVDVDSVSLCSLPPSNVDVDSVSLCSLPASNVDVDSVSLCSLPPSNVDVDSVTLFSPPSNVDVDSVSFCSRPPSNVDVDSISLCSLPPHNGTW

SEQ ID NO: 983343 - protein, 40 aa, Homo sapiens
MGVKVLCHLSLAALESGRYFLKASLVELGRGQCSSVASQC

SEQ ID NO: 983344 - protein, 64 aa, Homo sapiens
LTQPVVVYLSTEEITDTTEPVYCQRSHTKITLLQAPKIKAKASYSTNNIYLSSGKNSALLWVAE

SEQ ID NO: 983345 - protein, 56 aa, Homo sapiens
SILQVHFCNHQHKTTSHSTSGFTSSNATTETTSHSTPGLQFFDLPPPGTTLTHVLS

SEQ ID NO: 983346 - protein, 108 aa, Homo sapiens
VIRVALHTVESLPDSSIMAWPVSWLELALESTGDSHLVGQVIIDLPVEPGEDVGAHVVGGGEVGEWGHLEGIHVHCGLPLCGRDDGAKTWKGRIPREGIGPGKDILSG

SEQ ID NO: 983347 - protein, 35 aa, Homo sapiens
HQARNRLSQASRGGLTAWVVGSSSTTGCCEGLVIE

SEQ ID NO: 983348 - protein, 37 aa, Homo sapiens
MSGRSDMECNQCDGAGVSADGVGHQCQRSGSLVPLEL

SEQ ID NO: 983349 - protein, 44 aa, Homo sapiens
LSSLVGPADSADAWLVSMVRCGPPCSTMLWHMEFQRGRFGGGRH

SEQ ID NO: 983350 - protein, 64 aa, Homo sapiens
TTSVLRWESSKSGKRAARAALNPCAPAGRVCADEGVGDGSCVLRRISTRMCPGYHESQLPGVLR

SEQ ID NO: 983351 - protein, 38 aa, Homo sapiens
PRLGEESTTSRSQTGSTHSTVSLPDTSRLSEESTTVYS

SEQ ID NO: 983352 - protein, 66 aa, Homo sapiens
FLFTWNKLRRSLETNGEINLSKDYSSTDLDLDTEFEILLPRQRGLGPLCYRSRQLLDSPTQRHVDR

SEQ ID NO: 983353 - protein, 95 aa, Homo sapiens
EDPAGMDYTRRSEFWADGLSSGCCGLGVVAGLHTAAVGKVKCCGSCHTGSRVQPVSTAECQALGDPHYVTLDGHRFDFQGTCEYLLSAPCHLGQR

SEQ ID NO: 983354 - protein, 87 aa, Homo sapiens
VEDDQICLRLQHPACTLLYRLCYTCTASGRTTGIVMDSGDGVTITVPIYEGYALPHDIMRLDLAGRDLTDYLMKILTERGYSFVSTA

SEQ ID NO: 983355 - protein, 40 aa, Homo sapiens
PLANGLISYPFLTELNVVVGGMRHLCVEKSTLRATDVCLG

SEQ ID NO: 983356 - protein, 40 aa, Homo sapiens
EDRPVANGLRLMDCFLTLCSRQEGDSSDSWWWTVLAQRCD

SEQ ID NO: 983357 - protein, 45 aa, Homo sapiens
NVALCPFRVEPEISLMGTSDLNALPGLKHCDREGAGCCLQGLSDY

SEQ ID NO: 983358 - protein, 69 aa, Homo sapiens
WSICSRMDCAICGAEISLMGTMIEGCQYVTRRCGCVYKALSDTTSYWKATWLKAKMCHPGHACTQKFSH

SEQ ID NO: 983359 - protein, 83 aa, Homo sapiens
GGQASLMRKLLSAACAGATLLGFSKGFQVDVVVTQSLVDMSSTFSVTYWQLLQVMVRIRQDLRLHDGHNDILLVDTVIVAERG

SEQ ID NO: 983360 - protein, 34 aa, Homo sapiens
AGQWQYTASSLARIYYLPQRPGSTETTLLPDNTQ

SEQ ID NO: 983361 - protein, 52 aa, Homo sapiens
MTLWYREDHDTVMHHCDQKTVDGPPETVAVMARCLQNIILSLLALQSCGQGH

SEQ ID NO: 983362 - protein, 47 aa, Homo sapiens
MTFCRRKDYGEEVTCKVQQLQSHQKQKVDSRTKSKDYCKVIFPYETR

SEQ ID NO: 983363 - protein, 72 aa, Homo sapiens
MDYEDEVQNTRERQQKGENELKELEQKHSQLTEEKNLLHVIMLLCETELYAERLSEIAVAAGCAKKQELEEI

SEQ ID NO: 983364 - protein, 153 aa, Homo sapiens
SVCVAQYWGGDCTRVVESAGPMIYKRPTGDIGVLGGHPEAVLYRVAGAESRDTTWDTTMTSNAVAIHPDMVTIATGQVCGNHYGMGMPMPPHVRIWDSVSLSTLHVLGMGVFDRAVCCVGFSKSNGGNLLCAVDESNDHMLSVWDWAKETKVV

SEQ ID NO: 983365 - protein, 52 aa, Homo sapiens
RDRKSVITVRTEPEQTENRHMLAGRLVKVTASGIRICWSGAFYFLVRSDAGC

SEQ ID NO: 983366 - protein, 66 aa, Homo sapiens
MTASIPERASAVGRNVRCTPINISSEMDYRRRYDLGCSLIIGDISEEASYDGKYSSYVIGHKESEL

SEQ ID NO: 983367 - protein, 57 aa, Homo sapiens
AEHECWHYRRDRMRLAHFIANLASCVTGVGASWAPESSTQCRNMTAMARQQPSLGPS

SEQ ID NO: 983368 - protein, 85 aa, Homo sapiens
MSVPNTLLDGESTALVVGRLVTRSAFNSGKVDIVAINEPFIEPQATCVYIVPMMIPRQWQNSMVTGQWRENAEALSSYGKSLSRI

SEQ ID NO: 983369 - protein, 103 aa, Homo sapiens
VKIKYGSSETTEYNVHQHLIAYSYYKPGPPAGRPTGDIVPGFSGYDGHPGGTDPGPHPHLAKAALAQLDLTSRSDSRGISQDILWPGPEYCGYGGISGERRPC

SEQ ID NO: 983370 - protein, 41 aa, Homo sapiens
PNGDPGFNQIEVEAHDNIVISPHGIASVLGMLQLGAGRNPM

SEQ ID NO: 983371 - protein, 45 aa, Homo sapiens
MHRLGRRIATNLELVRTRKSDSKIKTKHTRKPSRRVYDADSDTLA

SEQ ID NO: 983372 - protein, 49 aa, Homo sapiens
MITPSILILLICFLVRYALLLSTHNQELTTTNILSTLRHIENASELSCP

SEQ ID NO: 983373 - protein, 85 aa, Homo sapiens
ASVTTHDHKSMPSLPPPETVDGPLLRKLWRDGRVALQYTSSLSLLALPRSVGKVITEITRTLTGMAFRVPTANVSVVDLTCRLGA

SEQ ID NO: 983374 - protein, 171 aa, Homo sapiens
SSVPLQAWSPVVLSLMSSSVWIFTSTNPEHKAGCEDECAREARCLGNWHTLHSVEGIAYNRAAQQEGIAYNRADHTGVSSTTELTNRRVSPTTELTNRAAPGHIWLFTVNIQPKFNKMCHFGSSTTLAIFQVLRWTTGGYRIGQCRYGALASSQTILSGSASLNSFRLQRT

SEQ ID NO: 983375 - protein, 33 aa, Homo sapiens
MGISVVDRLLVTGVPPHLPILTCQYLSSTSQIQ

SEQ ID NO: 983376 - protein, 33 aa, Homo sapiens
YPLYHELKARPGDQAPPSRISNPCLVSVIVVRE

SEQ ID NO: 983377 - protein, 84 aa, Homo sapiens
EYHDYSVDGNGMRENGVSRSGDNEVDEEEEEGGDGRGGGMKKVMVWKRMEMNIRKLSQLRCKRAAEDDEDEMSDTKKQKTDEDD

SEQ ID NO: 983378 - protein, 104 aa, Homo sapiens
MCLGNCKPALPRLILVRGFSWSLIEKPWLGRPFLQLLTASDPPASASRGAGIADGVSFTQCSVVSRLECSGVISARYNHLPAACLGLPKSRDCSLCPAATPSGK

SEQ ID NO: 983379 - protein, 69 aa, Homo sapiens
VRYDRFYTLLDRLPLPYIIAVIISVRNTRSAQLQISSTHVSYLLQELSITPGAKELNYDIRLHKSAYIL

SEQ ID NO: 983380 - protein, 104 aa, Homo sapiens
MSQVCSKHHGCNGEHNKVLVSSQNLRFQCRQEIYTVISVVTRAMIAKAIMPGTVAHTYNPSTFGGPRQMDRLSPRFKTSLGNVAEPCLYKYQKISQAWWRVPVL

SEQ ID NO: 983381 - protein, 38 aa, Homo sapiens
PGKKQEMNLYLERTEQHRHIGQMSPVCHPLQQKRCIDH

SEQ ID NO: 983382 - protein, 69 aa, Homo sapiens
LEVRYDMRRLSAREMLLFSAPETRRFAKTLLLHTTPGTLNASYLHDATTTAARLNPLQLPVARDWYFEA

SEQ ID NO: 983383 - protein, 46 aa, Homo sapiens
LVYWAPVQQASRSSSCSGADVRSGLWSVAYADNTPAASPRLEQELH

SEQ ID NO: 983384 - protein, 78 aa, Homo sapiens
RGGCAERITSQTGWRSGRDTPQFPDLKLNTTFFDPARSEETPYLEQQLFLIFLVTLEVYIRYPNKASGIISYCNFTTP

SEQ ID NO: 983385 - protein, 41 aa, Homo sapiens
MVCHVLPGKQALVRLDEMHEHAELLRLSVYKDSAHVGQAQC

SEQ ID NO: 983386 - protein, 51 aa, Homo sapiens
ISRYPIGLEQVVPALEFKTLIIGVIIVTETCLLLPYLLPVLLQMIKSFISY

SEQ ID NO: 983387 - protein, 40 aa, Homo sapiens
SASLIFHQASSSVNFSPRVCHHMSEVLQMKKYKALMGYRR

SEQ ID NO: 983388 - protein, 59 aa, Homo sapiens
QRYYTSGIEWQGIERTGIERNGLDGTKTAHWTQVSNWNGTLIVNWNCELELKLESNRNW

SEQ ID NO: 983389 - protein, 100 aa, Homo sapiens
RESHGVEWNGMEWNQPDCNGMEWNGMERNGNNPNGMEGNGVVRELNRFNPNVMEWNGTEWNGMEGIEWNPPECRGIEWNGMQWNGIIRNGMEWNGMEWNG

SEQ ID NO: 983390 - protein, 60 aa, Homo sapiens
AVRELYDELCSSETSDPACGKTYWYLIVFNQKTFRDEKPEEEARTHTEIEMFLRKEQQKL

SEQ ID NO: 983391 - protein, 39 aa, Homo sapiens
MGASAEGAEIDDPFGSPLQMSPSLLHGGEDASGPHDNCS

SEQ ID NO: 983392 - protein, 81 aa, Homo sapiens
PRIARRESASESHDREWNAMECNGVEGIRINWNGMEWNGMESTPVEWNGMEWIIMEWNGINPGGMEWNGMQWNGMESTRVE

SEQ ID NO: 983393 - protein, 106 aa, Homo sapiens
MTTAHTRDLWRRFSLMRRSQANLRAERCQVPPAIHSRFSTASLKLDRESICSSSSWMDSKVPLWLYCTTPTRVPVSDLWSLAMAPSLSTTLMTKVFSSENLVHPML

SEQ ID NO: 983394 - protein, 119 aa, Homo sapiens
MAWKCCPEAMFPLHTSQLGGLTYMTLHSWPMEDDATDSCPSSWDSLLRDTAAGEQRGTPEPEDLSDVAIAIHQHQGNKQFGTAKVGFLYKKSDGIRRVWQKRKCRSQVWMPDHLTTNCS

SEQ ID NO: 983395 - protein, 84 aa, Homo sapiens
MWLADETGACDFGLEGVAPDVVKGADRYLMEIRKLPGAMRIIGDAVAPTGHSWKSIFTLEGLSMVHRQVTSSRICSCSRKLQLT

SEQ ID NO: 983396 - protein, 51 aa, Homo sapiens
AVVVVTGVFTTMEKAGAHLQGGAKGVIISAPSARCPPCSVMVCEPIEKYDN

SEQ ID NO: 983397 - protein, 34 aa, Homo sapiens
PVLVRRSVWNSGFAAVVCELGRESRVHAGARRVL

SEQ ID NO: 983398 - protein, 45 aa, Homo sapiens
FWLAAVVCEHEQCWELVPCLVTIDGPSKVKMDCQLSAHEGYLCHP

SEQ ID NO: 983399 - protein, 99 aa, Homo sapiens
WLAAVVCEAALLAYVCLAQPQCPCATTLLAVSRPIDPGAPLLWVGTWWPLCHETSTTHLMTVSVEASGELDETGGLVTYGLERGLPQIVVVGQPYLIGD

SEQ ID NO: 983400 - protein, 53 aa, Homo sapiens
AVVVSPVLGTFPPTMGCREAHPARFLSGSSAGHSPLLHAHASTLTILCSIDGT

SEQ ID NO: 983401 - protein, 83 aa, Homo sapiens
RTMICRMDRPDERESQCTPRKVQWDTVKMAADTGGGLLRPNVSDAGIPRWLDHSRPCGFTQGISQALLLAPAPSAGEKLLETE

SEQ ID NO: 983402 - protein, 122 aa, Homo sapiens
KEKHEWNGMQWNAMNGMEWNGKEWNGTGMEFNVMEKKRGNGMEWKGLECNGMDWRQPDSNAMEWNGMERNGMNWNGIERNGMNWNGMDGMEFNGMEWNGFNLSRVARNGMEMNAMEWNGMER

SEQ ID NO: 983403 - protein, 39 aa, Homo sapiens
HSRSGVQEHQQDISTRDFLASRDRGPGGQLHQDVHLTHL

SEQ ID NO: 983404 - protein, 73 aa, Homo sapiens
LRHVRLTPAQTHVDCLAENGHNVWALRPAVGQCLELQRSAVTSHARRNPRAGALPPRWIEATTAHATWDMPRA

SEQ ID NO: 983405 - protein, 33 aa, Homo sapiens
LRYYPSDTGLHCSSVSVLECGIRTPGCLAIDTV

SEQ ID NO: 983406 - protein, 103 aa, Homo sapiens
HPLRLFSSQIYGNDNHDPNKALYSVLSMSPKIHNTVKLKSYLPMANRTKLSIGSSHHNPHFLHCLLDHSFLSLSDTAREHKLTLLSHDQANTTADSILYPSSL

SEQ ID NO: 983407 - protein, 83 aa, Homo sapiens
SIVTLLPSYSDPPQIIIMLYPVYSVLSHELLDLPFNKRSYLENPLAVRDRGRMHWWSERNRTGQGVSQRSSIQCLESMNNIGF

SEQ ID NO: 983408 - protein, 104 aa, Homo sapiens
VYARLALDDRKHNRLKLVKTRQVLHNSYIPQYILSNITLVLDTSPPLDLELQLLTRLALGHCRCKYGSDLQTTVRTYGTALEMFHIVISFSSHTKFNFIANGST

SEQ ID NO: 983409 - protein, 46 aa, Homo sapiens
LNALYFEKERKNKKEQKKEKSTRRRKKEEGTDRGRTKKQHAAERRQ

SEQ ID NO: 983410 - protein, 38 aa, Homo sapiens
MYKLFIVYLTISINICFPDHSINFYICELLSKVCHHMA

SEQ ID NO: 983411 - protein, 69 aa, Homo sapiens
STLLYFTTNIEPRLENLHADQTNDLQCSSNTRDGGRTEMETTSHVTCSKSGHAGMPSYGSRWFQEQVAR

SEQ ID NO: 983412 - protein, 161 aa, Homo sapiens
WEVEFIQARCIPGCAALTLKKLMVFKELKKELISVVIAVKMQARNESVRSHEIVLPPSGTVETDLALTFSLQYPHFLKREGNKLQIMLQRRKRYKNRTILGYKTLAAGSISMDAVMQHPSDRWPGAEPLQQHHGGPRQGGRNLNASLSSQPIDHEDSTMQS

SEQ ID NO: 983413 - protein, 54 aa, Homo sapiens
ARPIRRVCVHKDLQVQRLALWPGFPVAFGQSFISANWIECSWPFQWTQFNALTV

SEQ ID NO: 983414 - protein, 88 aa, Homo sapiens
GLDREQPSRCVAGLEQWLSAIEVDPAIAQACAPPHLIRMLAFAAGHCSPCAPVETLRAMRRSSSISVPPEDSAMTSLATDVLIIGAGL

SEQ ID NO: 983415 - protein, 91 aa, Homo sapiens
AQAGLELPTSGNLPALASQSAGITGMSNRIRPGSAIKGVKLGGLYTLFASHPILPFPLPFLPSTLGPAASGVSRTHPVVLHVRELLHEEAY

SEQ ID NO: 983416 - protein, 45 aa, Homo sapiens
AGIIGVSHHTQLDKDYWPSLPYIFESKMFLSLDGKIGIPPSPLFQ

SEQ ID NO: 983417 - protein, 47 aa, Homo sapiens
TTQHRGDLMLQIAACCTLLCCIMLQLLPMHAILLRDHTAPVVRTAGG

SEQ ID NO: 983418 - protein, 55 aa, Homo sapiens
KFVTLTSRDSTVGNNTQTLYTDGDKGFFFYTKYEEAKGGFQFRLCYMGFLDTQAH

SEQ ID NO: 983419 - protein, 42 aa, Homo sapiens
WARSSAYSFFSSSICQPQELVVHLQPIGLYEGILHALVGLAQ

SEQ ID NO: 983420 - protein, 32 aa, Homo sapiens
MGNVRNCKLLWIHDAADMSDQTSVHEDVTKVY

SEQ ID NO: 983421 - protein, 45 aa, Homo sapiens
ASELMTSLNTAALRCRILPVRARMPEARFRIPSEYLDMLVFPSFS

SEQ ID NO: 983422 - protein, 46 aa, Homo sapiens
YSCYLNQDTKNYHAMADIDEWVIQRISTYEIMELQYVDHLLKEDVR

SEQ ID NO: 983423 - protein, 51 aa, Homo sapiens
MDQIRWNEGTDHRPCTNSKIIENRPPSMNPYAYTEPEPTEKVAHEIRFPSL

SEQ ID NO: 983424 - protein, 33 aa, Homo sapiens
LSYSACAGLAGSSVMYSRVARPLPSRNGCISFT

SEQ ID NO: 983425 - protein, 34 aa, Homo sapiens
MLSALAGSGNPGYNPYRRVPGHAVRTVKCRWHQA

SEQ ID NO: 983426 - protein, 114 aa, Homo sapiens
GKRTEGTQRTTCSRPSLEKKKSYSARSEGRQVVSSTEDKHPFYRGSGRQEQHGSKGQAGGHELVTLLSSEDSPEVPLLEEVSLHLNEACSLTLAGQYSTECDGIVLAEGGLTGQ

SEQ ID NO: 983427 - protein, 53 aa, Homo sapiens
AKTFHITNDAPIPIWTFLSRMLTGLNYEARKYHIRYWAAYYLALLRFPHPGNA

SEQ ID NO: 983428 - protein, 47 aa, Homo sapiens
MYRSHMTYHVRSRDMVPRMRRTSRANIHHIKPTECAPLLLHEMAVST

SEQ ID NO: 983429 - protein, 43 aa, Homo sapiens
MQAQSECSILHHAVAAGFYYTCIAPLHSRGALEAAFTVAAYNR

SEQ ID NO: 983430 - protein, 66 aa, Homo sapiens
RESHGGGDPAHVVRHQVVEVHVVGGRQLEGAETDLYKCLDVYALSLIRILHHLVHRQRGGDELHHR

SEQ ID NO: 983431 - protein, 60 aa, Homo sapiens
MPPRESHGVEAHDVAIVLLQITLEHGLGGTDLIQDVYVLQLEERLEQEVGIKNQRSQEVT

SEQ ID NO: 983432 - protein, 167 aa, Homo sapiens
VGVISLHGTEGGEEIRSVIQRGQKVIWEGFQVDLYPTGHRSRTPSNPFSPRSNLCRRRHTSIAGVGGDMTNPSTARHAEERRLSLVAGEPMRLEVLWAPPGNHLRDLGLLQPPNPTWSKGDIMSPTNTVRLRKLIAVMSRCLAAIGECAEFEGVFVGYRNAVAECRE

SEQ ID NO: 983433 - protein, 75 aa, Homo sapiens
ATWWVSLSTEPSALALFVHGIHLVKAISVQYLRRKQLHVVHRTEVSLAAWCHCDIHCPADFSGALCTRSHTCGFP

SEQ ID NO: 983434 - protein, 126 aa, Homo sapiens
SEDEIQLSWSGDLHRLRAYQHNETFRGLTNDTTTPASTMTSVQARASTQPPQALEDSLPENISVSITLTLDPLKPFGGYSRNVTHLYSTILGHQIGLSGREAHEEINITFTLATAWSSDDCALHGH

SEQ ID NO: 983435 - protein, 103 aa, Homo sapiens
SPPRNRTEVVTPLMAAYIQVVEVPVGGGEQFEGAETDVAECLVVDAVGLIRILHQLVHRQRGVVGSTTVSDTLGEGTTLKVFMMRSVNSSRILLMSSVPIPDP

SEQ ID NO: 983436 - protein, 78 aa, Homo sapiens
MYAGAAEHVERRDVPMSERAPVSDDQGDAVDRSGRQQLVLRALQSLPRDGAARHPLQALDGFLELMHVTDAGSAQDHV

SEQ ID NO: 983437 - protein, 133 aa, Homo sapiens
VQQQEETPGGRNLRQIAGEAARDPSLRRARTVCGESPQKWSPCDGEHRSACVPVGCSLTGGSQSRRAEPGSFRGCLREGVPCCTCVFVMGVCVCVGGGASVCVSVCVRAQCLSVCRLLSLSHSLSLSLSSLLA

SEQ ID NO: 983438 - protein, 107 aa, Homo sapiens
FALEAQTGGAQMAQSRLPAASAPAIKRFSYLSLPSSWDYRRMPTLPANPCIFSKDGVSPRWQDGLISRPGDPPASASQSAGITGVSHPARPYSFTFLINLLSDYSVR

SEQ ID NO: 983439 - protein, 40 aa, Homo sapiens
PVVDELLGRLGDLPAPAAFLSDSFDEGSVSESESGSVERT

SEQ ID NO: 983440 - protein, 36 aa, Homo sapiens
TGESKGRWMAALACSQHLAWGRSVGGRSICRNSHKG

SEQ ID NO: 983441 - protein, 33 aa, Homo sapiens
ILEDPRAGTVPGRADDFSQVNVIQLSQLTRCLL

SEQ ID NO: 983442 - protein, 78 aa, Homo sapiens
RLVFRRIPRLGTDSGDRLGEDSMTKTPKQWQAKAKIDKLGSTETKELLQMQKKATIRVTRRPTEGEEIFTTYSSGQRA

SEQ ID NO: 983443 - protein, 62 aa, Homo sapiens
ELEAKVDALMAEINFMTMFFAGGTLSQMQTHVSDTSDGPLHGQTTRKPGTWIAIHRCSDQGP

SEQ ID NO: 983444 - protein, 40 aa, Homo sapiens
VQAHRSSSWLSLCASGVGIGLGLGGGSSYSYGSGLVCCSV

SEQ ID NO: 983445 - protein, 140 aa, Homo sapiens
YTEGLLVNRPPGDKGAKRYDPGVHLSSSSRVPVLLLSSPEPADDRTNQADTSSINRGVYTRNLTDRAEQNSEGSPGILIHTRPTVAHFTFSSKCTKVQHIGINLHPNMHTKELRNQAIQGLCISPHSSSQNPNRSAQTSS

SEQ ID NO: 983446 - protein, 40 aa, Homo sapiens
LQRYELYYLIRCKQAATLPGLLNGRRRASEIPHAVFAGGK

SEQ ID NO: 983447 - protein, 72 aa, Homo sapiens
AGTSPYCIYPKVSTSKIKADKSTKMRKNQCKNAEISKSQSVSSLNDCNTSPSRAENWAEAEKNELTEVGFKR

SEQ ID NO: 983448 - protein, 40 aa, Homo sapiens
KIKWVDAGAEYVVSPLASSPPWRRLGLIMQRGAKTGHHSL

SEQ ID NO: 983449 - protein, 34 aa, Homo sapiens
MAALKETEARAKYRQIVSAVHYCHQTHIVHRDLK

SEQ ID NO: 983450 - protein, 32 aa, Homo sapiens
MVFIRINIFPIVSIQVLFLLTAVILLICTHIF

SEQ ID NO: 983451 - protein, 58 aa, Homo sapiens
GSEITSDIRMATICTIAILGISYCWLHNSSMQSHHSLYAMLEPCGHSAQGAMVESQRV

SEQ ID NO: 983452 - protein, 63 aa, Homo sapiens
LTHSTASLSFFCRTISSWEIRAVSSAILQGQLILSLFLVPVYGLQHGLLDLFSFLTLLGTAFQ

SEQ ID NO: 983453 - protein, 34 aa, Homo sapiens
MQFFRAITVLHAHTPFVCVEHTEAYFLISVLSFD

SEQ ID NO: 983454 - protein, 33 aa, Homo sapiens
MTGLSLLSSARMRILLFMISALLHLQETCLSAV

SEQ ID NO: 983455 - protein, 91 aa, Homo sapiens
MFLNLSLQYSESALPNNVITKTYPLRGRLNSQLILSRYLRIIQSIKLRQQHRENTFPPTSYCREFALFSLKMIGSCSHRKVVVVISHRQPE

SEQ ID NO: 983456 - protein, 43 aa, Homo sapiens
CTPRQQEGLRPEVEESLGLMIMKLSPRTYRVLATGPVEERGAE

SEQ ID NO: 983457 - protein, 41 aa, Homo sapiens
EVLNEQRTRKKKPAVGRLLVGPGGQERSSVPRPRPTPTRQA

SEQ ID NO: 983458 - protein, 63 aa, Homo sapiens
NLFYLHMLQVSGNRYLHEALLYQTKPQTRSKNCYIIFIFLTSSKHVSDQRVSGINFKCFLLTR

SEQ ID NO: 983459 - protein, 63 aa, Homo sapiens
MSFSILARWRWENTFSDPHDVATLLLLELHEGIEDTKVKWSRKANLSRFTYVAQSNGLTNPLE

SEQ ID NO: 983460 - protein, 75 aa, Homo sapiens
AGEAGRVCPYHPALSERMAWVPAVTVASKRLLVTDEMMKDVNSPYAVGSGVHTNTLEATLSRDFQPCGRGEGATS

SEQ ID NO: 983461 - protein, 61 aa, Homo sapiens
QLPPHGARAQFYQLRKQLPPLGPGHSSTSSGGSSHPKGPGQQFYQLRRQLPPHGARAQFYQ

SEQ ID NO: 983462 - protein, 80 aa, Homo sapiens
GHVDQRMAHMGTRPGPAHPRGIAALVIVMPEAPGPRQFHGNLAHFGHLGQRVGDLLGIVHVERQLQPGLGTGAPLAQAFQ

SEQ ID NO: 983463 - protein, 36 aa, Homo sapiens
MRISFAVFIYNSPFGVLRRGISPYTNESVKQLFPPS

SEQ ID NO: 983464 - protein, 81 aa, Homo sapiens
DGIDPRGTGRLQYCNYGSILGFPKAKPYEVKHLARPDCGHTDSKLRSCMNAVAPNPDCSLEVYKPEIISYTVPYGPSTPGS

SEQ ID NO: 983465 - protein, 70 aa, Homo sapiens
SISAEREQIELSWLSVILPVRKKPPSRYHRLKVAVVGDPPTWDEGDVTDTREVSSLQMAKELQPSATAGA

SEQ ID NO: 983466 - protein, 69 aa, Homo sapiens
PARGDYGILDSLQDAVRHRIKLVYSIDNHLHQLHLCFAYIGPRLEIIKDTRLIASRCSNSSMYQRFVES

SEQ ID NO: 983467 - protein, 76 aa, Homo sapiens
MAYHVLYLAYPFAAGRLCACSSLHGQLLMLVKPAVLNCSRASAGNGRHLCAMPALVHLSVELDSSSLTLLGYAIAL

SEQ ID NO: 983468 - protein, 38 aa, Homo sapiens
GSVSAIISTNWIECSWPFQWNTVNSPDVMVICTHYLPY

SEQ ID NO: 983469 - protein, 64 aa, Homo sapiens
MAYARCSRAGLDMPPTSTSHDKELNLYSVGNHLKMHTRSVKAHEVSFVSYYASVQILFDMFSTF

SEQ ID NO: 983470 - protein, 57 aa, Homo sapiens
MTACGWWRQFRGQMLLLGLESCVGYYTLRYGISVGERWQMFCFLVLGFSGIVLVAQP

SEQ ID NO: 983471 - protein, 38 aa, Homo sapiens
VEFLRIPSYGPGAVILHFMFTYHPPSIVYSVLLTLGGG

SEQ ID NO: 983472 - protein, 63 aa, Homo sapiens
EQSQRKCHNSQHLYALQVKVKAKSTGPGIHSGSSRQGIHRDIEIHYPACFYLRYGDNWTNTNS

SEQ ID NO: 983473 - protein, 114 aa, Homo sapiens
GTQSTAITAPTDLKFTQVTPTSLSAQSYTTPSVQDSSGYRVRVTPKEKTGPMKEINLAPDSSSVYVSGLMLTTKYEVSVYALKDTMTCRPAHGVVTTLENVSPPRRTRVTDATE

SEQ ID NO: 983474 - protein, 76 aa, Homo sapiens
VSETKRVPPRVCVRYVCVFVPAQRNPSPGICSFPLWPPPRFPWLPCPERTNSGPLSWTVAATGSGLSLTLQLSVAF

SEQ ID NO: 983475 - protein, 140 aa, Homo sapiens
YSPGLASTESGTGADADSGRMEPKMELATTEEVLKRLKDYPLSPALSLQSELLPCWIMICISQNMLFPGGLGHAAGCCDDRVENRVVATFRHELICVQQAILLPGDGRLPSIPVFLPLQCVLVLHHAAEVLILMLSVPSL

SEQ ID NO: 983476 - protein, 71 aa, Homo sapiens
VDARPKTRAPGSPHPATAELEVSARTLREELNLARITDDRILCAPSPGDSHVSKLIHRLTQQLSQGSRGQG

SEQ ID NO: 983477 - protein, 120 aa, Homo sapiens
NWTLTVYVDDDRSTPSKLTLKLVVTARDWAATRGRGATVRPRTLRQGTTASSDGHVGLYTDDPTDDWERLIFNHDRLEDAKRDFQTQRTPDVSQTRPEDRTRLDLLTDDWTARPRGPGRR

SEQ ID NO: 983478 - protein, 32 aa, Homo sapiens
MPGNGRFSGDRGARTDEIRKLDALALCLNKRK

SEQ ID NO: 983479 - protein, 74 aa, Homo sapiens
RDRLILRVGLEKLYQVYKIKQSYYYNDAISHFLLVGEGREETLTLYRFGYMWQPASMAVEKHGALASLRHSWGS

SEQ ID NO: 983480 - protein, 59 aa, Homo sapiens
TPRFLTMTTFCLKRSCMNDTLAIIYTGAKRNRRPGTVEALVELCYEHDLVAQFTDKEAA

SEQ ID NO: 983481 - protein, 58 aa, Homo sapiens
KTRTPTTVLSGGTPCIRDIADRMQKEITALDAQQHMKIKIINSPQRRKYSDVRSDGST

SEQ ID NO: 983482 - protein, 136 aa, Homo sapiens
SYISNHRASPISQLYDHSQEPTTISYDEQFNLWLERLSSGKDKNKSVLENQDFRCSVRAEVRHLREGPVLPLDAKTLRMLQLPFLTMKFFRDHITMKQILLSRWFGKVSHGHLSVITPPLKFPTRVPRPNLVILAY

SEQ ID NO: 983483 - protein, 64 aa, Homo sapiens
TKFSQVDSLSRLPGIYLRSSVTLLCVLSYSPSTPTLQRESVASTRKSPPYSPISLRYSPVSLMS

SEQ ID NO: 983484 - protein, 46 aa, Homo sapiens
NECKLKEETSGPGEQARAELLSLTQMEREKIDGSLEQLYHSYNRSM

SEQ ID NO: 983485 - protein, 101 aa, Homo sapiens
DSSKEQSPNCSPDEPQEGCAWRWACFLGGVNRITWISEGPRQQSWARWLPGRLHDEAEIRMNSGRRKGATSVSLCTNIRTGFFEETEARSFTSSVMVAEQS

SEQ ID NO: 983486 - protein, 91 aa, Homo sapiens
QGWGMVCGPCLLSGHEHGGASNRSGGIKESWPGCVAAGYQQCKGGDSAVEDVSTRSALAIFKDSCVDGSWKCGLEIKAEAWTGDRNLSLLQ

SEQ ID NO: 983487 - protein, 57 aa, Homo sapiens
SRDYATCLCCSCAAGYTVNVRQCVAEGYPQRVNGTVKGRIFVGSSQVPIVFENTDLH

SEQ ID NO: 983488 - protein, 33 aa, Homo sapiens
ATYANLPTIALENTDSALSYVDIAIPCNNKGAH

SEQ ID NO: 983489 - protein, 37 aa, Homo sapiens
AHRIMLMRDSVQAQETTMSSRKSESRAATFPVSEIPP

SEQ ID NO: 983490 - protein, 62 aa, Homo sapiens
SEYNIMFEPDVCERGTKKLHVIFNYTGMNVADEQGHTLQAMMSLHTYYTLMVRPDNTYEVMH

SEQ ID NO: 983491 - protein, 114 aa, Homo sapiens
RESHGGSSRRKKPQEEETSDRSPARQRGIPTSGVRGRCAGESPQKWSPCYDEHRSACVPVGCSLTGGSQSRRAEPGSFRGCLREGVPCCTCVFVMGVCVCVLEGVRLCVCLCVC

SEQ ID NO: 983492 - protein, 41 aa, Homo sapiens
PREVPVLASQITVITGESHHAWRHIDFINAKYRIFRQATVF

SEQ ID NO: 983493 - protein, 149 aa, Homo sapiens
LEKSDADSGFLAVRPTSVFPALRRRRRAGRNKKRGWRRLAQEPLGLEVDQFLEDVRLQERTSGGLLSEAPNEKLFFVDTGSKYQAPDIDVQLSSELTDSLRTLKPEDNILRDRFKSLQRSNMIEPRERAKFKRKYKVKLAEKRVREIQL

SEQ ID NO: 983494 - protein, 127 aa, Homo sapiens
MGHSRGSPTTYPNGKHSDVNHTFMLATTIPSEISSRLLSITLLAPIQLQVTTSRLPLQIKPLLLFPIPSNDTDALFSKTKNLDLLLDNVALIEWDNGTECLQLLRLPFILMIPYTLYCELFIDVLPV

SEQ ID NO: 983495 - protein, 99 aa, Homo sapiens
LTEEQVQLTSNPTSLSVRLLLLDRSLYCFPRRVLFRLGLCKLVSSKLVLLLAQLHFGQDSPKLGLVNAGEEPAGGIGKGLAEKKSLEPAYRATTGCKTT

SEQ ID NO: 983496 - protein, 118 aa, Homo sapiens
GHRRVTRSSPRLLARLQRRLGEGYRQQAAYYAQTPGPGGPQPPPTQQGQQQASGNCHPPPSFSLQPPDTVHPALVGSAGNLFPCGVRPVTPAAGAVWPEVSGSPHAPPEKHSLCPEVK

SEQ ID NO: 983497 - protein, 100 aa, Homo sapiens
SQHIPVLECSLIPTYSGTFTAIPTKPHLLEPPPNAKSFYKKTFLDHSTTTIITIYTKFQTYNQTIHLVRANYCCILYTTCSLRADTKSDMPQHHRNRLTK

SEQ ID NO: 983498 - protein, 70 aa, Homo sapiens
VKVVRRAEAHERRRTLPEEHVELRVSGKLGEYWSSGSGQSPAYSWPGGQGHDCGPWSSTELLERWVSDEG

SEQ ID NO: 983499 - protein, 144 aa, Homo sapiens
MRLNEMKKQIISSNGSIQSIPEIPDDLKQLSKPVCEISQNLFSRWQLPRGAFIDQSQSLNIHIAAANYGKLHYYALLRLEAGFASTGMYYFRTRPAANPLQFTLNKGKLNDNDKVSQAEEEKERNTAAMVCSLENRDECLMCGS

SEQ ID NO: 983500 - protein, 58 aa, Homo sapiens
TGRNRNWLREGEDHQQNKEINLHALLSPSSQGYVPYPNIPREAEVTCSTEMSSYFPLA

SEQ ID NO: 983501 - protein, 59 aa, Homo sapiens
MVARTPGPLVRVIRADCEMGFPGPKGSCWRALTRLESEVYPEPLALSVLLAKMERLGAQ

SEQ ID NO: 983502 - protein, 62 aa, Homo sapiens
CGLLLLVCDEYKVAIKVGGRYLKGDRRRLKASAETVDPDSLWRVLRAGPSIPQHLPTWLAPA

SEQ ID NO: 983503 - protein, 42 aa, Homo sapiens
CTGSLDLASSISQVDRPPDESRLTQSSRYSGNWIPGPEAGQP

SEQ ID NO: 983504 - protein, 50 aa, Homo sapiens
SPLIKRGVSSTQSTPASAARRPSPPDVVTITQRVQSRQAGKGQREYILKG

SEQ ID NO: 983505 - protein, 34 aa, Homo sapiens
VIGIVQQLLSEAESAFLLVVNVWEFDGCLHGEVA

SEQ ID NO: 983506 - protein, 74 aa, Homo sapiens
HSHPDGFGDTVTTTGNGTRPHPSYLNAECTSHLVPGQAYITWLRYYYTMYDVLRLRGAPPTRSSIPRTATRTHR

SEQ ID NO: 983507 - protein, 82 aa, Homo sapiens
HTQQTQIHRGTLETESLPIEKDAGTETRAKLPNMSVYAEKSGHITHSTEARSEGSGIHRTTLYYRLLTFGTSPVQATTHWIK

SEQ ID NO: 983508 - protein, 75 aa, Homo sapiens
PDTYTSRSSRYLPHINSHVYTKREAKRAIIKVVLYNSKTSETTSCPPKSNCYRRLQRRRPPLEHTSIFTALAHAS

SEQ ID NO: 983509 - protein, 72 aa, Homo sapiens
NQYTCIHKKRGKKSLIKVVFTHSKTSENNLILLTKRRNCIRTADGTEDPLNTQRLLHAWDCFKLSKQDTDDF

SEQ ID NO: 983510 - protein, 67 aa, Homo sapiens
MGSLYCHKPCYWNPLRTQGSEHLLRCAATSMTGTPKASVQPLGYRGSHDVGSPAPQTLEGPPCLGLL

SEQ ID NO: 983511 - protein, 162 aa, Homo sapiens
TAQVYSSYHNWDITKCRGAPWQACHAENWALGRRLMVLTAAILITLMGWRYGCFRKSGPCRSVLTDLLSGGLAQLGALISLVTSGVALNDGPLCMFDVSSFNQTQAWKYGYPFKDLHSRNNLYDRSLWNSDCLEPSAAVVWHESLYSDLLCIRLLQLLLVVV

SEQ ID NO: 983512 - protein, 40 aa, Homo sapiens
MTSWKSLKNELSEENEGKEPPRILQTLSPGPPVSATLTWG

SEQ ID NO: 983513 - protein, 57 aa, Homo sapiens
RLRPLSLDLSSPIHDEGMCKRGILHRCMGGRDPQLLSPLALALQVCLWAGERSFSLA

SEQ ID NO: 983514 - protein, 74 aa, Homo sapiens
WIWCTITIQLVLRLCADIMNVIGEPIDERGPIKTKQLAPNSLLQAPRDDMRNAVLSTEILADWLSTVVDSAQLP

SEQ ID NO: 983515 - protein, 33 aa, Homo sapiens
MLRVSHEISKKTIQLASICIRLLGYLMGTHYGG

SEQ ID NO: 983516 - protein, 69 aa, Homo sapiens
DRVTMIDLIERRPCMLLDSSQIHARVSLWKLNGLLITYHLGTTTPSPLCSQQPLGKVGTRDYCAWKNVL

SEQ ID NO: 983517 - protein, 51 aa, Homo sapiens
AEGLLQQAGIKKTKARVGRGVRPGRAIYTMYRLCESVLLVRCSCPQPASSA

SEQ ID NO: 983518 - protein, 31 aa, Homo sapiens
MGAWGLLQRTTIEVSSTLVQQSGQDGASERC

SEQ ID NO: 983519 - protein, 67 aa, Homo sapiens
CFQWLVQSQQDLLLGAPGRGHWWACDATSLCPGLALHHWFWLPSLLCSPWPMLPLRHLAETCTVVER

SEQ ID NO: 983520 - protein, 74 aa, Homo sapiens
EAGVTGAHHHTQIIFVFVVQTEGYHVGQADFKLLASSEHAVSDLQSAGITDASLRTWHVIAASLGLPQIERLCA

SEQ ID NO: 983521 - protein, 106 aa, Homo sapiens
DTGTPSPSLGTVRHTYRRRERDPNTDRANNLTSGITTHQTKASTGMKAAALIHFPELQPITEHWSRDDSDSSGLKSLFTKIGTLGSGAVAHACNPSTLGGRGRRIT

SEQ ID NO: 983522 - protein, 135 aa, Homo sapiens
MLEAWTHGEVLDPCPVQERQGLNPSPVYGACSFASERGKLERDPGLWVPQEVGSGPSVCGKATAAGRADLMGYATQAGPGAAGSSSHCVGLPGDQQLRLLNHNPRGSRCLLTRLAEGGQLSRSPSSCPGRGREME

SEQ ID NO: 983523 - protein, 84 aa, Homo sapiens
MCTRTHTNTHRDAPPQHTHTPKTNTHCTGGNTSPAGSPLKLAGLCVSDEGEPRGERRRPLGTAGGIVCSVITRGSNFVGRLTAH

SEQ ID NO: 983524 - protein, 56 aa, Homo sapiens
RKADHRTIVLIGLLWRRVFNQTHLHHANEGNKLLIGVFIRELTAGKSAWLRPNGEK

SEQ ID NO: 983525 - protein, 54 aa, Homo sapiens
PALAEIEEGLLYRFPAPGPHPALMEGRRSNVKVEAEASQTMRVGLVSSDPGPQT

SEQ ID NO: 983526 - protein, 64 aa, Homo sapiens
MDRGGLPLIADTAARGGGLHVCSTYKGGERRRRIRPIHSASGGLQAQARLSPLAALFKIVLSRV

SEQ ID NO: 983527 - protein, 37 aa, Homo sapiens
AAQVGSERGVYTGSCTEMCSPSPSNVKSLPLAEFKTF

SEQ ID NO: 983528 - protein, 65 aa, Homo sapiens
RGIDSRKGSQSTDEETCHKNKYLVPSDLTVGQFYFFIRKRIHLRAEDALFLFVNKVIPPTSATHG

SEQ ID NO: 983529 - protein, 33 aa, Homo sapiens
RLRRCCQMNICIWSLAGVDGHHVAVNDGMAPLV

SEQ ID NO: 983530 - protein, 57 aa, Homo sapiens
HSSEMESTDETENFNNLTEQVRKHLASERSDIVVGAQAAVNVITAGIPITPPMPTWR

SEQ ID NO: 983531 - protein, 51 aa, Homo sapiens
PRTVIATGNPPIDGKDGAIEFAYSMEEAARKPMELEDGTVDYKEIIRLKNV

SEQ ID NO: 983532 - protein, 39 aa, Homo sapiens
VTEAKVEETIAVRCLDKNLLAAENRELKLVAPTLRSELT

SEQ ID NO: 983533 - protein, 106 aa, Homo sapiens
LEWFWSEGSKLVQPCGWAGVLEAGPGHAQRVVPGPRRASIHSPLPSRPPGGSHLTARSSTLGPLRVGFALARCPSSISARQRGLGHLLRKGAGRATGPRPPEGLGQ

SEQ ID NO: 983534 - protein, 31 aa, Homo sapiens
MSLHSSLVDRARLCLKKKKKNKIKICGQKVT

SEQ ID NO: 983535 - protein, 103 aa, Homo sapiens
FLFFFRQSLTLLPRPGCSSTILAHYNLCLPGSSDSPASASQAAGITSVHHHAQLIFVFLEETGFHRVNQDALYLLTLRSARLGLPKCWDYRLEPLHPAPYLFL

SEQ ID NO: 983536 - protein, 33 aa, Homo sapiens
MSSNGMAESLGGSSQTVAQAAMPRLFVVWNILP

SEQ ID NO: 983537 - protein, 40 aa, Homo sapiens
EQLPERLGLQVHATMSSYFYNMVIGGRDKVFYVAQTGLEL

SEQ ID NO: 983538 - protein, 56 aa, Homo sapiens
MLIIASQEEVHMIVGSDSEDSQPGFGVVKLAAAVGDNSYPFRILYSCTVFLEYILA

SEQ ID NO: 983539 - protein, 120 aa, Homo sapiens
GLFNWPVALIDSFPDLLGLAAEDWHCLIASEAPWTITDAELRVTLTVKGKSIPFLINTEATHSTLPYFQGPVSLASITVVSIDGQASKPLKTPQLWCQLGQYSFIYSFLVIPICPTPLLG

SEQ ID NO: 983540 - protein, 57 aa, Homo sapiens
SARTGSAGLLAARVQTRDDCSENIGRSGAEGIGDNNPSRYSGTSCRSIRCVSNRPMY

SEQ ID NO: 983541 - protein, 45 aa, Homo sapiens
RRRVNLVEVRSGPRQQPHHHPRSSIRYAAFQQPQCCVSSSRLLSR

SEQ ID NO: 983542 - protein, 45 aa, Homo sapiens
MGMGVDCTGRTLATGFSSPFKVGCQFLLAEGGDAGQALIAGRVIL

SEQ ID NO: 983543 - protein, 37 aa, Homo sapiens
VWLCRLFPHSCPRGLSGGQCLRFPTPRVQAVGESMNL

SEQ ID NO: 983544 - protein, 81 aa, Homo sapiens
MTPRPPFEDIYQYTDDAESQIEFIKILRYKTCKQLQRKNTFFCCCTYDYPPSGALGKLQAPGFGLGDNGRALLPSHHLYLY

SEQ ID NO: 983545 - protein, 46 aa, Homo sapiens
YREVGVDCDVVSRLFPWIGGRAPAGCVGRHALPRRTFQLTDAAGIW

SEQ ID NO: 983546 - protein, 93 aa, Homo sapiens
NGDALILYGLSRRTAIAVGAATHTHTHTHISLSLSLKHTDLMRTTHDNSKTDIHSHDRDHLPPGPSSNIGGYNFHMRIGQRHKLQNTIYQNQE

SEQ ID NO: 983547 - protein, 177 aa, Homo sapiens
RIPYVSIVIIIQHIQASGSKHSTHQFLNHPRISILINRRDEELFRLIGTNLAGPGSQNISTGYKMKLYFQTNPYFTNMVIVKEFQRNRSDNQEDLWVNPLRYYLRERGSRIKRKKQEMRKRKTRGRCEVVIMEDAPDYNAVEDIFSEISDIDETIHDIKISDFMETTDYFESTDNEI

SEQ ID NO: 983548 - protein, 37 aa, Homo sapiens
VYHNAGMLPVKYRRHVSTVLDSQYREAGALVELYEES

SEQ ID NO: 983549 - protein, 66 aa, Homo sapiens
QKKKCCCTIRLCNTNRYVISVTKDNSKYRFQHAIRGQLKVYLVAVQLFRLGGMGDTNLKQKTINYK

SEQ ID NO: 983550 - protein, 63 aa, Homo sapiens
MCALVCMHITNEQQNYATGFWVSRGKELPFFAEYSSGAMFSARHFMFNIIIYSVKTHNCKFSS

SEQ ID NO: 983551 - protein, 83 aa, Homo sapiens
TPDYHRLHEQKNSTGYTGESSLFAQLQNFLQLNIKALGEGLRASRTDCRVSHLLWWAEIVSFQFSLESFANQPNLVAHACNPN

SEQ ID NO: 983552 - protein, 46 aa, Homo sapiens
MKDASKMGPMGNSTLVHTLAIIYWMSPISIVFPDIPSYVDKHLRAL

SEQ ID NO: 983553 - protein, 43 aa, Homo sapiens
MHDPRPSRASPYGLQVHLVLVLVLAQLDLLGVDLLRQLCQLLP

SEQ ID NO: 983554 - protein, 76 aa, Homo sapiens
PVILLFAHEKDPHTTSGPQTDQPKNISPISNSVSGLILLSSPTSLTVPQPLCPFHSSISPRSFNFELFPFSGERQE

SEQ ID NO: 983555 - protein, 58 aa, Homo sapiens
MHCFLPFYWVSLLPSYSLRVLRVSLHISDGSTAPPFFVAPGFPGLPVLIGSTFSHYLV

SEQ ID NO: 983556 - protein, 121 aa, Homo sapiens
CGNRMQGHQLGELLLEELLCLSARACSCCLQSLVLVVLAFFGLGLAVHWELPASFGFSSPASVFELKVASSSASAVSCKKAEEAVLLAGGAGALEACEGIGVLQDELVGVRISMASMESSF

SEQ ID NO: 983557 - protein, 55 aa, Homo sapiens
QFARDNPGGYSIHKEHRIHPFKVYTSGGLTFRVVHPSLIAERFHHLKKEPIRPGQ

SEQ ID NO: 983558 - protein, 34 aa, Homo sapiens
PPYASITSIRPTVILRYAPVSSIGPGFLHTPTVT

SEQ ID NO: 983559 - protein, 50 aa, Homo sapiens
YTRWSLLLKIWHSVYFKTSLVEATWLPAYFTCAGNAPQNLTVAYGSLKPD

SEQ ID NO: 983560 - protein, 78 aa, Homo sapiens
HLYHVCQRLQDHEATSAVRFGRTKVVPSSSYEPHDEDIECIEQQQGTEKRENTGYKTVLHHTEVINTYLSFLLVKGGP

SEQ ID NO: 983561 - protein, 63 aa, Homo sapiens
SGRAADPYYAHTDRRRERNPSSGISDTAEAGQARLVCAVPLNSLCLHPLKRFPERETRHVRQQ

SEQ ID NO: 983562 - protein, 37 aa, Homo sapiens
TCPILADISFSAAIAVHCPTPKRIDRSGGVAQCNCGG

SEQ ID NO: 983563 - protein, 56 aa, Homo sapiens
SQQFISNACQDLLQDLLQFRAVAGMGGLQQRMPGVRAGQRILAAGHMGHDDVQLIA

SEQ ID NO: 983564 - protein, 97 aa, Homo sapiens
THYEELHQQVTRLARLGSFTATQLDAAHGACTLPPCTTVAATSSMAAECRIRCRLRGTANAVDAQYSLRVLPGRLSRRTDVRNASDDAAHAPGTGFG

SEQ ID NO: 983565 - protein, 47 aa, Homo sapiens
MLAVQIGSAPARPAHTKTNCSNRAAALTNAVYDLRLAQYRWLALSHK

SEQ ID NO: 983566 - protein, 39 aa, Homo sapiens
RDSYRFINEPARVTRSAALIVQAGANIANRYACSGNMAI

SEQ ID NO: 983567 - protein, 44 aa, Homo sapiens
LTTAQREAPFDYGLLIYSNGHISDSPRKVLLRAPTGRAATPPCP

SEQ ID NO: 983568 - protein, 33 aa, Homo sapiens
MRRRCAARVASVNATVADLTLARGAITVTCGAV

SEQ ID NO: 983569 - protein, 39 aa, Homo sapiens
SLRCDGANRRPFLFIEQVEVSDQPAEIVGVAAVGLLDRQ

SEQ ID NO: 983570 - protein, 46 aa, Homo sapiens
MLYSYETVKYNTGAGYNYWGTDISMGPFFDQSSGRYLGLQRVFAPE

SEQ ID NO: 983571 - protein, 57 aa, Homo sapiens
AIHSTPLMPATPSSPMRVSMLVQAVAHLMEQVVIVVMKVAGLAVGTAAESLHTQGRT

SEQ ID NO: 983572 - protein, 76 aa, Homo sapiens
LRNSWVILTQSMGRWRRFQAGIAAAEVVQRHADPLARSVFRIFTCRSECRMKIDSVISSTSLRGASLVEASTSETS

SEQ ID NO: 983573 - protein, 58 aa, Homo sapiens
IVCLDQCRSVIRCCMKLNADSNKAMTEVMAKVHEVQYRLPQDAYDPVLVKSAGEATAV

SEQ ID NO: 983574 - protein, 79 aa, Homo sapiens
MSVDLRVHVDSPWSHSGTLGAGADRRCLAGALPLLAALLAEEGIEHGDEQHEQEGILHDGSRRAVDRPQAVHDGQAGQG

SEQ ID NO: 983575 - protein, 46 aa, Homo sapiens
CVIYRASSWCPAEATDCWWGKEAVEKSLLELGPMSGAQKRLMACVL

SEQ ID NO: 983576 - protein, 38 aa, Homo sapiens
KALEGTQEADLDTLRLNYNPTDMKRMNSDTRAFLDTFA

SEQ ID NO: 983577 - protein, 158 aa, Homo sapiens
AGSRSIADSEATSCGSYDGHKSRILRTMRRYSDAMPNQMMQQRRQRRLLQKRKPRKVKTPARVNEEEPAEGQKGEQPSTKAKKPRKPRQKAAAKPRAKKATPEGDAEVEVQNETNADEEEPESDPELHEIDPEALSMYTITKQKRYGKTSEREKKMAE

SEQ ID NO: 983578 - protein, 308 aa, Homo sapiens
MWYEDEKHSLNSSSSLQPTDTSISQQQHIIALPCRIAHPKTKGANAYYSCNATSSTNHSVHIADTPHTPPLHSTSHCIVKHRFILYTTANLGTVHKLIPRQHPNNSKGLSTIGTPALPDPNPARTSIPLTAYWLRAGAYILAQAGLVHQPQWHNTSNGGIQPAQAPPLLSAQDTWTPRWINYPRPIGPFCKAVGLVGTHTLRQQEDFQQHNGFTYMEPRKDPPTCEVSHQHCGNITITTTPIRPYGPFPPLTQHITTTTYDLPRQLKTTNIWNHIIGLTLPTQDNLQRSSGPPAHNLQGLAGNTTITR

SEQ ID NO: 983579 - protein, 349 aa, Homo sapiens
KELQSLTCLNVKRVNGRRRQHISSVMYQRTTWEHGIPTTVTSRDERRQTAINENFQLGVIQTNNMGKGPPLAVTPEMERRRTHITENYELGYSTKKMWGKPPQPLSLLRCRESNAIKTHIARYRTKENMSTSNSDTCYSRDGESKRTQEHISSVLILIVSGKQNTRQKLPNVMEYPPTIATGDGRPNGPISNGATLLQTLTTHKGCFTTMCAQLRNQWNDSSSHDIAKNFQGPFNSPDSITEESCDNMDQHNGTDPQLCAKFPLTTYETPNHDTRHEHSTSKHTTHLVTRAHKSTGHDICPLPYRPAPDAENDYTMSRTTRTKEHNYNIPDTHKLSTIPDPAYLLYNYY

SEQ ID NO: 983580 - protein, 106 aa, Homo sapiens
MDSSQPKWHTTITRIRRHTAENVEEQQYINRIKPTTTYQPNLTTKRKGRRNTPPVQKPPGQPKQGEPKEKEKQAQTSELTRGHKDSQQHRKQQYQDKKQEATTART

SEQ ID NO: 983581 - protein, 77 aa, Homo sapiens
EVITNCMELHTYDPINSMLSIYMDNSRYIDAHVCNYAGNMEANRKEMKLDSASGFSTTSNILYTGAYMRSNSSYRAA

SEQ ID NO: 983582 - protein, 175 aa, Homo sapiens
MTGGAGILMGGNPMRRKRIMALDTTLTGVQLVGDPSVVGPRTVVREPRTHALVGIHTPNSLCRDMGNEYLLCLEPKVCDKFIGSKPFPRWHNIDSMVQEKLTHKPAGMYGEQLLLGRRTIGNWNGLGPGGTASVTRQLEALQGTLGHTTTGRTTSLNPREQRDTTGGTRNRAHIQ

SEQ ID NO: 983583 - protein, 146 aa, Homo sapiens
MIFSVLRLKINIRYPSQDFGTYFSQYCNLAYSGEKQNAFVSSSSVMDPDATGYVKEAYQYGKLDVEHTHYTKTDRQFDRWTITEAILFSHPDITQLHSIGHNRSQTRDVPKGYCLELGASEHNNVPNGTRQLTETVDHAMQVPRED

SEQ ID NO: 983584 - protein, 104 aa, Homo sapiens
MAQLLTWDGVDKRNVRTQIVLNGNNGTDHQESSQGKACWSSRAKSDGRQQTEGGEIGPGALYCKVQLKSPDGMQYGRNRCEHKEGRGITKMVTSRRPEGKDELS

SEQ ID NO: 983585 - protein, 159 aa, Homo sapiens
QKILATGANVIRNQLVELRLTYCGLNGTFVGRAGATGTLERRFKQGDPYNGIWPKKGLILCGKDKTHNFSLVITKTPRVGAPKFFVGATPGLRTRKKDLYIDRGLGTHGYGGNHGQERKRGGNNGDEKGKKFYGLGTWELGKRGPLGNFPFLKIFQNNK

SEQ ID NO: 983586 - protein, 288 aa, Homo sapiens
AESGDAPGYRERAAASVSASDLTHMSNYNYWADCLTTQATQALHYSTEAAFPRLLYHRLTTREGKDTTDYGANILPWRYYYMAPRQHKRHMRPLRITTINTSPANYSTPTRAYTTRRRSSDNNLDITAANTSAAHSPQPQQVNPLTTSGTPAQHIGIPHICYRRYIHTHMQTRTTHTRGAQKLTTFTPYYLLTNYHNNRLKHYTTLATPNNLKPSLAAHHPYAPPYPITHTNYTRPKTPNQTTLRILTKSSHTHTHIIITTRIINPPTPPTTNSPATTSLLTTNLPTN

SEQ ID NO: 983587 - protein, 143 aa, Homo sapiens
HSGTERQTSTHYFRLPCCVAAQPHPSCPIQMLTRLLEFKAGISPVLTEQVIPRITYKPESVMSFELWAPQSHQCRASRKVLGHPSNEEPAYCQENRVRTISLPMTAQTIHHHTRTRPPMNALRQEGLRSLRTPSSRTLTHHYH

SEQ ID NO: 983588 - protein, 67 aa, Homo sapiens
GNYTKIKELRLLTDNKYDYLIGKTTNHWLKYQDNYEYTRHTAVQQLRFYITAAQAVSLIYPLDNCVN

SEQ ID NO: 983589 - protein, 161 aa, Homo sapiens
SRVGDVLASGAWMCSVCAMRTNTMRTYTTGMIVDATVQRSILYICKCITSCSITALTHADGNAHRLRANTLPLRYIYLRSETRTSDSRCHPAHYLTLPTRLDTKSRHINTRDNYYMREHRTVHYYTTRQLSSRTTHCDRKSPQRHTAYSYHHIDEQHDTDH

SEQ ID NO: 983590 - protein, 128 aa, Homo sapiens
MGRKMHAGTTALTQPPRNEHPHSYNLEDMRKRQPHTSVTTQNAATRRHTPTAPQTTTDNTRDKQQPKQRSDPTLQHHHRRGSPPNSNPPPGPTHTRMTATTDDAPAKQNRHHATSIYTSKPARPPYPH

SEQ ID NO: 983591 - protein, 133 aa, Homo sapiens
MHEPYCKPTPSTAATDHMTNSTDKRKHNANQRTTQQKQQKTQTLNRAPKTKHNKQRTITHPHPRNHILNRIKTINDKDQHNHTPNQNTTTHNTFSLTKYKQHPKPAPQHAPSHHTTCQYLTPHHPPILEPSSH

SEQ ID NO: 983592 - protein, 158 aa, Homo sapiens
MVMLLLLLSALAGLFECGSRDNALSYLGNAATKSSECTRDTPDADIHVSRNHGHEHLRQIPNNLMHDLRPAAIQDQTNSSNWNTRHTRPKAAQHTQRTRHHDQNAQPRRNSNNRKGRKDQPQQLTPYNKSTQHTGLAQDLTTHTHDETTAQYDANPAN

SEQ ID NO: 983593 - protein, 363 aa, Homo sapiens
GINPPDLDIMNKPPRNPKEPLIRRVATFSVTWLLASYVRRSATVGAAAWLVHMLADGRSKSVLSTQLSTYSYSVHRGQPGLSKAWIVHIFRIPIPDDNGATLAISNYENMCNALNSLSENQSLLQDSTHLEKHLGYVGLNTRPAPCHSNILILYVEPLPTHLPESHPLTRETSGRIAACNNTPAPCIYMEDTPQDTRPATLPAHLQPPGRYPAYHTTNSRTQTLHPLEHAIPDLCTYPTQPTLYHPPAPSTARYDPIHHTLPPHHTQLIIHPTLPTQTPTLPHSTPSTLTPSTPPITHPQYHLPLTHHKTQHTTPATQKPQLPSTPRHLTYTILTYIHYLTTSNHTPTHTPLHTNYNQIYPPS

SEQ ID NO: 983594 - protein, 193 aa, Homo sapiens
TADGQRQVKPRFPIRGRPGPETESRQLVATRPETRHNVRRYTRPPPSMCDNGIRALDESRTIDRADCRPIGPRFTVHIDGARTHRNTQGRTCETDKGVQTQNIPTLRCARRDIRRQGRRLYLAPPCHDTTYSDANTALHHTNMRLTHLGRTRIPEHHNNHYYTKPASLIARRTHTSTATQTNPHHSEPDSKAD

SEQ ID NO: 983595 - protein, 105 aa, Homo sapiens
GLGVLLREEEWSRGDASGGVDNREYFLEGFFGPICEIDIALNDGENQENGRNEQLEDGKVENNTIIFYDGVNSVSAKGTTKTYEVNPGKRRLENTKRTPRHSQFR

SEQ ID NO: 983596 - protein, 214 aa, Homo sapiens
MHGSTIQGHHLAILPQSLIILQADGPSTVQSISLYGTLGANLATASTQGTFTGAILRIVRMAYKGRFLLQVEAEGSNVGGNKTVLQGAGPRYPTGDENKSTRKYPGLLKSPTTCQEEDTGSLQRERRGNPRAAHNQNPRPPEGDTRTCTHGAQRTGYGATRRPTAHTVPGNVRPRPPHDSNPPINEPHAGGFIINGGTPARNNSGGGPREHRNL

SEQ ID NO: 983597 - protein, 258 aa, Homo sapiens
MHPAMQEAHEAPKDSHILNPRYRLDLHRATQKNATTLNHYEQSVTKTNTVTNARYTPQTSNYSLLTNHETCHNAPTLRERYTNMNAHQLPREHNTKTQKQNAKKGQINTKPYVNSPVTPKELITNTSFVATIQESPRTINQTTPTGINPTDKSVKQEDTPNTQTHSGYTKDMTMATPSPPPTANVPDRPKRTNSRHTNNHRTPISPHQGVHPMSPTHTTKTNESAKLTRRDTSQQQEMDQREQAACHSALADRNPNDT

SEQ ID NO: 983598 - protein, 466 aa, Homo sapiens
MSRIFWKLLPFTWLTIIKLTQFSIALSTSNGLPDTPNHHYDQQITMCILLTHVIYLKQLVNCVAQSHCHCTFLVSPTYSQYSQCTSQPTPPSIPIISLAGKEAHKSLLESVRTLNDTEGINGTQQQLSTWSDDQPLTQTAGDEVHTRGRMDLTADLMTRPEKPNGTTLPKRPHHGRASNKTPPHIATVTTNLRTRPTLPPYNLDPRTKPTHIQSSTMGHRNNQEHHHDHSILRATSTSNLIPQPNSCTCIAQRHPISHHDIGNYITITKTRHKALTAHIGIYPEQSADHLSTQNDHIQLAATNTRAPTQLQNHENNYAPHPQGQPPISEHDTEHTCKHEDTNPPHATNTQPTTHITERLNNTSTQNKNGHNTSRPSTNTGTPQCNDTRTSKHQNRQDTITDNNTQKTSKNKKNKPRHTHKRHQQTISKQRRDDDEHKHTGKVYSCEVGQMTEAQSSTSNVHETHAQ

SEQ ID NO: 983599 - protein, 441 aa, Homo sapiens
MILHLETAFILKEEAPGPFSSHHSPKMVMLLHACFPAHGMASSDDWKRDIDHNNIEARCPQHHIRSKREIKTVKSDIIRKDGTETTQQDPTATKEQWTAANPGPNILQLNGNTRDKTSHRRYTHREQLRARIEGNMTPIPKSTKAESTNTQEKDINKAQQGDKTEKDKRIKHMRNIAQQRQPEHEAYHENTQTSLETHNDTQPIDITTEPHRQSTTTKQGPQMANSQQRDIQNDTKKTTDRDTPYKTQVARNNEHTYQEPLHKQTGRTTQNERDKRNQVTKAPQNTNKHEGTTRRGGKQTQEKQTGQHAHPEQQYQDKQAQTKQTQNTERNDQPENTRTTQDTRRKQDKTERKRAGKHNKQNTQTTRSQRNKERQKQQKHKKYTNKQHNHNHTTQRKKQGTKQDRRSNQQTTSATHDTQTSKPAHNEGDRNGTQRLKRKTH

SEQ ID NO: 983600 - protein, 62 aa, Homo sapiens
MEGHINGEHGRLLERRTARKGPCGDLGQAPRRGPQPTHRESPGKTLAKGTRKRGNAEETQRQ

SEQ ID NO: 983601 - protein, 99 aa, Homo sapiens
GVDEGTGSMLFRASAAWISPFKPISSASGSGIFSHLEHYSITHVYTQESVIMKIQTSSTDIQQQVRLAIFTTGILPLFQPGIQSINNSMFKQQSAQHVG

SEQ ID NO: 983602 - protein, 233 aa, Homo sapiens
MTTFACLTPKQTHNIEKHPTTPQTPPSITDHPTKAQSRNTNTDETQQAESQHVHNVGTTPPEIHLHHTTRDRTSRQQEETTNTQINVHPHEKWRHATRKTKGKREYMTTTAPALHRPLTKARSIRLKQRNNCHGAQHNKDRTTMTLETGNIRPNLQTMYPRAKTLQPAHKAQHPQLVATGMTHTMEQATPQVPGRRDKTEHNQNNQLQRKRPQKQTKKQRKNYTTMELNTNRA

SEQ ID NO: 983603 - protein, 221 aa, Homo sapiens
MLALGHKWLGTPTPSSSMATETVSETPPRIWIQIPGHYKRDRQRKTGGWSLSTFSQRRCLWGPLSTEAPSVQRGEGISAQWRGPRGYNFIIFRNKRCSGQPVKRGHVGSAHKNGVSWRSGSQAGEPRRAGTVLAAWDSPRPSNQTGGKCLVQVSAVGGRLLFLPPQELGADKGPWTLERQAVKETRHCESPRARSPLAHRRPGDWAGQGRADLCPSRGAPA

SEQ ID NO: 983604 - protein, 442 aa, Homo sapiens
PKPLVNTYVYHPMCAASNSTQYHHLSFQHATQYHPFYTCKAVGTPAIKLCQASSTMHQQHILIQILIHSQTTKVNHIFDRHLSVVIPINITGLTPYEQLIYLLTLNLHCDTIPLCTTAWTQQTSFHRPGVWDTAIIIPLSTRHSSILLTTLRIHLTTILNAVTIFHTLRSHYTSHTYMTIEEDMSPTTQVTQTRHAMAHHIPTKGCTQGSTMGPQQHAIRHGHQAAPPTTHRRAHTQAQRINNTIETSRPHGHAHTANKTERSQDNQERGTRTTPINEHIQNMIPTTAHAISQESTNNTRRRATMTPTTPRSYPPSDRRHDQTQTVNSAPPCRITVERRRHATATEHDTSTTRTKTNNPKLQNNHNHAKQGTKTRRTHKQRTEAKQTEHRATHRDQKKTTNKKRRGAPTHQKTRHHKHHRTKPTRRKHQNTQEDKTTQHKKT

SEQ ID NO: 983605 - protein, 336 aa, Homo sapiens
MSDGANGGGCRRDPRSPSGMLVCEGIRICLDTASRELAVSDPALGTLPPAKTYRFIYCSRHRMGRGAHEGVLDFVGLGLPAFPGVACCSEDFCDPGAGHEAVVVSGSLDRDPLRKLSRVLDGWIARSMAPKGKLFGNRSYMNEVLLWAPPASCRGGGARWIAVPLTRGLEGASRPCPTQLPALDYLPRAACSEPFDLTNLEPKAFGCVEDAVCSASTSVPPTVLSMCREAAREPAPLLAPVGCREALGGTAWIKHPAGSVLKAKEGGGGASPLTRPGPGGLTRGGRPGGNIASTGDTFKAPALRIRDGQMAGEGKGRSAVPSRTRKRRTNRKKKPP

SEQ ID NO: 983606 - protein, 506 aa, Homo sapiens
YKVLLLLHIQRISSICLAVRVLTPSNLTLVSWRSLATQHALGKGHGTRLLQHHHIWAPMAHMAHSGQAHQLILPAHQHPLSITLCACSPFSCSLTTFGNNYRTTKYLEEYTQRYNAPYHQLTELETKHGYNQSNTPCEPNHAETRNHRPTKPWRTAPEHWVRTLAHTPAHGQIETPELTYCAQSGAKHCMGSHNYKRHPPAPLHSQTPSDVHGPPHVTTPSTPRATRSNGADAPSATRPLALIARAKQPHNTPVAHTCTTYQTSLPQKSRPEQTQRTDITQQPTARLNKQRIPHNPHAHAEPAAPPSTYLPTNRPPHTTVRTNPGHKEQRDSPPTNATHTPPQHAPTHPSCPHRPPHHVATHTQHPLTRPNPSPHTRHHRPTPHPPTGPHAPHNHTKANMHRRSNTRHPPPTATSNSHTPRQAITSPLSPCAYAPVRARTPPPTPSRIHPAPTSACRHHNNPDPVRPRRQHRPPTTPPPHASSHATRHSAAPPRRRPPPPPPPPHT

SEQ ID NO: 983607 - protein, 104 aa, Homo sapiens
MDAAAPNTDAEEPVYRYILDEKMAGNSKPAIGLVVKAKPMGGHGRFLSRRTTRWVEKRGGAKNLPGGQIGTLVGKGPGGDKTRARGNPPRKRRGWEPPGGRNPG

SEQ ID NO: 983608 - protein, 216 aa, Homo sapiens
MTDNYSTTSTRNTSHTTVPRSQGHTGYLHTHDTQQPQKRQNMHTNHIRDHTGHHSEKVQHDTPPATRHSQTNTTSRQQKTRHNHCNAKDAEQATYHRPTEPKGNKMTKRQTQEARRKNGNEPTTTAPTTTEDTNTRYKHIPKNNTRERTRHGTPNTHKEVENGQHMHTTQEDNGEHSVTKTTKKRNKRKTDTDIRRTTETNKNQEQQQPPARSPKQ

SEQ ID NO: 983609 - protein, 314 aa, Homo sapiens
ADTDHSDASDPAAMAALHVKFFCCVCETCEDELCAVTAESWGSSSVHSELLAKVAWTETRRLEYDDIHPITCHILRAYRHTGQKSYIIHNDMACETVTTDKHGIPNCVQKMEGQTTAMSEKDINATMANWTAKEDTARKHKRVSDEITMEKKTSKTHSTRDKLLHQGEKATTELGKAVDLSGRTQDNQDEAPQYDIHCDKNTGATSRHKKTLKTHEHYAVDSTLRHTTLNNGGTQNWARAHTRRTETGYRDTHQTAGTPKGITYAPAVQPMTPRHRWNATRRTSPHGALPNGHSMNETPNRGEPVSRHEMAHGD

SEQ ID NO: 983610 - protein, 108 aa, Homo sapiens
MKAFGSYSYGACLILQIIHQELFLAMRYSPDSLIRLFINRPTITRDVKIMAEFYAGVPVTPMAPQYYFIVPLPTHRGRGLYLRIDFSTRDNLKHRDYPPACNHSNSLQ

SEQ ID NO: 983611 - protein, 68 aa, Homo sapiens
ASDEVLNLISYPLTSPSPKRPHNNHPLVEQTTAGTDTSASRRHHDSPYILYYAPHIRSLVSLSRVEDI

SEQ ID NO: 983612 - protein, 283 aa, Homo sapiens
MTNYKHRRITQPYTKDVRRLTRTGTVPANPYKTDYTITVGKPKTLDGRTLDTRDCDKSGYYHFIHFMASCVARFYLYRLNVPAALKVARIHRPLHYTAKPGCGPDNCAMETANTKWEIREQGRTKGNRQEATERRKGKKHEQTNHKTNGNNRTVAANHGHPMQTPRERPQKIEGQAQRGKQLTLGESPYPNVVGCKGSKRGTWRARQPQQDTTKEERTRYTAQNGHEPTNRAKPVIGQEDTHAGELTQGEPTTEATKGTQKGVGEQADTQPVPEHHVRAQVKT

SEQ ID NO: 983613 - protein, 136 aa, Homo sapiens
AQIPQAIPAMEDSSRGRPLAPSVMAHRVVNCKIQPVETVVVYIKPSLPVLQEVPEMILSQLPIRQGLLELSISQTTNQTNEIHDYLQQLTVARTVPRVFIGRDCIGGMPVILVSFVNQTGGEPDWSAGLESQDCEL

SEQ ID NO: 983614 - protein, 95 aa, Homo sapiens
TGHFEIFTMLLASMILVDIFQVKADVLHMCDNACDDEYLEMYGLDGNTVNTVPQLLIGGISKPSSELRYVCGKMQRAKMWQPRQDSNLSPYEFEG

SEQ ID NO: 983615 - protein, 136 aa, Homo sapiens
TSKNSNTNLSIDPAGGGDTHIYTNTYSRYFRYTLKLLYIYILPGFGIISHIVTYYSGQKRTIWIHRYGLELCISHSGLPSGFTRDEQQPYYYTRRNYDRRHNRRHIYNYRYHNTSTITHRQTKYLADIAHTSTEAI

SEQ ID NO: 983616 - protein, 68 aa, Homo sapiens
NLYPGGEYAESLDSLSLRCLGSISIVSFHPVVELQSSGMVMQQSISPRTAFASASHGERLPKVNTYDR

SEQ ID NO: 983617 - protein, 245 aa, Homo sapiens
VNQRNSYTSPRGTKNAVSERLFSAAMLCNCSVGSHSVSGQTAAGLPPKACWLKASTWKMSNFIAGAPCEGRLDTSSGVYGSVKVQMAPFFQRMNPARSRINRAQPRRNSIAPTAMTHAATMRTRVRGSLSTQAEITTPNRIDVSRSAETVAIGAWVIAHRARPYDATVPITGNDAQPPITRDVATKHGTPCHYRPRGKRDAGEQENPQGVAAARRIAHAKTIIQGVTGNHTGVDQRKNKPFLCPA

SEQ ID NO: 983618 - protein, 217 aa, Homo sapiens
HEKVPKVPEEPKKPVSRKQRFLLKVIQDGKNLSLAKVTREAHANLSRTKTFLMLYTNTTEAPPKARVPEATEKELSQEEKGSDNLKNKTEQEDTTQAKRDLKLQTTRRWPTERTTSTHTATRYTTQEQPSNPLTSKAQLHNLAQQKRTRDIKPIKQTDSCNHSNNNERTHNEITTRHIMHTTHPVTTKPATLRTPDEQRYPTRRKEPYQHQNQRNPN

SEQ ID NO: 983619 - protein, 295 aa, Homo sapiens
MRSIIFANYIARDTRRLGATIDVEHSHVRFLVEPGAEPVGLWAVRTPSWEDYFTSQRDNIFRIVYVLIYVFDVEHAAELEQRTCIIYQVPCLSTCHLSIEDSPDRHKIFCGWCTKTVMLVSGGLMRELDFLKSERNDLRSSVSPAWTLCWVCSERPIWDETLYRKPWSSIVYQLIPKRFSKLEMKPRGILAQDHRGQMKFVLVRKSYILQGYVHTTSCKGAAAMSTGLMKMRNDSLTVEVSLSKWRCVQSMKVGFHSWFHRVLLNSSDVGCRSDPWALLIERKLEWECATILVMK

SEQ ID NO: 983620 - protein, 331 aa, Homo sapiens
MHGSYVVLHKYLDLIGYNHCVILIIMVILIIRNSTLLHGGGDRPVQSRFDACMNTVVHVTTHVDYLTVLPYIPPRQMINCREILTARRVEHRGQCTQSKSIIVVNSTFDDLQRHPRKILVATRISDPPMQNFSLKISYIGHMTHSSLETIITYVAFQCRMDNNLAQPNLNNLSYLVFFHIECLGPIESTRHMFRKVPDVRGPTPHVVYCRRRTWVHLKLPVNILLPLREEYTSYVYHFLFPPETSRLECLSLCPGKSVGTQLKDCAEILITDTLSVLTALFIEIITWSKTLTLDVWTRLGRRRPLRPHWRVGKGPNQNKPGSGVPPAGENF

SEQ ID NO: 983621 - protein, 184 aa, Homo sapiens
MEREERMEDRHARQVGVVLKSLGLQHGPAGVLRRTCSRSAHKNCPMPPRMRTTVELSILLSRPHLRNDGSRDLLSIGNGQDRVDYVLLDPLCTTGVPRTHKPDNLVPELPGVPAPRKLTSCAATPWAHRLIDIGERVGAEAFDSNPLSHNSAQRGIGPYGPDVRQPQSMLERAWKWPSGTGLGA

SEQ ID NO: 983622 - protein, 141 aa, Homo sapiens
ALSMAGVLQASRLKQYCTQKHSCMFIAGNIPSKNASHHQQQSSPATMHSQTCSNAWHHVYKQLCNPALFNTTFQHSTATYPNVLCPTLQQQPGWHSLPWPCATIAHLHQSLRPKAKQTYAGCTCCTQHTIGVDRTVQLVEP

SEQ ID NO: 983623 - protein, 449 aa, Homo sapiens
MRRISYLYEFHILKKTTKHNPTRETPSQLCGCRKPHRCFSPHSVDHKQILYSPQRGVRERSLTGEGWAITTHTTVGDLSGRRGEKPQGSVFLHNPPKGKSVVWPLPGGHKGARGQGGHPLWGGLSPLSLCVGPEGPLLWNLHTFSHYFWGAYLWRASKEAPEMIGGARRLNKQQTRRGAPPPNNYVSVTKRGWAHPGGRYTRANEGGRSHNYSDTHLLCTYARAPRQEQAVLLQKSEFVNPEKLFRNDLRDAFYNDVLTKQPIGRVAPTRSISFHQTSGTEAGPALLKKVISPLQEGGAKRSITGAITHGCSLGYRGGVPPYLRNGAILYNELGHTCAPALFYQTTGSRGPCVGNTHRPSCRGETLSSVTEEPPHLHSRGGGEPNSVSHTPALPINEEIHGLYTGHNNTPFSAGFSVVNQTPDTYGLAAERLVAPTILSLTYCEPLPDI

SEQ ID NO: 983624 - protein, 418 aa, Homo sapiens
GTHCYLLTRHVTTLYNFYTTDLLRTYWNYYFPDEDDDFLDYYTFMDRLYLTISISSSHSMDPNSNPLQAPANQSNSCIYFILQQRHYLYAGGARFSHTFIKYAFITSVAAQQYSTSITKGTIRVHHSLADEAFQILHGSNSYAPVSSSTAMATIEALMAKTDAVKATHTGHGHIGQNVVLSLKQASVECSIWPKAQQDLGIIPRRPNRNDRQHRTGTFAYTADTSGYAILNPFQSPCHVHWASSGHIITVDRDRSYQLLELNTRPTAARQTPSEPYQKKNRSWLHDTEHREDKYMDGPTRHHAPQSRTQTNNTWRVPGRDDTHNGLQFTRTRRILTPTDNYNTSPITLNNDIIQDTRTPKQTKHREGPATEHAKRSKPTEEAIKDNKQLRQTTTKKSSPSMSRNSIPHSKIESTTTAT

SEQ ID NO: 983625 - protein, 476 aa, Homo sapiens
RRRVVYAELTESSGCVLTDDRAGETAAPAARRDPTTSTLPLARNAAQHRTDCCTTHMTLLPCQRLTLCTLTGRQLCHSYLSSTAARAGYCRPQRLPPTASAAPTCWHAPSPTHPTHCTANRPANHNGPHAQASTDPAGRHPLQSHMPFPHHSPTTTALHTAPAHTLLPSPPCPDTRPTPSTPAGRPRPPAPRDTSRQSPTSRPADPAHPALNAPHQRTSLAPCLLPAPLPGPACLPPPVGPTPGPYASPPTPPPPSAPTPLAPHPAPPTLHEPPIASAPPPHAPRNTKRPSPPTAAPAPTAAASPPRTRLPLPGPQPHSDNATPAARHAHPDHTRTHRRSNPRPSHYHPHTPRSPPHTQPPADSLTPTLRSSDSHPDPAPTPHHPPSPTPPPHPPPPTPPPTPPTTHHPPPPPHNPPPTPAPRRPRPPPPPTPPPPPHPPPAPHPPAPPPPPPAPPPPHPHPPPPPPPPPPPPPPA

SEQ ID NO: 983626 - protein, 215 aa, Homo sapiens
MQRVRLFYATCFAALVIFSAQLQPCFSWHPDLQQRCCSGRNAQLLKPRTAVLHATPTLSHSLLLRLTHTCGNAPSPSQLHTPLSASTRSCLHTPNTCFQHGTANTPQPTAPAAPLTHPLAYFTNASSAPPHPHCAHTTLSCTPTPCTQSPPNCATTTHHAATQHHTSPARCTQPLCDHRATTYTLLVALKNTSTRSHYFPSILPPPPLPPHICKH

SEQ ID NO: 983627 - protein, 512 aa, Homo sapiens
KDLENLGLTHLIGSPFLRRIYAWRFSLDIRLYHKVKLMAKSTLLYEATRKRTTNYAQHTHSKHNHAAPRTSSTLHHAQLCPNSSNHTRDLRHLYHSNLQRQHSKRSNATHNSYHCRQTHATRSTRKLLSPNLLSSTRTCTPHSLHTASPALSNANPPAPLSPHSLTTCNTHARLAHANFLTRPLPCTTPPPLCLYSTQTTFYPCTHTTRATRTRNTPLTRNPSYYRHGHTPQRQTPFRAATHTRKRKRHRAQGTPRATAGNTSTPKRLESCHGHTTPLRRNAKAYTQQNLGTAHTTQRPPWETPSDNSAQAAPKPAITAQRPRPDATYTALPPKAHTQEDTAPHQPTPALELTAPERLRHETNPAANPFPNTGVNGQQNHLKRTPGAKSQRAFRPSNKDAAAAPQRPAPSTMLSTHGNVAAHHTDPNDGTRDNTANQTLFRSARQPPILPQAHTDTLLPLAPPYASDTHGTHAQPHTLRTLGKSPLAADAPPFVQHAQSPGPSGQPPTFGQR

SEQ ID NO: 983628 - protein, 287 aa, Homo sapiens
MWNSFICGRQVHWCPSSDQSWDRHRYMHKNESRVSSILEQWCRPCSQPMHPKVPWEYSAEQAYVNSSMAPDNTVGMGFPYSNTKTLHPRTSTTLDGVAQYVSPRCTRGRGQLRHAKLCLGPLASMSARRPVDPNNFKPLNVACYPITLDNCLVVACKDLHISVGTVGRHHTWQGDRTTPELCVSRQLTQFPCTRWVSVEPQCRTVATCARSSQWHIVLRNWNPDGQVDKQVPIVFTIRHMVPPRTRTMHTHIPTTVEVVRGEYARKVIWHETSTATYLTRHTIDNRN

SEQ ID NO: 983629 - protein, 111 aa, Homo sapiens
MIKRKVPNGTTPSFHAGSRTNPLSFSGPSEDGSSCWKTQQPLAPCHHSGALWKKGHLKLPVNLGINIFSPSLGSFPVGSVKCCSELLSSSENVTASAFLYCGSKDSSGPVN

SEQ ID NO: 983630 - protein, 297 aa, Homo sapiens
MCQYIPRLDDRDLVIFLMKQVGKQKFKKGNLETKSQWRYNKKKKRKKTVKILLANFGGGFRKTILILRPGFDLGVVTQYVPGPMEFNTFFLHFSDSGVRPQGVKKVSTPPDNKQCSRAGPANCWAASQAEVGVQGGGTSNGDGFTHAVVHNMGLREIHSNLLARVWTEVERPRRKDIKDTNTDNDEVGERGNYQAQLSTCDTRVRVPAPDQQGDGEHEKQTGDPRPRGTVWQNTKCQNGAPTTVWNNRCSRKTMGTQIKMPMSSINRGLGGQAAAQTPRYTVRQIKAPRRHPQGEQQ

SEQ ID NO: 983631 - protein, 145 aa, Homo sapiens
ALSIDTTPNNQQRHLQVHSKWHMFNNRAGIQAIVCTSSMLHTGAIMCTSLVFDTTKIIFQHISLALQHIALPASYIMLASQHIHHTDRHNTQHCIGEDRFLVFIMQFFQYIAMHAHATAKAGHHHNTMRNTPNMQNSLKWMRYIV

SEQ ID NO: 983632 - protein, 110 aa, Homo sapiens
MSPIRKINPLIKLINPRHSSRLPTPIQHLPHDETIGSLLGACHESSKSAQDYSLPMHYSPDASNPPLHLIAHITSQDVELMAEIIRYSFGAKDASIILYLALRYTSAEGQ

SEQ ID NO: 983633 - protein, 30 aa, Homo sapiens
MSTRHAGRAKRDYADLRKRNKEHKDRGPTG

SEQ ID NO: 983634 - protein, 82 aa, Homo sapiens
IMTLGEVSQTRTGVLLPCHVNITTCRYDLTALTFKVHICTCSRKCWHLFTFHHMITVSCIRRDLTNLRCAVSHSYESYQLVH

SEQ ID NO: 983635 - protein, 434 aa, Homo sapiens
PTRRSPSPSLRPPRISAFTLTCSHYLCPPLSLIQQLELNYTRVTICPHALKSSNIWTRAHSAKTEPGVPRTTRDDIASEYRKSGRPRTDKGAALHQQEHTHKYQHPHGAERRHTNTAKRHRQQTAQNKRRETAAGADNTTTTPHGTHKQDPQQHTGAPPNEGRQQTSTHDENPTRNKPTKATHRTQHTTQRPSSHHTSHTHNGQPRNRHHTTHTQHRARDKRAPHAAHRTPRDKQPPQPHERKETPRGRTDASTKPRGNQNPPGPTRQRRRDRDQRTTATHETRRHNIASSSHNAQRDQQQTKRPPTAGERSMATEQNSKAGDETARHPESGNNRTHNKSTEERNRGDKGTQSKRRKSTAPPPQRTPTADRDTQHPRRTQPPPHRQNHHKQTQHNPPSPPTQPPAAAHPQHNAHHTDKRRTQPSKPNNTRSAHA

SEQ ID NO: 983636 - protein, 300 aa, Homo sapiens
ERVGAVSAGSSGNGGAEAANGDRDPELPAAARKDGAILGDTHAWVGVKRPCEARSQGRTDVKYSNQHLCAHQEEKLVACAVPRVPVCPYGLGAIQICTCPRVKGDMGHEYESMQEYFRLEPHVTGESHERGPDANYFDGCRPMVVQEAPLSSNFTSFNDLPASPTIGQWSTQPNPQCGSLAPNRMTWTQALAMSIRLTPKMTSPFNEESPRQRRGTEDLPIPCSAVPTCTNRGRGSGWHNRATKTSSNVLTEWGTYHRGNGFFPRREPKVTLASEEDGNRPDGPFGIRDGTGRNGCGQNE

SEQ ID NO: 983637 - protein, 248 aa, Homo sapiens
DLPVGNLLLLIVAILVSRGYRIAKRSKGIATSDFPALSAGPMSAKDTYSGITHLLVSTRNAYYYSYKPICMPLTIPKSTLYPFDHAYIIYPTRAPVHFYDILQSITDLHMLNLVDIPTIPRNNSNTSACLHILPDRLGALSYIYTQTQALFSFVPLVGHLLSSHSRPHVEVPTEIRQDKLQPYLGTFKPLEISGPVLTRLIRVEATHRKHSVYRGSATSSLCAVFYTIDVICHFKASVLLYRSILSLH

SEQ ID NO: 983638 - protein, 304 aa, Homo sapiens
MTIRGKRCRWHDWVLSSQTAICAECFESRGPLYKSCDEAGLSVTDSGVRRGRDSQQGMRDHEEESQGALREHCLKEAEDVGLRERRGQKAKMEKRHRQTEEARSWKAAEDWEYQRAISEELDPGVVNDMTSIYGSLVQLLPNDSLRGSLDGSNLLRRNGSRGKSPGCRVLHPRKNTALKRGGPQGRLAMGTEDTRARVKTLGVALDHTAHKHNNCRGQPPGDPKEQVGGAPKVKTGARAASTTGNLSCSHNRGEQRTRRVLENAQSDTRELYGTVTGESVTAVNRRSGALTRRLRADSTGQSRQ

SEQ ID NO: 983639 - protein, 327 aa, Homo sapiens
WLMNYNVEHALALLSARLPFTLLICALHGPCPETYHLATKRFFCVPLQQGSVLALAAPCSTPLTATNTTSPALLTSEQQRNFNCTTATLGKHTHWRHELLARLTLRLPYTGNASTATHCLTQHNSSLLNYTKEQALSSSTLTASAALLLQQHASMPAYYPSSNSTSYCNTRKPQRNSRAYTHTTRSAGTPAHPTNCSPCDLHAHAQRTPGYAITHSNGHNALSPSEQVHPAGAQRALALGRKALKTPHVHTLYLNLELTHVSQAELITALSTFNKPFYVGNPTGPLYTSPPPQRAYATIHDARGSPAVRRPAHSEQHEAPQQLPSAH

SEQ ID NO: 983640 - protein, 153 aa, Homo sapiens
MRSWAVPVPYSVVVFERRSKVTNSHSRVSVSEEDASLISPEYIIEGSTELSLDYIGLLDDSIKLCSHRKLDSDWSRLILYNQYHGETQVSRTHLEDYHGLSTGDAKQWYYGDPPRPKGRKGGSTMEFRMEEIHGYVVIIGGPDPNVVVGMPEL

SEQ ID NO: 983641 - protein, 118 aa, Homo sapiens
LVTDGTLHDPSYFSTPTGSESEDATELSSSHNSVISVTLSAAICAGSPIFLYLIPHGLSENRVVPYSLGNVDVLRKPMKTFGIHYDMPAETYDDPKRSASGFISVGAATHHIFISRAE

SEQ ID NO: 983642 - protein, 171 aa, Homo sapiens
LVLDRERRPFFLFFHLFSFYWVWDPGQGQGGTRSGGFPLVFSDYSPEAPWRLLWNVFPTRGRGFGGLSAFFLWGRPSALWVMCNKSLWPLKLSPLWPCEPFRTRVLGNWVSDFQRGAEGKQGPTFQAWGPLGRATRKNRGTPRVLKKAGEERREEVNSEKLVGDKKRGALT

SEQ ID NO: 983643 - protein, 128 aa, Homo sapiens
MPEEFIFLELGVQPPASRTPLVRYQLAGMNLSSKQWMEPSCWWVFRGSRYSRMGRPLNKTQALCYPGTVPTGYVVCRNSTSKILQRERELSKEQLVAFLENVLETSWETNGRTFFTVPWNTMLIAWIW

SEQ ID NO: 983644 - protein, 103 aa, Homo sapiens
MKPAAVDVESTDCAVTRAGGACAYSAMTDGSDRGRTTDERSRSERCDVMSCESAEVQRRDSHLARNLGKQTRQPKHEHVCQHCNTRELVRGGNQVRPGGGRYA

SEQ ID NO: 983645 - protein, 316 aa, Homo sapiens
MRRRGRGGRTAGSKAEHEAWTNKKTRHTEPRPRADTARRGERRQETERHAGARQSNEAASIQHHERTEPRNPRNASQPRDLVRMRFSGDQSGSREASRAERRRDSTRDAAARPPQPRAAARGRTQAPTTELEAPTAAGGGRHDGAHRRTARSRQHHYTNTHNTKKQERQARGTGKDCAAGQELRHSPAHTRPDTGARQRHTATGELRSRIDAGGSGRDDNEWTRMRARGDTRARGTHRNGRQTAQADEADDTRAPTTPHDDSPPHTAAATHTHTTHATRRTDERRREPQAGRRRAGREAPATDGAQPTDSASEQST

SEQ ID NO: 983646 - protein, 595 aa, Homo sapiens
NKARRDRIQPEGAFYKLLELEQLNTRWHLDEPGRRLTRLLIDTMHTDTTRLLTLTLSALHCHVLQSTSTPRLSTALDGADSDTHSAYCALRTALLPTAHLRTLTLNRYLTSQKPPIDDHSHLAHSMVINELPEEPIKASILFLPQTERRRNESKTNFIVDCITRKLLSICLCHSATPTFLLSYSPPTANACMLLYTTFPPPLNTSPLTPRLDPPPHFFTHCPPFPLAPHSASRTWRAARLPALSSWAHRASSRPLLGSRTTRALVLTHGRKARPVSAGPEKVVLAPRAPVRSPPLRRAPSPPVVLTTPASCIFVFVFSSPHLLLRLPPPAPLPHLSTRLRTHQHATTQTTHLPPLYNLLLSFSLLYVTAPPYSAPHTTPDASPDLHLPLLLPSQPGLPRRPPLLPPYHHNPRSSSALSPTLRPPLRRGLPPRGPRRAVPGAARVVVTLPLVPSRLPRPPPLLSAFSRPVPLSPGRLLTLPPPPRPPPPPAPAARVGCCGAWESAGERGRVAARSALFALLSRSLLSVTRSLAVAPARALSSRPPVLFASPPFVSCLSRLSRAVGGRLRCAVAALAVCSSSVPAAMPVCTAARLFL

SEQ ID NO: 983647 - protein, 338 aa, Homo sapiens
MTSIQRERGEATRIYVLVAAYLRKRWSVVPYAPRYMRSLVKKRLDIVNTQGELAILIQNRNAPRSVHHGKDLAMKSSIGYPRQCIVRALSEYNQKTWLNEGNDGLTGTNLIVAVFDAPYKARLKELERGFLNSVVIGTMMHVRQKQKAERDNGAWVQAKAPALIQPERSSTVMLEEPDGERRLKLVENYSLWIPWANRRGYHRKILRGPPGAYDKLVAPCMWSKKVVEFPCPKRNSSHTQGGVGGKILSDAPCNYPVRSPAEGTTLLLVTLSAKGGHLIKAVGKALTNTTTLGEPREEVTGHQMTSFSLRLEFIYYLSPTLHKKNDTPIAHKENSEQN

SEQ ID NO: 983648 - protein, 131 aa, Homo sapiens
SRPGVLVEVTSSLNPAWQSLMHRGDAQGIEGELESNYFLNYHPTIGGLSECVLIGARADNVGALEMHVMSMPRLPQCRFGGEVHVVLGCQSKRAPMIAQGHPRAAVENDPALYKLLCHIRGNVAIGSDHTE

SEQ ID NO: 983649 - protein, 119 aa, Homo sapiens
MTPVTETQNSTPKKHECAPQHGQQTDRRHTACLSYNTKKQSKAHTHNKNNLTPSHPPLNNTIHNHTTPTLYHTPHLSIPKIQKTLHLTPHISTYSTHTLHHNTSQHTPYTINPLHYKPT

SEQ ID NO: 983650 - protein, 161 aa, Homo sapiens
TILSQPDRRRHGSGMHAPEKACCPTRCVPPDRRHTYPRLLAAQYDLLTDRCRSFESSKIWTRTGSLPSLCEHDRSVGTLRRYTIGDCSEDTVVCAYGVGAPLLENLYYKSSRDLRSLKSSWNMLDQFSVNEEAGRMFRKGHSLQGVHYGSGVNGLLIPIPD

SEQ ID NO: 983651 - protein, 66 aa, Homo sapiens
EKRRQGWGPQNGRAQVRWLIEVVVDALPVLEIKVMKPHGCGGKRLRHVDAEEDECRMIPTIRKNLR

SEQ ID NO: 983652 - protein, 152 aa, Homo sapiens
MERNKAWMIETSMGNRSALMGGQEYNNDLSWKKTYRLRAHSASSYSCVIAFLYRCHLKHRNDVPGGVELAPGGNLIDLPPDENLTQNSIRHIWDGSLGRLKLGISLVLKFCVAFQKQFASRPNSCDGERGYLEGVGALSKRRRLMPVLTYPE

SEQ ID NO: 983653 - protein, 186 aa, Homo sapiens
VSGKRYSKWVAVAVVLHGGNVRVPGPLSRERERRCPSKGPGLGMAEESGEDETVRDPRTEYSSRSLTVIDTRTPHFRIPLLDWIRKTEMRNRKKLSTKAKAAKIGGIIVSEYDVNRAYNTRGPTVEMMIVNGISPSFDLLQAVYDRWMALALPMPVPCLSAMRIVLACSMNLPYGGIQQIFGISLV

SEQ ID NO: 983654 - protein, 126 aa, Homo sapiens
MPKNCESACFVSGELVVWDKFSALVTGCPEIDSVLLEGTVGMTPAFGLQAAWEQGEAHDLLTFPHLLANCMVQQKQPESPWEYNSIGPDTTPPSPTAVTASHTQGEAELSHAYPCPYRVVFLYTPW

SEQ ID NO: 983655 - protein, 134 aa, Homo sapiens
ALHPWRLPVRHGLLRIGRVCPHYVEVPFRWCHFCLAVRPRGLACDDAKNLHAFDQDITLLFSGCHVQGTDKFIPWLLYALLRLRTASLAGTILYAIVKPLTLLKREVNKSRFLLRELGTGTLSIEAPLKRHFRI

SEQ ID NO: 983656 - protein, 348 aa, Homo sapiens
MCDLSKSLFVSTCERSPPTTSQELSHRKGAVGISPERHDEAQPQHPQRRKRERVIHNKVDVGAQAGRGDLLPKHTLRNQQKGRELCGARAHVGALPQQRVPRRTEQDAHKKSQTQRAMGHRGKEQTNQHEKQKRTNTNPPQITQRLHEADIHRYEGREIHKKGKKPPKNRTTYTSGRKTYTTRGEQRTGRIPLTHKRNIWGRSRQDIHKKNTTNSKHEGAHKNTSGANGRRTWFHHTMDDPMSENYCDHTHGSKRGTERENSSRIKQKRHTNVVQVNTHKTQTGDKTYDNDTGSKTTDHKHLTQTVRYHHESKRKVIKSTATYSTRQDDSSMSKAVTTEQVGLLYDRQ

SEQ ID NO: 983657 - protein, 304 aa, Homo sapiens
GQCDLQDIDWPPFSHSPSEVSYTRSMPFGNIHNKFKLNYKPEEEEQPDLRKDNNRLGGQGYGAPLNFYERLRDKETPSGFTVEDVIQTGEGNQVTPFILDRGLLWHGDEESLRRVQGHAMNPNQFSDRHGGRYKRQLTSNKTELNHENLRGGDDREPNRGAQQTGFATGRGRSGVTRDSPQMGPVGSAGGGYAQLREAHHKLTGTRTKEKEIGIVYDGNDTGRRGQTEQRGTMPVQKRPVTKGVPGDGPNRTRGPWNGKETRDLVRGEEQSAPKNGKYGTQQQSKKPHTKAAVKGRQKKNEKRN

SEQ ID NO: 983658 - protein, 178 aa, Homo sapiens
MSYKRQTTIWHTIEQTSEKVTKDNRTNEHTDHREQNTEATYTKTNTPSQHHKTTRTDNNTTRPTNTANLAHNEEEHPDSTKAADAKTSNSTPPDRRARQSQQQQTRMCSQTTGTATTTKQANKHATTHRQTKSTPADDQPTYNTNNEQHNEEDATKHNETTRSEDPKQTNHQDRSKQN

SEQ ID NO: 983659 - protein, 373 aa, Homo sapiens
MPDPPTSPQDIFTSTCTYITRTPSTDTFHQLDPRSHLTTIKLPGNEHHHDSPFHAHSETHHQVISYLVAAILSRTTNRSRMSPYYVHEQSHLSYLHHAPTPCNKPHQRPLHIPFTSPSAKPTPYAKRHGHPMLHTTRSPINMTTPVHHRPRQQTPQTHSPTTTTTTTTRRRRPTRPRPTSVPNHHKPTHHPATHTPRGHQTLSHPRTTHHPTHRTTHTTQSTNPAIPQDTPQAAVTTNSPTWHNEATAEHSTPDTARDTTRKHHRGKATQANPPRSRQNRPNTGKQINTQHTHTQHHTRITNQTEHIRKHKKPQTQMEQPHAGNDAPHTKDTDTSGRHGDPHTRRGRAKSQNRITTDDAAHNNNYTVNRSNRP

SEQ ID NO: 983660 - protein, 267 aa, Homo sapiens
MATRGTTPIGKPNRSGMEDTKRQQTPWEQRISTIHMTPTNMGTWGDSRDKEKHHMGNGTIDTHNQRKTPAPNHKQTMARQWNHYPHIEIDKQRQHKPRTSREHRSNNGKNSIAHTYAIEPAALHEKNVKRINKHKQTQDEHITEETTSHNQRPHTPGTSQKAPPQTTTTGEQNTDAPNSRSHMHEAQTDHATRPRRHAGHTARSTAADQTNTRHDHHQPKDKGNTTTRRPRPQLNKTPHTQTTRLANQHNETDRKTRHHTRNAEEQR

SEQ ID NO: 983661 - protein, 590 aa, Homo sapiens
KPTPPYYQTTLAKPFTQNKVEAIEIENMDAKDHQYRKGKAGKIHNRSNQSSARHSTPSSPFMRSIDTKNQQHTLMHRQQTEQRKRRHQNTPRSEHTYQATPAINKKQQPQNVSRYAKEIRCGTASNIRAHDRPAPHTPNPDDPIGPHIRTRTNEHHAKRTILTSVTHTIRQNNVQDTQHAHNPRSSTNTSTHPDGDEEETTHVGYTAHTQRRHRDQRKRRHNAQTNNDNRRDKQRDHQSVTRHANNRDNKRTNSYTNTQTKTRETETPSHNNSNKDDQDTNNSRQQAQRRDDRITQKRDKNTRREDPPTSERKPATHEDRREKERPTTSNRHAATDSTRQRTTERVRKKYSSTRSHTTRNQPRGDAQPKQASEMRRTRRPPRSNMTREYTKDSERENTTDEGLTRPDTQKATTGDTTSKMENDTTQRRENERQQSHGNPKTTKGPHYDETPKRAQHTQRSETHDVGQDTSSEQENRTTDQTDDQTTKHTVKPPKDRDTNTTKAPRTHDSTQITNDRRRNHTRQNPHTRHDEPHPQTRSRATLTGTNRDTPTHAHTSRHTTKTRNSTARLEQQARKRNSQKRDSRAHERTT

SEQ ID NO: 983662 - protein, 433 aa, Homo sapiens
PPSSRDCDPLGILSLTLLPQALLGLGGTVGMNLAIARNRPGKRDLLQLTNGRCAGKGTNNVGHTADTNKTKTNKNNNTKNKKTKKQKQQRERGERQNYHREREAPKNDATTHRRSSWRSQERSLTRQSEAELENMKRHDYGAGAGVAHNPTPGRECERENTDADPSEAPLRSRKREEEPEQERGESRKNKSKGGKQQTPKQEDTRRKSTLRAGEKTHSKRQSRGRPSEGGEQTGREAIMRKEEDTAGQLASENDPRRSVIDAERQMRRKRGAEGGENRRQLNKGQERRGQTRKKRKTARAETHSGKRGGGGKVEEWQGGTEEGVAWTGRTGGEEEDASKGGQEEEQEAKRQKEGEAGGGGEEERKEAGERRKAKIEEKRTREAAGRVAESEKKQTKRRWGGETTERDRRRGEGEDGGRANEQKKKSSGAGDNG

SEQ ID NO: 983663 - protein, 129 aa, Homo sapiens
PPGTRPMHWTDATPLTRESWNTPCPRGSRRHRDTPDHLEDLTPRLVQGIERWIPDGGPGPRHAAVLDSSAEETGTRAVAEAEARPQSPCHIEGGLLPAHGSTHIEQPTYHHDTHPCTTSDRRVDETQCR

SEQ ID NO: 983664 - protein, 497 aa, Homo sapiens
KATLELTHNRGTEDDADPEITTMAISDPRGFGHIGIADLMYTVACKRFEELGVTFVKKPDDGKLKGLAFIQDPDGSWIEIDESKQNGHLTCSASENSPYADSQQERKQCAFKISTYQQALSGLTWINCTRIHTIITIQIHNYTPFTIYRTVLVTPNCTVPSWVFTARSIYILNVPSEIKIVVNHTITYRLITNETRNPYQKGQTSRTYQFVDTTHNEKYTISHYPNNVLTLMGNWIRVYQTHKKDIRHHDDHTTRSHNRDAMEQRASRDPRDDAKHHTSTTPGAGETSKKSNRDQKADHMDRKRNKDRWNQPIKREHRQRVEHEHRYNPRVRSQKTSDIYRKLNYAGKTMNRGMNDITESKNSVTRKQHTPRRRGNHERGEERKRKMGELGAEEEQERRKKRKRREEGKREEEEKKRKERKTRHIAEGTTEATREDHADDDDEEVKQKQRKKTEKSVRERQKTGAQRREEEASRSDQGKKLRTMSLRDSWERSKDRK

SEQ ID NO: 983665 - protein, 74 aa, Homo sapiens
YCAYCHTSLCRCEAVVGLALLVSFSNTYGYHYEYDLYAYSNATTNRPNNYITTSDYDLQITIFESSQATHITNY

SEQ ID NO: 983666 - protein, 394 aa, Homo sapiens
TTPGMVSTNMTSTSLKVYTQKQQVFHRTHLRYQPSTMTVNPQSVPEHICMLPSVNNPPTTHAILQANSNRIDNILHHWAAYVRKVIVINSWRVISYSYTLDAKMYYSRRGIRYRTIDEHDAIIEGNPWTNGMAHNRMHACPINIINQDLLIAPTTNILIIENRYKKAMHYKIQSINSTYVKDTYKVHQEIGTQTLTHPALSHQTAHPHGNSPITIHTAPQKDLIITQTATDKDTDTGAKYRPRHKDNKHNHTRTTKHRQHEDTHKTEGTKHNTTGHNSTETTNTKPPRRYTNAGINTTHTKRQSNNTRQTTIHQIRKRTKQKTEAKKEERKHNSQKNEKEQAKKKPDKRQTNKKEKRDNEAGREQATDKQQETEKQEEKNRNQASKQPKHCEEK

SEQ ID NO: 983667 - protein, 187 aa, Homo sapiens
MNWLNLTSKLVLWDITLRMDVEETAAKCTGLCAKVQYLCGTPAAPERIFTRSAKNVQGTHWETVTVIKGKLNGSGGSIYTRTRKVMVHQRILQMETDFVELIELCSIHMGLTAQESDLGQHDTTLAIRVQRDTPATALTQGYVEYKNNKEPYYRGQWTNKITMPYSQALPHVQCSGHLSTGPYVSDR

SEQ ID NO: 983668 - protein, 144 aa, Homo sapiens
MKDIQSTTVKATHYYGRTERKTARLYHRTQIRETTRAPAITNAHNANTRRARSTPDTPRGRRHYHEAPEPSANKENELTTHETDEWTIVCDTTNEGRHQERHRQENTLTKHPTNSAQGSNRQKRQTIPATSEQPIKQRKQEEPT

SEQ ID NO: 983669 - protein, 70 aa, Homo sapiens
YRCPPSLRSPGSTGRHLCLVGSRSAASRPASRPAAPPSGTKHEQITHNRIYKNYKQKRQHTLYKITYTWE

SEQ ID NO: 983670 - protein, 70 aa, Homo sapiens
GECTWMLLGSRWHSSSWLMCTVWLPAHPFCLEYDNSCYRVGTSPSPIYLLGFERCIYRHKKGEEKPKALL

SEQ ID NO: 983671 - protein, 129 aa, Homo sapiens
MTVAQLLHDLTLSRCYHTGYCGACWHREKPGKLAKTEIEKLQMKRDELAVISYKRSCMKMNNTYVTVMRVMDNALEKVELSWVDEFTCLEDLKLFREDVAEKKARNMLRKSLKEEGWNQMVNNLLTLIQ

SEQ ID NO: 983672 - protein, 104 aa, Homo sapiens
MLADDRGTRSRALSTAYPDSQVASLSTDRYPKQMLRCLATHQTGACDPGLQSNYRSYTPRRHMKSDRLERHSCAYQRAVTCSKLIQESEVAARVCSQSRPARVP

SEQ ID NO: 983673 - protein, 83 aa, Homo sapiens
VRVLLVRNLDIVMLAAVISRLLHTRTSSRTSNIKRSSPTRMSRRTDDTTVAQICHEPNEPLNYNHNCVQKYRPIRIDGGVKSR

SEQ ID NO: 983674 - protein, 117 aa, Homo sapiens
MVLESVYREGATTDLINPGSALYLLTMTRRLRPHHINLQYCQQCSSPSRNPGIRPFFRHRLLKVSNAQSVVQSQLECMECNSQRPQCIDKTIMYRGTSNRMLAQHVGEWEYMYAKVY

SEQ ID NO: 983675 - protein, 348 aa, Homo sapiens
MTEGHVCSCAVVGYMCLYYLVTGSMKGSSSVLNAIGVSLRRLSEMIHGPQSIQCVPYSETDSTATAWIDVARETRCTNDAHFCVEMCGDDDSHEDARMGIIRQHRVRSWRGGMCRAPRELSRPEAHVAIQYTRYNVWGVMSDVTRRSHMGIHSTPYGDYSWSLNRTPNFVFEPYLGTLDRAEIEVTHNTQISHTSLKEYDTWTTIHFALAPFLLSPGLRSWPRHLHVCNLLATLRASKNALEALTPNDQANGGPHRALGELQSGEQHQIVQIRSRSCGPNLGHLGGPPAEYLDYVNSCHALKGTPTRGISPLANLDKKRLRTGTWAGFVAGWSTECARDLKPRGNLGQ

SEQ ID NO: 983676 - protein, 107 aa, Homo sapiens
MAIVGLDGRQMARDCRTTTCWCPEACFHSYASMPNVHDVGYRIEPMQLCVVFVQELHADSALELPVSVKAHWSRSCGSQRIGQSTKSRRDTTYCVIVVGPHRPEIEL

SEQ ID NO: 983677 - protein, 151 aa, Homo sapiens
DQDDHQTQTTPYSGALSSEYPNESHMKSAKPSFYYQRLLINVAPLTSPTLSTTSMNDHRDYSMTIIDPSHNMIDLHSMQMTRNRYLTLTVPLPEWGVRDIDLQAYATSSQYARMGPLYAPILAIGRSTQTLIITKTPLTLTYESILWNKYS

SEQ ID NO: 983678 - protein, 247 aa, Homo sapiens
ILLPIQQFVTCLRDFYSSLITTPFTHALHNCSILPKGDNGSLQEVSAAVHKYRSRISQRAIRTYTRSVTTLVDETIVHTTRRAPCTYKGPHIRNIKTRDTRITVNDTMPWITNLVPCEYSSFERACLTRALQVSVTSTVSSPCLHHLPWMGSCLSLLYTLKKLMPSRRPMLKAVTYLRSQLNRVLQTLILYPHESVLCNPGPNTWRSCVNHFEPIPYTNSNLLGLIATSRHSPIDRLGLICVRKWSC

SEQ ID NO: 983679 - protein, 181 aa, Homo sapiens
MFGACSSWPPVPTTGLREPGRWLYECSCAPGVLGRGLPEKGGGPCVIDGSPLPSTEAPAWMIEGPGLPLLPAGGPPLGLLKANFRGDRGQQVEPQTHGEKEGGLQWDSERFRWRLPSRVQSNKNWRRPGTHGRSRGKRGTCWHTPGSYECWAADSGLTGQNPLTPKDPLAGKVTQTGDKRK

SEQ ID NO: 983680 - protein, 130 aa, Homo sapiens
MGQRRDTVEDRRGSRDQQPKEGPTKKEPSTMVGATPKRGRHPGGAPIHRGSSYPPPPNRGRNNLLRRRPKQDAEEPRRRGQIFTPTKGVVEVARRGSPSSRHTKWWRKKRPTKNTKQDGGEENVRTEELV

SEQ ID NO: 983681 - protein, 141 aa, Homo sapiens
PARIATWLSDKNHWGDEMITFNTFFSEHGRCQNSVPRAVLCIRMEHPQSIDLTTIRTGTITVIISPPCNVNAIIRQAMKMLTITMPEGITTLAREIIDLAVGAKFRKPELTTWPPVLSGASMAISIHAFCVSEPAYWGSLP

SEQ ID NO: 983682 - protein, 115 aa, Homo sapiens
MPFSYHSQEKLVNTSISDAQEIEIRRESILGRHHPSPHRPPIPYASFTVTDEVQRIPHPFTIKLNWRNQVVAEAYEYTDYGRTNRSTPYILPPVIPSNQATCDLLDVDDSSSTPD

SEQ ID NO: 983683 - protein, 186 aa, Homo sapiens
MARQRSGPLTTQCNPRAPRKCSPVPKRGPPLTKIAGARTGKNTQIPVILPRCNTTASTRCTQDVAGHQYTSDTHTTAYKQHTPREAPTMASPQVNRSPPQERAVSSRQDAMSGQPHGSVLMPHAKVVSTTKPDLKYVAQTIAVTHPTQHDSSENTDDHQQLCTQSQVDSTTHDMRRITTRTMHKQQ

SEQ ID NO: 983684 - protein, 106 aa, Homo sapiens
MQEVSSQPEAHHRSSSKEQPKRKYIQGTADDEIVTGSLFYSSYKPQSTFESPFTISEDIYGLNIFCSHRLPRTSRHYWLNFPHYLLHPPTNISLYIQNITLVRSRR

SEQ ID NO: 983685 - protein, 69 aa, Homo sapiens
AGLVHIPRPQQPSKMGKGAALPGPPTLVIATPSLSRATTVLDGGRSELTCTVWPSITYNSVITAEHKKK

SEQ ID NO: 983686 - protein, 209 aa, Homo sapiens
MVAWRPHSRKTFCSITWIPVKASQGRGAFRPGPRIGAEVVTVVVALFIAAQAALAPHWWPVAILGPPACSETSDGGNGLQETLVALYPTGTKTSDPRREDLKVDNSQVHGARDKDTLEGGAPGRPMAGLPPPFKQTGTRRPTENSSATRREHNNSVRDTRRSPAQTKETSNTMCDQRPLSSPNNERDAKRMGHPPNNVSELTQTSRPRI

SEQ ID NO: 983687 - protein, 180 aa, Homo sapiens
MTQDKTRSEQERDRGIDWIDAKRQENRLSRIEQATREESMRITENKWEASTSAIPKMTAQSTWPDEPRRATNTTITSKHYAPDRGLKQQDGTDYEIASIWENHEDNCKRALDEYKEITAHTKLPRRQEAQGKALGEAHNSGKRRNMGTNGQHKRHMEHEDICQPATTQGYDTDPIHPANT

SEQ ID NO: 983688 - protein, 157 aa, Homo sapiens
MGKCRGTSVLLGNDSATLPMSTQKWHDRHSIKKSRQFECISAHNRPNTRYRRCFSMQIRQSCVYIKVMISHSQHRAQIPDQLGTRVIRGGPSMSHRNGKQRVTKALIAIPKVTGMLYAPVFNLMERIALKDFMRFALRHIAVQADTVVEIASRKGVE

SEQ ID NO: 983689 - protein, 155 aa, Homo sapiens
MGVLRAPCQLLWSNYDSDTHPKLKGLSNPREQTKEDTPIAIAKAPKVCGGHLTNTSEKKHPKVLPIGSTQVDPTEYGNGTKGSIRDWTLHLAMQWDIEDLRKHRKAHDYGGRFGGHTHKGAPSKNNSIGANTSGNRLRYNEGTPPIPYQDRRYAT

SEQ ID NO: 983690 - protein, 433 aa, Homo sapiens
FIELQREESDKLSEAVQAQEGREGWATPLKSALTNRGWLCVLPVACGRWCVCFPRRYATTEVPPCEAYRWRHSINRGGAGMPVVTAVHTYLSVVFQACAYGVLCYSPRDRWWVTTSRGYTNNLQLDSGQRTNRGGSPSESSRPTISQPSRQHESYRAQSSHRPFTAAKQALLLELPPMGSEVLSIKILETIPRQCAKYHGTPTVMELTAHPQPELQCPSLAYSRGEVTARAITVSMVSNFQATIVPYLLKLVRRSARVYGALGPDVINLDADAQDTLQEGTIPRLTTLFTASRVQIPTNHDSGRPYPVCTHKCLPQGMMRAPPEANGTATGGNRFRGTQAPSEELNSKGHTVVAPPRRRHGRKKTSAGANRRRGRKRRKQGRETQQEQNEGAEANDPRKTDSPSKAIAHKGGHNEGSRETAGHSRGKRKRRDT

SEQ ID NO: 983691 - protein, 227 aa, Homo sapiens
GRVGRPTRPAPQCVNNWLAKGLGAQSLIGCLQCRARVPHSDLSSVQTLLDVEPQVDLQPGMLEQGFGSVYRSRLRYVAFSRKLPLIYRFEAKRGKSKRDVNNCRSVHRYFAHRSMGPYESIVWAAWTPWYIARESVPLSSTFPCIVLGIKWHVVVHLGRRTALIRRVLSNSFGDFLLSVPGERCAPTGLWPVARRSLGFISPFDAPQGQIRNHGDTGYFQRHKATGP

SEQ ID NO: 983692 - protein, 396 aa, Homo sapiens
MDVSLWLPRLGLAIGSISTHWQPPPPGFERYYLPTAYLSSWGPLVRATSAQHNLGYFKKQGFLQCCGSGVVLKHPNRQGDSARVSASQRCLRIPVVVSQRVRVAGIILYTSYAFTFGGLHNCETCVQKAKAYLKAKGYSQAGQSGSQISSREVEDGAINTAGESTKGAHGGIPGPEGYTGGIKKGGPRVGIKKVKYKELKNTRDPPHDPGKCGTDSRRTIILGTREKPKRQNKGRKQQVKDFPKQREGEPIMVSTTRGQKNITKHGKVPTKGDKDKENPKGGTEEDTNSKRQGRPTLGEKDNPKIHSTTQKGLTPPRVSSGIKKCDKGFTARNRKQRHRGPKCKKEREHHTEADRRKSGREDKRDPEWIYTEKDTDRKTEPEHDETKQAVSALPRP

SEQ ID NO: 983693 - protein, 116 aa, Homo sapiens
MHELRPPPLYIYCNAGAAVHKNSRSIQKEHLMTYEVKRTPRIGSNNCAPNDRKRKPPVYRSLELACGIQHTTEADREGVYLTSLNGRRLKEQTGDVTHIMWREKTRDLVKEHRLLG

SEQ ID NO: 983694 - protein, 76 aa, Homo sapiens
MVPYCMQTTDTLYGICWKDHSVKEAMSEHCIESTKSTKTLVSMPQRTSDDTQAKAVGEDWLMWSSEHSYLSDWASG

SEQ ID NO: 983695 - protein, 230 aa, Homo sapiens
TALSMDLDLERGPPGPRRPPRGPPLSSSIGLALLLLLLALLFWLYIIMSNWTGGALLVLYAFALMLVIIILIIFIFRRDLLCPLGALCLLLLMITLLLIALWNLHGQALYLGIVLFIFGCLLVLGLWIYLLEILWRLGATIWQLLAFFLAFFLDIILLIIALYLQQNWWTLLVDLLWLLLFLAILIWMYYHGQRHSDEHHHDDSLPHPQQATDDSSNQSDSNSNEGRHLL

SEQ ID NO: 983696 - protein, 106 aa, Homo sapiens
MCTIRAKQSYSRLVDNPRMHDRSSIVPNNASFCIRSRFPVLKSTMKDPYVSSLILIYLGLIGLTWRIRPNSVNVNQDGVKPVQAILGLSCRRPRPGRGRETPPISY

SEQ ID NO: 983697 - protein, 133 aa, Homo sapiens
MCVYIIVVCVVCVCRVCSAERRVRGVSLRHSVVVHTPRRGCCESRAQKWRRVTHSRAASHWWGDDLSQTLLLWGYLQEPEQSSLLVVAPLKRPLLLVKRNSRPERRTITHKGGPPARSHTTKENTPQGRINHF

SEQ ID NO: 983698 - protein, 268 aa, Homo sapiens
MRDINILADLNGLGKGLYRPDSRRLTCQLQGMEGAECSDQQVGEGRQRPQRPGDRVMGRTRSGMWQEEVTGPRIQTFQIPEAMTKRKQKDHDSHNMTINSTTMDPLSTTGNHNRQSQRRHGTKWHRKEEAMAWTPTEMSQHTGKGEQLPDTHDKDNNIGMDNLMTTQMHQKDTEPEQEDNAEGTRQQTRKPPGPDKQHMGTGMKENEKGGGDNPVTETRSSTQRTRGHKERLKDSDIGSEREKQHRHRTSQRTHQAQLQRKMKDERNN

SEQ ID NO: 983699 - protein, 130 aa, Homo sapiens
MESRSVAQAGWSAVARISAHCRLHLPGSRHSPASASWVAGTSGACHRVWLIFGYFFLGGERGIKRCLARSGPPIFRDPRCILPALGPPHRCVGFTGRVSHQCPGHLIFINSGKFCGTDDTVYRGFCHFKF

SEQ ID NO: 983700 - protein, 199 aa, Homo sapiens
YCVRFGVWLVLGIGRRSWCCGPRAGRADCRLWRISEWVQPNDSVEEAQRSIRGRGVLVSWPSRRSIRIYSSRDGALGPPEISDRDAVVFRVLNPRCGYTKKPPINKPMARHLVSPFSMGNGFVNKHNIVAVSIVVFTFVDPRGWRALEGRNGSSSWITLTKHPTVSRLSIGTHRDCVYTAVSYVPHEPRVYVYTLRARR

SEQ ID NO: 983701 - protein, 121 aa, Homo sapiens
GARGGAVYAGPLVGLSMRWIPPREARRSLEEAASDMRRAVYRIACAYNLPVALREFSIVKPIRPGASFGVGVYLGAERRRRSVMSVKKVVNRYSQTCIHTKNILTPIEGPRTSAENATWST

SEQ ID NO: 983702 - protein, 352 aa, Homo sapiens
GRVVSRTRGSSHASGDKPGPGRQDWASHGDPRWAAGIVKPEALQNQLDLAGELCGSGSPYLVRIPMILLSVLLPLRPTTPPAVWDIADALDQHSYTEWLNLIFKVVTLIGDRAPIGGSIESGILQHRLPSPGITSIPSYYSRDLVPGSPSGTTAIDHRSSPLDHNDGPVFTQVATRDRSRWVRVMPSLAYSTNLIGSDGIVRTSAYFATFPLNQVLAGHNKLERTGLDDDSTSAHMEPTSTPPTGTNRQEPTMLSTSPHKATPKAPSQNQPSPQPSHEGTRGHTGNRGKGAQAPSDTNTGTQGQGQPRDPGRHHHSQQSHAQPPREPTTPHTRKAAPSTHEPGPQVTSNPQQ

SEQ ID NO: 983703 - protein, 192 aa, Homo sapiens
MCATLSIEKGVSCECESFLLTRGETARIISWRCNPTQCGDPIAPAPLYISQSVGSPPKGNYFIGANGAPHTQAQTVVLCSPSHFGRDCLTLCGPPYKILHIIPRHNHKGGTSLGGAHWLYAQNTGCSPLGSLGGSFQGKAHGGLVFLPLFSYPYFLPCPSHGEALGVARARPLIDILSPSRYRALRSCGGLI

SEQ ID NO: 983704 - protein, 497 aa, Homo sapiens
MREFRTKTLQRGNTVEDWLRNLCTNDIYHGMRNIWKTSSKLLMHLRSNPVKQDGEHSNVDQLTLRSDVRRRKGPLTMATQYQEVVTRTVEHSRQERRCSEVSPGCVNCVMVAIEESRAMCISQESVRKQGVQKSTISCARDRRTRDGGYYMGIPNVRASKRCSAVTLGAGSTNNAGKPFRGITNLTLPSERQERMSKRCRPRQWSQPITDHALLGLPTSFSTEPANLEAQKKAGTLYELSPTQTECGSPDNHWVNLNNRCQLTSYHVPLRTNVELRGHDPFDVQPDSSVRLRHRAGTHLCMWHPEVIKRECALAMSQSVAHLQDLRIHMAIKEAYNKHPLRRGDEPYNNLYAREKRALMAYTASPTRLTFYAPNVDLIGFTGEIVAMNLRRTVACETDNTNARLQPKKTDTIGKNAAGYRPATQDKTSPKREPKVRYDGQNRVTSAQRLAAYRFKFIYDQRAGVKGTHDVIGGSERDTETKGDKPDHRVAPAGRPIK

SEQ ID NO: 983705 - protein, 52 aa, Homo sapiens
MRQNTADTRKTYHKNRSDRTNAPDKNNITRSPKQTSSAATRKEHTTTAPQPL

SEQ ID NO: 983706 - protein, 208 aa, Homo sapiens
MAPWNTRTIHAGTRENSIFTLIHLDYTTPWLIWYNEQYPWLEETVHIQCTYTNSHGGTNTLHANLSFLTHKDNRNNYMGPHHNTNLATPDPPRTAQQKLREDHTRRTPNKPPRKHNTPDNSNTGPPPTHRHRRRPAHSQKARGPHRTRGTRKRLQTPQRPRKDQTTNRQTKKNEPRPYRGDRTAETDPQHEQREEKQRPTPKTHTTDA

SEQ ID NO: 983707 - protein, 361 aa, Homo sapiens
KRETGGKEESSLMDLARRLHGPRLLPRAQTPWGGPSTAWRAARYQTGMTHQASGRPWERDHAMSHSHAACTHTWRRGPMPRTTDLRTLLGESPLRRTLALATHAKEPHNSIDPNDELEEHTPEPPHGQRQSESKPASPTRPTLTSPSREGNTISPTMRLGRVPQGTTPERPQSQAPSRNSPHGDHPGDTPSHRQSTGTTPCRQRGSPRWPQQAPQAAARGAHHHTDRPGPGTSRRPREGTRLRKLSSMTPILTPETPPTHRGHLVQRHNFPARQTPRPKGHHTIGRAMGQEHRGKHGYTTGRPAEAPPGEQRDPGPKHDRRGVYNGGRRPHPATCDAAMEKATSTPPHKTLVTSATNPRTH

SEQ ID NO: 983708 - protein, 133 aa, Homo sapiens
GQDEDEEEKEKCGRREGERADASIDRGGLTWMMSSGCPGDACGDGSGGAKSPQGSGKEGAVLANGAVRGDTECKERRGSEDEALRMDSRGMRWHFEGPKVGGTYRLLQTVIGIELPEIAGLKTKAIWRRMQGK

SEQ ID NO: 983709 - protein, 111 aa, Homo sapiens
MLNRPQSQSTFFEPTGGGEPNSIPNTYSDLSGHPEVYTFLILTRLRIISILELNNRKTDLGFIGMARELDINGLPRALRVFTPNIYLRYELNIQQHTYFNSEQIYTHSTRG

SEQ ID NO: 983710 - protein, 38 aa, Homo sapiens
MRAATINETTTTQQGRPTQAAAAQRHHDTRARPQTTTG

SEQ ID NO: 983711 - protein, 36 aa, Homo sapiens
TRGSTHASPLPRPSSATSLKEGWVLGLYRINTNLDG

SEQ ID NO: 983712 - protein, 90 aa, Homo sapiens
EPGSSAREHTLTDIGAGGGTSPRSPSRADSECVPDQWLEPCNVTAYNMIYADSDIGLIGILRISELIAYLIGPRYPENDVTPGQCKSLAI

SEQ ID NO: 983713 - protein, 193 aa, Homo sapiens
MWPQPAPHTPKNRTKHKKTGSFSGYNSCAEKNSRKPWAKPRVVNLFVVSSFLTSNFNREVVHPDHFKREACCSQEAALQGMCPRGSRARARPPLKGRIPGRGNVAWVDRYLQGPVECGQPLRLPTDNGCQRVTGKKTLEVPWISFLFTSSNATDLSPRYQAHRKIRCVEDPQNSAPWPVPSPSWSVFPSGKPG

SEQ ID NO: 983714 - protein, 300 aa, Homo sapiens
EEEEEEAFYEDLDDILESITNRMIKQCAGKICNWIKSSQHFIIEQPPVIGNQHNINIVCFSCAWAVLCRFSISNTISPEVVSVSNRFEDILSLFMCYKKLSDILNDKKRVKPRTKMANKTSDSLQSMKFVSSLLTALFRDSIQSHQESLSVLRSSNEFMRYAVNVDSAAKYRQLKETGHVVALMAKPRKDLSETLRHNSSLAIGDTLQFLLQWKESGKKEKGKSIYTACARKAKNKKNIQMAVKQNKRAQIQKKNTSTGRFHRTQEGNSRKTESQSNHKTETGAGKDDGPAAPIDKKGTR

SEQ ID NO: 983715 - protein, 353 aa, Homo sapiens
MGQWKKTHINIVVIGHVDSGKSTTYWTTLIYKCGGIDEQEPLKNIEKEAAEYAATRAPFTATAWRSLRLTLQQLQPSAHPLRLISPFCIIFPLHDEHSSTHPRQSYPTACTYSIIALGPPSWNHPGQQPSITPKHKTLAPLTNGPQTSINGPAHLPAIRTTPLPPLDSGPLALEPVLPRIRIPTQANTPICWLTSFPTHPTPLARTHQNHPSHPNLPHFDPPTNSPLPPNNHTQPQTTMVPQLVIPPTQQPNTPLINLTRSYPTSRAFIYTPQTIHNLVRTPYNTHTPISHAPPQNHPHLIPPHSPPQPYTLLTLTFKHYPNAAQPTTYSQAHNTNHADHKMTFLNTLTTPLH

SEQ ID NO: 983716 - protein, 77 aa, Homo sapiens
MSLIWGKPIPRPPVSTIVNPCQCCTIAGTRTRGFMNAWKDDQLGFTDNLSAFVPCARFPEAQTFLQFVQAPGRSGPV

SEQ ID NO: 983717 - protein, 205 aa, Homo sapiens
PLKNLAVAMVRRPDRSYRYCNQSRPIPKVSLAAEVSLMPTFHFGPEAEKGEKWMTFRFVPMVSDEYEQLFSEALEAVRICANNWYMDKVVAKDGFHIRVRLHPFQYIRDQQDVVLCCALIRLQTGSAMVPLDISHQAHCAARLHIGLRLSCSIRTRLQTIRRDHVIEALRRVQVSSFLVAMNIHISKKVGLHQVQLLDESDDLVS

SEQ ID NO: 983718 - protein, 339 aa, Homo sapiens
SYTKLGNPTRSEDLWDYGPFRDVPAYRSGYFKSYIMNNNSPFPEPITSMTRDHMNDLSLAENIAVEENVDCTSTQRAVLRRGLSHSYDYQRTSQIDGISSILCLLRPIGFLLLPRMFHYRDEIRQMLLPATRPYWDDSVEMEIRASLPFFGGWKTHYIVGYNLPSYEYLFIICGEQYALKMTLWHHVCRGTGDRFSDVVKIILPEGAKNIEDLIVPYEITPCPNELPTPIWTHLGALSLLPTEDLVNSAPGLVAPYPSPGAMRQSLLVVRLKLPSSRFTRSADSSPDTPNSKRTYKEVCRTKNPQSHTVDNTTAPGNAVRPYTKDYSKQARANTSDGGG

SEQ ID NO: 983719 - protein, 281 aa, Homo sapiens
MAGGLHGRAGPRASPRTRAQHGGAAGAFLQSLRTLFDYPVTDQAARLLCTAAEIESRWQGTDARELPRGVLGGLRQVSPAIGYLTFERFVAGLRTFPAERRRLPPGDPYAAPPARPVDVAAAPSQPPVVRSGSSEAADGSGRGMPLPWAVPRPLWTVPSAAGQHHEMQLCRRLTRRPRPRIPERVPDRGPDTLLSGPLQRYAGTLTGPEGDYREFPVAPVSQGPSQSPSQPLILRYHQLTTIIRRSVTMYICFLTSRKTPLCARSLNPRDKHPAISALTPS

SEQ ID NO: 983720 - protein, 326 aa, Homo sapiens
MCVCVSYIISSEDEDKRRTPQECVRNRSRERRSPLSTTPHMWGLLPRGNPILVNQSGPRLIHYRNFSEHTLRAPFFSQVVVFTPEKAGRHTRFLSIPTQVFHGNTFGCGQLMEARWCANSQSTGGPIRRGRLYWGPWNVFPGEHLPLNPLGNPACASPLGRGHISRCLPGHCCAPQVPSLVTTPLLLLPCQPPIFSPANTALTPKVSERHLPRTFSFLRVKLFVGHGVPTKRSWGKNLISSGQHEEVIQKPFTVYSVKKARRYFMISHMERDPQWWSRQQHAEDTHDRVNFCHTDTRILRSFLSLLVLILFSLSAHHTKKHKHTMR

SEQ ID NO: 983721 - protein, 150 aa, Homo sapiens
MSSGACIITKINLSWILPSVIGGFWKAPRKELGMGSLKEVHWPFRDHLWRVWAHYLVGGGGVHPVGPQRDSPQFRDFPRGNSLPQNSGELRSEQQEKTGIDGNSKLPRCNLDKNPQRELAQNRDKSVDRYRHRGRDHVQEEYPKGAGTQG

SEQ ID NO: 983722 - protein, 139 aa, Homo sapiens
MIPSEGVVHDEQHETRYVRTRLDAEDDQPPRDGKTNDTKATHHIKAIGPSRQNKETYRGRNKKKTEEGKGDRQNTKMRPIENKPPNRKARESTNEPQTETMRQNGSDTWRTNKNTSPHERGGNQGQNAPKTKCDRTAHQ

SEQ ID NO: 983723 - protein, 33 aa, Homo sapiens
GRVGRGRVGRPTRSEEYARYDSDVGEYRAVTEL

SEQ ID NO: 983724 - protein, 360 aa, Homo sapiens
MLELAMVLEFTQEDTTFPCTTTTHTTREHMTTQHLHEYPKVSHTAPHTRRLTAERKLGTLYAYKPRTNTPKASHRYPRNVLPERHTIPDGAPTDQRPTPPGRHNNNVGNIPKQAKDYENLPNHIIPLQMSHQTQDTATPSTWAYTDNRSPLAHRPAEQEHVPWPTDTRYDQDMDPHNCTTTHRGLTHKTIYKTTHQPRTIIIHDHKRGPAPPASTAAQDRGTTLQEPVDNAPPGSTNAAPTAERNQHQDHRNTRLETGTPATHRPHKRPHQANRENTPRSEKDTNHTPHERLNETTGHAPNEDEETPHHDTYQTISPHNRHTTRPTIKTEHNGPPKKEQTHTKITEETNNADNNQHKANK

SEQ ID NO: 983725 - protein, 372 aa, Homo sapiens
MWSLGAGGGSSRWPGGGGLKMDAWEVEHVECSWWCLCVARGLSDWGAVSAHSVEMPERVPAETSVAALCGAGGELGGLGAGRPDVMALPAWAPAGSATCCCPATMFHRAPGGPFGPLRACWVHPASLPGLEVLWSPRAAAAVASPGLGLQCGALPNCRRATVAEAAENLNGQESPAPYPINGFQAWLLQPCRMGMGMYSGAASERRSREMLLPLGGRSPPSTVTIFSIIIYMKAQVAPRIRPGNMEGKSGNRSIEVWQGRELSLAIGRRHTEYRKRDTGAHSGAATTGPVERRQAEQNTQQAKVGPRNRETRRNTQYAEGSDKQDTMKKRKRTERRGSKRARWTTTQEKRAHETEGRQEGRGTGEGASSRLA

SEQ ID NO: 983726 - protein, 291 aa, Homo sapiens
GRGLVCGPLFGSSRIAEDDGSCGHLLAWTRPADSGLLCCAPGSLDREEGLGQSRTRPHRNPKSRRDPSQGEHERGRSGRGAPAPAPAAMEKGPHGYGYHLHGEKGKWASNIRLGGARPPAEKAGLSSAGDRTGRTVKGEQRGRRRPTSEVVSTIPRRTQTPCDLAWEVTNPEDGEPDCETGYGATRSREEADARPREGSLGARPTPRPGRPARRMTGGGRGHNEKMNPSGRLDKELHPGRQHDDDLYDHSRLLVTSEKERGHPGGNRASNPGTEEDVTRRAVHSGQRTHDP

SEQ ID NO: 983727 - protein, 62 aa, Homo sapiens
MTGTRLDARTAHLLGATRHTQRPDESKMTSLEAAKTQDIEKQATTAGYTTSGEDEKRERKGG

SEQ ID NO: 983728 - protein, 162 aa, Homo sapiens
MAALELTLLLVTEVPPPPVLTPLQGTLHQLQTAAAMYLGQATNAPPATGAQGPRKRSMRSMRRRPARTLIEPIRLGGISSTEELDLKVLQFKNQKLAERLETNAQDLLKMNSENELSKEEKRQATDDATILIDQSLLEPRLAETVKALLRCHESQRELVFRD

SEQ ID NO: 983729 - protein, 223 aa, Homo sapiens
MVYSCPYYLCTILIDKEHRLPSTRPTSDDTYYTWIVGRGAARAETWPGLEQGSRELLQDPESSPETTNSYEYRLYETVQKLTLYGIYDIDNKNARELRDDDFLEEVLECTTEDQIVSSQVLDSPLDAENLENLDWDGETITVSAQELKDNRVVTMEVEGQKPKSERTSWEHSDTIYLEGTYRQGMIGKVEAGLYQNHEVKQESTLNPTMDTVTQEYPRISAIS

SEQ ID NO: 983730 - protein, 142 aa, Homo sapiens
MRGQLITRTRGRGRRVYQTRGGDRGRNRPTQERTQLEKKRNTITRRGRETPKRERHNTPHHTRHYKNNYTKEEKYINNYHNNSTYITCVYNTKLRKTNVTAQTKKKHINNNTTHTYDLNPNTKYILHTQESNKNETTQKTNK

SEQ ID NO: 983731 - protein, 211 aa, Homo sapiens
EGPTDPRLQKPTDSTGLLPGLPSPDLLRRPLPPPAPSGDASTTDKRSPYDTSSAWRTVNWAQGRRRAVFKLVVDEVDISLVQNAEVIPNCLEEAIAISSTNCIDEDDDTSKQGLIEGKVTIRHQAIQEAIGAELPEMIGKSRPGKPDQYNSVSACMHALWQPIYLYYYIWNKKREDVAMGMIGSEKKKYKTRNEYETYKRDREEIDRRETR

SEQ ID NO: 983732 - protein, 138 aa, Homo sapiens
MTYAGHKKFMMCHYIEDISELYYREYQSYEHIKSAHTDKSEEQSSTHIILLVTQSMLCHIGELYIRTKIIDTDISFTYEYHLYSDTVKLRITFKVNSRLGYNNKLTTIQQRNSHTNSTIKTHSTKEIDKTINHAQHYR

SEQ ID NO: 983733 - protein, 396 aa, Homo sapiens
MSGPYSWLSNTYLYFITWLSRTLDTTQTTTKNKHKQHNKTKQKKQHTTKQNRREKPWRRHAILQHTGKNRTQHAQQSRAAPPRPPDPETAQVAADPPRAADSKTEHRGGESVECKTTRNEIPYRDDKEEKVSEPIVTSHHPDKHIAQGGHIKNDQTDKDSYCIRTHEVANKRIDRTHTSPTNHHIATNRKEKSILHIYSFLPKKPGHTSNTTCTKQGRTHGTTRSEEDSPPQTPPDLGEVGKTRKEEKRGGHTAPTAPVTGSKAPDSQPNDRSGRATRATASAASTQGKAARRTARNGGSKGKHRSSKRGRREARRGREAESARPSARRYARAQQGTRQPRQTTRRIAERRGRSGMADRETGGETPTGSRIERDKEERTGREQRRSAQGDKRKEDR

SEQ ID NO: 983734 - protein, 39 aa, Homo sapiens
ELATKLSRRLQMEGEGWSAMTPEQPGSERGSGGGGGGTR

SEQ ID NO: 983735 - protein, 104 aa, Homo sapiens
MTLDLQGFPIDPGMYILPEAAGWTVRRSFIKDYPQVSIRRPRSNRDYRGALSLFRTGLDTGMWWGDNSYNGEKWNPPKSNLGPRTITKGLGGTKQSSKKGGCNT

SEQ ID NO: 983736 - protein, 285 aa, Homo sapiens
MVPLSSRHGTHERKGCSAQRMSQAEGILGIYELHHVTHPHHLWHEGEEAFTIEDTRPLAVGQEIKCQLAPPCSHMHACMSVHHASVQRGRVEAYKAQAQMDQRSHRSSVPPKGHPCAFETNHALNPFLHLPAVRCGAFGNRPTYSRKATLSERTRGFGSQYMYLGGLEESRGEIGNVTSVSRVPNRRTPFSGWAPFMAEISWIHGPTPLDQIKRRPRKLDQCLTPKVRRPETAGEGDVTLVQGICPCWHALVNTRWNNREKATELDPTLTKRNSLGMDHHRWFPI

SEQ ID NO: 983737 - protein, 104 aa, Homo sapiens
MAERRYFLATRASGRQGAKSSKKWGEGKRKWLGLNWHCACHKVLCIPQPSALPSEATPQGHRPYLPPTISNVALTPGYLWPGNEQGPVSEPRSETKTLVISTSS

SEQ ID NO: 983738 - protein, 148 aa, Homo sapiens
GGGKNYKTLFCVSPPSSLFVFSPSSVKKRVVCATTKNHLCAPPPQKFVCVGREVCAPPRREEKWMCVSLSLCVCVDTLSRAVVQFLFVCVCVSRARAPRCAIKVLLYYIFSPTHTYIFFSLPLHLIFSIYKRVCLSLCVCSTPIDIAS

SEQ ID NO: 983739 - protein, 556 aa, Homo sapiens
MVELKPYRGKQGQNNSISEVEKSKNSAVGITHAGYNVHLSSGLLFRAPSSPDQSALCHSSPHLRDNTIPQFNSGPLSESFIILSQQINHNPIIYTPFVDSMYYNTPEKRRHTQCSQLLPITHSGASTHSVSQNSNTAQHNDRASQRGANKKCGPPLHKVVTQWLNPKLNATRDSPRDTMGSPPNWNKAHNPLLICAVPPVDKRAYCYHKRSRYKEYPNVQHLLTQTSGGEKKHRTICPGRKDTPNENPAHHNNTHSRPTTQRRTQLPKHRPRTLDNNKRKTPPLKPHHRKKPPKQRRNIHEATRSTRQRPTHPDTPRRHNHTGRRPLASTPQARRGPHTHTTRADTIHTPTHHDTTSSSTTPSTIPHTTPYTDTHKTSTSRTNTPQAQTNQKQNHETTNTTQHAHRQAITEQQSPPHPPPHTNTPHAAHNTHEQRLENSTRPRQLPTAQNAKPDNDNNHTTKPHTSDTPKPDATHTHKHNVDTQQTTQQTTTPTTHSRSENRANNPHTRYELSSNRYRDNNTNTTQTELGRNTHTAHNDTIEEKERQHNNNNDTHK

SEQ ID NO: 983740 - protein, 443 aa, Homo sapiens
MLNDMKKDESQRGPAAVQQHVHVPYTRTSDILFADIDGLYPAVILPAGAQELADACSPRLLLPAFDPLGRSIPTSLLRFTDPAAHLLLTASRGLPASPPAHLAVLLHSSIGRSPIVSARPPSLSRAPPRHRTSRSALALLPRSPTPPPPRRLPGGAPWLPPPSRCHPLSAPAALRTALSHPPRPLRHPLARDPCRPTSPCDTPRSPTRLRSPHHDKPPPLPPRPSTTPTDSLSRTARDPPHDAHMPDSPSPSYACTPPPPHAPQERPRPTPPPPPQPRPKSHPVTLTPTATPPRPHTAHPPPPPPPPPATARPPSTPPHSPHLVTDNTTERHTPSPTARTAPAPNATRPNHYAHHTDNRTRNRNGNRPTTPARRPYPPQQTPSTARDPSALYGTTNKTHKHNAGHTQAQHATPPTRHQQPDEHIPTTRPTHRQSRQHTPSTRK

SEQ ID NO: 983741 - protein, 234 aa, Homo sapiens
MRPRTNPLQKNAGIKQSTYGQHYNECAEHNKRVRPKTTQSTETKQKRRQTIQHVKHTNNSYSLNQRWHPPKYRATDKWSHTNTKTNLTGAYEQASTEHNQAPYTTARTTQMMYPTTEHTGKEHTLPGNDYTPKKKTNNKKAFYGSNTEKYATSTLKLKATKRGTTTQTQPIMSQSRAHHQTVAKDITLARNNTPRDQPPHTTTHTRSTKNPEKHRNTNDAESAHTPTAETLSHT

SEQ ID NO: 983742 - protein, 99 aa, Homo sapiens
MTHHTSDKQASAQVRNTASPKTTSEKRYPARRGGKGEPRHKQRSTNQKKTATPDNRSTSAPRDTEDDNQNLECRKQPRTDEPNATKSHAGSTNQHDATL

SEQ ID NO: 983743 - protein, 103 aa, Homo sapiens
SGENIFLETPPTENWSRVKPLFLLEWVFSGSQKCFFSSGGSGSGRGPTLGGWCTVNFRVNHSTRSPPFRSAPDKDWGRVTPRFLGPHQTAFTAMTNIMGHFHQ

SEQ ID NO: 983744 - protein, 257 aa, Homo sapiens
NPFSVKNRKIGRAMVVLACRPSYLVGGGKIVRARNLRLECSGVISAHCNPDSWASNDPPTSGTQCSWDCRVTAPPMPRLISSVFTIEMASSDKDWPRNGLAAPATHPDPPASDLLRCWHNTARPNAAKDIAEILPKKHYTDPRWRDTHTNRRAKAHTNTSQTATAHHAPAQNHRMTPQHTKQTQTPPRQAPEQADKAPPAQKQSEQRQKTRHTHQNNNQQRHNTTHTRKPSTKPTHEHEAQTRKTKPNKRNTKKRNT

SEQ ID NO: 983745 - protein, 197 aa, Homo sapiens
MDEQSKAMQGPPVPQFQPQTALRPDTGLYYISQLLEYTQNHWSRTIQLKLTRRSPALLRCELPSIAYTPHRLHHYWDSHCDCHKALLTALAFTPHTSHPFFTPHLQPHSHTVPHTIFTAIHPTCTHSMTLNTLTYPDETLRHSTRPWRGTPLFPRHPAFQRTLLSPPHPNKRRALRSPRAPKPGSRAPLISTYQAIM

SEQ ID NO: 983746 - protein, 192 aa, Homo sapiens
MKTPPQPSFTRPARTTPRANPPSQQTALSPPTRPGPAPPISTSKTTTHTETTHKTRAANPHTAPPTTTHTSPHTTHNRAGNKKLRKPPHHQERSPKKDFPVGHADNQTLCSKDPKTIQLTHDKEQNTYTNPLPTNNLPEERLQTTHRATNSELSRHTRHTNRDNRPHHRGTPNPSPYTPGPPRFPAAQPYDA

SEQ ID NO: 983747 - protein, 184 aa, Homo sapiens
MRHRASNAQLYIGLRPQRLIPLAAYRANNCALRTNIRFGHLRLSPTTRSANTTQFDPSCRFSHTGSGNLWRKTHEYQTTHLADKQSDHLCDQTLATQDLEKQPPQTVPFGHFFAQGRRFHLWDTYCDEVSHVMHKPQRNDYWVHQQTIRDKPVHSTSWLAPPYDTSYLPRATYRSAKPQNKNMG

SEQ ID NO: 983748 - protein, 217 aa, Homo sapiens
HASPSPGPAGPAAHATAPLQAPSPAPYLVIRGGKRAGRAKRCAADREKPETGRRACARVTHASRRRHPRAGQPTHAASITALGNNGTRAREVLAADAAPGGTACRLLSRLLAGRPMNSASAWTRHSANPSRITGPSTQHPGAHSSHRRLSNHSAFLSHKQPATRYQQYHLTENAPQTHQDCPLTTPTKLHNRYNQPTRKPLHADTSIINNTHTPKRH

SEQ ID NO: 983749 - protein, 385 aa, Homo sapiens
KDYVSKCHAMHRANIFQLKVDIILHKHFSVKMSLPHSQRQQQATQALQAAIDNKALGLQQLSKLLASQRASSRTSSGTSIMLATHSRTKQGPSQNFPREILYSQCSHGDHISSKQNLSSSIYMLHHKTYMHSPKLSQGHKGTYGQQASKTMPNSHAQANSPTIRHNEHHQLAHLHPTPRANKRSYQKAPLKQQPSLNLCSSQSTGSMPSGYQPDEYTDTPPLANTTTSIQAFMAHTQRSSQAEQQLIPSRGQGLPQGNTNSAARPTNQPTDLHRLAARTLTITSITTHQKKGKSTKKHRKISKPKRPTDPTHTTTRQSTQQTAATEASEKGETQTQNTQTTQKTQNPRPRETQVSTNKLTPRPHKHPTHTNTQQKTQTTKTHTQT

SEQ ID NO: 983750 - protein, 138 aa, Homo sapiens
MATSGDPTRPADAKGVKPTALGCTQGERRKQPPREKDAPPPERGNQLGRSERHSKIGIPTPTKRRATRGKPPGAHALPREANKGSAKKHTRGGQQEHEAQHQIGQLNKKNTRQKTESTKRKQQRRTRETHTKIRQNET

SEQ ID NO: 983751 - protein, 245 aa, Homo sapiens
MWEDNTPAWKSTPQEATHIRRPTDGRPLPQQLSRGYYPRGAGNSPNTPSQIITASADTGKNSTQMKTTRQSGRPSHQHYKTTTKGRYPLQNTQHNSHGYSHPTNNSAAQIDPPTSRPIKRRPPTTRSRGMHNAEKSSPPSTSRQHNERNYEYAQRTHRYAQRVIQDTTRRQLNVAPPLEDKKRNTTIEHTQPNKSAIETENRYAQHRITHNEAFYDQPEHRSYTRTEASSKTRRNQTPTQVNNNT

SEQ ID NO: 983752 - protein, 474 aa, Homo sapiens
STLNASFYFSGIKPLCGTHSGSLSPLHGEPRGWWVSLTKGGSGKPPVYRETWGELQLFLSRRSRGAQVYRDRLYKNVASQRVALGKVVPRVWQCVSPGLEGVSSSLDYQPFSERASIGHRCARRTRKCPSVPPVGVPGNEEAYTQRHRKPARGARVHTFARGGTRWWALAPRPLGVPPQGYASCARTGGGTRCETTLVAPQRDMTGAPQPRYMRRCEPNPITLWDDTFISTPRTAMRWRQCGVRFPPEVSQKPKCALLEHPVGYASRGPRDTGGLDAISCATVGPDIISFQKNKPLRSPAGRKRGAPPQRGNGNTPPQVEPPPRENAPLTGRGHAGTTGGTHRHRPPRGGTLGQRRSQWILWNPKERGPKFVGAEPAANYSTTLNPTRDIGPPRKSIRGGHGGPTEPPAHKVAVNPRAPGNDHAARTPYGGNNSGVYPIPGGQHGHHEDPRDHGTYYNERRGVDHPTEQHKRDD

SEQ ID NO: 983753 - protein, 137 aa, Homo sapiens
MRVENVVHYNILKNNTYYAEGTSNRVTPTYMGDQAQNSPHRPATTKPLTDPHQPQTHKRVGENQRSGNTPKHEARNHREARAKIQWGEIQKHTRRVLQRRAHPRRRRHTQHKHETTGRRAPAQPAEKERIYPPTQQG

SEQ ID NO: 983754 - protein, 338 aa, Homo sapiens
MLAATGDGVGAGEQDDASPFCCRNLSSDRRTGSGAQETAAPGPVQIRPQRSRESYGAGTHKGQPGAEATEAMPAEPSETVQATGQPSGMQARPRGAKHAPTRTKQASEAEDRIDRGSQTRVTRGALHSMHCMDKQTRMDYPCMGNGIPQDHIRPPLQHLTTNRQRAQLSLFDARWSTRRLHDPTQPAMAHPTMMPSRYQREMLKDSNPRANTHQAYQSGWADDASRQGSWEPSKLHRTKAKATRMTGAPSDGQHGQMEPQVDPLSKGRRRTRRDGEHHIHSTPTRRHIPQRLGNQAPRKESPTSPREADDETAKTKEQQRHQAPAPQGRKDRHRKRTE

SEQ ID NO: 983755 - protein, 218 aa, Homo sapiens
MKEEEREQKKPTHEGPTKTKREPKEQRTGEETKSKRTNSTTHKRGRRRERDTRQDKGHTRREKMRQETETETHRGARRAPHQRKPHSHTGKETKTTPRTGEKAGRKPRSVHTQQGDDESARKTDNTEGPGCNAKARRTREDTEGAEARRCQTQNEQQEKKNVQTRRTDIARTGEKRRRGRASATSNDMQRGTRGDRGRQRQRRRRRETTKARHEIAET

SEQ ID NO: 983756 - protein, 150 aa, Homo sapiens
MGPLFMNGLHCMRMDTEIGHSEHEKYARHPPHTGWMGYPAGFATVCQQDEEVKSTLSMLPMMLPGMADCSPRCLVSGGLLRYHHGKPPALPHAHGVSITAQRHSGTDSDYEKTAEGQAEIANDVNHQNTIQTEDNALDPGSNTPASGYEA

SEQ ID NO: 983757 - protein, 421 aa, Homo sapiens
MVERGHTVAAKDEAASFDLRRFLTQTAGWMARAVCIGSVDCGIVIRPSIIWMQGYTQMPHEDLRQTVLRDINTRTQDAMPHMSQCHQGMLAFHGPSALSSYGGRRDHFPTDQTTTTRTAKYLGPYRVDLLYLKLSRDLPSRYKSGSLGYPSTKPSEAHVTRTPDRHVHAMREAALMLEGQRQYTISGISLFTSLLHEEVVLGLTLSLTETTHTGLGQLDRLTIHRTTARTPTSRDPNTLPHALPYPRCTSGAHHNYQTDPTPYHPSNSGRHHRRGVPKPAPPWRYLDAGRTKRRRTGAAPEQRHTHTAGPGARTTKESPLPANQAQSQAHKHTRDHPPATRSAHHTAKTRAPTTHGPERHHRAPPNQAHGNPRDTSYGRPTTPGTHYHQRHNHEHAPQAHTQQTNKTIRTPQRTHQARPRH

SEQ ID NO: 983758 - protein, 252 aa, Homo sapiens
MAGRISHKTDERSRKESLHGHGRACLEECAHTRGPSLANKLPWRGHVSINKSWNTWHRRTAGKPVCVYSHRESWSKVHAHLFGEHTMWNATLWLEALIEVVWERKVRVLERRFAMGKTKPKGGHRMLVTRHMSELKYTKVRNGFKSICDIWDPEGVAIWIPLRGLWVVSFWLGEIKDIGVLEELYGEKGHYGVTTSLTAEKGIELVAATKVNHPENLKAPQLGHTRSYTIVVGNVTSNQIGRPLGVRELGLG

SEQ ID NO: 983759 - protein, 137 aa, Homo sapiens
MPRPAPRSFPEHGLSGSHLHRDEASEVLAAAGSGAGDHQFAPMRMDSASWVWEFASRGPVLKRRQPEDEQLLLGTGNEPSQLLSPCGLSCRGHMTSHGADSRSEWSRRTCELVNCGSDTYRAADVSLWTTNQLPGMN

SEQ ID NO: 983760 - protein, 172 aa, Homo sapiens
QVSGRLPLKSQEWERKRLSINDCQSLETTLVFGAQSTHILRHHESIRCVLAVDIKNQLKRTYDDRRRVWRNGSSVASILEFIAMRLIRIKTVKTCTRATVGESDTCVYHPCDGKIMRPSARYLVVEHNHSRVTTQGSTMKHIIVNRDTEYTRGSDAREHEPSAMIRGCLLLD

SEQ ID NO: 983761 - protein, 109 aa, Homo sapiens
MVTTMLEPSANMTLGFTDGKSPVKDGHCRWKHAALRLWDWILSTYSSNLTSPWAGDLQGCSQKMWGDVSSSRIGQNDRRSVSKTRNVGHLMFKTTVNRRITFKRPKRLR

SEQ ID NO: 983762 - protein, 185 aa, Homo sapiens
MPRGEGAPRNSASQVPPHVGTSLETKVGLTNLAKIQIFQGGDGDSPQRVPPRGGGGKYKPLRDICALWTEKFLNAFTKVAPWCSPHANLAKAVNYMSREQDRKMNHTKRRHRYEAAEKQRQRDHIQEKTDGRHKKTASNPAMRHDQAKGEISAKPSRGVRKKDTSAIGEETTRGHGPTLHRDRQG

SEQ ID NO: 983763 - protein, 153 aa, Homo sapiens
MNHPICVGSHKVASTQWAVEVFQPVSSAKESHPGRELYTITCVGTPTPDFEKVHRDVEIDNNKIWLKNRTGTPVAVSISEGNDTTKRGNGDRNRQDRKKKKKNKTKNEAHNEHKLTAEIHKKRNTKQESERTNKDNRNRHAPRDNTAREKNPN

SEQ ID NO: 983764 - protein, 261 aa, Homo sapiens
VREGGKRTAAGRLGAAAALGGAGLAGGRLSGTHSPCALALGASPSLASLVSWEPRGPGCWDLVLCGLPYEALVAVPRVALPRGACAAPRRLHCAPCPPGPAAGVSCCAHSCAVRPPVRRLRREDTGSAQRVRPLRALTRGPGASSVRQLGSTESALVMSPECPGAERRAAHQFAGARGPVRPYQPGQVGERGCQRGPGVEVSRGLPSRARGTRAPAFPVPGLPRLLARRLLQRAQSRDSASGNLPAEPGVNAAKPDPGLHF

SEQ ID NO: 983765 - protein, 275 aa, Homo sapiens
MWYVVYIFSETDKRRTQEGGLVREKGFSTTHVGLARGNPFQHKRASYHARSLREILRAYLSEALLHQKQRGINPYSYQAQPTLGYAKVEPVCANSQYQGGHTPGANMGLGLGSREYITLEPVEDQVGITIGGATNGVVTQAGVHLKKQLGGTDTQLRAHLVSPTLGSAERELDAKHQRGSIANEMITPQGYHSNRGATPGVRPPQGADEKHTPFDCGNTEEKPKHPVVKPRQKGPREPQHTAEVAAHKKHHVSVKSHQQDPTQDRCSTSERNEWS

SEQ ID NO: 983766 - protein, 378 aa, Homo sapiens
HTCQSVSMPPAPVVLSAMAAFFRGQTSRSRPTRPAPPLHAASHPACTGMCDATHPSSDTHATRVPVAMPRNCNTVYDNTQHRVIHKLLPQVTTTATPLATLEDSDARTQTDNLPLATLHEVPQTPFTSTREWLDSQAEKLKELDKEIRPFRQQLGRKQTAMTEQPWQSLQNRVTELESVDKSGGNVARNTGLLESQLSRHDQIRSVHDIRLADMAPALPGPADRQLQRSAHLATIATYKRRNAARPATPEHPDPYTAQPFYTGYLAYTMRAHAHPDPRRLGAQRPTAPLNTRPHVLATNAARHPNTANANTTTTPAALRPPPPTEAIAPPPPAGTRTPPNTIPTNTTTPIYTALLTTHHNTSSTPQPHPPPPNHSPPT

SEQ ID NO: 983767 - protein, 189 aa, Homo sapiens
LVLDRERAPFFFLVGNRVWLGGTGWDVAVDVWISGSLATSAWLGVQRDSTGAQPPGVAGDYRHCATTPGLILGILECKTMGVPPLLGQGWVLELLDLGDPPGLGLPKWLGDYRVCGRHWDPGQERKQSFKPLWILWPYQGFSPRQILLWKRYYFPTILHYFPKGGLVFVVNVERFINFGDWREILFSWR

SEQ ID NO: 983768 - protein, 341 aa, Homo sapiens
DGCVCKQSYMEALQEFGPISYVVVMPKKRQALVELDDVLGACNSSELRSRQPKYTLLVTQAICTISLVTSYQKIIADPGDSDDSRSVNSVLHFTILNPIYINTPRIVLYNTTLYILSGPCPENCHFPGKNGRSGASVAILTSVSKDASSEDPRASSSNRGLDHLILGLYAHTAQIDIRQQPTTAGTVYNDMTHGILYATNTKTPTFSRWNKCRPLWQTTPPDNTASRQHHLLASARIKTRHDLIGTAPHCRRTHQDHSTIGINGHYRERQTRTAITSTTKVKPKDTETKTQQRESNTTRAHRTQPLRYENAQGTEPPSTVDTHTARQQATDQHQQPTAQRS

SEQ ID NO: 983769 - protein, 128 aa, Homo sapiens
LPPEQPGVVKTTPSELPWERTRFISTIVVIGLRRFGDVHHYWASDLSVRCASDRRKNSLEENFRGIGASVSLVPHGHKASLHRYALACLGIERDKAARRESSGKSTSLISSYGGKNLETRDKVCDDWT

SEQ ID NO: 983770 - protein, 101 aa, Homo sapiens
MKVICRYVVHTSNPRQQSRSNHLYYTLIKKKAYRSFITRTILFPLGSKIIKQFVIVGKPHGPLERDFARILQSNLHNTFKQVISNPFMAFPFEPLSRGKAH

SEQ ID NO: 983771 - protein, 67 aa, Homo sapiens
LCRKYGDLIDKQDSYSMGGSGGMGYPRIEWRMVEEGGDVWVVAQNRMTLIQLKDTVSGNGEFVVRRQ

SEQ ID NO: 983772 - protein, 440 aa, Homo sapiens
VRPSGGGEHVSEEPEIGPEYPPGPAAIAGAVAQQSHRTKHVGTGLVSISRISVSRCNTEPNGPYTCALAYWPHKDPVIRDEKEALYALTVLEMCNEPRVGRSSTAQVANISYILNELIKVSPQQYLESPGPQEQVTRHSVIRHTLSVGQSGIPEDITDTRRLSDAEETKELYNTDPTLPGGYKSIPQHRPWPKSSIILMLMKNSPRLLTRASKEQAPRGPSGLQNRVTSTEIRARRHTHTHSEQGDPRRDTSEGRKQRKTMIHGHRNDQSRSMHPQDHRQRPRPNQKTRQSEIDTQRKRETTPDTHGTRTPPDGPRQHRRNSDGRVDNTTGAGRENERDRQHTTANRGRGRGKTRDTKNKRRKRRLPPPKHEGNRKKGGQAEQKQQTGEDRENTANTAKARQGACSSSTRRQENSNARTAARGTATRPGRTGPKSGQTTQ

SEQ ID NO: 983773 - protein, 309 aa, Homo sapiens
RDAWVDHASESAEPGRTRLSRVSNLYLRTFSPALSRDHAPIAPQRMVSGWDAHCTLGAHDEWQGTVYTACHTLTSRSISRDTCAGLSPAARPGAPELQGVPSDSMEKTTHPEAHVDTQDTKYISWKGCFIAELWWMRGASLDKHLDTDWTSCGPEARDWLAMTPKTSMAATNTKFQVAHWLGLCLALVTRALTQSLYNVIKIRFQSFPGMSALSRTVTPAQRYHGIPPGLYGQILQEDGSDQLPVATGTRSSSRLHSIGLSQPLPKAIAHSPHRCPAPRSTEETAVRPPRHIPMHLRHSVARTPNLPPY

SEQ ID NO: 983774 - protein, 174 aa, Homo sapiens
ERIAGSAMSSEPARTTTEHPSHQASVGLLETPRDAVSGSPSASAGQRGPKPIAHSPDEDLLGRRVRASQGPRSTKEFCTYANVRGSKGALAYQDTPSMMAGPRHLSPATSHDWWTGEIVSQWEGDEDHHNKTDDPSPNPKNEKLQAGGGSYIYLRLVDHGYQWHESWSGHVIRS

SEQ ID NO: 983775 - protein, 395 aa, Homo sapiens
MCEYSDGQAEKWGDDCHWPEAGASGPKGSEAHFSETEWACDSAEEDRPGHRAAPPLLMVMSIHEKVASTSAVLKAGQTECFWQKEQHKQRSGNPRCLQFEGGERTPHYHPRHRKAVHLRHQGQDTWLGLQTLARMSRRTRGPVERAASRERRRKAEGRSRSQPPTPTSYPKDRGRRNDGRRKPEDRMKSKRRKLRHENNTPREGIHIQERSLRTNPRGSSHIRVAYTEDVRNTDQDGKSESEITEQKKPEAAEKEITAIAGEHRIEGNVISQQNDEQYEGETAGRWGQREAKIKGGGTTENGKQDIKTTTNKHTTDQGEEERNNGRGGVQETEKPREEWAVRGGRGTRESENEDEEHAEEGRGEEIGEREREGRKRAKNAETDGKRTNRKTKADA

SEQ ID NO: 983776 - protein, 164 aa, Homo sapiens
TWRKTHPGLTLKKPGRVGFKEKRQHPVHMATALAKTHSSGAKPQPRPGPYQGVRVKEPSEENCVRRKRGHASSGAATLHHTGGGAAHHQHPWTDHTPSRWGPSCLDMEGSVICSDRGGWPDVPVWFSQPHPGTTVQTARESPWVALHQSMCAYEACQDDPHTRD

SEQ ID NO: 983777 - protein, 405 aa, Homo sapiens
ISVDPRCRVRRERRCWVVGRRRAGCVCVSDDPRYGVRPERVCGDLSRTVSEPPLEDVVFTAALRIRRLVSAHRASRPALCPPGSHLGTPRPLVLPLLAMVSALARPRCSDSPVQVPCPFGWETCIIGLKTSLRFIPAPARAQTAAAVRRRDGRARGVVSVLAPIQRERTAQPSALHTDSAGRARSTTDRTAGQTGCSPAMEANTAAGGRDGAGVQSDRLGIGNDTGDSAPRGKPEHGKDPGTATTERRGPEYSRDGDWRQYVKPNELKAEHGGTTGPTRIHENTEEEDRKSQRNHKDNRKKTEPEQEKNKRETEKSNRQKREHEQQENNKTTKHEQGATEKNHESAEREERKRREKDKTINRQNRRKSNDKNEQQNERQKIDESEHTRRDDKTDAHKRHDTRDQL

SEQ ID NO: 983778 - protein, 47 aa, Homo sapiens
SDHLIRLLGSQSAVDYRREPPCAANRRINSPFEVLVDIDSRTVGQNI

SEQ ID NO: 983779 - protein, 42 aa, Homo sapiens
MGRASVDIGGGVVGVMSKKILLIYSACSGVGLMTGCGSRDIR

SEQ ID NO: 983780 - protein, 74 aa, Homo sapiens
SGCKVSRCCSHAIQSGLVIASYEWTNDPPLVLKEAASGTCDTTMCLTVPLPPAQEPRTCATIKALSGTCRPATQ

SEQ ID NO: 983781 - protein, 78 aa, Homo sapiens
LAVRDTCIQRTLASRDTCIQRTLRIQRTLGIQRTLGIQRHLASRGTWHPEDTWHPEDTWHPETLRIQRTLGIQRGNEL

SEQ ID NO: 983782 - protein, 64 aa, Homo sapiens
LSVPSVPKIKKYYSHTDIPAYPGEPRIPEPLVPMCSGMRSFSRRTGAGTIGAAELLTLSEYLEE

SEQ ID NO: 983783 - protein, 74 aa, Homo sapiens
MAMRALGFLCGEQIKGSKVRSGDKCEEALINIQPRHNKSLGQNNSRGMVRFSIYQNEDIGRNIKDESLSPGRVH

SEQ ID NO: 983784 - protein, 164 aa, Homo sapiens
MAVKAIPLAVCWIVIIVLLLPASLEVMPALNWSPSAPVFSGSQNGDLVSSCCGHTTAPEPSRATKSHATSIKTVRAMLSPLVLHAVTTCPNRRTCLVPCDGTWPVMYFIGLKHRPLMGPSCPDKTSRSLPVCMDHTTISKASCAPCRGRSHRSQSNRHNRRNWV

SEQ ID NO: 983785 - protein, 95 aa, Homo sapiens
RMWQDWAHLHSPALKRMWHQALLRSGDRVRMDPPCTNTTAASTYLNNPYGSLAVWANAPWLTPVIPALWDAEAGGSPEVQEFETSLVNMVKPCLY

SEQ ID NO: 983786 - protein, 193 aa, Homo sapiens
LDGSSRMQVSKQSRMTIAQKTMGRENPGDTHRVQKWHRAFPRKKRKKAATCKQELPKLMDLHGKGPTVEKPFKCQECGKSFRVSSDLIKHHRIHTGEKPYKCQQCDRRYRWSSDLNKHFMTHQGIKPYRCSWCGKSYSHNTNLHTHHRIHTGEKPFKCDDCGKRFIQNSHLINHQRTHTGEQPYTCSLLQRTL

SEQ ID NO: 983787 - protein, 30 aa, Homo sapiens
MAICESSSYCSLSCLVAIRINCANRVKRLC

SEQ ID NO: 983788 - protein, 40 aa, Homo sapiens
KSARYPVRWPNTVRWPNTCRWPNTVRWPNTVRWPNRCVGP

SEQ ID NO: 983789 - protein, 108 aa, Homo sapiens
TINTRLTDRWSYQTTYLTRSSSYIRREQMSRTTSEVDAHNCSCHKLESKTTSRWRREPGMATKFQVQGLQCSFLSKPEEGLFKVVVTFGRNVVVLKILLSVDDNGYRL

SEQ ID NO: 983790 - protein, 107 aa, Homo sapiens
MGFVFVMESRSVTQAGVQWRDLGLLQPLPSGFKLFSCLSLLSSWDYRRLPPHPANFCIFSRDQFSPRWPGWFRTPDLVILPPWPPKVLGLQHWREPPHPAHNLLFVW

SEQ ID NO: 983791 - protein, 83 aa, Homo sapiens
LPSTQSCDEKVWCLIVAGGGGDDLIAMLVDSASLCCRQRAIVPLVCFSTLSRSCVPPRVTGADDLQYPVMNVSTFLDCVKGDP

SEQ ID NO: 983792 - protein, 33 aa, Homo sapiens
KAHTPSDVESIGRILPLLISSLPHDNIHAPSHG

SEQ ID NO: 983793 - protein, 67 aa, Homo sapiens
DVYSATAVHASLDKYLSRLWAPLLTSRYLLSWSHGRRVFTTAVHASLYKFLSTREHCADLQIIVKLE

SEQ ID NO: 983794 - protein, 63 aa, Homo sapiens
VFSYMRCMAPWTSSWRDVSTVADLQISLSGAMVDVYSPPAVHASLYKFLSRREHVLTSKYRYS

SEQ ID NO: 983795 - protein, 38 aa, Homo sapiens
MHVLMYGKKPRKMNSKFGSCGELMNGEKGNGTLNDRIR

SEQ ID NO: 983796 - protein, 55 aa, Homo sapiens
VYNVGTHSNPVEDINWMQLYTDPDEFRANHQPLDVKSNKIHVVHSGLTFNDRIRR

SEQ ID NO: 983797 - protein, 89 aa, Homo sapiens
IHIMPRTHITLRHFKYLICYPDYYLDYSYISLPPFFPITKPPLRPPLDIPPPEPTSIRHLYSLLWRLIMHPLPSHGNLIILTPLNDRIR

SEQ ID NO: 983798 - protein, 37 aa, Homo sapiens
MLYTYSQEAARASYMWALNAHMSDDILNSRPTKIFDE

SEQ ID NO: 983799 - protein, 132 aa, Homo sapiens
YRGPLRGIVVHVYYEPSGRFISQCGDLTYYPPVRCNAPIGTTVLALSPFRQFQRYHTISAGNPRSSLLLLMGLSFQTSLLDITLHLESIMREFLTFARSGPVNSSRRYQLYTYSQVVYVSSYTLGPYRHMSD

SEQ ID NO: 983800 - protein, 33 aa, Homo sapiens
RGIAHAQRLTELTFHAEGPQLTTSTGAVQIEWL

SEQ ID NO: 983801 - protein, 77 aa, Homo sapiens
MAPSVIIFPYRSRLFSQLLRAPFYRLYILLPSSTPDPSILAVNSCITYSQAAARASYMWALNAHMSDDNLNSGRRKS

SEQ ID NO: 983802 - protein, 157 aa, Homo sapiens
MFEVLLDLNSVYEAYNEIVHLVEESGHLDCLEEDYVYLSVAVDVACYAADLVQFEPVHLFDGEKGDTVGVLGYLHHVLQQKHYYYFQLDPQGLARQASPEQVVVFAVLGVPRPVPCGPGPVNSSCRYQLYTYSQAAVRASYMWALNAHMSDDNLNSG

SEQ ID NO: 983803 - protein, 41 aa, Homo sapiens
MRLPGPLVLRVRFAPSSPYLAIKPSAELLGLFAELLSGNRT

SEQ ID NO: 983804 - protein, 43 aa, Homo sapiens
MQVLLWYRVGCRVCSIPVERNAQTSNFGADGSSLVGFPSFYSD

SEQ ID NO: 983805 - protein, 43 aa, Homo sapiens
MVIGNSSCRYQLYIYSQAVHVLATCGPLSPIMSDDNLNSWPTK

SEQ ID NO: 983806 - protein, 54 aa, Homo sapiens
MAPAVAWRPCVVPSIQADPSIQVAVNSCYTYSSGGRTLPSNMWALNVPYEDDNL

SEQ ID NO: 983807 - protein, 57 aa, Homo sapiens
MTCSMDRNPNEMFKFNEENYGVMTTYDSSLSSYTVPLEQDNSEEFQTEESCVLAKFE

SEQ ID NO: 983808 - protein, 42 aa, Homo sapiens
SRISSRCIGGADGIRITEFCHRFLEGKIKPHLMSQELPVRRG

SEQ ID NO: 983809 - protein, 64 aa, Homo sapiens
QYPSMHACLPVDVYSTLLVHASLNKFRRKMSTDADLPNIVKAGARSTCIHHCDALPPCNKYRRP

SEQ ID NO: 983810 - protein, 46 aa, Homo sapiens
THSIQRPKSSKQNNIIFLNKVHATVIGYKGCDLLAILGMNNSGVPS

SEQ ID NO: 983811 - protein, 56 aa, Homo sapiens
RGSRTVVHTCTVVHTWSLYRGGRSIGGDEQQCRYEQQCKYEQQCMYEQQCRYEQQC

SEQ ID NO: 983812 - protein, 47 aa, Homo sapiens
SHTQYYGNTTVIGVLDIYGFEIFDNNSFNNFCINYCKCETAVSSPLS

SEQ ID NO: 983813 - protein, 47 aa, Homo sapiens
YTSARPTFVTVNDYGSCPQGIQATGCIEVRGEGSVLDQKARGADEER

SEQ ID NO: 983814 - protein, 66 aa, Homo sapiens
RAGNDSNIDSSRPCSPDTHARSAAGDPGGQLHLLYLSWPPFLSGLPRGLPAFTGALFQAVPVRRPG

SEQ ID NO: 983815 - protein, 38 aa, Homo sapiens
AIHYALHCCGLAGVRGHSLSQSICPNEGRTRKPSPVKS

SEQ ID NO: 983816 - protein, 91 aa, Homo sapiens
MTHSCAGCSICVIFETILSEFKTQIGTNWTGRGSDTKKRIPGEGGSCCVRAIVESHQFHSDATPCILSHFLAPAFLQELSGVNMTKEQHFP

SEQ ID NO: 983817 - protein, 87 aa, Homo sapiens
ATSDRVITHSERVPTILTEFPTTDRVLTSERVTHTLTEYLTSELSSPRIRSDGDGRLRWSTERYRDLIPEKPVRRTGKKYSFLSEGQ

SEQ ID NO: 983818 - protein, 35 aa, Homo sapiens
AVLEDPKYALTFRIEYKYNIKYAWTSRANGTRSEV

SEQ ID NO: 983819 - protein, 118 aa, Homo sapiens
LSIGRLVSTPTRWRAPSGSSTHCPALPGLPGALQAGMEREQWRGTVPRFCAMKYDDHLHKFHENDKGAAAGDLWHVIPRALPRDSDGCASTPTGSVHLIHYDSPEESLMNNAESAASG

SEQ ID NO: 983820 - protein, 98 aa, Homo sapiens
WWEAPLISLVIRPKNDVSSEFYAPLVRALQQLEPVYNSLAKKYNGAIQGSVLYALMYVTDNDVPSDRYKVEGFPTIYFAPSGDKKNPVKFEGGDRDLE

SEQ ID NO: 983821 - protein, 55 aa, Homo sapiens
AADSELVLNVKTAIELREVKHCLQTVWNKPTVKPLSCDICNDVVTAAGDMPSPLH

SEQ ID NO: 983822 - protein, 37 aa, Homo sapiens
ESYNQKYVDEATKKEIKDIHIQYDRTLLIADPRRCRV

SEQ ID NO: 983823 - protein, 47 aa, Homo sapiens
SCHDLGHGCVWLRAVLSAHLHGGSSGLMLACRFETEKNNGAGYFFGA

SEQ ID NO: 983824 - protein, 83 aa, Homo sapiens
PSIDCTCDTYEVPNNQHVKVRFKLLLPAGALALHAGTCPMDYVEINGEKYCGARSQSVVPSNRNKITVRFHSDQSYTCPGFFA

SEQ ID NO: 983825 - protein, 48 aa, Homo sapiens
TIKVSARQTLCSTHAHTKDNEMQNGGCQALEEVEGSESQCLMGTELLH

SEQ ID NO: 983826 - protein, 145 aa, Homo sapiens
AEVIQRIQCTPQQQHGLTMYWNHLHSSHGTGKLINEQQWVLKAAPKWRFGFQPPSDSPVRRSKLQMGRRQGAQVAPVSGGCASSPPSQPSALCQSDTLKCLGLCFSVWFGKQQLHRELGVLLLPFHRGTATTSSSRDAPELGGHT

SEQ ID NO: 983827 - protein, 71 aa, Homo sapiens
ISSATPKTGMRLQGECANNTPGIFTSLETSIFKKCKKDRINSHLFAILIEQLQAICLNMAGRSPLSFLLHS

SEQ ID NO: 983828 - protein, 42 aa, Homo sapiens
VTLAGSFVIPFVGGVQEGWRLILGAFPGSSVLGISAPLGRAR

SEQ ID NO: 983829 - protein, 131 aa, Homo sapiens
SSRGSLSCQRVETGLELVYRTEVVKNNLNPGVGGYKVSLSTLCRCEETRPLKCLVLGLRLSMESTTSSDEFSTTFEEMLKAFEEGAVPKCACVNTKYKHEETQFITNSESGRPCADLKFHMGATPSLDYIM

SEQ ID NO: 983830 - protein, 69 aa, Homo sapiens
FELAVQRKIAPLRSSLSDKAIPCLKAIRKKDRAKLDERGKWVGIEYRRTIICPRKVPLFPHLSLLWRRS

SEQ ID NO: 983831 - protein, 113 aa, Homo sapiens
VPCTQSWPVPDFTRILRVCSVVMSRTPRSYELSATEWSREYSRLTLVLCTATGLLLEIYGRQRKAASSIDGFVWEHPADQPTAQGLVSHHLASGESQLVDQALVPDNLRQALQ

SEQ ID NO: 983832 - protein, 97 aa, Homo sapiens
MQTLLLCHTPRHSVAHGLEAPEDRCSDSTQDYCISIVPHREKSSARRGPKNDRTMSTPTKTQLCTAQINHSPTTGQLLTHPIQTAHKSAPSRLHLLL

SEQ ID NO: 983833 - protein, 68 aa, Homo sapiens
TLVDPAPPDGGGDEDLPPNPFFAKWAIIEESAKNNSLIIPTIIATITLRNLYFYLRLIYSTYYTTPIY

SEQ ID NO: 983834 - protein, 72 aa, Homo sapiens
MADEISSKSPVAVQSTKVILLYSRDHSVAESLNYVASWNMSMLQTRYLVKSVQATTDNKELKTVTFSKLLLP

SEQ ID NO: 983835 - protein, 107 aa, Homo sapiens
MARTSVQGAYCVLSAYCVVTNRYDQFYDDESDPYEELKAAENKKKEAGDGRRWGTWGQERSSGREPNQLQRGSANSCARSPKKDCKTPLTPSVGVFDKKDGDARRPM

SEQ ID NO: 983836 - protein, 81 aa, Homo sapiens
TCVHGPLELYQAHHDLEIGRSINGLSTETSPPITFSIKWLYRIFVHEVIALLGPTINYYHFTLKLFDQVLTTNSSYSLLLL

SEQ ID NO: 983837 - protein, 117 aa, Homo sapiens
LFLGSRAGFTALTYADEALGSGLVSAGLFPDNRGHAVMLPERWRPEISSMSPVAVHSTHVLLLYFREHSVAESLNYVASWNMSRLQTRDLVKSVQATTENKELKTVTFSKLLLPRLE

SEQ ID NO: 983838 - protein, 138 aa, Homo sapiens
IGAFCVRRSCSVLAQAHTTVDELARREDVRHYLQGLQQYLQELLLKATNEKLSVYAALQRQLLSPGTVLILLEAQACSGFLLDPVRNRWLTFNEAVKEVVVSPELHHKLLSAERAVTGYKDPYTGQQISLFQATQKAP

SEQ ID NO: 983839 - protein, 31 aa, Homo sapiens
MKKEAGGGGVGGPGAKSAVQAAAQTNSNAAD

SEQ ID NO: 983840 - protein, 110 aa, Homo sapiens
PRRDRKNPLTPSVGVVDKTEETQPPVALKTEGMKTSLEEDLINNFRVKGTSFDEKTRKGDHLVNEDSKSHLTTQGEGGEFTVDRPIIDRTIRGRGGLGRRSRRPWTQNAP

SEQ ID NO: 983841 - protein, 85 aa, Homo sapiens
MRVLRSPRSAGSLPNMAGPAGMGTCAHLRLLRQHVLGLPLLPLEHRAILPIVDMFTIAGLFHPEQRGTGDMNLPACKQRLWTFGL

SEQ ID NO: 983842 - protein, 49 aa, Homo sapiens
LRPSAGAYELVYAEYRDIELMVMDIRNAYAVLKYIIREELREALIAQAG

SEQ ID NO: 983843 - protein, 33 aa, Homo sapiens
MLKYKWANCDSSCFHINPSHTRTCDPYQAYLDY

SEQ ID NO: 983844 - protein, 93 aa, Homo sapiens
MARTGAGDKDDITEPAVLRSVPLTSLHLRPSMAQNSVVYNYCIPAIVKLLNQPNQWPLVKATIGLIRNLDLCPANHAPVQEASGHPTEAERAY

SEQ ID NO: 983845 - protein, 169 aa, Homo sapiens
DIRRVLVVTNRFDQLFDDRIGPLRGAEVQQQNTKKEAGGDGVGGPGAKSAAQAVDQIKSNAEGKQLRTESQKDRKNPLTPSFGVVDKTEETQPPVVLKKEGLKTELEEDLINNFQGRRGQYLIEDQKGDHLVNEDTKSHFEDRGEGGAFKVDETIIDRPIEVVVTWQRR

SEQ ID NO: 983846 - protein, 54 aa, Homo sapiens
SWAYELRIISNGPLGIGEALGTVVRGLPAARFCVSYRQLLPVASPRTLWCLQVP

SEQ ID NO: 983847 - protein, 101 aa, Homo sapiens
SGHKSFYAQVPETMPVAPWFMHEASSTEPQSACHLARDSVGLDDPVPPVASVHGDDRELGQDDGPTDSGCHLLGALNTQTDVGIVIPDSDKCLELLLPRLE

SEQ ID NO: 983848 - protein, 67 aa, Homo sapiens
MARYSVPAPIKKKSCFTCLPHTARWSMACIWHTGVCKMSAQLVAGLEVMCVAVTCRTIATRMRFLDS

SEQ ID NO: 983849 - protein, 114 aa, Homo sapiens
DGLCVASRTHYLCLSTETTRSALLIHDQMVDRGDIMCVLDDGMPLYRTPHEWGRLIIECTSRLVLETGLRSADNLSLLGKPLPERTEVEETDEMDQVELVDFDPNQERRRHYNG

SEQ ID NO: 983850 - protein, 50 aa, Homo sapiens
REIGRRGGFRAWLTREGGSSGAAFFTLEAVDARQQLGEGRGHLLFRYAGK

SEQ ID NO: 983851 - protein, 43 aa, Homo sapiens
KVRSRGPRTFQRMGSSLMFLEAILEEGDGRLCTRCHGTCTTKA

SEQ ID NO: 983852 - protein, 84 aa, Homo sapiens
DPTPLTEVKYVLDLLATSILLPPTVCQSNPCPAGTGVSGERQLQVHHDELWTVCWGSQIAALFRLPRRGADRGGSGGGGGVGCS

SEQ ID NO: 983853 - protein, 57 aa, Homo sapiens
TINAALSDFSAIFIGNLCAMRARWRKKRMLRLKRKRRKMRQRSKKPLACCAVGALDA

SEQ ID NO: 983854 - protein, 59 aa, Homo sapiens
RARTLTHKPRQATSHCMQQLEIRKNAVNKLLPNQSLPSDDATRTLLMRAQTSRLVLGPF

SEQ ID NO: 983855 - protein, 83 aa, Homo sapiens
SSPDHYLIFHREGASSSCQAALTLLGSSSPPAAAFQSAKIAGVSHRAGLIFGSIPCEMMVCPPAFGTFTRLCSAGESAPLAIL

SEQ ID NO: 983856 - protein, 48 aa, Homo sapiens
RWSTRRDDRVSTCIINSKEGDNTCVRQDGLDFLHLMICLPRPPKVLGL

SEQ ID NO: 983857 - protein, 39 aa, Homo sapiens
NNKLIRELMDEVTRLRDLLYAQGHVSDVAKTLGVQKDPQ

SEQ ID NO: 983858 - protein, 104 aa, Homo sapiens
MDTLVLPSQLVIWARMSAIDSWRGPADLRASNSIGQTMIWALWACRPFTSSSLVLLHEEQSPPVRAFDLCLQLRSCDIGVINDLGEPMDVFLHRLAHGQLCLIL

SEQ ID NO: 983859 - protein, 98 aa, Homo sapiens
DSRSQVYPPVSSSQSVGITGFSLCTGPGLRFLTTCFRILDVPGGSPVETGKSLQVIRGCISERWFSVCIGGSIVVSLSSFQQMWITKLEYDESGPSIV

SEQ ID NO: 983860 - protein, 78 aa, Homo sapiens
GTALIFITTSLDIACNLQTHPDIIREGSVMLQGDVHTVKGGLKLNPNFLEDFEKEPLGPALAHELRYPGGDCSSDIWI

SEQ ID NO: 983861 - protein, 77 aa, Homo sapiens
MAVWLLRACVLLSYCYNHSKSPAGTLLTSMAHLKLLKRSVEAAMRSRKQGLDYVHNLRVAEVLNDPENMEKRRSRES

SEQ ID NO: 983862 - protein, 69 aa, Homo sapiens
ARGLKKSLQDVAVEQTVQSLMSSLKKQCHYRVQKVPSGEVLCDKTPTVGSSQHRRQAQGLTELRCITLS

SEQ ID NO: 983863 - protein, 70 aa, Homo sapiens
VRLEYSLPVIGQTEGGQQSDEECGEVDVPAVLTGRVVIGERRWVVVAGTPSDHRLQSETSGYSPRGLHGS

SEQ ID NO: 983864 - protein, 73 aa, Homo sapiens
MSGTDDIGFRVETPNALAPFLGDEHLTPIIPILVIIAIISLLLPLIALAARITVNISGGHLLVHLIGRATLTI

SEQ ID NO: 983865 - protein, 102 aa, Homo sapiens
RHAPRSDYAARSDYAPLSSTSTRLGLHRSTLTFGPPPHGFNGQSPHMRRQGPLHINHDDPSLLPNVPYFDFPAGLMPPLAKLVDHEYKPLDPKDSRVDRRSS

SEQ ID NO: 983866 - protein, 54 aa, Homo sapiens
MAVCLKMVMKYKNQIIRYFKLFNGYIFHSEKSARSEEALCDMYPSQLSDFSAPT

SEQ ID NO: 983867 - protein, 67 aa, Homo sapiens
ARADYAARSDYADRYDYADPCDYAVLSDYTEKHGSMLQITDSSRVDKIAKNNSTELFGCPVIGMSPL

SEQ ID NO: 983868 - protein, 37 aa, Homo sapiens
RFEWRRPQDYGTSFVISMAVIGTRAVQSLIGPICFTT

SEQ ID NO: 983869 - protein, 88 aa, Homo sapiens
MPPPPNDRPFLPSLDCTAVISAHCNLPAWGSHDSPASAYRGPGIPGSATTPDWFLYFWGKRTFAALTGLVSSSWPRVICLPGPPEVLG

SEQ ID NO: 983870 - protein, 35 aa, Homo sapiens
VRWRLSGSFIRKASDVSEVRMVLGEKEIDRQDYQL

SEQ ID NO: 983871 - protein, 74 aa, Homo sapiens
TPSTTRLDLTTRLNLKSLAALTPRKRVSLSFEASKPGIDFSTPAMKVLDGIFLQKKTVLSPLKVCCFLEPRSQI

SEQ ID NO: 983872 - protein, 77 aa, Homo sapiens
DYAGRSDYAARSTTGYGPCPQAHPQAEGAYCCSGLMETLRSSSPPIMMSSVWDWRPFGSACSLPGSAPSAPASRVVR

SEQ ID NO: 983873 - protein, 51 aa, Homo sapiens
SCGRVDGKGSDAASMPAIFQPQAFCPRRMGAFCRAFSTRSLYVPSSRRDHT

SEQ ID NO: 983874 - protein, 90 aa, Homo sapiens
LTTRRLTHCYDSSRSPTITSVRDQHFNLASHSIPEATPDPHDWISLIHLLFTPFPCISFFPIPHPEHAGFIDGSSTRPNRHIPANAGYAI

SEQ ID NO: 983875 - protein, 90 aa, Homo sapiens
IWLQLSLGRNENKVESTSSANEDDAWWRGSWMAELDVEPNDRDLRGVLLQAQCTQSSREGSLSSCSLPAGSALHRGSNAWNISSSSSSSG

SEQ ID NO: 983876 - protein, 41 aa, Homo sapiens
MRRLLLQWVNVRIEYWPRGMCTHSHAKPQRKWNKAFEKEIV

SEQ ID NO: 983877 - protein, 33 aa, Homo sapiens
MTIANRDGTRYVQRGEYRTNPEDIYASNPTDDD

SEQ ID NO: 983878 - protein, 76 aa, Homo sapiens
RSVWDRYVNSTMSFLCASALPMAYVHHSFWVLTLCCESGGSALNCLPVVQCSVKAGAARWTRWDPEASPVLPRAHH

SEQ ID NO: 983879 - protein, 46 aa, Homo sapiens
FVLIAKLALKFLIFNMRLHDEGIVLKRILGGHLDPPLLIYSLALLS

SEQ ID NO: 983880 - protein, 67 aa, Homo sapiens
SSVVTGKMHPHSMAEMENITNGFTEDRLYDMRGHNSSDLTADPEPYSNPTTTMLMTSSYLSDSGSTV

SEQ ID NO: 983881 - protein, 36 aa, Homo sapiens
PVKSGRASSPTAYPYYASAFSMIAGALHLQTSSILH

SEQ ID NO: 983882 - protein, 86 aa, Homo sapiens
MHGILPSILVMHTGGSSCSRCLDCPSEAVHVLLVSMVNWHSCVASLLLRPPSAVMRGVNAAVVVLDSGMSFGQWSRFTCLVPDLHM

SEQ ID NO: 983883 - protein, 37 aa, Homo sapiens
LVTRARTYRTYDYELKTLTIQTQSQDDTMALQSGLEG

SEQ ID NO: 983884 - protein, 106 aa, Homo sapiens
IELATRSSLQPERRLIRSYKRHSEKGPSSPQDNIAAAFSPAPLAKPSLLMCDMGSCFVDTIPIDQVLRVSLWCWKPCQALYCTVSLNPHKNPGVSADITASISEEK

SEQ ID NO: 983885 - protein, 48 aa, Homo sapiens
ARTHQLGLRSLEEEGQKLPHTADEQRWEDTVEKDQELTQESPPAMTRE

SEQ ID NO: 983886 - protein, 74 aa, Homo sapiens
HTYVKPRSLGLDAFKTPEITANTPYGRRSEEDINAKMQARLEKGGLFANVEANFMNYGTNCYRMYDQESIHDFW

SEQ ID NO: 983887 - protein, 114 aa, Homo sapiens
PLDDEVLNTILLFLFPDADPEKPLDGTTSTDNSNPPSESEDYNLYNQVKSAPSDSLTYILALRLWMINFYHGGLKGVAHLWQEFVLEMRFRRENDFLIPGLASGPPDLRCCLLH

SEQ ID NO: 983888 - protein, 46 aa, Homo sapiens
AFIRESLKEDPIEKFENLVERYNPFAKTMRGNTIFRQARNHKLGLV

SEQ ID NO: 983889 - protein, 46 aa, Homo sapiens
TSSIADNLIKSDIPTVINVFLFLGGLLEFLEGCDDQGRGRRHHLNL

SEQ ID NO: 983890 - protein, 97 aa, Homo sapiens
TEVVPLVLEVSIACRFERMTSILKNVPLWVKGYPTATHATDKSFGKEESVDVAAFLVVSFKEISRATLTFSNHHTDHSAAINSEARLSSSNKDSLKT

SEQ ID NO: 983891 - protein, 31 aa, Homo sapiens
MGYRRNEESLREVRGGLPGRITQDGQRYQCP

SEQ ID NO: 983892 - protein, 93 aa, Homo sapiens
SALHNRMDRMELRTCHHLLALFRQDSAARAHLSKASSILSQSCVVISLAPFPSPGEIHTPHSETSDFAGTSCFLMGSTQFQGRDDILEALWRG

SEQ ID NO: 983893 - protein, 107 aa, Homo sapiens
LHLQTMLITHNVLSRPIPYETAGSADEATASQQPPQAQLHRYNGLYRPSYCLPAFSAGPELSQGDLTRPSSCFCAASPGPAPAWWRPLEAQPVPAVSLYRPNVCLTA

SEQ ID NO: 983894 - protein, 36 aa, Homo sapiens
MERLATSGMYDFIFVAPVVPDYCHCCLGLLLLLKLL

SEQ ID NO: 983895 - protein, 50 aa, Homo sapiens
VSAAQGEDDEEAVRERSSQNLYFCLAFRIQAQHLGVCPGEEENQATKGDG

SEQ ID NO: 983896 - protein, 57 aa, Homo sapiens
TPELARGPDLAPISLYKTKLMTHNGLSRPIPYGTLGSEDDPTATQQLPQAQVHRYKR

SEQ ID NO: 983897 - protein, 38 aa, Homo sapiens
TVVHTCTVVHTWSLYRGNAGDCNGYGDISWYEQQCSVT

SEQ ID NO: 983898 - protein, 44 aa, Homo sapiens
QADLATSSLWFRCRRHVSHRCSTERLPPVDEGRREYLLPQLTVA

SEQ ID NO: 983899 - protein, 84 aa, Homo sapiens
THKPTLTHSGSTALVQRSESASPCEGSITSSSVPRMMSTGDVILDTFSMLREGRGAGGDFAPLQSPHSAKSVGQAQAPPSPEGH

SEQ ID NO: 983900 - protein, 49 aa, Homo sapiens
CCSYLRTPPPLVPPPDTATRYEQQCTPDTATRYEQHVQCMNNSAVWYLS

SEQ ID NO: 983901 - protein, 32 aa, Homo sapiens
LLFIPSRCIGGGGMNNSAGITNSASYNNSAGI

SEQ ID NO: 983902 - protein, 50 aa, Homo sapiens
CHTPDTASRYEQQCRYEQQCRYNNSTGINNSAGINNSAGINNSAGMTQQC

SEQ ID NO: 983903 - protein, 46 aa, Homo sapiens
NGISNTFSLCAWSVLASPFICRVIPLLASISLSLYFPMGYLLSLLS

SEQ ID NO: 983904 - protein, 51 aa, Homo sapiens
DPLTHKPPLTHKPPLTHNPPLTHKPPLTDELPLYIGVICGGLWVKGVCGGY

SEQ ID NO: 983905 - protein, 38 aa, Homo sapiens
YIDIHVLRGGRSTLVYQPVGPQPNPSTNLYLRNEAVIP

SEQ ID NO: 983906 - protein, 99 aa, Homo sapiens
MAWTLKTRKDYRRKNHYTSSIKKKMTNVAEAKKVMKRNFNVNTKITFTDEGELVQQWPQMQNSFITDAEEDDDTGGINLHTAKERLQEEDKFDQEEYRI

SEQ ID NO: 983907 - protein, 59 aa, Homo sapiens
PVVTQPNIYRSPKTYHTVLLDLTSVVTTTETRSHSPPSFTSSITTTEITSHSTPVRLSG

SEQ ID NO: 983908 - protein, 34 aa, Homo sapiens
PRTHRTGPDKSNLVPLPEVLMVQVKKDLKTGHSK

SEQ ID NO: 983909 - protein, 56 aa, Homo sapiens
MTSSSYSGITPGLFSSDSRGVGLVLQTTAIPYAMRSTEALLENPWCHHHQCTVERR

SEQ ID NO: 983910 - protein, 37 aa, Homo sapiens
MIRNPVRNFKGKFHNCPEPLMSCKMKEEDVLKFLAAG

SEQ ID NO: 983911 - protein, 46 aa, Homo sapiens
AILREVLSTEGAETMALRQKREGQARLAVIQTPAPPRLFSEPSGPE

SEQ ID NO: 983912 - protein, 48 aa, Homo sapiens
IQPKTPKNGGKAKAQHSTQRKLPSQKMTKEIQVTVIWYLACKIFSWWM

SEQ ID NO: 983913 - protein, 53 aa, Homo sapiens
THTTSPHPLLHQPQDVKMTGSPGLALALYSSRHTLQPSRTHWMTRLIYTKIPD

SEQ ID NO: 983914 - protein, 34 aa, Homo sapiens
LVITNISLPEHIAKTKAAIHCKTGKGRTGVRLSG

SEQ ID NO: 983915 - protein, 53 aa, Homo sapiens
DLHSRSSSQLGDHSRFVNCVRFSPDGNRFATASADGQIYIYNGKTGEKVFGGA

SEQ ID NO: 983916 - protein, 52 aa, Homo sapiens
THLHGKLTGVKCIDETMKLAGMHYLHVTLKPAIEEICQSHKPCEIDPVRLSG

SEQ ID NO: 983917 - protein, 78 aa, Homo sapiens
QGRAAARELLLQKQYAAVVLQDTWSNKTLNLEVLLVLGFLPSLFKGFLTTYWRTSSSLEEIEKFADSASSFGAQAARP

SEQ ID NO: 983918 - protein, 106 aa, Homo sapiens
RSLCRIPTPSCGGGRIAIPGLAGAGNSVLLVCNLHPERVTPQSLFILFGVYCYVQRVKILFIKKENALVQIADDNQAQLAMSHLNGHKLHGKPIRITLSKHQNVQL

SEQ ID NO: 983919 - protein, 80 aa, Homo sapiens
EIPTQGSAITGDYFRIQYFSTPGDAHFYCIFSPTAVVNAIIIVVMWVWKTLNVMTDLKIAQREDRNITGEGSKTEGQLAE

SEQ ID NO: 983920 - protein, 42 aa, Homo sapiens
NSGCELRQLLHKDKSKRSAVASSVVKQKLSGGILKKQQSPLS

SEQ ID NO: 983921 - protein, 109 aa, Homo sapiens
TQVRAREERLRHVQLENKAKKPALVAMSSILLDVYPWDDETDMAQLEACVRSIQLEVWSGGLPSWCPCGYGFRKLQISVCGGGRQGGDRLAGRTEITRFEEHVQSVHIA

SEQ ID NO: 983922 - protein, 55 aa, Homo sapiens
QIGFFFVLYTVGCLARDPRVTDAHSVPALAAWDMGTARSPHPTCELLVAGLSPVS

SEQ ID NO: 983923 - protein, 83 aa, Homo sapiens
QDPNSSASCDASSWHRDYGSSTCTTEQQIQDKVATFRLMLLDKDVNPGGQEDTPWSEASASRETHQLAGVRTLEVRNSWVLRS

SEQ ID NO: 983924 - protein, 38 aa, Homo sapiens
DFRGTPTPAQGAELYEKRFGFFQKNAGDEAVNFIMAIK

SEQ ID NO: 983925 - protein, 79 aa, Homo sapiens
MVRHPLPISLKSQEPAMSSAPPLLVPLLMVASKYLYDEGEEEDVFNDEWGAAGGVAVPTLNALERGFLSAMDWHLYTDP

SEQ ID NO: 983926 - protein, 116 aa, Homo sapiens
NSGFDTRSNLNKFYNPVLISDTMLQVTISFLKGYSSFVKGSMRVVLPLAGANFYSQLTHGGNGTHLVSPVKSIWGWTMEGARIVVLLVGYIHILVEGWTGEGRMEPPIQTEYLRSG

SEQ ID NO: 983927 - protein, 43 aa, Homo sapiens
RLRGPPSEPNEAYRNKLKYLFFLRKRMNTNPSRGPYPTAHWVP

SEQ ID NO: 983928 - protein, 73 aa, Homo sapiens
RVPTCMTTGCAALGKFDKFRGVEFVCWPLAEESDNVDSADAEEDDSDVWWGGADTDYADGSEDQVVEVAEEEE

SEQ ID NO: 983929 - protein, 118 aa, Homo sapiens
IRVIPFVEPHGYSGLQNWVKKNGLSTRSRPGLTNNQLFFLGFAQVWCSARTPESSHDGLITDPHSPSRFRVIGLPLQFQGVLRTLPLPTWLTHEPASQVRSLLRGRSGRRAIDEVGIG

SEQ ID NO: 983930 - protein, 56 aa, Homo sapiens
STRRGGGMTEFAQDAVLIQVKLQQNVTGEVKPVTSVPLSCMFFDCIYTRDEIDWGR

SEQ ID NO: 983931 - protein, 36 aa, Homo sapiens
PADYGEGRSQEVGESCRTSDGDIVGIACARVGWVLG

SEQ ID NO: 983932 - protein, 33 aa, Homo sapiens
DFHLNGFDHNFCLKGSKEKHFCARVHHAASGRV

SEQ ID NO: 983933 - protein, 85 aa, Homo sapiens
LYFSGVRKDAGWQWYNEKISPKEKENKPVPAAPRQEPDIMQKLAALQTATKRALYEAILYPGVDNFVKYFRLQNYWTQQAGLFTM

SEQ ID NO: 983934 - protein, 75 aa, Homo sapiens
SARSARRTADVHFRSFGSESNIATLMDQLIYNLLLEEQTPPNKITVVGVSAGCLACAISILMKDLADELALVDVI

SEQ ID NO: 983935 - protein, 34 aa, Homo sapiens
SSLAQHYSPPQMTPIVERADAGPERKHLPRMFSL

SEQ ID NO: 983936 - protein, 32 aa, Homo sapiens
MREVAYVAMTPLDGQFPNGPELDFGAYRALMA

SEQ ID NO: 983937 - protein, 79 aa, Homo sapiens
YGENELSYDRLTLSIWADMYMFSDDGDKASMQESQAHHAVEGSAKNYRHHVKRTVEVTLTPLKMENESQSKNALKESSP

SEQ ID NO: 983938 - protein, 37 aa, Homo sapiens
TFYTGNKYYVVNGKNLGSLFKRNKDYNLKGKNPGEPF

SEQ ID NO: 983939 - protein, 42 aa, Homo sapiens
TFYTGNRYYLVNGKNPGGLFNTKTRNPSYRKNHMDTFKRKQR

SEQ ID NO: 983940 - protein, 50 aa, Homo sapiens
MVVVARRPYTLGLCVVYMPRMLRSVRIRNAIAIRMGTMRSRRLAMRGLPG

SEQ ID NO: 983941 - protein, 47 aa, Homo sapiens
HPLSVLFLSVQLGHDAVPPTLVGLGSQQHMRTAWSSGAEEGLPCVDC

SEQ ID NO: 983942 - protein, 47 aa, Homo sapiens
VHSTSLRGSPGVVYGYVTSCDGQKSSGTEVRPQPMPPSPAPAMRWIA

SEQ ID NO: 983943 - protein, 50 aa, Homo sapiens
TPSNTQQPSQLYNKAASQHRCHVVVNSTFASPHAIAQTLMRVMGKERGWY

SEQ ID NO: 983944 - protein, 57 aa, Homo sapiens
AGLLNLCVSEQVQVARRSRYARRSRYARRSRYATTGPGMPRRSRLPEGPGMPEGPGM

SEQ ID NO: 983945 - protein, 71 aa, Homo sapiens
FLTGHGFPWLSWHWAVLFVSPGPGRRGLEAFYEVAEPDTREWYLSELPHITYDLLSLVHEPLGYSADSREA

SEQ ID NO: 983946 - protein, 59 aa, Homo sapiens
LNDSIAGAHITDDARVHLEAVRRRKVSDGCCPFWILRAAGTRDVTIHDAQRARSIAPEI

SEQ ID NO: 983947 - protein, 47 aa, Homo sapiens
MGPLASHGSRTSEEEPPQGGGGGATSVAVTIALHHRYLLLMPKLDLS

SEQ ID NO: 983948 - protein, 33 aa, Homo sapiens
MICTDVCLQIGYPTDMHQIPHTIINGIQKESMD

SEQ ID NO: 983949 - protein, 67 aa, Homo sapiens
RTDKVEEDMKQLYDQIAQLPVDPRVTLRLVVPGSQCGSLIGKGGCEIKEIRESTGARVQVGGDVLAT

SEQ ID NO: 983950 - protein, 128 aa, Homo sapiens
TYRILCHPLVSHPTCVSYPFVCHPLRIVDHEVLMVFGMRSLDGLVMMATYEYTRLRMVCTCRSSWWSMEKVVFLVPHHRCLVCGSSWVTGQFEGTEAFQLSTFFLGVHRASSICRSVLVDVSLRKGGW

SEQ ID NO: 983951 - protein, 68 aa, Homo sapiens
AAGLYEGAETAPVQNEGLGWRCCCPQMMVMPMSFSSFGRGYRELARCLGLMLSSEFAAPVSVPVQEIL

SEQ ID NO: 983952 - protein, 41 aa, Homo sapiens
TRRTQTSQIMPMRDIALGNKTKPFVGVKMVAHQSDPVLRLG

SEQ ID NO: 983953 - protein, 50 aa, Homo sapiens
MDFNLLNNTNTLIGGCTIGDVRDPIIESRKPVKLICDSSNRIALVIPTGN

SEQ ID NO: 983954 - protein, 72 aa, Homo sapiens
VVFRALWGLPSPPRQSPFRIRRTNLPLSTISEALMWATMSAPTTLSKPYWQPPGGPPSREKTKIRALSAEQG

SEQ ID NO: 983955 - protein, 86 aa, Homo sapiens
TVKRVTSYSAMHFATYRTKLMLMSRNDAATQHKNAQNNLQQLFHEEYVVREDSLGLAIGTHGSNIQQARKVPGVTAIELDKDTGTY

SEQ ID NO: 983956 - protein, 75 aa, Homo sapiens
AADVSVTHRPPLSPKSGAEVEAGDAAEPGAGRRAAASRIQKRIRKGLEEKERKFRKGKEDNDEGPPGGGEEGGSK

SEQ ID NO: 983957 - protein, 71 aa, Homo sapiens
DLDIPKLVWVGDGQELRQQAAQRTVQRQGFRPLRIHSAKQTQIATGFGTLGEALGQAESPRGEGDLAATIL

SEQ ID NO: 983958 - protein, 58 aa, Homo sapiens
VALELPSRSTEQVSLCEVISVVVIERREAGSDCVPGLSGGDHRRSSYEYCVVCDRLSG

SEQ ID NO: 983959 - protein, 55 aa, Homo sapiens
MIVTVSAVQPMLGRADAAGLDHSFPHSTQTGEEEARAVHRLEAFMQLRALEHLLS

SEQ ID NO: 983960 - protein, 37 aa, Homo sapiens
RTPLYHRTGLYTYYNDRRTSCKSCRCPRAHNALQTSS

SEQ ID NO: 983961 - protein, 120 aa, Homo sapiens
LDDPFFWYTGAVCAAYLELSVHTGAIGCVTGAVCPASPGARPCATPWSPLLCRRHLEPVLCRRHLEPSCAHLEPVLWRRHLEPVLCHTWSPSSASVTWSPSCAIPGARPGPSFTCDKSRG

SEQ ID NO: 983962 - protein, 60 aa, Homo sapiens
IDQSRHGATSKRFTCDLCLIFLLLQLQTLRIRFFLHLALMAQRFPKEMALRPRESAALDA

SEQ ID NO: 983963 - protein, 34 aa, Homo sapiens
YLGFLHSETAKSVTCTYYPCPQNKMFLATLAKDL

SEQ ID NO: 983964 - protein, 120 aa, Homo sapiens
LPTQGELLKSFHRPPRLGTGSVTPDPSVLALHTGGFPLSRVGKTPCTPRGAESLAMCPIHMPAPTPPPEMQMLGKWHAQSEHGPWRYGKDISTHTNPKGVDPSARPDGTQAGGTASSPHE

SEQ ID NO: 983965 - protein, 37 aa, Homo sapiens
LHNAARMSQVQRVHSQAANVQRAGVPVGGSAGCQKLS

SEQ ID NO: 983966 - protein, 67 aa, Homo sapiens
YSTRIPRYSTVVNMYELDAIAAVTSYVDVPVHAMDQLIFRSVSNCGLPSHSRASPQLGFNYVRGLYG

SEQ ID NO: 983967 - protein, 91 aa, Homo sapiens
GRGVDVRPGGLTWRPRCGQVGILVSLHDQRLYVLRDGVMIGESPLKADALPAFQGTTLFVMGQGYSDTPSPLDANQRLHQWTAYPLLGQDR

SEQ ID NO: 983968 - protein, 32 aa, Homo sapiens
ILTFHISIKAYLNPVTDLSSEHPYAACYYSQG

SEQ ID NO: 983969 - protein, 55 aa, Homo sapiens
SPLAQPNTQTETTDTWGLLNGGQVERRDEKQKKLTIAVLGLNIGVMQGVLKRATL

SEQ ID NO: 983970 - protein, 61 aa, Homo sapiens
TEGGSVAQTVVSMKNTYEVVNPLFEKRPKNFGIGQDIQPKRDLTRFVKWPRYISVAAALDA

SEQ ID NO: 983971 - protein, 100 aa, Homo sapiens
PGHVCTIYFVDASVHYAVADLRRYLWRQLQAAAVCILGLLIFRSIRMPANVNNRYLRTIASMRKFKALISIARRSVMMIIAIGSIYRARVIITSGRRPMA

SEQ ID NO: 983972 - protein, 85 aa, Homo sapiens
VVSTGSPVIARGPHFIDEIAERYREKDLAQDCILRPLHLMTLFLACFDFWGSSVPSGFACFTSYASHIAILLSCNGLFDYFFILC

SEQ ID NO: 983973 - protein, 36 aa, Homo sapiens
CPAFGLADSQTISRFLRIAQHKIILKPTSIMRAPVR

SEQ ID NO: 983974 - protein, 63 aa, Homo sapiens
MPRYSTVIGHVLLLFVRKNRNDDTALFCSAKVSLSLTPCNPVLCINEDLATRRGLVAQKVRDL

SEQ ID NO: 983975 - protein, 113 aa, Homo sapiens
FLATTRLQQELDDLLWTWTTSAERVTLEKKQKKFDQLRGGGEDHLCQDMQRSATGLRREAREKETKALSLARALEEAMEQKAEMEGFNKQFPQGDGGHLMSSKDDVGKSCPQA

SEQ ID NO: 983976 - protein, 66 aa, Homo sapiens
IPPAIYNYLAIYNYLNISFAFKQLSKGEISQGTYASYKTAYVLDVLFSRSNDWLNRMDTLGCVTSC

SEQ ID NO: 983977 - protein, 81 aa, Homo sapiens
NENEGSGHSVPSPMLEGQSTLELSHTGLQHKIHSSLFTDDEMGSNVPQLIRTNPSIILKTYKSTNACNICNLPNTITYMRF

SEQ ID NO: 983978 - protein, 56 aa, Homo sapiens
LLQPDLFGHTSGSHEALGVVQPKCIPPCPLSRQDLGCLCRERFSAVCYGSVSTPDE

SEQ ID NO: 983979 - protein, 43 aa, Homo sapiens
MTVGYIGVICGENAISGAPIIRVNKSVANSLRLVMGITSEEDY

SEQ ID NO: 983980 - protein, 91 aa, Homo sapiens
AQYSKLGGYGIIRLTLILNPLIKDIAYTFLDTYPYEAYLIISSICLEQTDLYSLIAYSSVSHIALVVTAILIETPLCFTEQQHFRHHRPTG

SEQ ID NO: 983981 - protein, 73 aa, Homo sapiens
LEDPRLDAIQVTTPNYYPSCTIVRAHGIPLVVIIGEQELKQGVIKIRSVACTEEVAIKRENFVAEIQNADCHL

SEQ ID NO: 983982 - protein, 71 aa, Homo sapiens
SWMIGAVPKSINRSVIVGLMISTKSVVRDMRGDITHTYKYPERASEEREAFTRANHLNKLSEKEETGMSMR

SEQ ID NO: 983983 - protein, 59 aa, Homo sapiens
TSKKSQRVIRVCFNVAFGDMAGSFTYSLPPRFLLHHPQPRGLPMLLSSASSMLLKLLKL

SEQ ID NO: 983984 - protein, 106 aa, Homo sapiens
PFLKNHSPSSLFWALCLASRSTLFPLFSLFALFLLPSLNTSFIFSIPHTVLYPPAFLAKTIKTISPHCFYQHKPSISSISFPWSSGSQEITPAFQNLVLRLVRNQN

SEQ ID NO: 983985 - protein, 71 aa, Homo sapiens
TAVAMIADSVNVAVELEKVVSHSLPVGDTVDEGGSIIAHVVNEPARVVDGVHSTVAWSVLVAPRGEEILSV

SEQ ID NO: 983986 - protein, 81 aa, Homo sapiens
MGKYPNSNHTRIFNDSSVYPTQRAWRLSEFLPCMPIPSQVLPHHRPPAHTVSELAARAISTDGFSVSLATLDVATLCPDSS

SEQ ID NO: 983987 - protein, 70 aa, Homo sapiens
MSRLSHRGIIANKHFLGSLGPWLSRGICDISWHHLSPAFSKYLCQADVIPARNRMNSLKVHLGHSPFGGQ

SEQ ID NO: 983988 - protein, 102 aa, Homo sapiens
TITCSLYSLRKTELKSIIEYSSVSHIALVRNRDSHLKCPCSIIGAFILIIAHGRYILITILPSKHNLLNAVTCRIIILSSRTSPSTPTNSSQMTSSKPRLPE

SEQ ID NO: 983989 - protein, 107 aa, Homo sapiens
LGIRLVARSRGRLQWQGLSKVSDLPMHILCMEQSRAITIGFHDMRDISIKLSAFLRAYWASATSDSHNPPDTLGNGYYPYTINKSSCITRVSAGSVSPQNSTEVREP

SEQ ID NO: 983990 - protein, 133 aa, Homo sapiens
MTSGCLTKAGFMISTLTLSASSQVHACVLQLPFHQQVWKNPTFFLRVISDTASLCYSILRYLSLTASTFCSFCVVEISPPRAGARLAVELDIRPSSGRRNWKDCREQEGRLRGTQSWGEETAPPQKLAWATRG

SEQ ID NO: 983991 - protein, 126 aa, Homo sapiens
VHSLWKPLTVLSQQVYRGNSSKQPARLHRQSAYLCNPGLRSKALPYRGQQPRPTYFSIGAGAEDSKTGSAYDGQLCGKTCPIQTGNRSKRACKRVNSPTGKIHSRYGAGAGQAHDDRTTLGPGDPG

SEQ ID NO: 983992 - protein, 37 aa, Homo sapiens
YARITRVGTRTTVLYGILLVQLYPYYVEYYAGTLNPT

SEQ ID NO: 983993 - protein, 171 aa, Homo sapiens
DVIGYSFRRQTLEFERVRVRELCSWLQMTACLSAQNMRRAHLQTRDCKEKPQRSHHLDRVFGKVLMASTSYLPSQVTEMFNQGRAFATVRLPFCGHKNICSLATIQKIPRLLVGAADGYLYMYNLDPQEGGECALMKQHRLDGSLETTNEILDSASHECPLVTQTYGAAAG

SEQ ID NO: 983994 - protein, 37 aa, Homo sapiens
PGLLRSGVGYRNWGSGMSDGAHETQTLSPAVPDLSKP

SEQ ID NO: 983995 - protein, 69 aa, Homo sapiens
KFNTSCCCKNFSARSKNALFETFNWALSMGGTVPVSEGLEHSDLLMAKENSYDAWLMLVEKDGESHHGA

SEQ ID NO: 983996 - protein, 67 aa, Homo sapiens
LWSLYEFPPGSPGLSKVRALHGVSHCVPVTIVYLIFYPLYCTIPTLYSVVYRLRALRCGMGITAFCL

SEQ ID NO: 983997 - protein, 77 aa, Homo sapiens
MLSCYQTASHATEKSCERMSVWQTSLSFKKLPQLSVIFNHHHPDESVAIVNVGVRPSTSKKIVSIFEAVMYLSIIHN

SEQ ID NO: 983998 - protein, 66 aa, Homo sapiens
CAQPVGRWAGLQGREAICLNSSTGELRARVPFDYWHTFMELQYMCALSTNYIIHPGSICAYRYYFM

SEQ ID NO: 983999 - protein, 64 aa, Homo sapiens
TQLKMHPVYEVEAFTFQDLVGHWSEFCQFWWVFSLIFDSFTKDSITNGRPKDNALYVDVTKKAD

SEQ ID NO: 984000 - protein, 35 aa, Homo sapiens
VVRSVRKEKVDLYNQLEEEEEEGGVICSSCDVLES

SEQ ID NO: 984001 - protein, 44 aa, Homo sapiens
MSNNKDVAPKADFLHPHVFIMTLQRDWNYLHRIGPTGAPGKNRA

SEQ ID NO: 984002 - protein, 114 aa, Homo sapiens
MVPARLANVCVLVAGGAEDITWSAALTHFCHVVPSLTQGPKEQAFWAKKENALSLAHNFIQHLKPFVHTTTNFIPDCYTPPQNNLNRPRRKPGNSNHLTSRELRFSGGQLTKLS

SEQ ID NO: 984003 - protein, 56 aa, Homo sapiens
SYRTLGISQEQIRSPGVFNHFDKDHGGRWGREFKAASLAGQKWKKNRQGEGEFNRI

SEQ ID NO: 984004 - protein, 42 aa, Homo sapiens
RAMCSRYSVWIGARVGVCTCVSVCAQVDECVDEVHVWAHIME

SEQ ID NO: 984005 - protein, 109 aa, Homo sapiens
YPHARHRPLSTQTHRPQHLDLSAPRPQHLDLSAYRPLRTQTSAPRPQYPDLSAHRLLSTQTSHITYTQTLHTPHTQTSHNTHTYRPHTHTAHRPHTPHTHRPHTHVHLI

SEQ ID NO: 984006 - protein, 112 aa, Homo sapiens
SLPHAKGVEAYIQGARQEERTKASRHPGQKDVPSSHRRLLQGLYFPVIQHVINYDMPEEIENYVHRIGRTGRSGNTGIATTFINKACDESVLMDLKALLLEAKQKVPPVLQV

SEQ ID NO: 984007 - protein, 48 aa, Homo sapiens
SLRRDRVASRDSSIISKSTDAAHPEAVLPEVGEGDRRRISNTEPEGFM

SEQ ID NO: 984008 - protein, 70 aa, Homo sapiens
MQYTGGADRQHWVGVQVYADVHVTLHDGVEGSFVDATGLHAQEGRLEQCLRAAEPLIANGDDLAVRQLVT

SEQ ID NO: 984009 - protein, 46 aa, Homo sapiens
YLLKLVTEVICSQTGRCRYCRTILEYSMVAPMNLVPQDLDGRVVVA

SEQ ID NO: 984010 - protein, 67 aa, Homo sapiens
TTQYDLYLCEGFSEALKQCKFYHGLELPAPEEVGADYGGQYLHHTYYPYADRPDHNTRIVPSIAGHW

SEQ ID NO: 984011 - protein, 105 aa, Homo sapiens
YLEIPVVDDQVYAAPTVWKSLPFCLILTVSGIRYAEAGAVVTLYPALWEAEVGRSAEVQEFESLANMENPVSTKNALGMVVRACNPSYSDAEVGESLEPERRRLQ

SEQ ID NO: 984012 - protein, 40 aa, Homo sapiens
NTSTYDTQRLGEERRFQRWDDWWKCWADWKAGLVEGTSFS

SEQ ID NO: 984013 - protein, 37 aa, Homo sapiens
MSQAWIGAYDRRVYTSAVHASVYKCVDTVSTVLELQI

SEQ ID NO: 984014 - protein, 75 aa, Homo sapiens
TLSYCKYALFYRGVHIVCQVLRVYPKGSRGPNSSYPPSGGTVRDRKGTQYPSTADSEVSDALPVCQQRLRDRGVP

SEQ ID NO: 984015 - protein, 38 aa, Homo sapiens
MSLRLLSQLCLQPRCFDSNTFSLQPMKLDKDAITTDVV

SEQ ID NO: 984016 - protein, 47 aa, Homo sapiens
MSVLPFSNHRGSELEEPWSPHPTPAFPLQVIGPNLSSLSYMGGYQSV

SEQ ID NO: 984017 - protein, 121 aa, Homo sapiens
LLRSHYVSGSTDDITKTSVIKPDGHSGQCDTDDIRVVSVEPFVTMGQVTALLISIVWTLPVLPELDDLTVAGLIMGTGIESSSHKYLPVTTTSGTAYELVLADGSFVRCISVPKLRPEQAR

SEQ ID NO: 984018 - protein, 104 aa, Homo sapiens
FQMQEYRASFNTSKGSWRALGPRVQGLPHQPGYDVEELTGQVRPSSNRIMSLVDPNHERACEPSKAFIDFMWRENTQTRTRLDQVIASFKVSAGDRNFITAEGA

SEQ ID NO: 984019 - protein, 40 aa, Homo sapiens
MWLVSSSTVACTEATGSSRVSRWIFGKTANAPVPGSYSIL

SEQ ID NO: 984020 - protein, 46 aa, Homo sapiens
CSGLRRVSRSPIGGGLGQGLSASIRLLPDSPPTLLIRNAAYTRVVV

SEQ ID NO: 984021 - protein, 35 aa, Homo sapiens
GAVTVIPGLDAGKTLGRRKGRHMGIGKRKGAANAR

SEQ ID NO: 984022 - protein, 30 aa, Homo sapiens
MCIRYLLFGFNFIFWLAGIAVLAIGLWLRF

SEQ ID NO: 984023 - protein, 52 aa, Homo sapiens
TGGDLTAVVIVLHDRSDNAECLTFLTRQMIRQIRLARCVGRGISRILRRHWR

SEQ ID NO: 984024 - protein, 149 aa, Homo sapiens
CSGLDQWPDIFYRTLHLKTRECTFFSAPHGTYSKIDHIIESKTLLSKCKRAEFITVSQTTAQIILELKIKKLTQNHTTTWKLNNLLLNDSWVNNEIKAEIKKFFETNENKETMYQNLWDMAKAVLRGKFIALNAYIKKLERSQIDTLTS

SEQ ID NO: 984025 - protein, 64 aa, Homo sapiens
MHETLKRQLSDQQLVWTSGSGEARGEPLYQADSDGAILTPPVAGALISEPPWMASCMRGALPPV

SEQ ID NO: 984026 - protein, 74 aa, Homo sapiens
TVRCTPRSGCTGLYQYPATQNLSIILNYPHRMNNSNSTVQAAGVVPPAGGSYKLPVEYKLTGEVHAVRVGTSAI

SEQ ID NO: 984027 - protein, 42 aa, Homo sapiens
VESKIRMVLMSHHLIISFNVSTDRESWANGTDDASVPGSDAL

SEQ ID NO: 984028 - protein, 97 aa, Homo sapiens
MSDKPGRRHDIKYNHGAATRMGPGRIESQRTAKAKMTDVDRLTVMNAKKLRNRIILNEVYKLQLAALLRASPKYRGSRSWRPLRAPGLGLPWAHIME

SEQ ID NO: 984029 - protein, 33 aa, Homo sapiens
RQWVQLPDGATPLTSLQLPLKINNCWLSAVAYA

SEQ ID NO: 984030 - protein, 36 aa, Homo sapiens
PSARVQIPLDGGETTRLVGYDLFHWACLNERAAQLP

SEQ ID NO: 984031 - protein, 118 aa, Homo sapiens
MSTSTVMLECQRQAYYSTAFSAEHRKAITPGAIAVQRGKDPQYARSRPTFIFLFTVLDLSLSPSLLPPPLSLAPYLSQTSEVLLSLCLCHTEISKQGPTLTPKLECSGVISGSLQPPS

SEQ ID NO: 984032 - protein, 44 aa, Homo sapiens
VCRDGRERFPSPCTRRIMSEQCHFWDASQLLCRLDHKSREWRTR

SEQ ID NO: 984033 - protein, 46 aa, Homo sapiens
TAASSFILPAKIRVVRKKSARALTVLPQTQKDPLRHFYQGQEVQAP

SEQ ID NO: 984034 - protein, 70 aa, Homo sapiens
MLSPKRQQLNQQNCIAEHYEPTDENSKDLAELHIPLEEPDAVIAKPRSTTPALAQAIYRHAEETMMNATK

SEQ ID NO: 984035 - protein, 77 aa, Homo sapiens
RVPFNLSMGTGITIGYTRARHQIQLLFVGDFTKTVKIMSNLYPADRTIHGILGLDYMYFINETLRNLVFLLFVTYHL

SEQ ID NO: 984036 - protein, 155 aa, Homo sapiens
MNSLRFLLPSITTAETTSHRTSSFTCSITTTKTTSHSTSIFTFLNNHRDQLTQFSQRHFCNHHHRDHLMTVLPRYSFFDSHQHEHLKEYSQLHFFYHYHGEHSTEYSQLQLLVSLAKQEHSRSTPSLTSVITTTKTTSNSIQGFTFSITPTETTS

SEQ ID NO: 984037 - protein, 55 aa, Homo sapiens
NISDDVVVCKLGSREARGEAESGGSQEPRSSRLQGSYDHMTAFLSGQQSETLCLY

SEQ ID NO: 984038 - protein, 76 aa, Homo sapiens
KAGHHYICVICVGDAVGGSALLIGVVGARLEWSKAQQESCEEQKLLQVNQLGLSLYRQAVFWTVWGDPSSMSTVSG

SEQ ID NO: 984039 - protein, 89 aa, Homo sapiens
GHPCLTRNKGHPFSPKRQDQATRKIMRFLQSWRHRMRALKQNQELEGLPHAGTGHMSWAPFFLTSLGAPRAVLTGRGLSEAGVAPVGSF

SEQ ID NO: 984040 - protein, 38 aa, Homo sapiens
LTYTILEKLPHASQTNIKKSPGKVKEVNCKRKMKTVKE

SEQ ID NO: 984041 - protein, 75 aa, Homo sapiens
AVAKQTTRSGQAKQRAGKSRNSVPKEVGNYVTVQIALNYQHSLRESRSAAPKIKDAVPYTHFTVMKTEKTVFSVN

SEQ ID NO: 984042 - protein, 132 aa, Homo sapiens
HWHQSLSAQPAHLNGGGGGLRTLCILFSRGSVYICLVILNLGSPPEYPSNKDVCHRVGQSGGHSGCTGSIRLLAGLSLSGSGTPYVPPAGPVSLEAFGCLSMSVLPLSVCLSGGLCICLPGVGLSPLWLCLP

SEQ ID NO: 984043 - protein, 89 aa, Homo sapiens
DRHGDTVCDIDPQNDLTFLRSRVHKNDIMVAPDKDYLTDSDSESTRISHSLGSLCHSFNLMPPKNVNDNHVSGLEHGRRLEPTHTNPVI

SEQ ID NO: 984044 - protein, 67 aa, Homo sapiens
MMVAPDNRLSPDCDSRLQPHKPLSWLPVSFLNLLPPKNVNVNHVGGLAHGSRLESTHTNPVTVYGRA

SEQ ID NO: 984045 - protein, 54 aa, Homo sapiens
MCAHSIIAQTFEAVVRFKKATATLSWVRQDPFKLYAACLLVVVIETLHYFNHEF

SEQ ID NO: 984046 - protein, 39 aa, Homo sapiens
YRAASPLVEVDICTTLQEQIYTLAKKGAGSFTDLVYLLR

SEQ ID NO: 984047 - protein, 45 aa, Homo sapiens
EVGLPYRRSVPTWSKLTSDDVQGADLQTAKKGRTPSQIGVILRDS

SEQ ID NO: 984048 - protein, 53 aa, Homo sapiens
QVTRCRRSSSPPIPTHLYITDEVNDPSLTIKVGVAPSGTEPYEYTALPADYIF

SEQ ID NO: 984049 - protein, 75 aa, Homo sapiens
FSFTSSSTTTETFTQYSWLLFFNRHLQDHLNQSSQIHLVIATTKTTSHSTPRFTSVIASTETTSHSTPSWAHIME

SEQ ID NO: 984050 - protein, 109 aa, Homo sapiens
MECNWNGIEWNRMESNPFEWNGMEGNGMESTAVYRKEWNGMEWNGMQWNGMALNQTELECNVIECNGVQWNGLEWNGINPSDMERNGMNSNGMEWNGMEWKQHEWNGTE

SEQ ID NO: 984051 - protein, 72 aa, Homo sapiens
CTIDCPSSSPKAHDILMPSCMTELGYQMSYCLPKLSKRTQTLASWALCRLFSTRDDEGLIRIYGAAGTQQTG

SEQ ID NO: 984052 - protein, 61 aa, Homo sapiens
EPVMSHLISVCTGGYILAVQLIEQGCELAVVQSPGAYPVHGLHYHVHDVVHLQLLSTEGFR

SEQ ID NO: 984053 - protein, 139 aa, Homo sapiens
RGHDGFIRNMFVIAIVDHGKSRLMYLPWCAWRDVIASRPGRARTRFTDIRTRDDRDRCITIKVNLASSLFYQVSLDNLTLNCHQAQLGRLPASSSTSLTPPGMSTSPSEVIVAPRGTDGASLVVDVVSGVCVRTETVLR

SEQ ID NO: 984054 - protein, 46 aa, Homo sapiens
MIEEVKLGGLCEVVLVVVIKEVKLGVLWDVVSMVVIEEVKLGELWD

SEQ ID NO: 984055 - protein, 62 aa, Homo sapiens
MWLIEEYALSDLTVCCVIRIYVACHNLCLIGKYNESVRYVFSQAVDNECEAYYTKRRRLRTA

SEQ ID NO: 984056 - protein, 73 aa, Homo sapiens
MRQTPNDLTGEHSCIYAEHAHMIRMKLTSGRLAAAFWIDCRRRFLALLSYQFSTFLSFPGSEHHSEQEHGEAS

SEQ ID NO: 984057 - protein, 66 aa, Homo sapiens
CLFQLYTASPDMMPMLEWPGRVVHLLNDQHMGVVTAAVSLITCLCTKNPDDFETCVSLAVSRRRLL

SEQ ID NO: 984058 - protein, 32 aa, Homo sapiens
KLVGTRVFFWIGKHANEEEKKRRSNHCTVNTQ

SEQ ID NO: 984059 - protein, 34 aa, Homo sapiens
MPHRDITMKVYAMCFVRRLPNVCEAYYTKRRRLH

SEQ ID NO: 984060 - protein, 35 aa, Homo sapiens
GVPEEITGADEKVHLRDKKSQNDDFSKLVAGRCQD

SEQ ID NO: 984061 - protein, 56 aa, Homo sapiens
CFDGAGRHSLLRSNDGNEYVLPSQRRSGNEHMDPGYLFRTSPLIQHESVSQTPKRH

SEQ ID NO: 984062 - protein, 110 aa, Homo sapiens
MLIREYWLREQREVLAGLFTLAKIRKAGRDLLMACMRRTHGVCTKATPCCGGWSALGVLDEGKMKLDYILGPEDRGFLQRDSLKTQVFKTGLGQSPSTTLAVMNPQRRRL

SEQ ID NO: 984063 - protein, 72 aa, Homo sapiens
TEPARFTKITIALSPLSYRKVTPIALIPIVVIIEIIRLVIQTNSPGRTPNREHNCRPPTHAANWKRRRLRTG

SEQ ID NO: 984064 - protein, 63 aa, Homo sapiens
MPVAEWTKVFAQPNLAEMIQKGEQLFLEPELVIPHRQQRIFTAPKYTGSFLSPWTTAVTDASF

SEQ ID NO: 984065 - protein, 62 aa, Homo sapiens
MPVARSWVCRISYVDPCGAPSRNLVSTYELKLIGESGLRNNREVWRVKFTLAKIRKDDRELL

SEQ ID NO: 984066 - protein, 80 aa, Homo sapiens
MLYRVIHNQERGYYEDAKTAASGIPYHSEVPVSLKEAVCEVALDYKKKKHVFKLRLNDGNEHLFQAKDDEEMNTWIQAIS

SEQ ID NO: 984067 - protein, 59 aa, Homo sapiens
VDLRLQAYALHPPPILQTGHPLGRGSRKLLGGVTIAQGGVLPNIQAVLLPKKTSAVAYA

SEQ ID NO: 984068 - protein, 39 aa, Homo sapiens
MPSSVSTCWPQYLVHLHDLMWRVARVAVCLGTLCLGLSL

SEQ ID NO: 984069 - protein, 118 aa, Homo sapiens
VVYSHYILRANAYDHCASLYNVDGHVLRFTMIVGCLVYLSEAESEAALVVAIKMIKDTVLRDQVRSFTVVSGYHSVKRLVLISHCWVVISRSLLTYSAVGITRGGYRMISTAVGVDAM

SEQ ID NO: 984070 - protein, 39 aa, Homo sapiens
LSVTLTMKPDFSQLQRKIYGYETPGDQLHINWDNNMDRL

SEQ ID NO: 984071 - protein, 127 aa, Homo sapiens
MVAQIEYYAACSGDCPDLEPKNQELGEKLSKDPNIGIAKRDATCQCCSLFSYEVRVCSTIYLFSANKKLNPKKYEGGRALSDSIMLSTKRIYKHLFEFKKNKPINDIFKHIACIKNTCEEKRHHSKC

SEQ ID NO: 984072 - protein, 40 aa, Homo sapiens
RIPESLYQGEECNGKKRKEVLWGRVCRERAVIGVDFANRR

SEQ ID NO: 984073 - protein, 41 aa, Homo sapiens
RRSEDTGRIGGGRPLRPSAQLREGRTWSGREEGDTRLASHH

SEQ ID NO: 984074 - protein, 73 aa, Homo sapiens
QYPSMHECMQDDVYTHYCGACIPEQVPSDDVSTVLTSKYRKLEPGRRVFTNAVHASLYKFRRHVSTVLTSKYR

SEQ ID NO: 984075 - protein, 51 aa, Homo sapiens
AAQWLLCVSSRSDLLVPDKDTEDCSAWKQDPSRRAAPPEPHGGLRPREKAL

SEQ ID NO: 984076 - protein, 105 aa, Homo sapiens
MDRALPEESGVWSFRGSRMSFRASWAWPCAGLRFESSCDSQSKTIVQTCALSGTGGLDLPGAAALECCNLSLSVSSLTGMALGMSCLLANTMCSASRSSSSSVDL

SEQ ID NO: 984077 - protein, 49 aa, Homo sapiens
IRQVVLIIGCCLANGICVGTVWNNDGFCWRHWSLFELLVCCWQAIKAWA

SEQ ID NO: 984078 - protein, 93 aa, Homo sapiens
YVDLARRKQKTDSVGQTDAQLFTGYQQQRIAELEAAAFGCRLDELDAGWAVELWQGLIGLVKAVVSTAGLAAAAAGWKPAVGTEHSLERKGQC

SEQ ID NO: 984079 - protein, 94 aa, Homo sapiens
MPAPIPSPIHPLQPIPGIHSRSLGISGDYNFCSSDREVTPAGSNRAVLTTFVGSMIPFSTIFTEISSHSIITNCLRNFALFSQLSEILQAPAFL

SEQ ID NO: 984080 - protein, 85 aa, Homo sapiens
YGGTGAATSLVPGERPQCGVTDCRNGLVRALVCVWAMLAPKRGCLSCFPVAGPALVDMEGERYSLKVGLAQALLAVTQNQGCLKV

SEQ ID NO: 984081 - protein, 39 aa, Homo sapiens
YRTFRSLAGTGVVVEGEQVDAIRDKRIILGVAEGLQALC

SEQ ID NO: 984082 - protein, 59 aa, Homo sapiens
MAAASTELQDVILISVGTFSLLSVLAGCCFFLVLNYGGLIYYWFHTTTKPSLLLDRRVI

SEQ ID NO: 984083 - protein, 37 aa, Homo sapiens
AFTCPAYAVTEHCNLPQSHASWCELVLVGWKCELQPV

SEQ ID NO: 984084 - protein, 64 aa, Homo sapiens
YLATTRFLPTTREKTQVTELNRECNEPAGPDVTSSSKAKLAGVSLRARDWLSKIETGDAISSTC

SEQ ID NO: 984085 - protein, 34 aa, Homo sapiens
MLPDSCGRPGPVRGGAELAHTVHGLGLDQKDLGP

SEQ ID NO: 984086 - protein, 55 aa, Homo sapiens
MSGCPVALLDLDAGVLENIFGVGLSSLVAFLGYLLLLQGFFTDIWVFQFCLVIAS

SEQ ID NO: 984087 - protein, 61 aa, Homo sapiens
MRPGACPRPMLTDPRLLYIGGLGYCSGRIDNVIRRSAIATAGKHSPAFYILRPEAYGCCYG

SEQ ID NO: 984088 - protein, 60 aa, Homo sapiens
AVVTGWSEECRHRWCQKPHRYRAGTVALREIRRYQKYSELLIRKLPEQRLVREIAQDFKT

SEQ ID NO: 984089 - protein, 64 aa, Homo sapiens
KEPLPVEHQIPLYLAHISSLYPIVCSSHSCYSWTTAGNITEISVTRYITNDDGHHFLADYFNSV

SEQ ID NO: 984090 - protein, 119 aa, Homo sapiens
SLPVGTWRQLVARGLTNKFDALKDDDMWGPDQNEENSYQQDGSRSPDLTYTTRKCPNPDYRLPVTPIPVKGNGKVGRPTASKASQEKTPSPIEEHEEPDSPPEKNTSTSPPPEKSGDEG

SEQ ID NO: 984091 - protein, 40 aa, Homo sapiens
MMRHRPPHIPPYKSPNFEMYEGYRSPWEWVEAAKGYTCTL

SEQ ID NO: 984092 - protein, 93 aa, Homo sapiens
PRLLELIGLASPVASESPSPLVAQVAVNATTSCGVVSCCPSLSVISAALHSVGEVLLVGEHHEDSIPELVLRQYPHELLTGLVHTLSVFAVPL

SEQ ID NO: 984093 - protein, 36 aa, Homo sapiens
MCKLLVDLAVWRALSPGGEFWRTCEVDAVVMDLRQA

SEQ ID NO: 984094 - protein, 48 aa, Homo sapiens
GRKSPGHRWRQEAPPLQEGCEAYLVGLFEDTKLCAIHAKRVTIMPKDI

SEQ ID NO: 984095 - protein, 44 aa, Homo sapiens
IGIATAWAPSAIFLGHEHAEIYTVLNPGEVLPTAFEASEKCAWV

SEQ ID NO: 984096 - protein, 41 aa, Homo sapiens
PIPRLYARTPSSSYQRPHPVVPPPPYQGLLPEFVLQKCAWV

SEQ ID NO: 984097 - protein, 42 aa, Homo sapiens
DSPPSTTPRRPHTECEHPVSGPAALMCVSREQPKTRRLVHAG

SEQ ID NO: 984098 - protein, 33 aa, Homo sapiens
FTYLRGLGFAGGLVCFVGLFAMKVDMRGRSDAL

SEQ ID NO: 984099 - protein, 31 aa, Homo sapiens
MSRPPLLLCPIITFPYHTFNNQCNRVQFHLL

SEQ ID NO: 984100 - protein, 49 aa, Homo sapiens
SPPMLTPRGSRLSLLITDPVRLLKIFLILPSSQVCHFTPFYHPKQSVDT

SEQ ID NO: 984101 - protein, 97 aa, Homo sapiens
MHTIGLPAPSKGRRACAGSVRYLGVRSCLECLRPPWGCDSVVTLALWAWELSGTCREKAQCLCPSAWLCPCLGGALQCQSGSTNAPMVACETAVCQP

SEQ ID NO: 984102 - protein, 72 aa, Homo sapiens
EYVHEHPGARMCSLTHTRALRHHAPATLVGQRGRCRGTRRMSSYLGCESCLYSQASSFISSNDKFLLHKHGI

SEQ ID NO: 984103 - protein, 61 aa, Homo sapiens
LIASLPDEALVYAVSPGSLEELVGGTGSIPTCYILTANPDFGYYLHYKHVSVFWQHSVILA

SEQ ID NO: 984104 - protein, 53 aa, Homo sapiens
ERTTLHSYHARGDERSTNPISKNHRGGVKKELNSVMNRGQHATINQVDQRDNS

SEQ ID NO: 984105 - protein, 74 aa, Homo sapiens
FSYVIWSRAGLADEFTPALSCSPKHARLRERSGSVAPGASYRPHTVHGLRLGLFQVGEGGESGIRGSPEVRLGA

SEQ ID NO: 984106 - protein, 46 aa, Homo sapiens
SSTHPATGCRDLNRYLMKMLTERGYSFTTTAEREIVRDIKEKCAWV

SEQ ID NO: 984107 - protein, 48 aa, Homo sapiens
MSSLSQSLLTGSFPEPSGVVGYLEQSGGSVRKEGAGTRGREGSQKCAW

SEQ ID NO: 984108 - protein, 36 aa, Homo sapiens
YTHTHTQHTTMYFLYSFTQQLSTRNIFVVGPEVRLV

SEQ ID NO: 984109 - protein, 52 aa, Homo sapiens
WSAVSGGGRCIEGDGDLPLPDDYELFCRDLKEVVQKPEQFLLSTMLVVTKSP

SEQ ID NO: 984110 - protein, 88 aa, Homo sapiens
MASDYHSCQAADRVLLQVDCTMLTCCYCTSSVLMENPGNSWCYFRTERSHCGTALQDSVAFSQHVTRPLLSDPDARCTGLIDGFWLRT

SEQ ID NO: 984111 - protein, 35 aa, Homo sapiens
MLLLTPQLLLLLLQPQLRLKPRKSRSDSQSAHTDA

SEQ ID NO: 984112 - protein, 43 aa, Homo sapiens
ALQLATKVAREELLLATGGVKKPHRWRAWYSGSPLRFCRYHEV

SEQ ID NO: 984113 - protein, 45 aa, Homo sapiens
SREQPGNRNGLNDRPAIILVLIALPYPDASLDISRRGRTIPRLTD

SEQ ID NO: 984114 - protein, 70 aa, Homo sapiens
AALSKTAVAPIERSQAVAAGPARQQADRRLLAVQGASWTVLSCIPEVAGRAVLLRGATLCNVHSLASPLK

SEQ ID NO: 984115 - protein, 55 aa, Homo sapiens
MNPLSSWCIGVRSAPFCSLYCSVKSAHASLKDLSDILWTSAPLSRTDFEALWSPI

SEQ ID NO: 984116 - protein, 44 aa, Homo sapiens
ASRRDMRQTVAYAVIKNVEKKSARRRSRSPCRRRNARNAGAFCE

SEQ ID NO: 984117 - protein, 44 aa, Homo sapiens
THTGRPARALPWKSALPEGPSAQLGHSWALPPYLLQCPGRSRVR

SEQ ID NO: 984118 - protein, 36 aa, Homo sapiens
LQDPPLYTFSPACGEGEDKPCSGRAGSCQCGRSLLI

SEQ ID NO: 984119 - protein, 72 aa, Homo sapiens
MGAGSPRQLSASRVGAESFAFRSAGAREMLVTGPVSRWLAPICGRREGSLPSLSRRGGPGSAPAVAMQPRGV

SEQ ID NO: 984120 - protein, 35 aa, Homo sapiens
FQIASARTARLRGEDASAGQASRVGSEECICTSMP

SEQ ID NO: 984121 - protein, 37 aa, Homo sapiens
MDWPPPYSFRTRRCRCHNMGGLGELANLLLLVCSRDE

SEQ ID NO: 984122 - protein, 106 aa, Homo sapiens
NNLRKTGSLCKTCEPEEDGTIDFPEFLTMMATKGKGTDSEEEIREPFRVFDKDGNGYISAAELRHVMTNLGEKLTDEEVDEMIREADIDGDGQVNYEEFVQMMTAK

SEQ ID NO: 984123 - protein, 45 aa, Homo sapiens
GKTTARKSPILGLAVSGGKTTFKKTRSLGAGGSGGENNLGENLEF

SEQ ID NO: 984124 - protein, 43 aa, Homo sapiens
MTMVAIIITGYGNDGFDDRMRDGIGMGGHGYGGAGDACSGFHG

SEQ ID NO: 984125 - protein, 46 aa, Homo sapiens
GGARPILAVVGLGDSNQFFRDVYGEDFEGQSPNVHPWMCGNGYRSS

SEQ ID NO: 984126 - protein, 139 aa, Homo sapiens
GRPTALSGQVGRSERTSHCSVDCYHRVFSGIFRVIPWKYLPRMSWYGNSPSIRLYSDLMSRRSVSLRDTMMRIRVRSFVPAPLMALLSLSAKKAGVFLRHFTTASMPSSRSPDISRQMLFSMSRPVILWYSLKTATKWE

SEQ ID NO: 984127 - protein, 39 aa, Homo sapiens
RRGPMSQHKTQQKTQSKTNIEEMDCGTDEEEETVPLLEP

SEQ ID NO: 984128 - protein, 31 aa, Homo sapiens
MHPPFTTPPKLHFHAVSFPKHGSPELPFARP

SEQ ID NO: 984129 - protein, 35 aa, Homo sapiens
RLEKGERQTELKRKSLNTDETTIGSPDTRVLSLVC

SEQ ID NO: 984130 - protein, 129 aa, Homo sapiens
MKQDKIYQIPGCSILYVKILDDGIDDERLRREKTPVGTITSAKVMMEGGRSKGFGLVCFSSPEEATKAVTEMNGRIVATKPLYVALAQRKEERQAHLTNQYMQRMASVRAVPNPVIKPQQPAPPSGYFM

SEQ ID NO: 984131 - protein, 105 aa, Homo sapiens
DVYRIPKARKGGRVGARAVVVLQWRTAGYTCGMECAEPLSCMIRALRVSSPPGSGLTAPGDRELNELVDDFLLLGMLLPKAGHLPPQSLILMLHGQELGVHALLL

SEQ ID NO: 984132 - protein, 63 aa, Homo sapiens
RFEKGSPLRGSMEAAYAMSAPPGESPEDRPQGCAWTTCLCLAEPLGGGRGGRGRRISLLALVA

SEQ ID NO: 984133 - protein, 62 aa, Homo sapiens
LEVSPPLEKGPCMRIAAGYLSDRAMAKAVLSIFGNPRHCLLLFMMAGMTVAMYRFRVTVTSD

SEQ ID NO: 984134 - protein, 54 aa, Homo sapiens
MRYHNSHVNSDHPCAALDDQRLGAYVDQAQASSVFLASYIRMTVRLCIPPFSEA

SEQ ID NO: 984135 - protein, 53 aa, Homo sapiens
MGKVVLHTFCPRCVPVVTYNCVTLFVQIVRLMEQGHSLTGKGNEDWRVDDVAV

SEQ ID NO: 984136 - protein, 69 aa, Homo sapiens
GSERGPTGSIDTKSEGKMRCLLCQRERARSVERASTPYGIDSDSLGMECIISCKVPLRSLAINTVYYRQ

SEQ ID NO: 984137 - protein, 71 aa, Homo sapiens
RSCFPWCSRLWEVVTVEASLFHHAAYAFTTFTVRLLGSLSQEADNAAGLNGAVFRPEVPLRRDLPLLLFRT

SEQ ID NO: 984138 - protein, 46 aa, Homo sapiens
MASSIDCFQNIKLAINLLAKLQKHIQNPSAAQLVHFLFGPLDLIVN

SEQ ID NO: 984139 - protein, 105 aa, Homo sapiens
NGSKRCGNGQTELTRKFEQINNIGSSRSRCSSLCEINLDDGIDYERLRKEFSPFGTITSAKVLMDGGRSKWFGFVCFSSPEEAIIAVTEINGIIVVTKPLYVSFA

SEQ ID NO: 984140 - protein, 50 aa, Homo sapiens
AIVRWLVSGHHFRRLLLGVASSRSPLNISSICLSCKQCPWIYPQSTFSSI

SEQ ID NO: 984141 - protein, 36 aa, Homo sapiens
GSKRGVIVHILSLTFRFQQRSAHSYKHSHIWISQGC

SEQ ID NO: 984142 - protein, 102 aa, Homo sapiens
MRHVSALVVGVARQNSNEDVKPVGDYENDCAGKASGGLDATGCYYDELTVADLTSMHTDAIYGLVSRTADWTLVTTLLPHTGLVQWTRGMAYDVLVTGGLRH

SEQ ID NO: 984143 - protein, 49 aa, Homo sapiens
LVDNGSGNIGETPVPGLISDGAILTPAVDGALYRADLVASCYARSLAAG

SEQ ID NO: 984144 - protein, 70 aa, Homo sapiens
SPNGMDGKSRQCQKMKLNPNSRYLMHLCASFDLAWCWANYSRGPERCAGTWVGCAAGMVTLQHQCCSGDP

SEQ ID NO: 984145 - protein, 50 aa, Homo sapiens
SDYRCWIQMALREIRSIPEDPASVREIRKLPLQRLVREIAQDLKTDMGPG

SEQ ID NO: 984146 - protein, 83 aa, Homo sapiens
AVLTVPVYNDHMTLSDKALMNGPESSVRAVSSSQWPGQSYTIENHEQLEADPWPRTVCHWHHDPMDLLTMAWGLLYDVDRACA

SEQ ID NO: 984147 - protein, 46 aa, Homo sapiens
MSTDLVKESGPVLDSSYISSFTSSDVNFNQVGTLRRSGTADLRAGV

SEQ ID NO: 984148 - protein, 47 aa, Homo sapiens
FIDTTSKLGHGRFQRMEEKKACMGPREESTDIATGRRSLMPGPRFRS

SEQ ID NO: 984149 - protein, 40 aa, Homo sapiens
EDPRNPYRYTSYVHNISRTLPCKPLHNIIYVTNDHETKPG

SEQ ID NO: 984150 - protein, 36 aa, Homo sapiens
MGFLASVRCLTRVCIRWMLMTNQEEEYHARHFKRWS

SEQ ID NO: 984151 - protein, 93 aa, Homo sapiens
IEHELGSVTFRRLRSIRGLQTACHNTWRHYGGRQRPQPSSSQQHHSSQAPQLQGCTPALYWPHRLQGSKKHLTSATSTGIGTQLHHSLEMRPE

SEQ ID NO: 984152 - protein, 86 aa, Homo sapiens
GLLRSLYRKPHVLSKNTNGQELAERPLTSPEAVSAQQETPHVHANTSCRTGAARREDRGKPSRGNGSSARAGFRPLGDETADLSKP

SEQ ID NO: 984153 - protein, 39 aa, Homo sapiens
DLEDPRKPYRSSFLGTHMTHSPLIALHNIFCHQDLSKPW

SEQ ID NO: 984154 - protein, 80 aa, Homo sapiens
MSPEEEYTDGLPSHGVGGTCLRQHGPALSKSQYSPAIEGHGNNIHGLAKAINQMAAALFTIHKGSIEDRLKEFLTLGLQR

SEQ ID NO: 984155 - protein, 49 aa, Homo sapiens
YQENRGSLVVTNGGVEHDLDQIDYIDMLHRRGRGGRGETAQGTRPEQAR

SEQ ID NO: 984156 - protein, 38 aa, Homo sapiens
MSQPNKDSGVEGKGSHTKESKVSSATLVYKVRDPVGTM

SEQ ID NO: 984157 - protein, 53 aa, Homo sapiens
HGEYGLGAVADGVSCNPIVTVFLWVTYDALSPELYTTYFVTKTLASQETLASQ

SEQ ID NO: 984158 - protein, 113 aa, Homo sapiens
AAAVAVDLRIPRVARLPLVRACLALLFVSWDYPRKGSLSVSWCWVPRGACCSERPDDLGGECVPCFLLPRVSVLFMSPVHFYGVLHVIARGVSDRFPYLVCTGTASLGRVESV

SEQ ID NO: 984159 - protein, 40 aa, Homo sapiens
NLHRYITIIKDLSKPGDLSKPGDLSKPGDLSKPGDLSNPG

SEQ ID NO: 984160 - protein, 45 aa, Homo sapiens
PWLLRSPGLLRSPGLLRSPGFLRSLHLSCLFTVPDLSKPGDLSKP

SEQ ID NO: 984161 - protein, 70 aa, Homo sapiens
WISVAHGVADAQLDAPFRVEEVVSMAQLLPMARPGCAVMDRTSVGAAFFFPSEGSNLTPAHHFQDFRFKT

SEQ ID NO: 984162 - protein, 43 aa, Homo sapiens
DVRTPRMQGSDLVSMETGEEKLPPQSEYGRVVACTLIEVSVHS

SEQ ID NO: 984163 - protein, 47 aa, Homo sapiens
RTFGEKRGQLDYQSLLVRLGLIRQKVRERLHNEECQKMDLWIAVHLG

SEQ ID NO: 984164 - protein, 36 aa, Homo sapiens
RQSEEEEEEEKHPPKPAEPEKNRINKAVSEEQQPAL

SEQ ID NO: 984165 - protein, 41 aa, Homo sapiens
SRDPGPYLRGLSQTGQVEPAVPRTVTLCGAWVRQTRLDPEY

SEQ ID NO: 984166 - protein, 117 aa, Homo sapiens
ASTSQVAGITVAAAPHLANLLNFFVEMRSCYVEQAGLEFLASSNPPASAFASAGIIGMSHHAQPAESFFFLATSASGFQAIPRASPSRVAGITGLCHHPRLILVFSLLKFFKQSLDT

SEQ ID NO: 984167 - protein, 92 aa, Homo sapiens
VTASDEVDVLMVAARDQSYQMVGIVGCVTRVVHKDVVSAMGSQERWVMTSLVLQVLGTPPGVIAHVSVDCQAGDVKSLNDVAVPFLAVLNVV

SEQ ID NO: 984168 - protein, 64 aa, Homo sapiens
PGHRTSLHIIMSTPDSSWILLTWPIQPHQQRRTRDSTLPQLGQCGTQHHAALLPSGQISSTVHL

SEQ ID NO: 984169 - protein, 50 aa, Homo sapiens
IPPVKAGPTGFLFYTLMLSPGDNLPAVLFYSKQGVTSYYFWVVCKGLGAF

SEQ ID NO: 984170 - protein, 94 aa, Homo sapiens
YAWRKSKLSDPGGPVALSREERWRGPLLPPNAYQVGPTASAPPWTSGGWSTLLEICFDERPLCRAAALREKHFYQRQHRLPEPSATVAHSPASV

SEQ ID NO: 984171 - protein, 110 aa, Homo sapiens
DLEDPYAWRKPTFPIPRSVEPECAESAEGLLSPCSGRETGLQVPKVAFLVALPKLLFLLQPSCVVTKCPGSLLSGVQGPLRQHPRDLTFLCVSSLSGPAFRYSLTIDVFE

SEQ ID NO: 984172 - protein, 40 aa, Homo sapiens
MVNCYPKSIYLCRPIIIFSDMVLARKYLHVRNWYVGGYLS

SEQ ID NO: 984173 - protein, 105 aa, Homo sapiens
MWLQLRPCPLSMAFSREGQGFLYSYPIHPFIATLSLISLSLSLSHTHTHTHTHTHSLVCLAQLPPLCMPFLECLVSLRLPTHGCKTQYTHTDPLGFKLTLSPLLH

SEQ ID NO: 984174 - protein, 104 aa, Homo sapiens
SSRSYSCDMWDADAKVRSMAKPVPARLEGERLLFDRPRIWRRAGAGGGAVCRRPRAGRRMDRGDGGGVTAPPRTGEELAAIARTAYSPDPMLPALSHVRNWYGG

SEQ ID NO: 984175 - protein, 93 aa, Homo sapiens
PPHPHAKTHTSFSYPYTHTHTHTHSRYSPTLTAHAHSKYSPTLTAPCRHIHPLIYHHPDSSHKTMEIHSKPHASGYSSIAIAVVYPKTTIIPP

SEQ ID NO: 984176 - protein, 48 aa, Homo sapiens
VQRSGPISRAELSRRTHLSKASITSLAAELAARGLVREGSPDRNWYGG

SEQ ID NO: 984177 - protein, 77 aa, Homo sapiens
RAVQLRLDEMRRRDVAGVRFDHRPQFARSRDVVVRDVEQAQAFLQIDRPAHAFRCRQLPGPHDSLPLFAGVRNWYGG

SEQ ID NO: 984178 - protein, 43 aa, Homo sapiens
YLTSALASSGLLRTDSASALAVPVLSTAMLRALQLQKSLGELS

SEQ ID NO: 984179 - protein, 44 aa, Homo sapiens
QVTTDTGSGDTEGMPVSFPFSSGMTLPTACAAPVRRDDVLESPA

SEQ ID NO: 984180 - protein, 61 aa, Homo sapiens
SVGMQPALLTAARASNSTKVDKTSRCLHGPIPHIAHMFLALKKWQGPKEFVTKRYAPLTPR

SEQ ID NO: 984181 - protein, 105 aa, Homo sapiens
GIVPTGTWGLDQETHSAYRAWRVDELSVVDYGLASLGGQYGDDAHEAPATCPVLTNVPSRMSLCGKLSAYERAQRPVVPVTRHIVPCQCQCACRSHICSRHLWEK

SEQ ID NO: 984182 - protein, 37 aa, Homo sapiens
PKILLDCLQKHIPNIVKIHEKFFNRQLLWGPERKYSP

SEQ ID NO: 984183 - protein, 53 aa, Homo sapiens
VHGYSHYNLMAMEILEIPFDTYTYTGTTYLIPQSRMWIMSLYVSDIIIYQKFN

SEQ ID NO: 984184 - protein, 56 aa, Homo sapiens
LYHNKVQLTPTGGLGLNLALNPFEYYILFFALSLITQKPLPSGLHVRTGDCAYCIL

SEQ ID NO: 984185 - protein, 60 aa, Homo sapiens
LYNAVLTDFYQATTLSLQVLGTLVMLGLGSSTHNACSRSSVVVAKTKSACLSIITQISTT

SEQ ID NO: 984186 - protein, 76 aa, Homo sapiens
RHAGVAVGCGSSLLPSFPHNLVPSLICSSCTSLLRTWPGAVAHVCNPGTLGGQGGQITWGQEFETSLANMVKLHLY

SEQ ID NO: 984187 - protein, 57 aa, Homo sapiens
PSEHCLLAGSHRGCMLPSVLRYSSFWSPLVAPVGALLVVKHPFVVLHQAAQLLGQLR

SEQ ID NO: 984188 - protein, 38 aa, Homo sapiens
LILNIVVLTPINGRLCNRGVVAGLFGCTIRCRSSRSTV

SEQ ID NO: 984189 - protein, 95 aa, Homo sapiens
SFAQRCRCYVGHICQSLESAKAGIRVPRTHQWVLCKPERTVLQIRDWSASCVAAEYWSQEPAMRFLRTECCFRAGSSISAQEKVIFPEDVSPKDQ

SEQ ID NO: 984190 - protein, 42 aa, Homo sapiens
GLESDGVGPSMSCAGDAGFPVRHISAPSPWGGASALGSSLFT

SEQ ID NO: 984191 - protein, 150 aa, Homo sapiens
SFALRCLWFGDVRASSDNPHAGMPRDGWYCTRWLLCVPGRWRGRCRGVRVCHETFIKVKFIHDQTSPNPKYRGFFHGVREIVREQGLKGTYHGLTATVLNQGSNQAIRFFVIDLPAHWYRGDNPNKPMNPLITGVFGAIAGAASVFGNTP

SEQ ID NO: 984192 - protein, 79 aa, Homo sapiens
TLEDPDWIVLLIVRVHCVRQALVYSRGLLDLLASDGSRRVVPLESWRFPMITRSPTAPVRDRCVPQHSSTEVCSAALDA

SEQ ID NO: 984193 - protein, 122 aa, Homo sapiens
SQSGELSKPSDALLLAVAIAAHVALVFAGIRSFWISEVAPVGALLVVKHPFVVLHQAAQLLGQLQSQVLLGSGLSAVLTTVCVGWSREAISSSLMIILLMMECTVGRSSSNMSDSVSMLMES

SEQ ID NO: 984194 - protein, 58 aa, Homo sapiens
MPLDFCWSSLRRSPARSVGRPRDDWVPRSSVGWAASGLLLLVRGCALLRCPPRGLALS

SEQ ID NO: 984195 - protein, 100 aa, Homo sapiens
HLHNKTSCPRVHTFEQEYKRSETESIRQDKEIKGMQIRKHEVKLSLSAHDRIKYIENPKLQKWHQRNLRTDKFTELAGYKINMQKSAAFLYTNNELAEQE

SEQ ID NO: 984196 - protein, 58 aa, Homo sapiens
FFRPGLALAIVTEEETEAVYWMLPPTATEGPEHQILCLWLLLEGPGCMRVLRLGLTYW

SEQ ID NO: 984197 - protein, 56 aa, Homo sapiens
STGSRHRPHHRDLRERSPTHSCWQYAVVSYVLGIDLQYWAVSIGNVDGHLYPQAIL

SEQ ID NO: 984198 - protein, 77 aa, Homo sapiens
GGLRKLTITAEGEGEAGTSGHVGAGETERVKWEGCTLLNNQIPQALTQYHENSKGEVGPHEPITSHQVPPTTLGITI

SEQ ID NO: 984199 - protein, 64 aa, Homo sapiens
MSSSNIDDFQYPAARRVGAGNTRRLRKMAIQPVNNRQRLAERLTVVREQRRHQSDRVHSPICQL

SEQ ID NO: 984200 - protein, 148 aa, Homo sapiens
RSATDADEDNSGWLGVGKDDADHSKPGAWRPGPSPLINQYSLTVGLDLTPHDTKSLLKCVESLSFIVRDAAHITPDNFELCVKTLRIFVQASLNGGCKSQEKRGKSHKYDSKGNRFKKKSKEGSMLRRPRTSSQHASRQSDDDEDEGE

SEQ ID NO: 984201 - protein, 87 aa, Homo sapiens
LGIDHLLKRSVYQVVHNLHLALAMRTDVSPSHASMPHDELSMVVIDVSCELSVITKAVRILPFPPEFLGSKTLVMALVNHGMYTKPA

SEQ ID NO: 984202 - protein, 102 aa, Homo sapiens
MRLMSRCVLLETTGPVCRLVPRFVDCEILLEAGTIKLSLEVTWSPFDKDDQPSAASSVNKASTVTKRFSTYSQSPPDTPSLREQAFYNMLRRPEELENGHSM

SEQ ID NO: 984203 - protein, 34 aa, Homo sapiens
MPAIILDPHRPPIPTTSYYITDEGPRSLPYHQYQ

SEQ ID NO: 984204 - protein, 33 aa, Homo sapiens
SCKALSYSSPAQAVSCHRGSSLSDLFYHGMARS

SEQ ID NO: 984205 - protein, 40 aa, Homo sapiens
GRGLWSCTNCLDSPSLVVASIHEAVLRDETMSVIYKWMPS

SEQ ID NO: 984206 - protein, 59 aa, Homo sapiens
RLLTVSTELVQVRLAAGVIKNVEQDPGERYLEVSTGSRVTELVQGGMHRSGEYTSSWRH

SEQ ID NO: 984207 - protein, 118 aa, Homo sapiens
HFVGSNSPGGLHGSWLQPHVGLLFHSAPLHQRLLPQALGQRMRGHAGRGCRRCSLGQDVSGIQTPSFPIHVSRIFFHNPLAHGRQLGAGCTVQLWSPAPSSLHAWSPSACQLEAWGIV

SEQ ID NO: 984208 - protein, 33 aa, Homo sapiens
CLESPARSLRTSTLKRQLSDQRLGGLPVAANLG

SEQ ID NO: 984209 - protein, 71 aa, Homo sapiens
VFTMLAAIILGPHRPPIPTRLQIRDEVNDSLRFSIEINVATKVVLKPTSTPTYGGLIFNSYILPPVIPRTR

SEQ ID NO: 984210 - protein, 34 aa, Homo sapiens
RVVYKPDTVAFVPKLVGSGDNSAESQDANYALDS

SEQ ID NO: 984211 - protein, 56 aa, Homo sapiens
ALLLLRMPRKEVCLGGLRSNGRLRLQNQPAEEALVVWPCASASSCEVSHVPYVWAF

SEQ ID NO: 984212 - protein, 41 aa, Homo sapiens
LRGGRDKGGLTPVYGSRNPLESEARDLVACPDLACNGHLLP

SEQ ID NO: 984213 - protein, 104 aa, Homo sapiens
MLRCSPSYKLLLACAVWPPAPWVVFSGVRSVSLAGLSHGRGIEEILSDLPLRANPGLPPELIWVAGAGHVESALHVPWVKLHLAQGRPSDFQLVTHVLNPLTRA

SEQ ID NO: 984214 - protein, 61 aa, Homo sapiens
HLLGRPASFSSSSFIFPQKIRVRSGRSIARVLTVLKQTQNDPLRKFYKGKKYKPLDISSRR

SEQ ID NO: 984215 - protein, 55 aa, Homo sapiens
TASDGEEVAGVGLWDTVQASWTGGGRGRRHWLRVALCREYGLSAPHTSEVGFGDA

SEQ ID NO: 984216 - protein, 34 aa, Homo sapiens
RRGELETATTFKEAAGRLRMNVEKKIDNYTEFCL

SEQ ID NO: 984217 - protein, 41 aa, Homo sapiens
MLLLSDDDSGVGGGGKAGGTSLSVWRSSRRGSGCTAAGPPA

SEQ ID NO: 984218 - protein, 77 aa, Homo sapiens
MTRTEKVHALNDVTAVLNTRCDVLYYEGTHVVTLYVGLSSSGIASLRSSVQRANSGKVVLNLRFPQQDFLSEQIWLL

SEQ ID NO: 984219 - protein, 66 aa, Homo sapiens
TISACSGHFYALELIQQLRLQDCGDVLRVGMMHYNTQQEIDMLFEVLASEKVAEHHTQKDFCGTEL

SEQ ID NO: 984220 - protein, 113 aa, Homo sapiens
MVYTPHTHSQALTKHIAYLISICLRQQHSPRSNSHFSSKTPEASPRAVILIIAHGAYIPHYYFWLGKLQITETPLTGRIINPSLKGLHNSNSQLISFLDELLRQASVNPEALP

SEQ ID NO: 984221 - protein, 40 aa, Homo sapiens
SYTPHIRMNPVYIKSTTKIELNLNPPNACFNANPIASMTF

SEQ ID NO: 984222 - protein, 49 aa, Homo sapiens
MPTPSLYYPYGLYNKLHLNRSLHTLHSTPPESFTRRSSFLIIAHGAIHP

SEQ ID NO: 984223 - protein, 44 aa, Homo sapiens
STRHRFEVLKAAKNKKKKKPAGRVGAWGQERSQAAGQNNSNAAG

SEQ ID NO: 984224 - protein, 45 aa, Homo sapiens
SPASLVATLHPSTDKQLEKRSTYSTGRHVSLVKTDSTQNQQSKCD

SEQ ID NO: 984225 - protein, 30 aa, Homo sapiens
MGPFEELIVGTWKQEDIVSGRLCSRVICLF

SEQ ID NO: 984226 - protein, 58 aa, Homo sapiens
HLVVVKNAPSAIWPGTVALREILPLPEVHRAADQKAAFSCVWCCEIAMDFNDLTCDQC

SEQ ID NO: 984227 - protein, 168 aa, Homo sapiens
PGLLVAAVCCVLHIAIVHGWSGLCPISLVASGDGVRVMTAVPGANVCSSCPTGLASSSGQMEAAKVPLRLSLKFEVWCRHAGVTPGALKTPEGRLHALSETRLCFISRASLAEPLFVENDSSSSGLEDATANVSPMACSPRKQAAGPGRDFAHAGTEGSWGWASGDCC

SEQ ID NO: 984228 - protein, 76 aa, Homo sapiens
PYEQGAVIIGFPLMIKECPSPLLTTRTQPYSALIPSTDVIIENHHAYYSSSHIGPVHSTAKHVNSYWQCHPYCMLA

SEQ ID NO: 984229 - protein, 41 aa, Homo sapiens
SDYTVSVKSVRPFLCQFVNLLLQVVRCQLTPKWGRCVDRVK

SEQ ID NO: 984230 - protein, 81 aa, Homo sapiens
MAEKYHNVGLSKCEIKVAMSKENISKQQAGSDLGGGLAGRARGRGGDHQSGYGKVSTRGGPQHSYKPYYIIPFATYTQQVV

SEQ ID NO: 984231 - protein, 89 aa, Homo sapiens
TRSHYSLSLSHSYPNIKENMLLSVTSRPGYFDYGGTIETTRSHMCHWLSRWHHLAQATVHLNSSSEDAMAKDQLEQNQAYTSRLDEQRV

SEQ ID NO: 984232 - protein, 59 aa, Homo sapiens
PIFGETTAPACFDRDVQGKLQVKDKCPRGPGLAELHLVFDLPLSDGHSQLTIHTPGKHP

SEQ ID NO: 984233 - protein, 116 aa, Homo sapiens
MYSFSPGNCTADKAQQNAAHDVLQFLNGMNKTGCFLGMLHVHTMYYIAPNKSKELDFPALACTHLAIDYTTGKQESVYVGWIPELQLTREGRRISSLTGSQGIVILGEHMLIRFTE

SEQ ID NO: 984234 - protein, 33 aa, Homo sapiens
MIPAISCTYWWHELLSISQRAVMALSYLTARYF

SEQ ID NO: 984235 - protein, 55 aa, Homo sapiens
NDAVAPSGAGGVLRADQIVNQNLPPPPPAPGSPAHNTLQQQAPAAKPGKNLYMAI

SEQ ID NO: 984236 - protein, 35 aa, Homo sapiens
STVEHGMHRLHICVAVPLIVVYLTGSTEYDMAHKC

SEQ ID NO: 984237 - protein, 59 aa, Homo sapiens
FLHTFFPGLKLCATFEMKGLSCLPSLPPGHVSLIIFTSTAWRDHTRSIPTTVIKFNCTA

SEQ ID NO: 984238 - protein, 83 aa, Homo sapiens
GGGERGTKYPTCQDEELELYDLDKTRKSKLHKIIRSTKYPEYLTSPTSPCALVHIKCLEGYTTNWYPWLLYGEESSVFRAVAV

SEQ ID NO: 984239 - protein, 115 aa, Homo sapiens
YNVSSIYEYCNVMVKWSIIKHKLQMEIIKLSGVGHLNNNVKCLGISQRNLGLLIWISTGRDGLCSGRFLDAADRWLDFSTAAPPPWSAVSLLPSLGTGMGRGAEDLLKTASTRSQ

SEQ ID NO: 984240 - protein, 52 aa, Homo sapiens
MTLLSVALAHNIRLVSAWVLCVRLSSPACECARLNGIAEYRVVLHWILPEAL

SEQ ID NO: 984241 - protein, 88 aa, Homo sapiens
GQCYNRELVFTGRRCLLGSNVMAGVVVTLTEKIPLQHSSYSAKVKLDSLGVDAYDILYQSRVFIMNQYIINYCVGNVVSTVKRPKAGL

SEQ ID NO: 984242 - protein, 72 aa, Homo sapiens
QEDPFEAEFENSPGNISETLTLLKKKKGSWMRVDKPVVPAIQEAEVGGPREPEESEAVVTYDCAIILHPGQE

SEQ ID NO: 984243 - protein, 93 aa, Homo sapiens
MTESPGCSNRETNTRIPWYQCYVLMGWRGIIQGPPGPGLIACCVMAQSFAKTGCNEHGREESKCLLPHNHMSKAEVKYSSGELIPPLPLFQSL

SEQ ID NO: 984244 - protein, 103 aa, Homo sapiens
GEEGGKAGTRRHSVCREVLTNRLSFLLGLKKKKFVINILLIGNRCTRRNLIVFIWRLGIFSLISYAQLYLGNAMRHQNEHAVSKNRLSGRKKYEQEEAPEADP

SEQ ID NO: 984245 - protein, 60 aa, Homo sapiens
GAGEVQAAAAGVSSGRSAGQLLEERKKRETHDALALECSRNWVLLLTKERDGMLWLQSVR

SEQ ID NO: 984246 - protein, 72 aa, Homo sapiens
PIVRSTSPYMDRSLEVDQDSTLASIWRSRTVLTVSTELVQGVHAPARGEYTVDHGSSLNRYFGGQHVCSLCL

SEQ ID NO: 984247 - protein, 37 aa, Homo sapiens
FTLFFRCNIISKSNIKRGKHMDFLSDFEMMLQRKKSM

SEQ ID NO: 984248 - protein, 73 aa, Homo sapiens
MYLGIPGPEHRRLLLTQMLPRHVARHRARAHSIQIMKVEEIAASKCRLSGVMLLHDSQIMFPLPDRVLRRRLR

SEQ ID NO: 984249 - protein, 73 aa, Homo sapiens
RTVAMHVIYAADGSGHTERTLKWAKIEPHCLGKRLTLAKRRDNRLFVEAVLWIARTGSPWGDLPERFRNWYGG

SEQ ID NO: 984250 - protein, 71 aa, Homo sapiens
AGRSEDPVRGIGALVVFPLQMIFLVVKRGVGLVLSAKLLGTCRGRTFVITVGGIGFSASVSPCYFSYPAVR

SEQ ID NO: 984251 - protein, 47 aa, Homo sapiens
EWRARVQWVDITHLEKNATLLFPESIPCGHPRPGASSTMFLHTAMTF

SEQ ID NO: 984252 - protein, 40 aa, Homo sapiens
GYPLYMLRTLDIRGQHRVGAVGGAWIAAVPPRYGKELLRR

SEQ ID NO: 984253 - protein, 40 aa, Homo sapiens
ELCWSESRVIPFVGGAHAEEEERHGRRRLRTCVEHGAVLR

SEQ ID NO: 984254 - protein, 52 aa, Homo sapiens
KVDIISSIHLSKVLTILLTDIKKSFISGPRFVHSGIVTLEQETAFPLLVRRG

SEQ ID NO: 984255 - protein, 120 aa, Homo sapiens
VVVLRIPVRCTVPGVPLMHAIGSHGVGGADRGLACGACRTMQLPDGFGSDQSEIVYRGAGSIRDAGGAFVPERAALKRNDMSEHRVENNWQLCKNTMKKTSFIMRRRLQRLQKEIERRRL

SEQ ID NO: 984256 - protein, 42 aa, Homo sapiens
PSSPRYTPALAQGERKEQSNTQSPTDFDSLEIQGQYSDIHNA

SEQ ID NO: 984257 - protein, 31 aa, Homo sapiens
MDAGMLWDLNEGKHLYTARWWGHHQTRCASV

SEQ ID NO: 984258 - protein, 89 aa, Homo sapiens
MTVLRWRTERRLVTDTLSANNAVQSVEACGYKTMLSLDCRRKLVTGRLDRPLTACRTGKHYDDPRKTCNYTHVLDLTFGFRSVLLLTTY

SEQ ID NO: 984259 - protein, 62 aa, Homo sapiens
MSDRWDTGMCQHAWLILEFSRDGVSPCGQAGLELLTSGDPALFPECTDYRHEPLQPTKTDII

SEQ ID NO: 984260 - protein, 63 aa, Homo sapiens
GNASDGGEIPSSVPMKVRGPVRRQGQVRVQSKDTDSIFRLQSAAPATEDTDVKSHAAGSKQHE

SEQ ID NO: 984261 - protein, 69 aa, Homo sapiens
TTGGEGGGRLFCRRLVAVGLRDWYLVVLVVTGRTGRDRGLVGVARGGAVGDWSRDLVVVVVVSVWTVVL

SEQ ID NO: 984262 - protein, 67 aa, Homo sapiens
DAACQTVEYDISTLLTLFSDSARLHQVKRQPCGHTKPVAGLFTRTRVKIHTHTHTRMDIYPTPAFVL

SEQ ID NO: 984263 - protein, 73 aa, Homo sapiens
MKAGYTDVAPTSADGWINRRGSYIHERMNKQTWALHPRTDGSTDVEPTSTDGMDNIDMAATSTDVTGDNQNVA

SEQ ID NO: 984264 - protein, 68 aa, Homo sapiens
TTSPARMRFSDLYMASLSCLLNYRVDFRRATHAVRRCSDEAPLWMDQLCTGCMKRSEKRTRRLEKYVG

SEQ ID NO: 984265 - protein, 99 aa, Homo sapiens
WAQQGCIAATHVRLLPNEMWICVCARSVGSIPALCWICVPMEEGGGVSPPSTALKSSQDNYMADMDELSSQVDEKRKVSVCRLLTMAGRYSCSAPFRVP

SEQ ID NO: 984266 - protein, 148 aa, Homo sapiens
LDDPGLLWLLVIDWCVFMVFLSGELEPRAGIPEICGLELECALGKTHKGGDCSSGPQRLVSFRLIRDLHQHLRERDSEDYISMSSYEGSEIYLPEVVKPPRNPELVARLEKIKIQLANEEYKRITRNVTCQDTRHGGTLSNQVGGRVP

SEQ ID NO: 984267 - protein, 64 aa, Homo sapiens
ESGKKTGMEPEEYDSDILRTLAEAYKIRLTETSHLNPNRLLCAHRETGALIELRVHISDLDLSK

SEQ ID NO: 984268 - protein, 37 aa, Homo sapiens
QYRTSTKSHYPPRPLDYYLPAPASRRLTLYPHSCELT

SEQ ID NO: 984269 - protein, 135 aa, Homo sapiens
VSGLYKPWVFTAQSSQREAHVTPFAVCVSSLSLVCECFGQPTVDKVVAEEPQRELRPLLPRNVARLLYKSVPDHISNQQVKAINQGLRADLLPRMIVLLVLTSGRNSTAFLCFFTSSGVEDLRTFMSSNPLITPS

SEQ ID NO: 984270 - protein, 104 aa, Homo sapiens
MGDCFNKSVSQVNGSGEAVLVKRDKLGLGMVAHAYILELWEAEAGRSLEVRSSKPAWPTWFSRNPVSTKNTKKLAGRGGAYLESQLFGRLRNGYHVQGRQKCAW

SEQ ID NO: 984271 - protein, 38 aa, Homo sapiens
ESKQCPESIQCPESKQCPESKQCLVVMKWARAYIILRA

SEQ ID NO: 984272 - protein, 33 aa, Homo sapiens
SYAVLTTQPRVLTLTTPVAEEGIARLILVKTDP

SEQ ID NO: 984273 - protein, 88 aa, Homo sapiens
STAQCVDTVRVQQCIPLRGQHSLYCSHYQKQLAISRVYTAIHIHAYNGDFYVGRVLKILSSDTFELKYDSIWISNFSFTLVRVDKMQS

SEQ ID NO: 984274 - protein, 70 aa, Homo sapiens
MHRLVNSRPYYSYKHCAVGCQAFRDPGELYPNIGLLGHGRSYNSHAGCPNGKRTRNKMYSGTVGVQSASL

SEQ ID NO: 984275 - protein, 87 aa, Homo sapiens
DTSMTRETPRRTTYHLQNQSTPHTGITHTDTSRPRAPLTQTPPDPEHASHRDPITRKPPRPETPLTQTPPEAEHSLNRDPSHGKTTR

SEQ ID NO: 984276 - protein, 113 aa, Homo sapiens
YSEDSPVTCFGLTTIVTEHVTPITDVTVRGSLWLQKTVDAVDCRRKLVQGDLDSTLTACRTGKIDDPVHIVLTHVLDLTLVSDCFLLHLLVTLTVTDYLLTATYIRTVFTDAG

SEQ ID NO: 984277 - protein, 47 aa, Homo sapiens
MLGWTLWLAAVPNTNTHWYWGETVTSTSAKSLVYGIRGGCDGVLLLA

SEQ ID NO: 984278 - protein, 125 aa, Homo sapiens
SLPASVQLEQPLEHPCDGRASHVDDLPHLLLVCEQIGQKIRKITDCFHCHVFPSLACMDVMALPRCPAAAATCRARSCRSSSGTHERFLSHVLVPEIAAPAACHWHVQVHNNEGRATLALNHRTP

SEQ ID NO: 984279 - protein, 52 aa, Homo sapiens
SNIEDTKALLRIEQVKERGRQLQEANRESTQRGGPYYSTPYTHAKPPATVTH

SEQ ID NO: 984280 - protein, 63 aa, Homo sapiens
VVASICNQSQQQYTFLLVILPCSTSLIHQILLESYFLVLVRNFHRNRVGGHNQVGVRKQVVRP

SEQ ID NO: 984281 - protein, 44 aa, Homo sapiens
RGMEYLESKCYAYTGTWLLGTAWLTEKNVLTISDFGMYRAGSRW

SEQ ID NO: 984282 - protein, 43 aa, Homo sapiens
ATNDVHDRGSLWLQTNVEPVDCRRNMVKGDSKYSAGLYGRVKL

SEQ ID NO: 984283 - protein, 60 aa, Homo sapiens
MLDEVSAREPRPTLADCKYLGWLEEQLQARAETLVWLCTNETRSTHTLDLYQAALGGPRP

SEQ ID NO: 984284 - protein, 120 aa, Homo sapiens
MSRYTVEKHRRDTHTHTHTHAHTHALISPKVVCHVLIARGRAVEVCHQDLGPLIRNAVSPPGGVRAGDRVRRLVASYMICGHTIILFRASVSSLRASSFFQFLKPSDEMSGKLYPPVPRY

SEQ ID NO: 984285 - protein, 45 aa, Homo sapiens
YSHTAGGAGSDQACRCPPALPGYSHMCRCALAAAVTSTHNVSLSD

SEQ ID NO: 984286 - protein, 82 aa, Homo sapiens
LIPSNYVQVYLEKHTQEHTHTHTHTRTQHALISPKVVCHVLIARGRAVEVCHKSVASSSKLYITLEEIRARGQSQGDLCIAT

SEQ ID NO: 984287 - protein, 48 aa, Homo sapiens
MTVTRPVDTPCGYQLTLFDAVRLPSDKLVTRDDLERTSDVLVRTGTNY

SEQ ID NO: 984288 - protein, 39 aa, Homo sapiens
MRCSIGGVITNDALPCCWLQIHIVHDLCQPCPPAGVSQL

SEQ ID NO: 984289 - protein, 115 aa, Homo sapiens
PGRGSHGYPQAEKQRVERASSTPWEEEESHRPYSRGKTKRGGVLLSVVKANKPFKSVPYLCLSLLVDKLDLFLQSSLLYVVLFTVYEENPVSHRHTAPMTDHLPKVRFQVIQLIS

SEQ ID NO: 984290 - protein, 41 aa, Homo sapiens
PPWLLRTGPGTVPLEVPQVKAKRTDDGKGLGMQLEVGPLGP

SEQ ID NO: 984291 - protein, 42 aa, Homo sapiens
DEDVVVGFVKCVGPPGESGELLWRLLKGCDGGGEVGKAVHGG

SEQ ID NO: 984292 - protein, 70 aa, Homo sapiens
MLYPWECFVFCLLIFGNFTNQIHTWSAHCTLGMHAVVTILQDWYVILPRTDHRIHHVSPHENYFCITRGW

SEQ ID NO: 984293 - protein, 135 aa, Homo sapiens
MPQGHDGGHDNMDIDQVDELMQDIADQQRTCSRRFQQTISTTCSGSEYEFDEELSSWLALEELEQEELDQNLLELSGTRNSTSTKSSLYSPTIKTRQEERRGGRRHEGIGELGWIHVMGSSAGLGPDRLRWPAQR

SEQ ID NO: 984294 - protein, 110 aa, Homo sapiens
LLCESHIKNIFTETSKLEFDQTRVPGPRQVDAENSPSHIIWEEDSDSDSTSNPEGSAQCPLWCQGAHQQLVTLANKLNDTEHKPEEQKTEANIATEVSSKEQGEVNKSKQ

SEQ ID NO: 984295 - protein, 103 aa, Homo sapiens
SDLFELGELWAPLTWAVAFRCDTLSIVLRHGLTIFTAGASFRERLQRPPAHRITSSDPWVPDPQFPDGRLGLLSGDCLGTCHVVCLRLDPRTPHDSSGTSGTL

SEQ ID NO: 984296 - protein, 56 aa, Homo sapiens
ILKALVCFSDLYMASLSCLLNYRVDFTLFDPRRTPLQHEAPLWMDQLCTGCMKTPF

SEQ ID NO: 984297 - protein, 97 aa, Homo sapiens
ALLADMSARRLYHRSSRSLVADIQLLKTKVTVKTKGRHTLIRVHEESYFEVWLVKAHGVSKPHDQNQSISSSFLASIIATTSQLLLSIFIERWQLKP

SEQ ID NO: 984298 - protein, 77 aa, Homo sapiens
MASLDPAPASQRSLQALKFLKSSSPGPGHASLQTLQAQLLHLGGPSRPSLCLPSVSRVRHLAHRRFFTPSIWLTVEP

SEQ ID NO: 984299 - protein, 43 aa, Homo sapiens
MHQFLNFSPIEAPSEPAAFAAHPSEQSLVVTQEGSTESQSLRL

SEQ ID NO: 984300 - protein, 49 aa, Homo sapiens
KVDKGERPTELKRKFEQMKQDRITRYHGLLYLICEEILTDWYCMYETSP

SEQ ID NO: 984301 - protein, 121 aa, Homo sapiens
LSCLRELSYMSYLSPSSGIVLQWHNLVGLPPPSSDPLTHLLAEFLLVAANSMPISSRSCPSSVTAFLSRSIRTLLLPPVSRFRFFSSARTSITLQLAEPRSSQSPNALGREKPCHGPESPD

SEQ ID NO: 984302 - protein, 100 aa, Homo sapiens
PRCVRDGARGWQTVPCTEFRHTMWPFCSSSIQLLQKALSGPRTGPRGVDCRWDLREGIIITCPLTLFPCDHWCALFTYGWCMSPTFSRDGLWALWYTSFP

SEQ ID NO: 984303 - protein, 137 aa, Homo sapiens
NALEGGDDSQNELQSSFSFPAEELCVEAGVVERKIYLHPLYLEKEPAYRSQGQHSPLLWGQYTVERQKRLLPTGRKAGNWEEDGWLASFSLEPAGSIQEVVDSCLKKIAPRLGLRVKGHPRCTVTHLAFCRALGTEL

SEQ ID NO: 984304 - protein, 37 aa, Homo sapiens
PPPPGSVSSAFLVRACAWSIAWSNSLDTERFGRHHAS

SEQ ID NO: 984305 - protein, 41 aa, Homo sapiens
LTPWAHAEAGPMSRCCAGRSSWEMGVRVIPNNEAPSRSAPG

SEQ ID NO: 984306 - protein, 79 aa, Homo sapiens
LLASVNRFHARVCADGLCEHIVVKNAWTTERFGRHQPLEARTGRAGEKPGAGTSMSTGAIATEVSCPQDPEWFEKCAGG

SEQ ID NO: 984307 - protein, 73 aa, Homo sapiens
CVLGRRLGMHRGVLDGMLMALAQTEGAVRHDLYSYRLETSHGSRACQSHDTAWLLVDEIYRQWSLERRQKSRC

SEQ ID NO: 984308 - protein, 52 aa, Homo sapiens
MKHRCQFREAMLAAFQAARGVHGEGAKDSPFDGFRGESKKLRDVMGHGNTLE

SEQ ID NO: 984309 - protein, 73 aa, Homo sapiens
RLCQWHYRRIHKKQYLIIPYHHKPPSASLTSTSTYANSTPLHSHALSFFKNRKNTNDSLNIQNPPHFSPQSSP

SEQ ID NO: 984310 - protein, 55 aa, Homo sapiens
MAYKDSTVVISFLGFRSIEGKFLGCIRHHGIINLMFNVFLSNLNQEFLTEVIPSL

SEQ ID NO: 984311 - protein, 93 aa, Homo sapiens
PSDRVLTITHLLRVEGRVSRHSGGVLRLSSARVVERGVSTHSRRCLDDYHPAEVMERGREHTLREGVLETYPSARVVGQGECSTTLWAGVYEA

SEQ ID NO: 984312 - protein, 96 aa, Homo sapiens
MGIGMSIGIATPGYGSIWWPGALYRPRQQNRIIEAMIPGEAVAEEHLGSGYRKDDDYRGGGDRYEDRYDRRDDRSWSSRDDYSRDDYRRDDRGPPQ

SEQ ID NO: 984313 - protein, 99 aa, Homo sapiens
MSEQTVVTKSSRDPACFASSPRMIPRSSRLGGLQGYHEYAWLSVGHLEELELVVKKLARSFNHMDGFPENTLWLYVQYVLQVCHIQSFQCFLQAAEAAL

SEQ ID NO: 984314 - protein, 134 aa, Homo sapiens
DEQAAKDSVAVTTTTQSSYYLSPDPASVQQPILQNKFRAHTAVTIIHCCYPSQGRSRLVPVTKLSQVSWLLSFARYALLSCSSQSVPAENTSQIQSLLYSWPFCAAPVALQIKARAFMVTVSSPQAPDLSPHIP

SEQ ID NO: 984315 - protein, 68 aa, Homo sapiens
MVMLKSSILGGEMGGSLEAGVQDHTGQSGTTPSLLKVEKIQPGVVVGACNPSYLEDSGTRTVGTQEAE

SEQ ID NO: 984316 - protein, 48 aa, Homo sapiens
MGAYNRGDHYSDCQRQASRKVALAYYEYTGGKYCKKFDTIQSCLLNQS

SEQ ID NO: 984317 - protein, 49 aa, Homo sapiens
RIYALTVGSRLWLPEEASARMQMDAAASRDYGREYLYLVYSKDRQAVCA

SEQ ID NO: 984318 - protein, 43 aa, Homo sapiens
MSAKLVSNSWPQMIHPPRPPKCWDHRHESPRQAWEPFLEEVLV

SEQ ID NO: 984319 - protein, 97 aa, Homo sapiens
RRGGDGGVSSPRFIAIICHQHNKICLGNLVVVVTLYKKSYLLTQEKELVTFEDEVDQIKEADKNSILHVKAEVHKSLDSYAASLAKAIGAEAKINLF

SEQ ID NO: 984320 - protein, 45 aa, Homo sapiens
MRRRRVTYALENERVFTCLQDEIIDKSYTPSKDRDMPRNWARKGQ

SEQ ID NO: 984321 - protein, 67 aa, Homo sapiens
MQFPARLNQTTYTDTDRGYPTVYALQSSGSTTYCFMPIVLELFPLTIFEIRARIYPYSTPISRYDDG

SEQ ID NO: 984322 - protein, 68 aa, Homo sapiens
MLIEAVVSCHEGSTEDSTKAKKLQHLSNLRAHSIDTSDSDDKRQIGDSAGYIERGQHFLDQSSASSKF

SEQ ID NO: 984323 - protein, 62 aa, Homo sapiens
VLRGSPALTESLGRSECEIERLERLTAALDRLRQLRPGTEVSAVVSPLRPRQEELGLCAHEY

SEQ ID NO: 984324 - protein, 143 aa, Homo sapiens
EPRRKVVDPLSKKDRYDVKPHAMYNHKKYWKARSYSRDQGTKIASDGLKGRVFEVSLADLQNDEVAFRKFKLITEDVQSKNCLTNFHGMDLTRDKMCSMVKKWQTMIEAHVDVKTTDGYLLRLYCVGFTKKRNNQIRKTSYAQ

SEQ ID NO: 984325 - protein, 32 aa, Homo sapiens
RSNYELFNLLQVSKVNSLWHVGTRSEVGTRSE

SEQ ID NO: 984326 - protein, 48 aa, Homo sapiens
LTVGLGVNSVRGKNSVRGENSVRGGNSVRGENSVRGGNSVRVENSVRG

SEQ ID NO: 984327 - protein, 111 aa, Homo sapiens
SEGEMRAGTIIEVQGDQGLSLDKHGETPTLLKIQNRQGSWREPESQLLERPRPENRWTQAVEGAVSRDRATALQPGRHNKTPSEKKKMKKEGAREEEKMHRNGSMVRMQNP

SEQ ID NO: 984328 - protein, 49 aa, Homo sapiens
MPKRVTKAAAAEDGDELTTEPEARKSKTAATKTDKVAAVEGPALYEDPP

SEQ ID NO: 984329 - protein, 57 aa, Homo sapiens
QVEQNSAEALRSRPIYDRWRDRKCNRPACKKDMCFDDRQCGRMEQAQALEINRTESV

SEQ ID NO: 984330 - protein, 85 aa, Homo sapiens
MKEMGRRSFEHIQRIDRDVSGTLRKHIFFRDRCGTKQRELLHILLAYEEHNPEAGYCRDLRHIDDLLLLYLAEEDALSALAQLLS

SEQ ID NO: 984331 - protein, 122 aa, Homo sapiens
PQRERIYPPGQDPAWKHSSNYSSAGAFNNVHASALNRAEELPDLRPEQRDVYTLTARMSLASEGTDSLTHACICTHTDSDLLTAGIELHPSVLSTNYRAPKLRERRSRDGKDLTDGKSSSSP

SEQ ID NO: 984332 - protein, 60 aa, Homo sapiens
VTYDASRSAYRNAIACVPHRRRHHVLAELTRVVNPAIDLCTIVMSDKYERVIYLGFMAVK

SEQ ID NO: 984333 - protein, 97 aa, Homo sapiens
MSQIYQSRPSILQKEETDELKRVDDPGLMLMVFKLPILLTNHHYLQPSLFVYPEESLVIESSTLLSALLIKCLEKEVAALRRYTPPDDADVVSARQP

SEQ ID NO: 984334 - protein, 69 aa, Homo sapiens
RRADTLYVDYRHMGFEELLDEEQYGGSEYLKTPGGAYNVDAYAQSVYSLEFSARKALRLPLRLNVYNEE

SEQ ID NO: 984335 - protein, 30 aa, Homo sapiens
MLLSEDYNGPRLVWVLSAPREVATAIQWGH

SEQ ID NO: 984336 - protein, 52 aa, Homo sapiens
MAVVSTKRMSYRNICNTLTRISWTVDSRCDTHTHFKAHTTYSLKYLKKQNHD

SEQ ID NO: 984337 - protein, 51 aa, Homo sapiens
MVGHGSVLQSLCHMEDGVELLGLHSEVGAGPVCTPAGPARAPFQTTTDRAS

SEQ ID NO: 984338 - protein, 32 aa, Homo sapiens
MEPSEVPTPKRPRGLTKWEAKTRVLPRPVVPP

SEQ ID NO: 984339 - protein, 63 aa, Homo sapiens
DNVDICNLSEYSSVPAMSQDKSLLDGEGPQAVGGQDVAFSLKLPPSERGLAAPRTGRANRMDS

SEQ ID NO: 984340 - protein, 33 aa, Homo sapiens
SCAWSSRGPEVDTGRAGTRATSRYDHIYNVIVT

SEQ ID NO: 984341 - protein, 69 aa, Homo sapiens
VAVLEDPERWKAKQEQAFTVEEQDHEKKGKVPHTFKQPDLTLTHSLSQEEHRGNAANPFMRTLPPWSHL

SEQ ID NO: 984342 - protein, 73 aa, Homo sapiens
MRSRGYPSGCNVSLRERNIKQGSRTPLYPQSSGGKKKGKMKNARPSNGQKTYSWRLQGDGSRTLEARSTWLAH

SEQ ID NO: 984343 - protein, 70 aa, Homo sapiens
CKRERKDREAYLDGWMLSRLCSPQCPVSVHEAIYAYALQVFPRQERVCVLRCRVTSEKNHVHSVSPCEAL

SEQ ID NO: 984344 - protein, 34 aa, Homo sapiens
MKVPRQLFRPRTRVGPHHYASRLIREKHPQLVRR

SEQ ID NO: 984345 - protein, 58 aa, Homo sapiens
MPHCQRRMPPERQRNRKRQSDIPHGVVAQQRVVMDILRCPDQPGQITLPIKDACHPQG

SEQ ID NO: 984346 - protein, 67 aa, Homo sapiens
ATSMVNTGPCRTSSGRMPPERQRNRKRQSLIIPHGVVAQKRGGHGTSCDAQDQPGQITLPIKDACPP

SEQ ID NO: 984347 - protein, 35 aa, Homo sapiens
HTNPRRARKSPRSRRAQEPHPPIRSEVSPLQNRDR

SEQ ID NO: 984348 - protein, 111 aa, Homo sapiens
ALGLSSSFSISKEVWRGDVVDPEGFYGTFDVHLGFGRPPGKIYEDMKKPLYTHMDLPPIASAIPAYSRRGDIVIGDRAACVAIQKGLQASRSDIKLFKHNDMVNPSATRVP

SEQ ID NO: 984349 - protein, 77 aa, Homo sapiens
MSVPVKAINEASNLLGQWIIQNWHEESNQLVICLKEETLNRLWTITLLDACSHPEEEVEPILQKIYIPIAETLFRGS

SEQ ID NO: 984350 - protein, 39 aa, Homo sapiens
LLYPWLMGLSASLVSPNLTLDGFTDGQRACKLAIRESIE

SEQ ID NO: 984351 - protein, 89 aa, Homo sapiens
ASLLLYVDARLGQARSSTVFVILTGAYCCPTEQLLLGFLGGQRVVSVSSSGSVRAMMATSSSQSYDDRQLPYSWLRVQGSTFASFNGHT

SEQ ID NO: 984352 - protein, 55 aa, Homo sapiens
DLVRCFYQSNTPPFVASRTRRSNKTLNLWELYGPKVFYTYTIILTGYIYNRHNYG

SEQ ID NO: 984353 - protein, 80 aa, Homo sapiens
RVGEAEDAPGHDITEHSALIHEHYTREAPSLMHLTVDTCLQIGRMSLTAYTSTSMGVTGSTMGVKITRVTVRCANYDTVR

SEQ ID NO: 984354 - protein, 115 aa, Homo sapiens
STSVGPPYEATQAWPGRSDPFSSYVYGFELRTRQLCRQVLMFHCFPDEPDMGSAPVLVRRLLLEYRPSPLGYSLLHAAHEQAIDRAGKVQSRPPLEFIYNAFELAPDPRRYAIET

SEQ ID NO: 984355 - protein, 126 aa, Homo sapiens
KARKGVWSGKRNPNSASVDAYTKSDAVTVPARLYLNHGDNLKTESVVHQKLIMQLIPQSVCLTTLGPLFLELKDGQFHFTNKDLESLRGLYRIMGYGFAGCVHFSQSAPCEVRVLMLLYSSTKTIF

SEQ ID NO: 984356 - protein, 43 aa, Homo sapiens
RLRTREDSSLFHAKQEVVSIIPVYQKQVSQLSVEKRASQSAVL

SEQ ID NO: 984357 - protein, 34 aa, Homo sapiens
MSGRGLGGEVDPRLQASREHIFPQVVSSLHSDMR

SEQ ID NO: 984358 - protein, 65 aa, Homo sapiens
EDPFLATTRSTGFLAVDLLCAMSGLPCCSAGPDAGSAGEHLRRGLSSLVAFLGYLLLLKGFFTGS

SEQ ID NO: 984359 - protein, 124 aa, Homo sapiens
ASHLACVASCYNDCFVCHPYWLATFSAICCDASATVPLWGRRASRTGSDHLRDKDGLWAVLAWISILAIRKQSVERSFSKIIGKSMAGNYFTRYNYEEVEAEGANKMMKDLEVLMMDRSFVVKQ

SEQ ID NO: 984360 - protein, 46 aa, Homo sapiens
RFERIPAFHLVLRLSIQHLVPITVSINAELRPYCLARQEQKYQQAP

SEQ ID NO: 984361 - protein, 87 aa, Homo sapiens
RSDKGALDDDDSGPRFRQQTGKQGLVEEDKVVCPLFPIASHWDFLLIIVPSEPTRLLLDWVTHFYDDTFRNTSGNMVKVDRGSPRDG

SEQ ID NO: 984362 - protein, 88 aa, Homo sapiens
GRKRGPPWEINPLSSCSLLHEKDPPTISAPQTNQPKEHLTNFKSDLLSLAAEDCCCQMTLEAPWTITDAQLWITLTVEDRNIRSLSPS

SEQ ID NO: 984363 - protein, 35 aa, Homo sapiens
VTTDYQTADTHYLTTYMTLGARHSPTSDHYSTQAH

SEQ ID NO: 984364 - protein, 64 aa, Homo sapiens
MPCSPSLLKSADARSYHLKHRRSKRCSAAENHDHCNSTPRAIRAETHVSKEINKILKHIHVSTQ

SEQ ID NO: 984365 - protein, 46 aa, Homo sapiens
SDLLLRSTSKRVGFEAVPNAAFLYCLSCHFWSRREAAAYWLAGDPS

SEQ ID NO: 984366 - protein, 45 aa, Homo sapiens
GRQALAKALGRSTCLQARGTEVSPKRDTVCMEDSARRSHLGYELN

SEQ ID NO: 984367 - protein, 116 aa, Homo sapiens
QGQQSVRKGWPSCGTSRHTGDPGERPQQRVCHHHKRNTPVTHQMQRGTEKSQERQTNKHAFCFLFLNETAPSRQKHNLAAWCSRQSEAERWQAGISGANRHSSSSSSTSRELRDLG

SEQ ID NO: 984368 - protein, 62 aa, Homo sapiens
VIIMTCSRDGEYVHRIGRTGRLETITGIATSFINNACDESVLMDLKALLLEAQAEGAARAAG

SEQ ID NO: 984369 - protein, 86 aa, Homo sapiens
KILYELALSSARVLSIGTITHHSACCQGARTTKREHAASAVVHALGDPPSAVLSRADLPPDEQKLCATPATSDCRAAEIFPKLVPP

SEQ ID NO: 984370 - protein, 47 aa, Homo sapiens
MIPDSAPFEVLKAAENKKKEAAGAALGAWGQERSSGRGPDQTPSAAG

SEQ ID NO: 984371 - protein, 76 aa, Homo sapiens
MEDSAQEIATCNSRNGNPAPKITWYRNGQRLEVPVEMNPEGYMTSRTVREASGLLSLTSTLYLRLRKDDRDASFHC

SEQ ID NO: 984372 - protein, 37 aa, Homo sapiens
MGRERVDNHVKAEKDSNPTLCPLQVFPILPAPYPQPA

SEQ ID NO: 984373 - protein, 35 aa, Homo sapiens
MAYDLLSQLVSFRCSQKDPEALEVQAPSMHRDPCR

SEQ ID NO: 984374 - protein, 41 aa, Homo sapiens
TGDSFMKQISSFTVRNLGGIQAGFEYKRAIVDCIISIIEEN

SEQ ID NO: 984375 - protein, 42 aa, Homo sapiens
SYGSSDNSMSFDPSSSSKTRTLVYPCIEERQPLQLHGHIGIR

SEQ ID NO: 984376 - protein, 36 aa, Homo sapiens
MAQDAGRQCQLRTLDIDDLLGEGLVTGACVQAIATA

SEQ ID NO: 984377 - protein, 77 aa, Homo sapiens
LIDQNRRLDLYSVLRRLCYDALGKAENEGSPSTGQHEIYRIYLILPISDKLSFTNKDANICFQTVFSNIHNIPGQDI

SEQ ID NO: 984378 - protein, 115 aa, Homo sapiens
MASIRSCVETLRALGMHAGLRRRARVLLCLDPGVQLQAPPPSDPEAQAPASPPSDPGVQAPALFPQTQESRPPSLIPQTWEFRPPSLLSQTQESRPPVLPPSDPGVQAPILPLSD

SEQ ID NO: 984379 - protein, 131 aa, Homo sapiens
SLGQNRDGPFISSTERRASAHGHQSWCHPAPWGSNACATRAPCVQVGLLARKVSWAIVNEMVQRTREALGIKSMIVWPGCNSSTFGGRGRRITRSGVRDQPAQHGETAFLLKIQQMLGVVVHACNPSYSGD

SEQ ID NO: 984380 - protein, 67 aa, Homo sapiens
AGTALWDALAQAGAGARRMGEKPLYYGYSGAELVFASELKGLMPIPGFGRNLNRNALASFMRHNYIP

SEQ ID NO: 984381 - protein, 110 aa, Homo sapiens
SSFLSSWGRSPCWCMAGLKLLILLIHPPQPPNDAGDYRRVPPLPVPIIHFYLEWTTRSEHGFKLAAIGFLGLTSSLASPRGIPTGIYINMRVTRDIALFYDVLFLCMFSG

SEQ ID NO: 984382 - protein, 52 aa, Homo sapiens
MQSLANFSINEMTENTLTGRAVQLLRSYMSSLTHYTSNEKPIHGPVTTNAVL

SEQ ID NO: 984383 - protein, 41 aa, Homo sapiens
PTTGRLQKVFGEAINIKKDVYEQTNNVHSCCDEVRIHNASW

SEQ ID NO: 984384 - protein, 57 aa, Homo sapiens
RTETGDSRLFLAYLAGAEQQQTVWWSSTGQQHKGDGSARRLDLFSKWEGVIRLHRQG

SEQ ID NO: 984385 - protein, 60 aa, Homo sapiens
SYRRQGDSSNTWPASSNPVDATDHLLWTLDLHIGRCGSMTAWLGGQHTGVDGSACAVADD

SEQ ID NO: 984386 - protein, 41 aa, Homo sapiens
MGYCCNSWVANLQTDTGNIADTLQEARMQSFLCDIKHFRVV

SEQ ID NO: 984387 - protein, 75 aa, Homo sapiens
PTGGRLAVDVVIVVLNTTVLLSCAGSATIRQRPSPETARTVAGAGRQAPGQLRRRVPGRDLRLVPEPVLQRDPVR

SEQ ID NO: 984388 - protein, 95 aa, Homo sapiens
LRTPGVCLPTPTYPHHSVTLHILRHSLPPHIPHHLRTRRNTRASPPYPHIYLITSVHPHTTASAPYPRTQLVTIRTPEHTSVTSVPPQESTLIIR

SEQ ID NO: 984389 - protein, 66 aa, Homo sapiens
GAVQPGDALYVETPYGFLTLERFAPGGDLWLLASGTGLSAYLSILRDPAVWRAYRRIVLVHGVRTA

SEQ ID NO: 984390 - protein, 98 aa, Homo sapiens
ACTWQEDDEDSKQYIYATSLYRKKRSRDTLVPENCWFQLGHSMNPRAMKNRSRIALLRKRRFQLYRSRNPRAGKNRSRIPLLRKRRFQLYRSMNSRAR

SEQ ID NO: 984391 - protein, 121 aa, Homo sapiens
PVPALERWQTATAAQGEAPHQERGQHRKVPLQGKRLGVGQQVVARFGHEDRHGVQEQHQAGAEQGDDQIGHRGQQPTADTRVFSLRHKGFLIETGITGGISLAGNTGFVISINRIARHRGG

SEQ ID NO: 984392 - protein, 37 aa, Homo sapiens
ESVALGFTLVFRPRGLMRGGPARLRLFTPFTAVHALK

SEQ ID NO: 984393 - protein, 34 aa, Homo sapiens
PSRRKAIVRATAPRTDQIGALRSIVTCKAVATFH

SEQ ID NO: 984394 - protein, 100 aa, Homo sapiens
MSCTIRPSARILPSFTKKSFTGLAFSHFITVSPSVLPVAATAFRKVVVAEESPACSIDGFFFIFSSKRAAHWRDASSWSQYQAVVRYMPCAAGRPSAWMS

SEQ ID NO: 984395 - protein, 36 aa, Homo sapiens
RYLGSSSFVVYNGQITPMAPPASTAPASGYRCCRRT

SEQ ID NO: 984396 - protein, 81 aa, Homo sapiens
QTCWAQARVALKSRAGIHGGALADNGQGFRRRVDPGNLVMSGEAGNGTRLTTINALDPIYFTFDASEALYLKAMRAGEPSA

SEQ ID NO: 984397 - protein, 40 aa, Homo sapiens
VGTCTFRHMTNVRVHWMTSMFEGLDDDAETRKMVGANIAM

SEQ ID NO: 984398 - protein, 73 aa, Homo sapiens
IPQVKTPLLLMLGQEDRRAPFTQAMEYYRALKTRNVPGRLLLYPKSTHALSEVAALTDSSMNAALWLHTHLGS

SEQ ID NO: 984399 - protein, 45 aa, Homo sapiens
MLRANAADLRRDQGVQTPSVAQNGRSSLDLDFQYEYRHVKACASR

SEQ ID NO: 984400 - protein, 80 aa, Homo sapiens
MRRTCVRVQVNFWNFCFISGINLSVQVSALDYFNPVCMYACMYVCIYYETEFCSCCPELECNDAGSTHCNLHLLESSDSF

SEQ ID NO: 984401 - protein, 63 aa, Homo sapiens
YSLEKGGLLGPETSVLGWHSDFTWSSATSTGSSWHLIDQQHVPDLSEDLLDEHRADIPTDMRQ

SEQ ID NO: 984402 - protein, 36 aa, Homo sapiens
RAEQIRRLGMRGLGRWLLGVGRLLLLSSMTRLRVMS

SEQ ID NO: 984403 - protein, 30 aa, Homo sapiens
MWLNNPALLILLLALFSRSAELIVPFPLRL

SEQ ID NO: 984404 - protein, 51 aa, Homo sapiens
DPASELHQGFMDGKQACVLMIIALCSSDMQSVPHCASSNSSSSDAVCCWSH

SEQ ID NO: 984405 - protein, 58 aa, Homo sapiens
CQLFSIFKMSHNEIMLFSNEEQAPYGNDSAKCQPGQDQRPVISEIQASSLDLNAPRMK

SEQ ID NO: 984406 - protein, 33 aa, Homo sapiens
GTPHLIIYYVWMKALRDLNRKGNRVKTCKAKIE

SEQ ID NO: 984407 - protein, 50 aa, Homo sapiens
PGSPDVVTFVRAVGQRRRGVSASDVAKVRKDVGAAKAPVRKAALPAGGKP

SEQ ID NO: 984408 - protein, 35 aa, Homo sapiens
TRQRCKRLASWAREGKTLLLRVAVDGGGCSGFQYR

SEQ ID NO: 984409 - protein, 87 aa, Homo sapiens
LQDSEEPYPTFTPGSHQADPCALPQDPPPGLPPGPPPRGAPPRLPPPAPRRYSSNSSWDDVPTFGAVPLDRAPPGLFASSLLPKPGV

SEQ ID NO: 984410 - protein, 152 aa, Homo sapiens
MGIDGQYSHRYYGRSVDPSLIEGICLMSTDLAACMFVCDRHSATLLIGEYPGVKSRFAPQSSAMDWHANKLFAGMQDHVTSKWLSVFCLHYYEVDEKPASTPWGSKDAFWACLMSEFGGSGTGGWVHGVSFSANGSRLGWVSHESTVSVADA

SEQ ID NO: 984411 - protein, 95 aa, Homo sapiens
NPSNMQVVDGRLCLTGYLGEQQSVQSGREGDSSFVRALSQKEMEGKIHRTAGEDHVPGNEGHEEPIIGDSELGPRSRVSQKACPSPIACDIYCAY

SEQ ID NO: 984412 - protein, 85 aa, Homo sapiens
MVLTPTLVILRHYSRTYVCEGVPRYENKLVVWEVEHDSFLYVTVESENDWWVSKHIKKPIGPDVLSLDWHPKQEYCWQEDHVIFK

SEQ ID NO: 984413 - protein, 39 aa, Homo sapiens
PSPESRTLPQSNLLGLLPSLIYTNPPNLSINLALFVHLQ

SEQ ID NO: 984414 - protein, 58 aa, Homo sapiens
CPSLKIDSGTAGSLEIDRLQLYDIWRSDHGAHVSTELCTEKAYTAVVEYTSTRLQTKR

SEQ ID NO: 984415 - protein, 42 aa, Homo sapiens
MRGGLKREPTNKVFDPLSTQRLVLCESTCYVLVLRNIGTDAR

SEQ ID NO: 984416 - protein, 98 aa, Homo sapiens
DSTRNTTLERPPVLSASEITCRDAVCSSVIPYMSLYSLMAAPVVNDSSRISSGCADVPELAAWHIVLVCCIVDVRPLVRCYDLACVCPGRTYRHEVNR

SEQ ID NO: 984417 - protein, 101 aa, Homo sapiens
LSPVATEVARVSILRRLRVQTPPRCATSPPTCWVALGGNSSPSAKAIKKIWDSVGLEADEDGFNRVISELTGKTLMEEVMAQGMGKLASVPAGGAVAGLCC

SEQ ID NO: 984418 - protein, 104 aa, Homo sapiens
AAPFILISVCISNSPSPSLSKSVSLYLAHSLINTLPIQLLFLFPTQGTHPDGQHSIHTLHFILSHHFTFGHLSVQSSEHFIRHATIRYSHRHTSVSYTHSTGVP

SEQ ID NO: 984419 - protein, 40 aa, Homo sapiens
TEETGLIHSQRKPWRLHAGHRLYSPPGNSPERPQVLAASE

SEQ ID NO: 984420 - protein, 125 aa, Homo sapiens
GTTVASSGQSDNLARQIQRKGREHPDFKPHSGLGEVAHACNPSTLGGRGRQITRSGVRDQPGQHGETLSLLKIQRISWAWWRMPIIPATWGARGRRIDLKLGGGGCSEARSSHWIPAWATERDSI

SEQ ID NO: 984421 - protein, 89 aa, Homo sapiens
LESGKETLQRTDPRKTHMTHHPIYDHEATLRSRALSFYPAEITLTWQRHGEDQTEDTELAETRPAGDGTFQMWAAVVGPSEEAQRCTCH

SEQ ID NO: 984422 - protein, 95 aa, Homo sapiens
ITHHTHSFGGISSSVTATYTLIFNYENLGTSSNPPATPQTCPLYLQNGAKIPLQTHRPSPSLLSAPQCKPALPSPGLMSQLAVPQYYPPPSSCTT

SEQ ID NO: 984423 - protein, 53 aa, Homo sapiens
MNESEDVFSLIETHEAPPVKLLGYNTDTETAEKRLSHQTLRVAGKAANAVALQ

SEQ ID NO: 984424 - protein, 117 aa, Homo sapiens
MIVKKEEGSRIEIVMISCYKVWVGMLLPRAKALVALSTAEAQASGIYMPGLNKLQDKHRTSQNSPVSQDPQHVCQALGSLTNRLQDTAIELGRTNYFSTKQEPYLGIAEHAVRDSDE

SEQ ID NO: 984425 - protein, 37 aa, Homo sapiens
VVNTLSTRLQGERALEVSAVLTCRRNLSREACAGVVN

SEQ ID NO: 984426 - protein, 39 aa, Homo sapiens
YPTHEGHVSLLPAESDNDVPSSLVSGLSVRRRGIRRGRA

SEQ ID NO: 984427 - protein, 63 aa, Homo sapiens
LEAHKSQSQEIEEAAVLVPPTTLKGSSSLLADNSPGPFTVLAQPTPVTITYQLHTHPTKLKAY

SEQ ID NO: 984428 - protein, 35 aa, Homo sapiens
VVAQCVTVCSGLQNKSCNMELRTGPRTLSWPWSNL

SEQ ID NO: 984429 - protein, 48 aa, Homo sapiens
MQTPNNTPANTPTNTPANMKLVPVANNRLFDMSAGVLVGVLADILLGV

SEQ ID NO: 984430 - protein, 63 aa, Homo sapiens
PHLLLTKFQKAGDSQDVITITGHARWLMPVIPALWEAEAGRITQGREFETSLTNMEKPRLYYK

SEQ ID NO: 984431 - protein, 46 aa, Homo sapiens
DPKAKHPDIHFTSIYSVSLHFPSAIDQTPLASHAQATAAVSYKEQL

SEQ ID NO: 984432 - protein, 67 aa, Homo sapiens
CGYPVLSTWTSASCLLKGPYVGGAQSWQVQSPYYSSSRGQGPEQWLWSFQPELGCLPSGSHESCMGT

SEQ ID NO: 984433 - protein, 39 aa, Homo sapiens
QADMGQSGKGGEQDLTCLPNLFCPQVESVDCRIPTQQPV

SEQ ID NO: 984434 - protein, 53 aa, Homo sapiens
EEEGKKLHCGNVSILLMSCLGMMRRTLPADGCVCSIQLTGCLGGFQAVARALR

SEQ ID NO: 984435 - protein, 178 aa, Homo sapiens
AERLDDIENWLKKRDGTRLPPPHRDGRSCRVLGEESSEVAVIGFYKDVKISSAKQFTPAAEDIDDIPFGITSNSDVYSKYQLDNDGVVLFTKFDDGRNNFAGEVTKENLLDFIKHNQLPLVIEYTRARQPRSIKEVKSTTHILLYLPKSVSDYDGKLSQLQTAAESFKGKILYIFIDL

SEQ ID NO: 984436 - protein, 155 aa, Homo sapiens
MAKMIQTASTSHSVGITGMSHMPGPPYRSLRVIYHTPEEDEGKLPIHGTMLSSFYSQYHNDFLLDFISSQMCAVQGDREEKRMVGGKGGEHSSWSVCKGIPGIWFHLRFPSIFPLKPRVQGVSHTGLLADPGHSNRCSCLTAFCSQTPSQIATRH

SEQ ID NO: 984437 - protein, 47 aa, Homo sapiens
MVRLAAPPYSHGRPRSLHTSQVGGTKKGEGGARHSSSFKYQTIINKV

SEQ ID NO: 984438 - protein, 77 aa, Homo sapiens
MKTEELLKQVDDLNVELSQLHVAKVTCAVRPPSSLRSESVRKSIARVLTDINQTQKEHLRKFYKGKKYKPLRLCDQA

SEQ ID NO: 984439 - protein, 76 aa, Homo sapiens
VSIILSPGSGSGSLYSLNVHISVKDIYHYSRIDITDIIYQSTNTNMPIIWRSYCGIGIGLPKPLGWAPWLITCNLS

SEQ ID NO: 984440 - protein, 85 aa, Homo sapiens
ASELISDLQSYGRSDMLLKTNAACGPCSTTDVTMYSIKAAINNKISRILRRPPTGVADYEVHSPVTHARDTTRGLHLRRRPMHGL

SEQ ID NO: 984441 - protein, 51 aa, Homo sapiens
DLRASEYRYTVRYDIVTRHYYPGRQGETCTHKKITQSIGVVSCVLATCCYA

SEQ ID NO: 984442 - protein, 81 aa, Homo sapiens
LTKCIWQLLSRAPWLVLERASRQVSPLYTSEIHTPNSFCDRILLYVSDAQILAPEAWALLSSPASFSCCSRNPFPSEHAGT

SEQ ID NO: 984443 - protein, 111 aa, Homo sapiens
MVGYNQPHRLVVTAILIQPPLTLHRRCPSHNLPTGYTSSLLFMQQTPPHDLHSPVASYSSLTAFKLYSHYQLFDAFQHASLTLALPPHINLRGQLSVLVTTWLLITYHSPT

SEQ ID NO: 984444 - protein, 107 aa, Homo sapiens
TVRRDPLRVEYVNPRTCKMRGLSQCGVDGAGPRMCDIGVRSEAGAPVTVAMGSEASVMKTEGDCPIPSLCVDGQAVGQTGTGGRFVPCFDSLVELHQWPTPLWDRTC

SEQ ID NO: 984445 - protein, 140 aa, Homo sapiens
PSAHMCHLPFLLQNQLQFCMEQLPLSLWEDSSGGLRPVGARAVWSAMLSGQQQQGVVIRTGEKGPTPAVLSPLPWVQALPPHRQPSPDGAPSCLQGLTPFRGVLAALRVTSSSLGLLGPALYEESCDECYWLTATDDSLS

SEQ ID NO: 984446 - protein, 51 aa, Homo sapiens
LTDRDTSVDTPVCYHTQLLTPYDSPIGQLVTRTTSTRTSDVLVRDGYTHYD

SEQ ID NO: 984447 - protein, 117 aa, Homo sapiens
ALLRTVFGRFFLRWVRGLAGSGVKLQTFVVSVYTLLRRRVWRLFLSSLVGSLVLYGFKTRSHYHCGGEHSQTHVGFLTTVFLTRHDALTTWTADPRPVRHPTRTLPGYPTLELRTSW

SEQ ID NO: 984448 - protein, 43 aa, Homo sapiens
QGRVAQLVGEDEAFGFAHLAQAAQVRILMAAAGGGLDEAPAII

SEQ ID NO: 984449 - protein, 71 aa, Homo sapiens
LSYDRELGFTDDVNIRKHVFTIEKSLKGILCDLEDKGNIQNIHKTTTERISYEYRCKNPPQNTSKPNPATI

SEQ ID NO: 984450 - protein, 52 aa, Homo sapiens
YSPCPYTEHYQTDLPSCQLPLCYRGPSLGVTQHAAEDNGIRIPTLVIANCPP

SEQ ID NO: 984451 - protein, 55 aa, Homo sapiens
YNGKRSGLAVGRDKRVMAPIVLGYKSSSWRRTITLNPGFSDLNSSCPSPSHTVQR

SEQ ID NO: 984452 - protein, 132 aa, Homo sapiens
MVQEWDVLKRYLKMWKRLWNWVIGRGWNSFEGSEKDRKMWKSLDLSRDLSTWLCQKLLTTDLDRGECTSRVGRDTDCCRTWTSRGNCTLTCGTGPEDAADNGPGRRDMHLQLLDGTRASSTGTDRGLPLDVD

SEQ ID NO: 984453 - protein, 112 aa, Homo sapiens
SDGLLRAFSPLRTLDLNSGHADDTLGSDFPPVAAVLDVMYESPFTLLSCVSDTYVRYWDLRTSVRKCVMEWEEPHDSTLYCLQDKMATTLLATGSSYYGVVRVVGTGVKRAC

SEQ ID NO: 984454 - protein, 69 aa, Homo sapiens
TEYMVTRPVRDDLTKHVQYSPAQWPDCRPGAGAFVHDPSTDTDHHTHPLIALSKGVVIQQACRGGQETE

SEQ ID NO: 984455 - protein, 45 aa, Homo sapiens
VAGTSHPENVGLNSGQLMTHLVSDFPPGAAVLHVMYESPFTLLYC

SEQ ID NO: 984456 - protein, 108 aa, Homo sapiens
RLYQADTHRFSIDALMVPAGLSHAKPSIVEDVHENLKNPNYTSTFYDGTRTPSKNTSAVFEALMPIFFSGGPPVSRQCGKAEVVFNTVVTGGQTCSFAPYAPGRNDDH

SEQ ID NO: 984457 - protein, 66 aa, Homo sapiens
LLEDLLHMLGSDNLRCHHSRLTREPEELVVCHSSWEISIHKLAAADAAEEGAVLPPEVPVAAAAEQ

SEQ ID NO: 984458 - protein, 71 aa, Homo sapiens
RRCHEQGIRTHHDEEVPGLRHAELPWEDGSMYQVSEGIEHRVQQQHPQPPGHVMPCTTSGLCGKYRAAGKD

SEQ ID NO: 984459 - protein, 59 aa, Homo sapiens
MRQIPITADSSTETNVSGFLRGYSHGVPSKILITPKKTVTLQGRDLVDTTYILEQQAKT

SEQ ID NO: 984460 - protein, 40 aa, Homo sapiens
GHGYYQDLELLVGTMAVLEGPFPGGRPMIHTLKSTLPTSF

SEQ ID NO: 984461 - protein, 103 aa, Homo sapiens
SRSVPVTNTKYSLDCSACQTSFHSKIMPGCYPPSCSYYHHYSTTQYQLLHRFHESCQHSVLLTLFNTSQWVLFLLLQPLHLLLLSAPFHIINMLHEFAILSNI

SEQ ID NO: 984462 - protein, 47 aa, Homo sapiens
MPGLQSLFFTSPQFSLEMKSRSVAQAGVQWRDLGSLHAPPPGFTPFS

SEQ ID NO: 984463 - protein, 55 aa, Homo sapiens
GHDIDADRAERVCEAMDKSENLLNTQLEVGDEGEAPEWHTDFYNSQSSCWEQQGK

SEQ ID NO: 984464 - protein, 36 aa, Homo sapiens
MHSDGRSRGIPVGSFMVFNPAYGIAVYEPAALTCTH

SEQ ID NO: 984465 - protein, 132 aa, Homo sapiens
GVVIQRIPAETVGPGREEAAGKGDVQRRDHLFSFEQVVNTVTTLVENKKAQLVVIAHDVNPIELVVFFRALCRKMGVPYCIIKGKARLGRLVHRKTYTTVAFTQVNSEDKGALAKLGGSYQDQGQGRIRGGS

SEQ ID NO: 984466 - protein, 49 aa, Homo sapiens
RRKGRLSGLLSANDYDYNTTVSNHLFTAERHIYVLRPWLDASGLTFSRY

SEQ ID NO: 984467 - protein, 46 aa, Homo sapiens
MQFPVRLNQTTYNVMQIGEYDYGLNALKSVEQTDSFIATIVSLAVT

SEQ ID NO: 984468 - protein, 71 aa, Homo sapiens
MLTIATEPSCTGARAIRCCHMLAAGSSVKAGRIGDGGQSSGWAGVTGLHQHLLVVQRDVRKRLCGQVHVGL

SEQ ID NO: 984469 - protein, 38 aa, Homo sapiens
AARYLSDLLYSRRRFSHLFTLARGTSPQLGAEGLQGWV

SEQ ID NO: 984470 - protein, 51 aa, Homo sapiens
LGGSLIRELGERVAHASGAGGKKQAAHVCSYNSWPLQSSYLSLLSSWDYRS

SEQ ID NO: 984471 - protein, 45 aa, Homo sapiens
VIEDPIQAGRWGLNSLASALEEMGKSEMLVAAGVVAVVVSTGGIG

SEQ ID NO: 984472 - protein, 61 aa, Homo sapiens
DVHRTAFQHDLVIGHFTIVDKATRRVDALVYDWSIAFAWFKLDQLAVLDKVALANLINLLV

SEQ ID NO: 984473 - protein, 73 aa, Homo sapiens
YSVVTTIITPPSPLTVVTTIITTTFTITVVSTIITITFTITVVTTIITITFTTTVVTTITATFTITGIASIIK

SEQ ID NO: 984474 - protein, 67 aa, Homo sapiens
YKQSTFRIRYLLLGTVPKSYQPPSSFDYFPKPGSTHKPGSTHKPGSTHKPGSTPKARVTQKPRVNPK

SEQ ID NO: 984475 - protein, 33 aa, Homo sapiens
VACTLTDALWVDRGYWLTVACRVDRGLWVEAWL

SEQ ID NO: 984476 - protein, 69 aa, Homo sapiens
IILIIIIYHIAHSSIIYQLLLGISTLQIKSDHYRRSAAKDSFSIIIQISTLRNFRRGKKVEDSVIGNSI

SEQ ID NO: 984477 - protein, 96 aa, Homo sapiens
APVLLLKGGDEGYCPNILPGSRYAAAHPWQGKGHWGKRLALSSLGDMEEGVRGIPQPRWLYLSDPYPACNPHSSTLYNPKRLKNSLGYRIFKKQEL

SEQ ID NO: 984478 - protein, 90 aa, Homo sapiens
VNCAVVPVLEEQRTQSLVSVEVSMNAKIRVADLGRKKAKVDEYPFCGHMVSDEYEQLSSEALEAVRICANKYMVESCGKDGFHIRASVCE

SEQ ID NO: 984479 - protein, 112 aa, Homo sapiens
QRTSPMEKRTPAPEPEPCEGTELPAKRLRSSEEPTEKEPPGQLQVKAQTLARMTVPKQTLTPYLLPEDLEAQFLPRLQPRVLEDTGPSALTESDDGYHSTNNQGAANAAETG

SEQ ID NO: 984480 - protein, 63 aa, Homo sapiens
MEAILAAPAIRRQEGLGGPELAQGVDAVWDLQDGHESSLSIRLYPMDHGGIVHQDGDVTHPSP

SEQ ID NO: 984481 - protein, 124 aa, Homo sapiens
SRRIPLHCSDGDSALMATAVTRDALPPSAGFCSVVHVPFLAVVPAASLWVWPGLRVFRMWAVLPAWFPFPGTCHCLPVSLRGHFWEVRPWPPGPLFRSEALTCLGSGSSGERPCPPQDIPSEAV

SEQ ID NO: 984482 - protein, 42 aa, Homo sapiens
LEDPVHCFGCPETHDLQFLWGWEGCGRDWCLTSNGCLPHSLS

SEQ ID NO: 984483 - protein, 30 aa, Homo sapiens
MQKTTRTLSISGRAATGRPASYSVRIRMTM

SEQ ID NO: 984484 - protein, 101 aa, Homo sapiens
SRKSSFMFSTAQALKKATLLTVILAPSDWLTPSKPSKGSSSILDHPFLLYSCCSALLKEIHPTEKELLHNNDLQSQGRPLVLLSNPFLTDPLFPRLIPTLQ

SEQ ID NO: 984485 - protein, 64 aa, Homo sapiens
YALENGGRGSITEQLLKTRADVTLGGGAKSFNQLAKSGEWQGKSLKDQAAAQGYQWVSNADELQ

SEQ ID NO: 984486 - protein, 49 aa, Homo sapiens
LWVDQTLGESQVKREYNVKLVEQRAYRETPVVAVTCGRDSPFNKKSLLA

SEQ ID NO: 984487 - protein, 81 aa, Homo sapiens
SLSVSGKDTKTQQYGSCGGGRSASLKSPLQTWSPTMVGGRTGRPGLLCDYSGKKDMRDSGSPQAEEATAHGVRNWTQSPQV

SEQ ID NO: 984488 - protein, 35 aa, Homo sapiens
ADGCGLRAVVTCCDRDPLFALYENFHTNKSRGTQH

SEQ ID NO: 984489 - protein, 50 aa, Homo sapiens
WTIWRSIRKNFDEAANVFEFYTAEENQLQLIVCLHNWGPSYVTWTYGGSD

SEQ ID NO: 984490 - protein, 81 aa, Homo sapiens
IARNCEALASSGSVLWTSCARAFRLMVDYVLPVPVSCTGLHGAQLPYTLLCAYWLPCCCALLPGYATMQERHSKLLGPVAA

SEQ ID NO: 984491 - protein, 95 aa, Homo sapiens
MNWELLLWMLVLCALLLLLVQLLRFLRCLTGHLTLLLAACQGRRPDWALTDMVVWVTGCLEWQLVRSWLTSCLNYEFLLCCLPVKLDQLDPGARK

SEQ ID NO: 984492 - protein, 35 aa, Homo sapiens
PQLEEGAEASAASEEEAGPQAIRALSTPSRGRRVA

SEQ ID NO: 984493 - protein, 34 aa, Homo sapiens
MLPSQADVNFVNAKLLVKEAGLTVSTSHSPAAPG

SEQ ID NO: 984494 - protein, 67 aa, Homo sapiens
MVNLMDRDGHGKLSLAGVHHPVEPGSGSYLSDLPESFEPWTSQGSMSAYDMRIGIESAGFQPQLEAV

SEQ ID NO: 984495 - protein, 102 aa, Homo sapiens
GVEQFTSLCNFKEALDVRLDVYSLGRCGCSVVKGSPSGPMRNFSQFQASSERRTEDSNTDELVRSVLTENVVNHKVGELVLQVGEDRMLVLPIHLTFLDKGE

SEQ ID NO: 984496 - protein, 95 aa, Homo sapiens
SIGRRKATQAVLMPGVPTGQEVGPADRSISHSLTKLVKLYGTIFNWPYEENQAYGRIHRTERSDRERGWGGGYSPFLSGLRYRQPGLQVLVVTSQ

SEQ ID NO: 984497 - protein, 70 aa, Homo sapiens
MWWWVRGAVAALIMASQTGVQCAFNVGIEANPRPSLLLGRARPRDGCLAHLTALEMFASGVCGVRFPLGP

SEQ ID NO: 984498 - protein, 89 aa, Homo sapiens
GFYLLSSLTDAAGQQQFIAPPPSRCHPLTGGETHHPFPEPASFTVSVRNLWQVRMYLVRGSHPNPTVTFRASSPRFSRILFTTAGMPAP

SEQ ID NO: 984499 - protein, 50 aa, Homo sapiens
LISTAPVAEYQLHTRPGLPLGPISVLISVLMVLLQVGQALPSGSSICIST

SEQ ID NO: 984500 - protein, 76 aa, Homo sapiens
LKTAPWCQQRFKRKGRMSYHVALHTALCTSAYNCSYCGKSFSRPNHLNSHVREVHSDENGPSYVRNVRQLFAMKDR

SEQ ID NO: 984501 - protein, 72 aa, Homo sapiens
PELHHITGRATSRVYDTAKGMLTRPQEHRYIVVSWMIAQTVTAVAGVVSYPFDMVRRCMMMQSGRLRSSHHV

SEQ ID NO: 984502 - protein, 86 aa, Homo sapiens
HRLRVVTGYCKNKSYAKSRFCRVVPDAKIRIVDLGADTREIVDEFLCFVAIMVSDEYEQLSSGALEAVRICANSYMVKSCGRDGFH

SEQ ID NO: 984503 - protein, 80 aa, Homo sapiens
SSDCARVDEAGVILCNGDSVGYMLSSLAEPWKVQPSDQVGKVIFEQILQIRLTDTLGRLSHILEMDHFALVVHEQIQYHS

SEQ ID NO: 984504 - protein, 72 aa, Homo sapiens
PPHTLSRIREVAVRRVSVTLGRHRWASLVVTFRAPKNTLMSLSPTQSTRGSSSRGPGPMVSGGSVAIGTVRS

SEQ ID NO: 984505 - protein, 91 aa, Homo sapiens
TDRLRRRPMVYTEDDGGIEALCSDTRPLSNLVQTRDAYTEILDGKTPLASWVRSPPSYSVLYPSSDPKSSHLKGQAVPASKTGILEESMCP

SEQ ID NO: 984506 - protein, 70 aa, Homo sapiens
ACGPHCSAVLWLRECDPHSVVERHNMPDVEVMDVAKELLLQAVTISSTEKEKVLIEGSINSVRAHSVSGY

SEQ ID NO: 984507 - protein, 72 aa, Homo sapiens
MTGTLWPYLSAVRATLQCCPLPGELLLPVLWNDTTSRKWKSGVAKSSCYNLVTIRQEGEGIRFCIEGSINSV

SEQ ID NO: 984508 - protein, 41 aa, Homo sapiens
ELPLSGGVGGAAEKPVPVRLGVRLWVWRADIWCEMRAQCVR

SEQ ID NO: 984509 - protein, 77 aa, Homo sapiens
QTAARELKLQCEGLRQELQLAGAPVAPPSVQTPPGRFRILPCEKLNEPRKCFLEVAHEQPGNLNAWANLAHVYCRTR

SEQ ID NO: 984510 - protein, 118 aa, Homo sapiens
PQTAPGSPPLSRSSRTGFFFSDQCLWKTSQIPQRGLDGSRTMPRMHTPKYHDLPSCPEGLVAQDQDAAPAPQPQRFVSVLRACLAHEIARTLIRSHRHRNLPWACYRLNAQPHARTTV

SEQ ID NO: 984511 - protein, 60 aa, Homo sapiens
MCKYDLLGLRVQMEEPLGSSMREHSSPPIEDIKGPYVSIHSSGFRDYMVKPELLRAHSVR

SEQ ID NO: 984512 - protein, 54 aa, Homo sapiens
LKLRPVKAAGLRWSPSGKAAREIRRCRWSPHPSRIVGRQIGQLVTHSAYSFFTE

SEQ ID NO: 984513 - protein, 81 aa, Homo sapiens
MPYPKSRYAAEVVLMPRFAFVDLGRLKVKVDKFPALWAHSVRLISAAVLLKPCEAVRIRATSYIVKSCGRDGFHIRAQSVH

SEQ ID NO: 984514 - protein, 59 aa, Homo sapiens
IPLLAAGLSPYPTPGLSSRALPWKPVLPEGPSAQLVAQRGLCHHYLVHVSTVRILVTGV

SEQ ID NO: 984515 - protein, 51 aa, Homo sapiens
MGHRRLMMEFDARWVIYFNKPDIDAWELRKGIITLVILCDGSRAQESLMLL

SEQ ID NO: 984516 - protein, 104 aa, Homo sapiens
SQLRPHKAPWMLRGEHRAPQSTSRCVHRTGVAEDRSSSCPHGTYPWLWERSTTHGLVSMGQRFKESSHGQSTHPCRRTVSESYLCDRRDPSLLTTTHTGPLDRV

SEQ ID NO: 984517 - protein, 38 aa, Homo sapiens
RSHRKVAGSCRRLKALEALQTTRLTEQNASCLDDFCIA

SEQ ID NO: 984518 - protein, 185 aa, Homo sapiens
MRILRVTENVFFRGGGSRWVIFVNKSSLFGAVRRLEKEVGGMEMAHEGMIWSLAWHPLGHILCSGSNDHTSKFWTRNRPGDQMRDRYNLNLLPGMSEDGVEYDDLEPNSLAVIPGMGIPEQLKLAMEQGTDGEDESNELEMTIPGLDRGMEEVMQKDQKKSTQKKVPYAKPIPAQFQQARLRNKV

SEQ ID NO: 984519 - protein, 37 aa, Homo sapiens
WKDRCPPEQRAAWNVARTRTRGRCGEWHVDRGRSSVT

SEQ ID NO: 984520 - protein, 57 aa, Homo sapiens
MVTGCNTSSLLLLTSTSGLLCRFHILVRNSSPGRVQPAKCVPHGTQVGSREWHSSRV

SEQ ID NO: 984521 - protein, 58 aa, Homo sapiens
MPKPTDRFHTHTYPYLPILTEVHGDAHPLEYSLGYVANSSSSWDTSVTSGPCAESPGT

SEQ ID NO: 984522 - protein, 70 aa, Homo sapiens
MTGTLLALAECRAGHIAGCLCLENFSSQVVERHNKPEVEVRSSKELLCQPVTISRNEKDKVLIEGSINSV

SEQ ID NO: 984523 - protein, 82 aa, Homo sapiens
GASGCGSDSASPKAAAGSSSLYSLYTFSSSSSSVFSPGRYTQALQGSTCRVVWKQKSQLLSSSSADGVSLSLIYLLLLCPLL

SEQ ID NO: 984524 - protein, 77 aa, Homo sapiens
LNVRSSRDEQDYMAQHIISRVKLTCLTDGAKPSSRSHIEWVNNANARVNSSFTIDYEEPDIDRIKRATLAYATLWHA

SEQ ID NO: 984525 - protein, 50 aa, Homo sapiens
MIFWRTTEDGRAPGSSRDHISSPYERHHRDPTFPSSSSGFRDFLLKPELL

SEQ ID NO: 984526 - protein, 81 aa, Homo sapiens
DRRPHSPPKGGRPSHAIHSPHQKRSSDEDDKPTHKPYTNDGSDVTRERTYQGHHTPPVQRRLRHGIIIFINSEVYNFAGYF

SEQ ID NO: 984527 - protein, 103 aa, Homo sapiens
MKAAMTTWTSISDELMQGVADQQELAEEITTAITKPVGLGEESDENELMAELEELEQEELDKNLLELSGPETVPLPDVPSIALPSKPAKKKEEEDDDLKELAN

SEQ ID NO: 984528 - protein, 49 aa, Homo sapiens
RKPNPAGFCSDILLSAIPREKSQRGGESLHLGGQRADYGNLCPYPHWAC

SEQ ID NO: 984529 - protein, 57 aa, Homo sapiens
DSSGELGVMGDKGERGENSVSVRSVGSTKRGRAEVYYMWYRGGQVCDDDVAQILDAT

SEQ ID NO: 984530 - protein, 37 aa, Homo sapiens
GAKDLVRDDGSAVIWVTFKHDGSTRSSPCETGMREYR

SEQ ID NO: 984531 - protein, 105 aa, Homo sapiens
ARPRMMLADQARDGKREVVRGETWQRGLTQTPPAYTGKTHKVHRTETSPCTSPIASCVTMGRTLWLYGKDQGEAALVDMVNDGVEDLRCKYVSLIYTNYEAGQDD

SEQ ID NO: 984532 - protein, 35 aa, Homo sapiens
MIAEASGEKVQLLGMTSYFSWWEPALSWDTDARIS

SEQ ID NO: 984533 - protein, 87 aa, Homo sapiens
ERAGAFGGPGSRRRSNSILALGYYPELAPQIGRRAQRWGSVTREEGLARSTSLESSDCKSLDRSTVASGRRKTRVTWMGCRSPKVSP

SEQ ID NO: 984534 - protein, 38 aa, Homo sapiens
DWPTLRARTVSAMRGHIAECWLSGLEELLLATLLELTQ

SEQ ID NO: 984535 - protein, 157 aa, Homo sapiens
MRKLSAVVVSLQSAIMIIYRDLIQPQIEMFSYIYKIREIADGSCLEVPWRMVSRTEGNIDDSLIGGNASAEGPEGEGTESTVITGVDIVMNHHLQETSFAKEAYKKYIKDYMKSIKGKLEEQRPERVKPFMTGAAEQIKHILANFKNYQFFIGENMN

SEQ ID NO: 984536 - protein, 75 aa, Homo sapiens
RYELTLYSTQRTKSRNMSRIPFLSISVLKQKPNLGSGTLVARQTQLRLGYILASNAIAVVRVGMAAAPLLEQQGK

SEQ ID NO: 984537 - protein, 107 aa, Homo sapiens
MSPSGPISPTARLGRQSLVSLFSKGEADTLSSGKRNPGLVALANNKKVGKSSGKAVAMGIFHVNHVKRSRWPLSVGDHTNSSYVSTSSHHTQVTRVELDEISNLASL

SEQ ID NO: 984538 - protein, 36 aa, Homo sapiens
DHTLTSALFCMVSRTQATTACRLLRNATACKKRACA

SEQ ID NO: 984539 - protein, 156 aa, Homo sapiens
MLGGHACPRCPLQSVQVFGRKKTVTVVAHCKCGNGLIKVNGLALDDDEPAHAYSTMLAGASSCFSARSEFVGVDIRCPCPGWVVNVAQIYANSVSPSSKALVAYYQDICWMQVPRTGAQRTSSSSMTVPCLVADPSSAAKSNKCLQALLPVLGTRN

SEQ ID NO: 984540 - protein, 33 aa, Homo sapiens
RITHFTSPLCLVVRLVSTPEDWKGALEGQVHGA

SEQ ID NO: 984541 - protein, 85 aa, Homo sapiens
GNRVSLGRPGGSAGARSGLTATFTSGVQAVLRDSASQVAETYGQHVMAPDIIMCILSKEGGRPGWARRVSNSGPRVIGPPGPPKG

SEQ ID NO: 984542 - protein, 62 aa, Homo sapiens
GVITQEERSPLLIRDVAEHEAPNVVGMQQTTKAMTTARRTRTPCRKGLLTLPGSMDHAECAV

SEQ ID NO: 984543 - protein, 52 aa, Homo sapiens
ILPRIARDTSDDPLKTEPSLSPGSPPQSSCQSGCGRVSLAGDLRQREPLSIS

SEQ ID NO: 984544 - protein, 36 aa, Homo sapiens
LQRAEIALLHFSLGDSKTPSHNKETTINKKKEPFKR

SEQ ID NO: 984545 - protein, 44 aa, Homo sapiens
EPINESGDTANRITPHICGLSTRGVFLQIRKHASGSVGSHTFRS

SEQ ID NO: 984546 - protein, 47 aa, Homo sapiens
SISVPLMCFSLIPNFHCVVSKFSVWPWLQTLSALVPSNTVTRAAGKD

SEQ ID NO: 984547 - protein, 66 aa, Homo sapiens
HHYKVSWDVIISLSPKDEATMAHEMPSGDTSSFVPTAPNLLETSLAQELMLSFLKHVLGMTTLWKW

SEQ ID NO: 984548 - protein, 45 aa, Homo sapiens
VLFEDPFQAGTRDGYEEDEEDVAVQPVRGTPLSYPSPGVRSSLAE

SEQ ID NO: 984549 - protein, 43 aa, Homo sapiens
MPIQRVFPRMNITDESSEIKEVLFKSRYRDLFSSTNRFQEAGT

SEQ ID NO: 984550 - protein, 72 aa, Homo sapiens
RGPSSGRNEEHSVERRSIGGDEEHLLEEEEHLVERRSVSGAEEHRAEDEEERLAETRSSVWQRRGVVSGRDE

SEQ ID NO: 984551 - protein, 82 aa, Homo sapiens
SYEQLLLTDDHRVSETCVVAAWIPSLPDEKCYLEEAPLVRSEITTRPLMPPRGLQPVSMPLTSRIATWLRGETSGFPKQELE

SEQ ID NO: 984552 - protein, 49 aa, Homo sapiens
VEDPLGRTICQMVRARGGKELRARPTCPEKLLDRTPPGDLYPDVAEAEG

SEQ ID NO: 984553 - protein, 41 aa, Homo sapiens
RYIFEDTVNHKYKILLLPPCATDHAPLTISLKPNHGKPRST

SEQ ID NO: 984554 - protein, 37 aa, Homo sapiens
GLEVDAVFTTAVHASLYKYRRHVSTVRGPPNIVKLEP

SEQ ID NO: 984555 - protein, 42 aa, Homo sapiens
MQQCCARPHKVDGRVVEPKRAVSREDTVKPGAHLTVKNIFVG

SEQ ID NO: 984556 - protein, 104 aa, Homo sapiens
EASRGSHAQAGTRTSGLKHQKQMATKAKIDKWDLIKLKSFCTAKETTIRVNRQPTEWEKILAISSSDKGLISRIYNELKQIYQKKTNSPIKQWVKDMNRHFSKT

SEQ ID NO: 984557 - protein, 67 aa, Homo sapiens
RTSSEFHESSWEWGIVERSFSLFYFILLYLFLRQGLALSPKLECSGTVSAHCSLNLLGSSNPPASAS

SEQ ID NO: 984558 - protein, 46 aa, Homo sapiens
DYSCSSMLCCDGTFLLTQSGKVLACGLYEIQYSWRLTSVACTGNYT

SEQ ID NO: 984559 - protein, 151 aa, Homo sapiens
MLARKLELLTSGDLPMSAFQSAGITGVSHCAWPKILVFFFFLKMNLGSYGPGKSAGANSGTLHPLRISDFKQFLRPQPLPSSRGIPGARHHAQLIFLCILSKEGVFPVWLRRVLKRVYLIIHPLWPPKGVGFPGCTHYSGPKFLLTFFWAG

SEQ ID NO: 984560 - protein, 69 aa, Homo sapiens
VWCENDGHLNCFVSAAEGVFLSLIQKTFLSTNEKCGTDGAGSNAETATSVDAVAKAPCAWCARHAGVTP

SEQ ID NO: 984561 - protein, 86 aa, Homo sapiens
LGTLRILRADSQRRTAEWGEDETEADAPCQPILGERWSQEDTLEDGARVLRDEPELGTWDREKSAQSRRQEKGGRRSRWMDRNPAG

SEQ ID NO: 984562 - protein, 50 aa, Homo sapiens
MFGPSADYFQELSTSGTIGHCRWLSNGVTLETPYPGWPTLLFWPGVRRLV

SEQ ID NO: 984563 - protein, 50 aa, Homo sapiens
MFGPSADYFQESAPQGLLENVVLSMGHLEDSVPRLANSSLLALGYVWLVA

SEQ ID NO: 984564 - protein, 61 aa, Homo sapiens
MGRDEDELSQPPSLGSGDEDSSKDRCRVLRDELTWYVGRESQHESTQEKGEESVDDRNPAA

SEQ ID NO: 984565 - protein, 90 aa, Homo sapiens
MSTALSSMNMAGSELLSLLWLRGSVGRLEGRTWIPRELLARIKIVTIASTGSFSRTITRQRIRRAALTWQGRVFSGCPNQSDRPTFHVRV

SEQ ID NO: 984566 - protein, 67 aa, Homo sapiens
TPEGENNLRGTRLQLHGRFQGSNITPALRHGTELRYLGTHQDAGALQYCVVNILSVTSAIVVITSGI

SEQ ID NO: 984567 - protein, 34 aa, Homo sapiens
LRDSIRITSQYEPPGLLSAEIRREITSNITTECH

SEQ ID NO: 984568 - protein, 90 aa, Homo sapiens
ELTLEDKRLWKTACGHFGPCSESQTWVGMGGQGNGIDLTLSTLSWGAGPAVTPLELGMALGGGSGSLAPAAPSLHLASKADGTCVDISGT

SEQ ID NO: 984569 - protein, 87 aa, Homo sapiens
EENSERISQMSSNKSMVAHTSAFSTEELRTLLSTSQSQGNTWMYYVTCGTVTQRYFVYPALGQDRYIQLRSSAWHRDAFYHYSSVCK

SEQ ID NO: 984570 - protein, 35 aa, Homo sapiens
HDAKMAEQTKRYAQHNNTESNLEPDIKNAPGGIRD

SEQ ID NO: 984571 - protein, 44 aa, Homo sapiens
MIMCCLSGPADLAYSAFVQLVGMCIPDGDLDSCPARHRYNPEHA

SEQ ID NO: 984572 - protein, 100 aa, Homo sapiens
RHQCLDSVSTHGRGGRRPWSRADSRILLRAPRQQEPIHPPARGLCLEVTLKTAVDGPDLEIAHGAGAALALANRKRECGNAHYQRADFVLAANSYDLAIK

SEQ ID NO: 984573 - protein, 81 aa, Homo sapiens
RPPFFKQKGYLWVHITEKSRGYSSFRHGGIQGTNAVIRIQVSPYLGSAFPGTGFILYMVGPVSWRFSSYKAKAPSVKKGRP

SEQ ID NO: 984574 - protein, 37 aa, Homo sapiens
LSNYRVTSPSTHAVRRCSTRQASRWTSSAPASMKTPF

SEQ ID NO: 984575 - protein, 77 aa, Homo sapiens
MTPSEIQLKDSSKFPNVPQYPISLTHQKGLQPIVNKLWSCSLLRPTHSPYNTPILPVKKSDGSYRLVHKLQAISQAV

SEQ ID NO: 984576 - protein, 58 aa, Homo sapiens
KLPVEWREGPFSVKHTFAEWTDMPGSYGSTGFLTVGFIDKESIDQDFSWRLVAHGDVR

SEQ ID NO: 984577 - protein, 66 aa, Homo sapiens
DQEVAGLWDAKGGTGQEQPGAALALRKLTWAEEPGMLLGVERVDHMTGLPNRGKLTTERWTAELVD

SEQ ID NO: 984578 - protein, 95 aa, Homo sapiens
TLMPPSFKKCTITNSKLHEEEPQNMTHHQETISHYPKQLLKIQGSLKLIKAAKQEARSDQQSDLAPTPGPQSTPRNTVSQSISGDPEIHRRAISE

SEQ ID NO: 984579 - protein, 41 aa, Homo sapiens
KLAGGGDTNRGGQLSRIQWGGSLETRKSRRQGAMFTPLSGL

SEQ ID NO: 984580 - protein, 91 aa, Homo sapiens
MQMDSSSRLPRNIPCNESGGEEESLCEERERAPGSEVSLSKSHGSPQPSWLIPEKVFIGEAKENNSIMAENLWTLGDGVCGNGWVRSQGRQ

SEQ ID NO: 984581 - protein, 52 aa, Homo sapiens
MEYNGAISTRGKLHLPGSSDSLSELRLQAVRHHAQLIVFSEKRRFTTLVSLV

SEQ ID NO: 984582 - protein, 68 aa, Homo sapiens
HQYQSFGEIPDMLMKTEEHVAPVSKTESYLYSIKAAITNKIRQNTEESNNGVAHMKSFPWSSRERQGR

SEQ ID NO: 984583 - protein, 96 aa, Homo sapiens
LILSLLGILITRYHHATQNSTKIATLRSLQYRHIAHVVTAILIQPPKKLHQAQSFYIIAQGLTFLITILTSKLKLRTHSQTHHNPLSRHSNSTPTK

SEQ ID NO: 984584 - protein, 66 aa, Homo sapiens
DPFTVPKSEREDEDDNVEGSVPGTSQKEIGKIDKGRWLRSKEENGSDLESWTYMDACFTEQQEKTE

SEQ ID NO: 984585 - protein, 40 aa, Homo sapiens
GLSDSLHSAMCVIEMEGWRGTEVVQAKRALQTGVEAERAV

SEQ ID NO: 984586 - protein, 42 aa, Homo sapiens
MRIGLHEHVWDLPKLCSSLNQALTSLIARLDAWSEQQGKTGR

SEQ ID NO: 984587 - protein, 115 aa, Homo sapiens
MTQSDRCVHMLVLSPAQETVVVSVGLSALPKDTGVVCSRSISCAQKTVVVEHRTYKTLHRVTGVLCADPQPSPGNRCVVHTYSDYNTGIQGVISVWVLRPAQVTGVVCAGPQPCP

SEQ ID NO: 984588 - protein, 44 aa, Homo sapiens
MVPFLWLSPGGVTLDPWWEHEHSSSGRDTFQNFSFTSSRVSEPF

SEQ ID NO: 984589 - protein, 41 aa, Homo sapiens
EKTPDIHYIGDHLQGGTARLARLASTSSKQLLVASRVTKSG

SEQ ID NO: 984590 - protein, 66 aa, Homo sapiens
HTASHETLERTSSTLTSTDTSEPRFENTSMLTGCVMFQTQDVRYLPMDQELGSICCCPSPGSSRER

SEQ ID NO: 984591 - protein, 46 aa, Homo sapiens
TDRLMPSWGRHRSHNSRRIWFTAKKSQLRLEQFPGMSAQQSMQYSD

SEQ ID NO: 984592 - protein, 45 aa, Homo sapiens
MPALPLDIAPDRCRIWPCIPVLQNKYVFPKCVERCSDAAVTAMPH

SEQ ID NO: 984593 - protein, 63 aa, Homo sapiens
HQYYESSKYRGRSNETWQLSSRFGQYRRIPLIRKSETLQNPKLFDARNHDHSNGNCSWTFSKF

SEQ ID NO: 984594 - protein, 70 aa, Homo sapiens
EHHSTQALARRGGDLQGAGLQSASGSGVINSHFWLGPSEPRVDSWGFHAPYQVPTAWVMAQGMEPYLRGQ

SEQ ID NO: 984595 - protein, 81 aa, Homo sapiens
SQAGTTSFIYLSCIVLFGACIEGVVLRDKFGEALQENLVIGMLAWPSPWVIVIGSFFSTCGAGLQSLTGAPRLLQAIARDG

SEQ ID NO: 984596 - protein, 118 aa, Homo sapiens
MYILAEEPGMVRNVSAAALPSCPLHATGPSPTWWGALSTCPSWSICPPSEAGSSPYFLTFVWLVLLENSPCGLCSAPLSQPREGGMLVPKRRGDFPRTIQGVGSRVGLEPSPIREIAF

SEQ ID NO: 984597 - protein, 64 aa, Homo sapiens
ISGSDDGGGGMRRWKSTVGTAGTHSGRGTDHIVADVGGSPAEVLDDFRHLHPFDTELREAALAI

SEQ ID NO: 984598 - protein, 83 aa, Homo sapiens
PGDNPRTRAYNRAMTRLQHLFWLPKQSPECENFLDVGLGRECTSTQGVLKRESGSDSDLFHSPSADMDSIIFPQPEAAHLACD

SEQ ID NO: 984599 - protein, 41 aa, Homo sapiens
PGLSGVIRCTAKRTWVIDQTEILSRVNADDIHESSRVGYIS

SEQ ID NO: 984600 - protein, 126 aa, Homo sapiens
VVPWMYGKQTNLELEVEPARCDRIVSIIVKKLETDERLLCIDKQRTWFPEMKSTPEDAVNIVEKTTDLEYYINLVDQAVAKLERIQSNSKRSSTMRKHVNQTASNAKENVSHVLKSQNTAAIITAD

SEQ ID NO: 984601 - protein, 39 aa, Homo sapiens
VDTLPGLMITSAASTMYSTFSHNELYTFCTGTHGPACVP

SEQ ID NO: 984602 - protein, 114 aa, Homo sapiens
LCTSDRRLQTCCICCRKLMGMVLGPELQLLDKYRVAALEEVLQAEQEFLANAKESPQEEEIDPFDVDSGREFGNPNRPVASTRLPSDTDDSDALRTQVLAPSAEEPSSSCCEEE

SEQ ID NO: 984603 - protein, 33 aa, Homo sapiens
RRPFLSSLPFFELSHTSNFHINLKLYANLPTLQ

SEQ ID NO: 984604 - protein, 81 aa, Homo sapiens
CAPGRPFPQWAACGVFSTAEGVQSIHTTQCTEPSSGWADPGGPDLEAGVSLTRHVTQDVVSRTLTTSGTLSTHMFQQFFQT

SEQ ID NO: 984605 - protein, 40 aa, Homo sapiens
VNEEELTDSRQVPWDDRGSDYGQPLILTFRVPPGDSPLPC

SEQ ID NO: 984606 - protein, 47 aa, Homo sapiens
WTRMGWGYRRHPNGYLVLELSVQEALSGTSCLLGPRPVLTVLALLLA

SEQ ID NO: 984607 - protein, 108 aa, Homo sapiens
RQAGLGQTVVTRHGFTLTNIWDYGSRFVSSEWTLWLFTRLGHIQSIDNMEWRGSLAMSWFTHSSDQQGNKGPREEKAVPGQTWDLNPARALTPSPPVPSLPPCPALGP

SEQ ID NO: 984608 - protein, 84 aa, Homo sapiens
DVQVVGCLAGTRWCCDYLWAAGDTTAAGAGVVTLNVAGYGLTHDLGPGRLTARPGDPNAVGGTLTCLDWVVVTLVADGWTLTDR

SEQ ID NO: 984609 - protein, 133 aa, Homo sapiens
MAARKPLKSSRRYGSPGIGRCNKSSRLLLSGSPAPDPFPQYPLPASLINPSVAAHHDPIRIQLKDSSKFLSVPQYPISLTHQKGLQPIVNKLCSCSLLRPTHSPYNTPILPVKKSDGSYRLVHNLQAISQAVL

SEQ ID NO: 984610 - protein, 109 aa, Homo sapiens
DASAINCARIEFWILTHLSVVVVARALCKAEVFAGPPKWEEGAPPEGESKDLLQPVEVVVSSCVTGLPSMLLCRAARLLKCSWPEELPIEAEEGLHLCAQAFAILLQPP

SEQ ID NO: 984611 - protein, 31 aa, Homo sapiens
MSLHNNELPYFHRTQSHVSSAVWVRSAVPGY

SEQ ID NO: 984612 - protein, 68 aa, Homo sapiens
RGIRTAWVSSADVPTDDAVTGTGGTGVNLSSATLCVPTTKTLGTVTPVSLLRAFIQLILQTLGQCYLR

SEQ ID NO: 984613 - protein, 48 aa, Homo sapiens
MMLLKGLAEVYFQNGKFRKPLWLRLYREWTGWEPGKEVAAVFHAREDG

SEQ ID NO: 984614 - protein, 67 aa, Homo sapiens
CRGSRHRRLYHHGDTGDGESVLRYPGEGAMRNGYHHPRKAAARANYPLPTREGSAANSHYRTLSSAL

SEQ ID NO: 984615 - protein, 91 aa, Homo sapiens
CESAMVAMCKADGREPTVAGPNWKTALCIFIVDGVLLLLRGGSQGPGPNVATSSPNRERFPRCRGSQSGPSSSLTVCLAVCKEASGVGLGL

SEQ ID NO: 984616 - protein, 104 aa, Homo sapiens
MTQCSRSVELLICSCVRASPPSGCSQLAFNFSWSPGRSPGMDCTSQLCERRLSSSNLSRLCGDHCGALLNLLSTVLVYLLSVLPSQLVILGPDVCHDLGEVLRF

SEQ ID NO: 984617 - protein, 115 aa, Homo sapiens
YSLEARSPAPRLLSCDNSVEDWITEECSVQPAELSSTSQVHKEYSKCLRHSYCCIRSPTGGTHGYLKNSAMRSNTRYYTGTQVSGQTGLPGAECRNLEPERWGVAWPRFLIVMIR

SEQ ID NO: 984618 - protein, 68 aa, Homo sapiens
CFMIGSMLFSISLYFISDLKLLMQFMNLRNKNVKNPDKEDEISEELKEKAKIEDKKKDEEQEDPQGIP

SEQ ID NO: 984619 - protein, 44 aa, Homo sapiens
LPQPVDQALAYSYSVYFELLHQHLQQHYTKRLTVSIGYFKKQEL

SEQ ID NO: 984620 - protein, 46 aa, Homo sapiens
ARPEDPFLKGVCCSLSASIYKRFEIINAIMNLEEEDAGTGFKKQEL

SEQ ID NO: 984621 - protein, 140 aa, Homo sapiens
ESTVIYAETDVLWNSQIPLLICSDIWTSWLYEDHYKTNIQYIESHPDYALEDLRLDEPFPELREHFQSYNLDHMEQKDHSHTPWIVIIAKLFSTVDSETNGRIPETYNDQEDFRDLIRQGILENENGAPEDEENLQEAGT

SEQ ID NO: 984622 - protein, 71 aa, Homo sapiens
QFLLLKACGSEVQICITFWSETHEDLWKLNLLRLKNFHPAGKISQWELKEQVLDSVVFFTKSNQCFKKQEL

SEQ ID NO: 984623 - protein, 70 aa, Homo sapiens
ARLEDPPVLLLERKYAVLYQPLFYKRFEIINAIMNLRKKNVNGIPDEEDEISEELKEAGLEELVSRSRNW

SEQ ID NO: 984624 - protein, 34 aa, Homo sapiens
MIPRSCFLKGRPRGSEEVEVTRVPRGTGFKKQEL

SEQ ID NO: 984625 - protein, 59 aa, Homo sapiens
MTSNYIYILKPWHKTKERTYRHKDRKKTERKKGKEKKERKEKTEQTEQRDRKAKNQNRQ

SEQ ID NO: 984626 - protein, 47 aa, Homo sapiens
PQFLLLERTLVGEIEIQKAPCEKDLNARFLSGEEAAEHKVVVDVQAR

SEQ ID NO: 984627 - protein, 39 aa, Homo sapiens
TGALTYRYCVAIGAGGLYYGVGGAGRRRLSEGEWEDECS

SEQ ID NO: 984628 - protein, 32 aa, Homo sapiens
LPLFLVHSVCERTARLSRSHRVILKIVNVYQL

SEQ ID NO: 984629 - protein, 52 aa, Homo sapiens
RRSRGSRQLSDPSSTSQVPCLKTSPSPERSLLLKYARTPTLDPDTMHARKGQ

SEQ ID NO: 984630 - protein, 37 aa, Homo sapiens
NDKVSVVTPIYLADVILRNSSRMKYLCPRSRVVLSGL

SEQ ID NO: 984631 - protein, 70 aa, Homo sapiens
GIPYCYQRTLFVKNPSNIIVQTVSGAKAHCHLWDGSRTYIPSDKFTYNIYASMNGFRFSSCQCNSNRCQT

SEQ ID NO: 984632 - protein, 36 aa, Homo sapiens
DGTCSFYTVRSMPASQSEEGAPGLTYPSIKVYNFTA

SEQ ID NO: 984633 - protein, 105 aa, Homo sapiens
MCTLPRGRWQSCSLCRSICEGRSRPRLWGKKTKGLLRFPPVGATEDRAREGGTAGGSTGGRRLRGTIPARPSIPSSQQTARQWPTRPSSALWGHDLRRVGAPSPC

SEQ ID NO: 984634 - protein, 98 aa, Homo sapiens
QRWSSAFYFSEKQKLNFKISGELSWRWFGEEASITRSGGGFMPPGDRAELHTVGFGGSKMSRGSCKDKKEKGCVAFLSFPFFFSKDGVSPRREVGVQS

SEQ ID NO: 984635 - protein, 57 aa, Homo sapiens
IEQCAQLLYLLLNQDRSLQALILLYGIYQMIDFSLHMWQICVNRLHHLVTHEIPHHF

SEQ ID NO: 984636 - protein, 35 aa, Homo sapiens
MSSSDLLGFHFLLLSWSSTTLHTSCWSRSTGPYIA

SEQ ID NO: 984637 - protein, 73 aa, Homo sapiens
VDSEDPLLSQSDSKSKLTKDFSALEIQLQDTQELLQEENRQKLSLSTNAQCRCEDEEEFLPVSSWRMEEEANA

SEQ ID NO: 984638 - protein, 48 aa, Homo sapiens
NDCPQLAAGAQVKTVSMEVNILKKTLDGVSANDLTDVPRFHVSMMCMN

SEQ ID NO: 984639 - protein, 38 aa, Homo sapiens
SDLEDLRIRWTQIEPDSSSMFRQVDVLWVVELARRINP

SEQ ID NO: 984640 - protein, 96 aa, Homo sapiens
QKIQITGHCELYSCMCISVTIVSMTKVTDVIFVFLKNNWLYIQVFFISFCARSTFSTLPIKSGHLLSVRQTHGNVQVFQPKPVMHGNQCKVQFQCM

SEQ ID NO: 984641 - protein, 41 aa, Homo sapiens
MPLGCIPMRRKDCVKNYPTFHSVIVIATVAWAMARRGSKIA

SEQ ID NO: 984642 - protein, 117 aa, Homo sapiens
SRGSYARSELGIKENWVQRAGRTQRRVWQRGELGPKGTQCPNVHQRWFMGVPVAPRVLLGLQGRPGVFPGITGEAGEFPGTGGQLSSASRQLVCGRMHQPNKFAHVHDRGYRKLDIR

SEQ ID NO: 984643 - protein, 56 aa, Homo sapiens
EGAVVYLQEELRLWSGQVGLLFPLRLGCCGMLLIPHYVLRVVELSGTVCLLQFTTA

SEQ ID NO: 984644 - protein, 66 aa, Homo sapiens
EVEGGVSGIQVKGRAPGLWWAGRGMEDRVRGIQVTWQSSLCLNDASLIIAWACDDQTLWMTDEEWS

SEQ ID NO: 984645 - protein, 40 aa, Homo sapiens
LSVLRIIVDERFYPVTLDVLHQIFSKFGTVLKIITFTKNK

SEQ ID NO: 984646 - protein, 33 aa, Homo sapiens
MLRWDPGCLYASPLGCRLSFGSDQAAVTQFSFI

SEQ ID NO: 984647 - protein, 40 aa, Homo sapiens
SELHDGGARSTGMKCSCFTPSSRRMPSGDTWTTVAVVPDV

SEQ ID NO: 984648 - protein, 69 aa, Homo sapiens
LNALYIRKRGQHSYLESEGNTHTWKSRTTLILVKPRTTLILGNRGQHSYLATEDNTHTWKPRTTLILGN

SEQ ID NO: 984649 - protein, 105 aa, Homo sapiens
SLSASSAGPARDALCISTVILMLQSVTTAAHLAWCIQPATLNHSCANSFPHAAIIAHFPPSVPASSCVPPVQHHSMQCKHPHSGTSTLVPCWSQQLHAMCPLHGS

SEQ ID NO: 984650 - protein, 34 aa, Homo sapiens
DSESSSAECTPAFRFIGVTGVPFRDIFPARNSTK

SEQ ID NO: 984651 - protein, 155 aa, Homo sapiens
MAFVAWVEEVVDMTGVTAADWLLGAWSAGAAPCDAHCSPVSCAVHVQSGPPAHPVLRCLAGPMMLHELAVAHVSQQALQCHPHRLAQRVRGRCFRWTPVPQCIGGFVQILVDISWKLLLILVCLGFLHPEEKPIGPCLELQHVDPPAGALRNPLE

SEQ ID NO: 984652 - protein, 53 aa, Homo sapiens
FENIVAEAAAGAEGLGVATGVKRWWMTVVTCCRSGSGELELSELLPVSAHCYH

SEQ ID NO: 984653 - protein, 122 aa, Homo sapiens
MDDGMTAAALTPASWSEELLPGVTTAPQSAGQARSSHDPQTTQSSEAGWSRLSCMSWLWIMFPTQALQATLNDKARRVLWTLIPLAPSAPGIGAVVQDYLVDFPDMLLILESVSGSCIPNTT

SEQ ID NO: 984654 - protein, 46 aa, Homo sapiens
GTFLIQLLIQELLHSGTGVGLQQLPLSASRSSLSTFLCAVVPGAQG

SEQ ID NO: 984655 - protein, 51 aa, Homo sapiens
MAAMIGCSMSLQAAAVAVELEPGHCQADQRIDGTRVQAPVEERKRIEARAA

SEQ ID NO: 984656 - protein, 115 aa, Homo sapiens
VCAAVTLEDPAAAFFWCSELAVVRVFLRFNFQDLNWPCPLKKESSSWGGLNFNTDEQAREDHFSSFGPISEVVVVKDRETQRSRGLGFITFTNPEHASVAMRAMNGESRDGRQIG

SEQ ID NO: 984657 - protein, 37 aa, Homo sapiens
GLIRFLHHSHFFFPIAAPFFGIIRFLHHSHFFFPIAA

SEQ ID NO: 984658 - protein, 57 aa, Homo sapiens
MVWSLFHSDWTLVHFGLEYLYRFLHGRFFFSFLIIKIIIIIIFIIILFIIIVIRGTE

SEQ ID NO: 984659 - protein, 113 aa, Homo sapiens
GGADRVANICNPSNLGGRGRRITRSSNRDHPGQHGETSSPLKIQKLAECGSTCLQSQPLGRPRQENHLNPGGGGWSELRSRHRTPAGATERDSISNKNKNKNKHKVGTEKGPS

SEQ ID NO: 984660 - protein, 52 aa, Homo sapiens
MSSPCGSGWSRTPDLVVIRPASVFQSTGITGMSHRAQPVWFLIGFGKKGAAV

SEQ ID NO: 984661 - protein, 59 aa, Homo sapiens
AAGPFLVEEGLAMWLRLVSNSTDPPALVSQSAEITGMSITPGNGMIFGVFGVWFPSVFP

SEQ ID NO: 984662 - protein, 99 aa, Homo sapiens
HLSLRGSWDYRHRPLRRANFGILVEMRFGHVAQAGLKLRTSSDPPVSAFQRAGITGVSHHAGPKTGFFGIFLSKTGLTTVFLKQQKDNTGGHTVLKLET

SEQ ID NO: 984663 - protein, 65 aa, Homo sapiens
HINDIRSVTHGYTRSDANLYREACTADGEYTSTRLQLNDISAVSTVAHVSTELVQGRHAPTVVNT

SEQ ID NO: 984664 - protein, 111 aa, Homo sapiens
FGAATRFRCFLGGGVMAALGKEQAWRSEDGCCEGGCAAGPAVGPGEIRGGGATSLWTKMRSWNRAENRRLPLSIFPKVTPGARVSFTEMTDSPFHIFPPSAECREADGLNF

SEQ ID NO: 984665 - protein, 114 aa, Homo sapiens
STLYTSTSVFTPIMQVGVGSDPADIRVILLRHQENPQCALSVSQWATDKVYPSELVNSAGQQHAVVLQVGTLLTACLLGDGVPVKMQFSIHSSSPGVRIGTCQEREGHHLQIHQ

SEQ ID NO: 984666 - protein, 108 aa, Homo sapiens
QRFIHSYNAILSQRFILPQRFILPRQALAKPFTQMKYKAWSSTLYTSSPPPQPAAEPGSPPAPAGPGHRPVPALGPSGPSGAQPPGRGKINHSLFLDPGNADQDSLQP

SEQ ID NO: 984667 - protein, 105 aa, Homo sapiens
LNALYFMPTNSSSFFFWRQSLALSPRRGVQWCDLSSRQPPPPAFKQFSGLSLLSNYDYRLVPPRRANFSIFSRDRFHYVGQAGSGTPDLVIWPNSASQMCWGLQA

SEQ ID NO: 984668 - protein, 33 aa, Homo sapiens
MQGPLELRKYKAWRKYKSVELNALYFSPAPSPT

SEQ ID NO: 984669 - protein, 38 aa, Homo sapiens
ALYFLKLYFLNALYFLNALYFISSRGPGILNIRSIKRG

SEQ ID NO: 984670 - protein, 76 aa, Homo sapiens
CGDSTDAETRQDWASEVWLLRRESGGCGGHVLPPPPSRGLVPHWMAERCSSVLPWWAPNRCLLLEQACGLSGVRHD

SEQ ID NO: 984671 - protein, 48 aa, Homo sapiens
TRLDCYSFLPKLCATLNGPGADRDRTAPGTCIQAKSGPGFVHPVRPTR

SEQ ID NO: 984672 - protein, 104 aa, Homo sapiens
SSHGRHVGISRSMQTQVEHSAAQVDVQWKGTDGAVHLLLLLVALLQAAQKEGLAKKLLGSATRLDVQQGVVCVLGQALGEGQQMPSCTMGGVVKDLHWGVCMLN

SEQ ID NO: 984673 - protein, 41 aa, Homo sapiens
NSPFQACREHRQQMQQCEQHCMEVMAREQFELVMMHDDEST

SEQ ID NO: 984674 - protein, 105 aa, Homo sapiens
LEDKPRCKATVNKSLATFLVAENVLQLRHLFHPGGAWALQSPQARMASHRKSKGGGLPLSGSSVPGTFHISIGQGMLVGVAGGPSWEVLSSEVEQDQGPAYRSSL

SEQ ID NO: 984675 - protein, 110 aa, Homo sapiens
LTPQKVRLVVYRDEAHYRFEENLEIFPVDLQKKAGRGLGLSIVGKRNGSGAFISDIVKGGAAYLAGRLTQRDQILSVNAEDVRNASQKTAATILKCAQRLVQLEIARLRR

SEQ ID NO: 984676 - protein, 52 aa, Homo sapiens
ITTIQVLPTVPGSSISVPTAARPSCPSAEASTDPFLTSTPVTSQPSPPQSPP

SEQ ID NO: 984677 - protein, 98 aa, Homo sapiens
VKQTHLCCSSRGTFSHELCDFVLESTAGETPVVAIRTAKGETFVMQEEFSRDGKALPRILQYYYDGNLKRHLMSEPIRDSNDVPVKIEKAENFDAIVN

SEQ ID NO: 984678 - protein, 43 aa, Homo sapiens
CTSITRPLHEPHHHEAHTQNSTRYTAPPPEAQTHNSTRYTAPQ

SEQ ID NO: 984679 - protein, 50 aa, Homo sapiens
ILSDPKAKPSAISITIHHHPPLSPTIINVITITNIQSITNITTIIPTIIA

SEQ ID NO: 984680 - protein, 40 aa, Homo sapiens
PVPEHACLACRSDRVFTTADAIASHDKSVRPVSTGADLQY

SEQ ID NO: 984681 - protein, 41 aa, Homo sapiens
MPNMDPLGILQNKECRPQNSIIWSLVSTSIVSILLKLSCMA

SEQ ID NO: 984682 - protein, 123 aa, Homo sapiens
MWASRRREGTGWAFGEALLSERGVLMPSVHVEVFGFGPQPLSGNSAYHVDPTMDTSFLRAHWFGSFLINQRQGLAVVLLNSLGQCLRVFGFFFSWVVGQGRDLGTLLIQGRDVGSPGLDNQKP

SEQ ID NO: 984683 - protein, 57 aa, Homo sapiens
GPVSFLRGGCQSVVLNGTEGETAPGDLGELSGDTSGWHILVGRPRTSSGFDGRECLN

SEQ ID NO: 984684 - protein, 63 aa, Homo sapiens
MVLRSVSVVSAAPNFSRWCGDHCGALLNLTETSTCLARLGSCEPGRHIVARMSAVILVRSVRF

SEQ ID NO: 984685 - protein, 65 aa, Homo sapiens
DNPELAIWAGRPFTSSSGFFFMQSRPSVRASISVVQLRSCDIGVVNDLEERMDVVLHRVQLRTIV

SEQ ID NO: 984686 - protein, 78 aa, Homo sapiens
QRWSSAYCNSASRVQAILCLSLQSSWDYRHPPPCPASFFFFFPKGDVYLVIKNNKGKENMYLGGVPAGVTKTMRVSKK

SEQ ID NO: 984687 - protein, 83 aa, Homo sapiens
NELSYWEAEVGGSLSPGGGGCSEPGSCHYTPAWVTEGDLISKNKKNILKYFKYGKRNKNLKQYQNYIKIIIYQNVVECNKDNN

SEQ ID NO: 984688 - protein, 67 aa, Homo sapiens
EDPNDGVSSQMEYPAYLRLVPQNFGVIGLREHFAIHFLAGGGLFGLVCLDVACLSNGITNDETSYAI

SEQ ID NO: 984689 - protein, 77 aa, Homo sapiens
MRAEDHRCNDVSSVVVCGRPTSMGSERSLMRPISDECSWRHEIECLKEELSSDEDHDEEVHGYKPDCSLGCGGEMPN

SEQ ID NO: 984690 - protein, 163 aa, Homo sapiens
CGYVTAMPEQCASSEAQCPVWMDADAFEHIKQGSDAYDAQTYDVASKEEQQLQTDSGKDQEEEEIEDTLYGHSRSRRSSKAADCGAAEARGTRCRAAEHPWALMRWQWRSKLSKQRKTKIPEQTKPYKETANEETRKKRGVYHSYSSSIPHGHDLPALFTRCQ

SEQ ID NO: 984691 - protein, 73 aa, Homo sapiens
GSPMMRPQSACLVDEYIIVSCHGHLTDTKYHTDVLFVRHDGSDSSQGSELLFMKKNHDEEDKAYKPRLARDLV

SEQ ID NO: 984692 - protein, 56 aa, Homo sapiens
DYLEDPTMVSDCFYTVAISGMMEVVASVARPWGPVPLMVDLEKETRRWWFSPEVCG

SEQ ID NO: 984693 - protein, 116 aa, Homo sapiens
MAPMLCILSRGIKKKRNGYEQCMKRDKQVLLHWVYYGDSYDTWMPSSAVDGSVADARTPENLRKVRAKWIVESESFKEWLNEDDYEVNDDENPVSRRKKISAKTLTDEVNSPDSDR

SEQ ID NO: 984694 - protein, 95 aa, Homo sapiens
LPSSSFFFWAFFSLDNSLFGWIRLSLSSDMAAISFSEFFLQLRQPSFHKGWWSSGSRVIPHLSQFLRNITKGQARRFSLDLGAILRAEEEEEEEV

SEQ ID NO: 984695 - protein, 59 aa, Homo sapiens
VGLNGCITTPVNHDMMKFCESGPSSSSGPRTPPSLQVVEFWGRRLGPGPEDCSADSLSL

SEQ ID NO: 984696 - protein, 39 aa, Homo sapiens
MPRLQMVSARMYAVQTGSPTNSAWLRVVLLVHREAVIDP

SEQ ID NO: 984697 - protein, 43 aa, Homo sapiens
GAYCERHYTQEELLREDTITEELYFTVTGDILSGSRLTNHRSR

SEQ ID NO: 984698 - protein, 57 aa, Homo sapiens
GSMDQADFKRSQGNTQTHFPGGQAHVRSWRYQSKGLLVPRGGKSKSKLLSLLGSNGY

SEQ ID NO: 984699 - protein, 37 aa, Homo sapiens
LNSLQEAAQGKRLLLFRVIFWSSCLSIQLVLSYRLCS

SEQ ID NO: 984700 - protein, 42 aa, Homo sapiens
GYQAGITGDACETPAGERQVVAGLPTHGFVEIIEMECHNVAK

SEQ ID NO: 984701 - protein, 52 aa, Homo sapiens
PSGEVLVDDRGVLCKNDWSIAPDDDKVRFSLSGVTPNSSPTMLNQTVSDESC

SEQ ID NO: 984702 - protein, 190 aa, Homo sapiens
MASSLETKVTEISLNQFRKFILLRLRMHSDTASGGPDDMCLRGLGHSLLLYILGGHNTSISTRKIHIGSIWKGRTTQTRVLGDFQLIGRFKHILIGSLLKALLSVERNVWLIFVLLVEMGFYQVAQAGLKLLSTSNPLALASKTAGITGVNHCTSLDIIPKYIVDLLNNKGIMMVANCYSILYQITGRCG

SEQ ID NO: 984703 - protein, 81 aa, Homo sapiens
QHPQTPASPFFPSTSILRAHFWSLSNSEHHIWWDMPIQCHSGHLTPCISVLPVSAGTDQLRARPSCLADRWVGTERARMPY

SEQ ID NO: 984704 - protein, 37 aa, Homo sapiens
TLGSCQDGRTSQAMPAHSSVDPDLRLPLSGKLLPDAS

SEQ ID NO: 984705 - protein, 30 aa, Homo sapiens
MGDDEDACSDRGTEAMAPDILARKLAGAED

SEQ ID NO: 984706 - protein, 132 aa, Homo sapiens
MCPQLLRRGHKERLHVLLLLWLMTDVSLLLPKLELQWRDLGSLECSASLCSCDSPASASRAARITGAHQHTRANFFFFGNLLQYRWGTTYCWPGWVWRLLTPGDPCGSASSRLGTQRREPPCPPQRSWVLPW

SEQ ID NO: 984707 - protein, 36 aa, Homo sapiens
NDWSSRYRVAESMENHLQPAEVDVAYELGIVPSIRV

SEQ ID NO: 984708 - protein, 192 aa, Homo sapiens
PAKNQATCREDDKNTVSPTTKKPAGNLFCFSPRGIKRSKAVWEGQNRQGMVGEGKSRGCGVCLATGVKGLPSPCWDPPSPSGLAGRVQPATPKGRCGAARCSRQGARRGSQRLALQGDDGTAPQLLCQGAGVLDLLVADCLQFMLDPCQLLLDGDLGAGINHFALKGRRLGCPEDKHQILLLALLGLIGCII

SEQ ID NO: 984709 - protein, 196 aa, Homo sapiens
NDGPTADTAEEEREEIIIPSYGNLWDSNGPFPVGCNLLPSLAVCSLTQKGEGHQVPLTVVFVSSSNPGQWLPCKIQPHLMTVCNTPHASDGRNPMPHATPISARLGSLISISLCSPQLWGLQTHFRSILSTSQEAEARGNNPCPNAPDHATSLYALSPSPGKIKLVEYLPMCPRTFSPHNHFMGQHYHPQVTDEEI

SEQ ID NO: 984710 - protein, 66 aa, Homo sapiens
KNISYHLTGPVQDNQHLCDHRCWSNTSTVILSTTPRGAHTTVIIPHSTDRHGRHKQVNVTVTKDIN

SEQ ID NO: 984711 - protein, 51 aa, Homo sapiens
ATTAAADASTGPSSRSPSTLLRKTPTAIKTERTPAEVKKTTAKSVPADYSD

SEQ ID NO: 984712 - protein, 50 aa, Homo sapiens
MRYVASYLLAVLGGNSSPSVKGIKKILDSVGIEADEDRVNKGFKKQELGV

SEQ ID NO: 984713 - protein, 125 aa, Homo sapiens
PPVPALERKSGRVVTTRLGCKYVSLNEGSEYDHVYVEKVSPVMIVQASAILDYLLVNNRLSHVYARSRSATALGDNLQELYETYVRTWKYMLKNSKWLNITVLEMLSDCILSLPERDQISRSRNW

SEQ ID NO: 984714 - protein, 35 aa, Homo sapiens
MAIQDECTWSFSISIFSDYHQRLMVIIGDFKKQEQ

SEQ ID NO: 984715 - protein, 118 aa, Homo sapiens
LLEDSEQVIKEAGSLEETQVIKRHTLVVAQMKRVSRLPDLTPPTGSNRGQPVPGELLPFCQEFWVVRPSVTNVFQESEEEKQPEVPCSWAKGESLSLPWVASSTTDGTEQVIIARSRN

SEQ ID NO: 984716 - protein, 95 aa, Homo sapiens
PQFCFLKRECIISTSVPAVIKHQGQGCLHQFHDRVPEFRVHGIKPVSSYLYHDNDRTFETDEKGEIEVCRLEIEEDQKRLRDREGGRTREFKVVA

SEQ ID NO: 984717 - protein, 104 aa, Homo sapiens
DYLTDDIGAPTTAKFRVKVAGKSVLWIGQLPSTIFICMEAEIFRAYWFTIRKTGRCIFIRGLCHDHGGVVKPAHTGMLFLLLILSVTFKVTVATHSFFRGSGYR

SEQ ID NO: 984718 - protein, 52 aa, Homo sapiens
RYYYRVYFFTSLYNGFFLVVQTTRFLLGPTHVNTLPHGDFYDGFLGATLYTR

SEQ ID NO: 984719 - protein, 157 aa, Homo sapiens
TSVKRRDRSRSRETRPEAESEEDLEVETGDAQGVAAGAGDPDPPVLEIKARKLRIDLGPKRKLMVGKVLKQKQKSTKHDKAGIETSTHSMLATLTRISWKQATCSKANSTSSSKNGEQAARKKAHGKHEEQLHTAHRRDANKGKKWSLEARKMMHQH

SEQ ID NO: 984720 - protein, 35 aa, Homo sapiens
NQRIPLNAYTSSTLYFLNAYTYTGKDEKMQQDSDI

SEQ ID NO: 984721 - protein, 44 aa, Homo sapiens
RPVIFSRLYFLNALYFLSFIFLNALYFHAYLILYCNSIRKYKAL

SEQ ID NO: 984722 - protein, 46 aa, Homo sapiens
TLYSSTLILSHFFLNALYFLNALYFLNALYFRIEFQYNIKYAWRSI

SEQ ID NO: 984723 - protein, 37 aa, Homo sapiens
MTWPQASDTRSGVVGVSVVRAPLSLPTERAPDGSIKT

SEQ ID NO: 984724 - protein, 53 aa, Homo sapiens
RPHYYYSSSPSPSRTVWDTRLGITQVPIRQPNTHSHHTLHHTQATLSAAHPTS

SEQ ID NO: 984725 - protein, 43 aa, Homo sapiens
PLNPTFWEAEVGRSRGQEFKINLDKLARVSQAVHSGISRGDLY

SEQ ID NO: 984726 - protein, 73 aa, Homo sapiens
MWSLQIGQESAKRLTAVRLQRQRAILYKRLNVPPAIKQYTQCLDRQTATQLPKLDHKYRPEEKQEKKQRLVGP

SEQ ID NO: 984727 - protein, 55 aa, Homo sapiens
NSPQGGSLGCCQSGLCVELQGSEEKCLARGLERGEVRSLRNPSSPILWRKRAGES

SEQ ID NO: 984728 - protein, 48 aa, Homo sapiens
MVGEWTWIDENDNITDVLAFCVAQTASRLSHHPFMPSHGVDCHPNNDL

SEQ ID NO: 984729 - protein, 46 aa, Homo sapiens
MLIVYGIDEDDETPPPHSGLQTRKVIPVTAGGTVLAAALCRVAYGK

SEQ ID NO: 984730 - protein, 34 aa, Homo sapiens
LLVDLEDPTMAQLFSYSFLPYPFFYVNYYVTEPQ

SEQ ID NO: 984731 - protein, 58 aa, Homo sapiens
MLRSLYDDSPNWSSRSENNNTLRHRVLLPLTSYARYSTAARACFTHHLKLTDPLVGVP

SEQ ID NO: 984732 - protein, 112 aa, Homo sapiens
CGFVQDGEYSGWRVCDCMLIMTELGLYTVTSAKTEDLNSKINKIARQQHYERQINNSEDLAVLHYPSRVACPAYSINPVSPLTTSGSSLYPAIFTQIPMKRYQATRQYPRSR

SEQ ID NO: 984733 - protein, 69 aa, Homo sapiens
MRRQGRGKCRWTIVRLGRSVVSDETRSGMINRYKNAHLGTALKANPLGGASHAKRNRAGKKSRSLKPKR

SEQ ID NO: 984734 - protein, 202 aa, Homo sapiens
MVSAVAQLQMEGSWGRWEGAPSETLCALQTIRCDSESFQRYHEACNTPFELNLSGEPGNQGLRRVVIDGSSVAMVHGLQHFFSCRGIAMAVQFFWNRGHREVTVFVPTWQLKKNRRVRESHFLTKLHSLKMLSITPSQLENGKKITTYDYRFMVKLAEETDGIIVTNEQIHILMNSSKKLMVTDRLLPFTFCGDLFMVADDS

SEQ ID NO: 984735 - protein, 72 aa, Homo sapiens
GEDTDTELYLLLVIQATGTFSGLGCLHTKFSSKPLHIVFLGLVLLRSALILKANGALIHLVLVDTVWARKGQ

SEQ ID NO: 984736 - protein, 123 aa, Homo sapiens
MMSVAKRIKMEGNDGMEGLTMSGLLTRQDLENLECCQSELATKQDGSGVTGYEEKLNGNLRPHGEKQDVLEGQANENINDEPVDMSARRSEPERGMLTPSPDIIVLSDHEASRPRSSSRMEER

SEQ ID NO: 984737 - protein, 52 aa, Homo sapiens
ALRGVDLLDIIPGLKSLKEQNSFLGLRVAFNFIFNYQRKFRSFLNTMRVRAS

SEQ ID NO: 984738 - protein, 82 aa, Homo sapiens
NDGPQGLTPVHGIWRYSNCTQRLNRERGWTKTLSIYTNALFKDITHKVMHLHSPMSGDHDSEECKPLSRLSSTSKKKAEGHT

SEQ ID NO: 984739 - protein, 79 aa, Homo sapiens
ERIPAYALLGLTASLTTVPCVRCLGVCAVCYVCVLCVHVCACAVRLCAVCSCVCCVRVTGHADASRASRVTQLALVNHG

SEQ ID NO: 984740 - protein, 42 aa, Homo sapiens
NDGPQLKIGGAEILVQRVMQQKARGMELIVLGLRDPYRLATP

SEQ ID NO: 984741 - protein, 81 aa, Homo sapiens
SVRGKVTQSLPVKEGDRGLSPSSGVVCDLSRPQLGEDEFSYGFDGRGLKAENGHLEELGQTLGENDVMGCLANLETEEVEL

SEQ ID NO: 984742 - protein, 34 aa, Homo sapiens
YPRNQISGRDSDLEVECSQRGKSASHSQFGPVAL

SEQ ID NO: 984743 - protein, 87 aa, Homo sapiens
WHRRGEGHSECVAHFGPPSPPNRRWTWSWKNRNSLFYLEDRFKVQKFLLYKSSSLHALPLAEDQPPAQDVRAAVARQGQGEGRKAKA

SEQ ID NO: 984744 - protein, 35 aa, Homo sapiens
RTALLICELVRREVVQQLPGYCSTYWVVPVGGRPR

SEQ ID NO: 984745 - protein, 131 aa, Homo sapiens
NALYFEILNEGVKRPLQRKRKTLLKEIADDTNKWKHIPYPWMGRINIVKMTILPKAIYKVNAVTIKMPPSFFTELEKTILKFIWNQKRAHTAKGRLNKNNTSGGITLPDFRLYYKPSPKQCGTGIKIGMEV

SEQ ID NO: 984746 - protein, 73 aa, Homo sapiens
REPSWLSAFRDAHNEASVTPSSLAVHDGAPQNEPAWDGLSSQELLVALVMRPEAGAPNGQTSLVLSSVLTVSQ

SEQ ID NO: 984747 - protein, 40 aa, Homo sapiens
VYSVQGSLQRSGQFQRQGSLQRQGVLNSSIILSMHGPLEL

SEQ ID NO: 984748 - protein, 43 aa, Homo sapiens
SWQLYHRLRTLTLDHTAQDYSTLTSVSSHDLADCWCADSPPAC

SEQ ID NO: 984749 - protein, 120 aa, Homo sapiens
MANFIVEDVHGHYEGNPKLNQEFSDGTRTPSKNTSGVFEALMAIFFSGGHCVRAVWESRGVFNRLSLGEKLVLLVLMHQGGMTTTRLLEGTGNNSPQALRAKEAWLCPILCWTWLLDAKL

SEQ ID NO: 984750 - protein, 92 aa, Homo sapiens
TRQTLSRAFDVPIISDPDAGTSFDGGPSFKAVVGTAPPNASLSFITIHQYTAGPFLVSCQQETHFWWDMPISATGPTHPMHTLYLPRQCLGT

SEQ ID NO: 984751 - protein, 178 aa, Homo sapiens
CAEVDLRIPHVGITALYGRQSETPSQKKKGTQVEAQPAVVYMSFSGDTDAGSNWRSTGLGLEILWLQFRHGISGMFSCPLRATSYFTGPSKTSRSVKPQFGINPGLLPSGVPKRVRVVYTTIGFNFYVTSKPPAVVLMKRLHGSSPPPSSQRASEFGLCQRELNIFLFRTSPILILPV

SEQ ID NO: 984752 - protein, 85 aa, Homo sapiens
LEDPPVGITEDGDVQFHLLPVLEEGRRMNRDGYTNCKLSAKEKKDSLFKPNEQFPGGGSRQLKQYGALPCVGTLCELRKVRTHET

SEQ ID NO: 984753 - protein, 56 aa, Homo sapiens
VLRHTRWHYFWAWAVLCGSALAPENPQRDVAPETDGEVAEATREGKYEHVALDLFS

SEQ ID NO: 984754 - protein, 77 aa, Homo sapiens
NDGPRAWIEKLKPNNINFKMKPGFHLGALVQDTYYKSSSMAGHSGSCPDLWEGEVGGSLEVKKFETSLANMVKPHLY

SEQ ID NO: 984755 - protein, 71 aa, Homo sapiens
QRWSLSFTSSWDYRHAAPCPANFVFSVETGFHHVGQDGLDLLSSGDRLARAPKVVGLQAIDTGPRRDLCII

SEQ ID NO: 984756 - protein, 67 aa, Homo sapiens
GGCSEDPSRLYFLNAYFLNALYFLNALYFLNALYFLNALYFLNALYFREFKYNIKYAWKYKALRGTE

SEQ ID NO: 984757 - protein, 50 aa, Homo sapiens
MVLSYSSKEIKIIKRKQLDAVIKRDQQKIKEIQLKTGQEEGLKPKAEDLV

SEQ ID NO: 984758 - protein, 128 aa, Homo sapiens
MVRQLHLSCCKLQQDPPSSSGTGSASVCNHLITITSNSCVLKQSSLPHPPKIAVGYVTRPPHLARFFTYFVERGLNAGPPLCGFCIVASTNRVSNIFRKENDTLCLYCTCRLYSLAIVPSNTYHIKHY

SEQ ID NO: 984759 - protein, 86 aa, Homo sapiens
MGRIYKIIRATYGKLTANIILNGQKLEAFPLKTGTRQGCPLSPLLFNIVGEDLARAIRQEKEIKGIQLGKEEVKLSLFADDMTVYL

SEQ ID NO: 984760 - protein, 65 aa, Homo sapiens
MHRTTAMKMSFQLFCCCTIVHIANINGTGISLHLCSSMDMITGPALPGGGLLFICFSTSYCTSFS

SEQ ID NO: 984761 - protein, 76 aa, Homo sapiens
QRWSYSWSSLEHSSDEMQLMKVCVMFFRGSDTREYHRDQPSLSKCSQKYGSATESVSSIGVLALKFIQHKGYSRAR

SEQ ID NO: 984762 - protein, 30 aa, Homo sapiens
MQVTADLDGGAAEATYQVTPCMLSLLPFGP

SEQ ID NO: 984763 - protein, 119 aa, Homo sapiens
MVLMLFRSLALQVLGSLDSVSRIAGFLVVCSKPKCFFSPLSTVPGRTSLVSLLSCFQMVFFFFFLEKVSLWSPRRECRGAISAHGNLRLTGGSDSPASASRVAGTTGVCHHTQLIFYFK

SEQ ID NO: 984764 - protein, 66 aa, Homo sapiens
NDGPQLPRSRITGARHYAQLIFFGIISRDGFTMLARLGMMACACNIPATWEAEAGESLEPRRWRLQ

SEQ ID NO: 984765 - protein, 50 aa, Homo sapiens
DLEDPPGGASRPAFWLRKQKAYFNHLIRVSRSFKCWFLFHIFWQGVYQIS

SEQ ID NO: 984766 - protein, 96 aa, Homo sapiens
MWGITATETPHTIRSSWTSSITTKKTISYSSFQLHFFNHDHREPLTQYSQLNFLDHRHQVHHTQSSKLHFCNHHHREHLTQYSHFHFFNGHHGEHI

SEQ ID NO: 984767 - protein, 37 aa, Homo sapiens
MVLSSAREVMALALRGAPKCRIYSQDTCVRQQLDKIN

SEQ ID NO: 984768 - protein, 49 aa, Homo sapiens
SDQRIRHVGLTGLNILTEQSICLSLPSSWDHKHVPPHRANLVFLIETEL

SEQ ID NO: 984769 - protein, 39 aa, Homo sapiens
TSSEATAQNFVKEQGGEYRYFKKVLNGKPLYVITYGNFA

SEQ ID NO: 984770 - protein, 172 aa, Homo sapiens
MVNCTNESVSRMFHVGVVYQLELGMAHVNKKCCCYELSPEAQRVYNFDVRQLNWLESIENYVLGVKNILIDKRLWLGSQTANATLTKAPKYSLPLYYCPLPYRLPPSPLARSQMPRNVRYFMCTLLSYTSSPTLHALQHAQSFKSIEPIALYIWNLSRYPSQTTQTVIPNAC

SEQ ID NO: 984771 - protein, 44 aa, Homo sapiens
MFSMAGAALFLPFLPLLPAQLLLNTLLYDLSQLAIPKDYVGVPS

SEQ ID NO: 984772 - protein, 44 aa, Homo sapiens
KITQFGRILNELKIDIIFANSPQAKGRVERANRTLQDRLIKEMR

SEQ ID NO: 984773 - protein, 56 aa, Homo sapiens
RDGLIPYHGETFLLGEECLPIAQCRAQWLMPVIPALWEAKTGGSRGQEIETILPNM

SEQ ID NO: 984774 - protein, 41 aa, Homo sapiens
MSGIFAIDGAYCHVGRHFLIGLEMLHVQANKKVGQKWGYRA

SEQ ID NO: 984775 - protein, 40 aa, Homo sapiens
NDGPQLLIRQDRCRTVATPGFESPLLPRGFRGSDFNASEI

SEQ ID NO: 984776 - protein, 101 aa, Homo sapiens
LDLIVIRWRVVLGIVCCREIAHSTFAVLALSLFPRDPFWLLESSHPPPFYLILPLRESLGTPRRESGGGPNMNLDYCFLMMYRKSKGIYYVQLEDDKPWKV

SEQ ID NO: 984777 - protein, 134 aa, Homo sapiens
SYIRKRIPPDSETSNLIRIERAHRGAERQARVLEYASRLDNERTKDLIIEARFHRTIIGAEGGTDSVKFVNKITQRSYINFPDPAQKSAIVQLRGPKNEVEKCTKYMQKMVADLVENSYTISSPIIKQFTRISL

SEQ ID NO: 984778 - protein, 102 aa, Homo sapiens
MQLTIESRVHVAEGKEVLLLVHNLPQHLYGYSWYKGERVDGNRQIIGYVIGTQQATPGTAYSGREIIYPNASLLIQNIIQNDTGFYTLHVIKSDLVNEEATW

SEQ ID NO: 984779 - protein, 33 aa, Homo sapiens
STLYTFLQRLTFSTLYTSSNAFIHSVNRSYTIR

SEQ ID NO: 984780 - protein, 51 aa, Homo sapiens
HAYTSIPPSATEEDRFSLEALQTIHKQMDDDKDGGIEVEKVMNSSDEEGTE

SEQ ID NO: 984781 - protein, 82 aa, Homo sapiens
SDTCIRLWALPGLSVPTSSSSSFKQKSSGRGLLASGSEASISLSGLAILAAALCDGPICFMFSKLRFKNGGPVWAHQCCSVC

SEQ ID NO: 984782 - protein, 76 aa, Homo sapiens
MRTDQDKTLKEVFTKEVPPLSQLSKLIAWLLQFYGYLSCTGTCLLTLPLFLVPDLTGSCSFFTEDYPSSPLFDYPE

SEQ ID NO: 984783 - protein, 82 aa, Homo sapiens
MVMARRWVATGDQARADKLSEHSEVNPSVELSPTRSWSSGTVSLDQPSDSLDSTWDGVTDGPQPTALKETLPEGPRHHLLSP

SEQ ID NO: 984784 - protein, 52 aa, Homo sapiens
ERIPCLAREESPVKSTITGYYINSKWERKEFRDAVIDISSPHNCFNKAGKVV

SEQ ID NO: 984785 - protein, 107 aa, Homo sapiens
FRVVHPEYTDYGDSSSTPTYFTSSTATFLETTTLTPTTDISTESFMTPMISTTPITSSMTLRNTMTSMTTAASRPTTTNTLSSLTSSILSSTPVPSTEVITSQTTNP

SEQ ID NO: 984786 - protein, 112 aa, Homo sapiens
SRTQFCFLKDPYLSLDTAAVVTFWDSQPGSEQLGLIYLLCTKPVKAYDRNVPVRLYSSGGSGEKGLMRGDALFSSGNAGLIPNSLSCCLLSNDRVTQIITKVDGLGFKKQEL

SEQ ID NO: 984787 - protein, 44 aa, Homo sapiens
LLLKLYQQPQPINFNTTIGAKPTASTAASTTTTTAGTGFKKQEL

SEQ ID NO: 984788 - protein, 111 aa, Homo sapiens
MPQIYWWPLSNVAAQYAHGLLSQRGPNVGHCSSYRAFGSLRQKVGTFTFSEVPGFFRGNTEKIIPEVLSAFQMELSSFTPVLTFLLRTLRRCQTGLHMLIGYSQHILCCLI

SEQ ID NO: 984789 - protein, 77 aa, Homo sapiens
RDPAMRYWDQEIVGDLGLSFTSYANEDGSLEWATCTLEASDATFLVLRAAMAVLQDTQWDEGLCRQTGATAGEPKNF

SEQ ID NO: 984790 - protein, 102 aa, Homo sapiens
KLGNTRGEIYSSPGIINNLFLFLKSLGLLELIGKGTGLELGARVNWGGLSIHQFPDWSREYFKEKIGFLNPKNFSSTKDNQGCLLICKPIYLKARGGGGQFT

SEQ ID NO: 984791 - protein, 102 aa, Homo sapiens
ESTRGSPMWASRCQHNSGHIHGLRLSSGLRVKTKSGTPRKNGQISRTKTPGLHWSRRVNEVTIFWLFNQQVVIKHSCDLVSSGHFPSTAAKIKMSVQKREEE

SEQ ID NO: 984792 - protein, 46 aa, Homo sapiens
MPGMSGTCSVHLLVVHRGVAQCHLCSCAHCVLAEAINCPPGQHGTL

SEQ ID NO: 984793 - protein, 37 aa, Homo sapiens
GQLVVPVFQQQATQQQWQPPTAVGVQVQQGIQPHWHP

SEQ ID NO: 984794 - protein, 77 aa, Homo sapiens
MHGQAGLQLLASGNPPALASQSAGITGMRHQARASSCQQLLDQEASDGSYEVLCADSVDPVASVRHRLHLGPREEPH

SEQ ID NO: 984795 - protein, 50 aa, Homo sapiens
MTMMKPAAPSMGLCALASSKIRSPCSLQMNWPDNCDHRQVVSIHVDWAKS

SEQ ID NO: 984796 - protein, 33 aa, Homo sapiens
RGLSQVYGELADVEEGVHGMATPGSRTSSLLAI

SEQ ID NO: 984797 - protein, 53 aa, Homo sapiens
FDTGFHSYAPDGEHGVWLTGSLGRRGHSRCARRLVLVLLVKFGYVYPGYSVNS

SEQ ID NO: 984798 - protein, 87 aa, Homo sapiens
QMNIVHPVSTRSCFIMSRVMTTAQKQVLLTYVTVGNAYSSEAIKKYHLRPGMVAHACNPALWEAEAGGSRGQEIKTILTNMVKRRLY

SEQ ID NO: 984799 - protein, 35 aa, Homo sapiens
MNVQNDKGGGAIPGEWLYPQNTGRARPEQNSLPFT

SEQ ID NO: 984800 - protein, 46 aa, Homo sapiens
FTWRPLYGLQSTALGTVHQLQCIQVCCELSDCGFSWQMTLPFHVQP

SEQ ID NO: 984801 - protein, 48 aa, Homo sapiens
ATERDISARGIDKHRWYRWDLVVIVATSRCTSSSKVKSAEPDRGKSFR

SEQ ID NO: 984802 - protein, 38 aa, Homo sapiens
EQACDFLLPPSSLLWSQDHHLSNRIIAVTYPFSCLSSL

SEQ ID NO: 984803 - protein, 68 aa, Homo sapiens
GGGCCCGRLCSIPCHRSTRSSSHSLARLYTAIFSKPCMQGYHSKRQYPVKTLGPGVAHAGGIDHTGYR

SEQ ID NO: 984804 - protein, 43 aa, Homo sapiens
PRAYISLLFCLANSNYERTHSGFDQYRADLARFRTHCCTCLLC

SEQ ID NO: 984805 - protein, 36 aa, Homo sapiens
IDATIDKTEILSRLVNADDIHESSRVGYISSVASIN

SEQ ID NO: 984806 - protein, 114 aa, Homo sapiens
RDVLSPVIDSARICRSSAGASPLGSSIPGKSHGHQTGSLISPLPPGGHKIRAESRIRQIESTILKLLAGPSQGLASMLTTPSKMASPSIFQAGFFRVLWTLIVLRAAAYKRDYS

SEQ ID NO: 984807 - protein, 44 aa, Homo sapiens
RNDVVKKRFFRRLSAFRYSRTIVSSGSVSVSDPQCSLSQQFMSY

SEQ ID NO: 984808 - protein, 74 aa, Homo sapiens
PCILQHCTQAILDVELMPLLLAARSLESPIHSVGAKAGLHDQAKSDAFSVVVRYFTVRGVNITPIVLPGTPTDI

SEQ ID NO: 984809 - protein, 103 aa, Homo sapiens
SLAVKSVDDCGDPGATGTRHRARPQASVGQQTQPLPPAPPQTDQLSVQQQAAQTTRLGSTSEPWQWVRTYIGVDGNGVGQSSGWLWIYSFRTPPSVGQAPVHY

SEQ ID NO: 984810 - protein, 43 aa, Homo sapiens
DRCLCSSSEAGDELVLIASTSLLVLPMTALCVSGVGEARRKPG

SEQ ID NO: 984811 - protein, 34 aa, Homo sapiens
LLNVYDKNGDGFVDQDEYIADMFSHEENGITRSR

SEQ ID NO: 984812 - protein, 143 aa, Homo sapiens
LANCVIRGTRNSATVQIMTYECFITGPGFAAPWSWRVSSRSFFSFLGEASDGARDVWRAYSDMREANYIGSDKYFHARGNYDAAKRGPGGAWAAEVISDARENIQRFFGHGAEDSLADQAANEWGRSGKDPNHFRPAGLPEKY

SEQ ID NO: 984813 - protein, 40 aa, Homo sapiens
RERVSADKVVIEACDELGIILAHTNLRLYLVLELMDNTFA

SEQ ID NO: 984814 - protein, 86 aa, Homo sapiens
RERYPENLTGTINESGYNKQQILNVDKTAFYWKKMPSRTFKAQEKSSLASKLQGLTLIDNLKNARALKNYAKSTCLCSINETTKPT

SEQ ID NO: 984815 - protein, 123 aa, Homo sapiens
MLSTRETRLSRGDIVRSDQKTRVRAFCYARTGPPEGSLVYAVMPASGKTPVTKRIVVQQQQKVSRNNTRYLADRESRRRGGGLSPGEFREDSAPPPLVEGLTSVRLARSYPEAYTVSLWITRS

SEQ ID NO: 984816 - protein, 88 aa, Homo sapiens
FRFVHPMTISQQEFGRTGLPDLSSMTEEEQIAYRMTNVPAWKQSGQAESADHGVPATAIGHILSQPRRMDDYDCVCRTPDVPSDVSLE

SEQ ID NO: 984817 - protein, 95 aa, Homo sapiens
IQPRTDYSEHWTECTLGVEGPALYFHGDEMVFGVRQVAGCAVNVYQQAGHSGVRAQKVVDTPICMHSLAAHQALEEVLTSLSTSKGYSQRSGQAS

SEQ ID NO: 984818 - protein, 38 aa, Homo sapiens
CIPPPRVSLLSPVLSTDNNLFSETGHMLKKLEVSCLNV

SEQ ID NO: 984819 - protein, 30 aa, Homo sapiens
MVDNEASIHLRRNLDIEAPPTYTNLNRLIS

SEQ ID NO: 984820 - protein, 127 aa, Homo sapiens
NAPPDGVGRAERYRVKAMEAEDETSRPWGLQEALTTPLRPELSAPLPDTASRALLSSNMAKIFSPTETERCIESPIAVFQKYAGKDVYNYTLCKTEVLSFMNTELAAFTKNQKDLGVLDRMMKETGH

SEQ ID NO: 984821 - protein, 82 aa, Homo sapiens
GYGREDTRSLDDERETKAETWTLVLPVAGLNKVLKISLCAREYISGLESLGGQNRITRNKYNDHSGIRVLYLVHAHINSHTF

SEQ ID NO: 984822 - protein, 52 aa, Homo sapiens
QVEYAECDPRHVEPPKYLGLKDAIPHRAVCLFGFRFFVEMESHYVAQACLKL

SEQ ID NO: 984823 - protein, 106 aa, Homo sapiens
GGACNRDRLVNTREPGSHEPRKRSCEVRCTQSTKPVTLTVEPRRLVSERITEDYYFHLIADTLPVATRLALYSTRDSDDKKKEKDVQFEHGYRIGFTDVNKIYLHT

SEQ ID NO: 984824 - protein, 33 aa, Homo sapiens
MLTPGLVNFVPATAVTGLTHVNRSRRKECYKIT

SEQ ID NO: 984825 - protein, 68 aa, Homo sapiens
TKGGYRIRRERVGEPNGGVYSTNEQERWKRVYRIITAHELEVLGTAQSLLITNRAGASHGNLSRYDHI

SEQ ID NO: 984826 - protein, 34 aa, Homo sapiens
NPTPPAHTAKTIGQAQEGERKQCPFRAADGASLS

SEQ ID NO: 984827 - protein, 102 aa, Homo sapiens
MVVILAHCNLCLPDSSNSPASAPWVAGTTGFVPPCLANLRIIMGDRVSPCFGQAGLELLSSSIPPALDSQSAGIRGMSQCAKPIKVIRYPPCIFTQVVWDQE

SEQ ID NO: 984828 - protein, 36 aa, Homo sapiens
LLRIPNVAGGEHPEETLEEEARPRGPDPGDEAEALT

SEQ ID NO: 984829 - protein, 37 aa, Homo sapiens
AARRLDVRQGSMLLNKLGARGVTRCVLQCLMSSENHE

SEQ ID NO: 984830 - protein, 74 aa, Homo sapiens
SRGSLGEDRIGGPPRILSNWTMEKVRREGVKVMPNAIVQSVGVSSGKLLIKLNRRQRRKTDHICGSLWACEPKC

SEQ ID NO: 984831 - protein, 81 aa, Homo sapiens
LGVSRGSLRRKTVFGFKQVKKRCIWLGTICRYGFAADGVCWEAVQSSGGCGVGASAGWVLQGCSEEQLLFLAPVNVSTPHS

SEQ ID NO: 984832 - protein, 50 aa, Homo sapiens
MPVPFLGEKAMRLVSSFSLSTSRVLNKMVGLGSLLVSIVFLIVVILLLAF

SEQ ID NO: 984833 - protein, 106 aa, Homo sapiens
SAHSAAALLYSLTHCEAADLVPFQAVRRVTHTRRLRPQRCTCGKHRGLHLDIADAGCIGCLQIRLLVLLRVGAESPIQTALPFIEVQGCHLLFPTAVVNSLSRLAK

SEQ ID NO: 984834 - protein, 73 aa, Homo sapiens
MKVVQMNHNEDGWDTSKCCAQRGIAAPGEHPAFHTEISAQESELPPQETRKRSEVNPQTQGSIPGKGPARLQT

SEQ ID NO: 984835 - protein, 49 aa, Homo sapiens
QTGSFIPTIPSFPTCISRCEPFNGHALAPSTASLPIHNGEGEKRRERPC

SEQ ID NO: 984836 - protein, 146 aa, Homo sapiens
ARYPSRFSLPGCSARAYSAHCNLRLPGSSNSPASASRVAGTTGAHHQARLIFLFLVETGFHCVGRAGLELLTSGDLPPSGSQSAGITGVSHRAWLPGIFLSENPFLLDLTPLFACEFEHLPPRGFVLGTQGGEMCVSEYWNEKRRR

SEQ ID NO: 984837 - protein, 63 aa, Homo sapiens
PFALSFSLSSRSRCSGTSSNILLVVPVFPLHSKRVAFSGSRTRSFKAALLLMEDGLRVPVICP

SEQ ID NO: 984838 - protein, 99 aa, Homo sapiens
KTVDERGPLPLSSALVSVCAPQTHTHTHIFSLSLMHTSIHIPTIAGAKFGHNPVDSFPWLRVEVRGKEASNNMKTAAGTCSDALSSSTEEAGKRGISRV

SEQ ID NO: 984839 - protein, 105 aa, Homo sapiens
MGTEQQTAPNYSEAGGSLGAEQSVEKPVSSILSQNPSSRQRASKLRAPSSRSLHSRYRTILLAHMYTRGKGTPTIPRTVTNTLARCLTSWHLTNCSAKVVCSFRP

SEQ ID NO: 984840 - protein, 41 aa, Homo sapiens
MECKLEREREKTLETDSGVKWRTQMGLQTMPPTLRCPSPPP

SEQ ID NO: 984841 - protein, 111 aa, Homo sapiens
LTELQSLGSNDPPHSTSQVAETTGAWHQAWPIFVFLVEMEFHHVAQAGLKLSASSNPPACGSQSAGITGVSHCTQLDILLLSSGKGTFLESITFILCKTVRSNYHLGFQNA

SEQ ID NO: 984842 - protein, 46 aa, Homo sapiens
RRAYHCMETQVLSNHSVDLQAVGLEDYGKQGDYIPRQVRTWVKQYR

SEQ ID NO: 984843 - protein, 131 aa, Homo sapiens
MFLDFTTKSKPIFAVNYIIYSHKIIHVQGAYNYQAKGLVPYLVFLYSTKFDIHTFSSVLMQSIRYSNKSIIFEHPTVFRMPHLDPVLPLVPGKFVLVHHSLRDPALRAEVPRLVHFFVVVPNLAARVGSQS

SEQ ID NO: 984844 - protein, 65 aa, Homo sapiens
RFWSFQARSILPDDEDQNPKIENHLLSSSDCRQVVFMAPRELNHERHEQPGASFIPETVTNRQCL

SEQ ID NO: 984845 - protein, 190 aa, Homo sapiens
RAVRKLTAECCSSMRGKGTQPGSHSGVIAASLCSGLCSFRLLPCPLWASVSPSEQREQPHPFTHWKPSPSSAWEGVVLSLGIPGIPQAGVNPEALGPGLYPVTAPGGYDAPVLQASPTDSPGQVACGWTSLCLAALCNQFMQGPAARLHKGRPGQRPAGEGELFKGAASPAAPSTGPGAESIGELGTPPS

SEQ ID NO: 984846 - protein, 39 aa, Homo sapiens
LSLTRFNKFTPSVTSGVSWMVSFVAKVGLKGPLGLKGPL

SEQ ID NO: 984847 - protein, 139 aa, Homo sapiens
MRIRTLTVELHLILMDVAEACVTLPIRHYLQVLVHNLWCRADVGPVQNEVPQLSSTCGGLSRVTAVITTILIQAYLLRGTIGLVAENSVVHHAEKLACLSQASTKTEGLPPFCSLISFSANIAVVSGTFCGSAPQTEED

SEQ ID NO: 984848 - protein, 113 aa, Homo sapiens
MKAERGVEAAEEKLKLSRGWFMRFKERSHFHNIKAQGEAASADVEAAASYPEALAKIIDEGGYTKQQIFNVDETAFYWKKMPSRTFIAREEKSVPGFKASKDRLTLLLGANAA

SEQ ID NO: 984849 - protein, 115 aa, Homo sapiens
RGGGGKKQNRNSHRIDKNTPTGYQNLQHLTIKQKEKAEAVSIDINCTSITKTPVSKSQLLIAFHSVHRLSFRDSLDYFPFTQTNLPVFSPGPAAASLVWSSLSECHKAGDRRGWR

SEQ ID NO: 984850 - protein, 44 aa, Homo sapiens
MLYSDLQFGKMSSMDQLHVIQVYTTTTMTPPTTYNTATPSSLHC

SEQ ID NO: 984851 - protein, 43 aa, Homo sapiens
MSGYPRSEPGVNIAASCDCAMVFQPGVTEQDPISKNKQAKGPL

SEQ ID NO: 984852 - protein, 93 aa, Homo sapiens
MCIAVSNDIESDWVSEDACQSCLVEIIPGTWDNWIHPVSRHYQSVNFRLAKAWSQSVCSAPTAACPGLPPDTCLVEFSRWQPKSLRNEGHQQP

SEQ ID NO: 984853 - protein, 42 aa, Homo sapiens
ESGDGIGPTDIGGGNLKRQGGMAERMEAFLNAPEATEALGVQ

SEQ ID NO: 984854 - protein, 42 aa, Homo sapiens
TPILRIPSDGMNIDPIPWMEKKGGQPCSSLMSAQGWEQYSED

SEQ ID NO: 984855 - protein, 34 aa, Homo sapiens
TLRIPEILNRGPGNFSYRIFETSSSEELLSLENG

SEQ ID NO: 984856 - protein, 33 aa, Homo sapiens
SEDPESGDGICAVIEGHFMQRMGPGRPIPYYCT

SEQ ID NO: 984857 - protein, 41 aa, Homo sapiens
KAKPRLCLYDNQSREVIETYLSILGKNNPVDKEKEICLLAT

SEQ ID NO: 984858 - protein, 35 aa, Homo sapiens
MLRIRVRGLGYTFIDPPYGISNLWKALNLQRWSRV

SEQ ID NO: 984859 - protein, 67 aa, Homo sapiens
ADIHHMMHHHHGTSDWQTPGARTESHLAEILAKAKESGEGAEGEGSERDLMGQIIPIYGYGIFLYIV

SEQ ID NO: 984860 - protein, 33 aa, Homo sapiens
TSRTLHRENGGKTTSLAKKVVLEPKMNAESLHA

SEQ ID NO: 984861 - protein, 118 aa, Homo sapiens
SLSHKPNSLHSMKAEESVEAAEEKFEASRGWFMRFKERSHFHNIKAQGEAASADVEAAASYPEALAKIIDEGGYTKQQIFNVDETAFYWKKMPSRTFIAREEKSVPGFKASKDRLTLL

SEQ ID NO: 984862 - protein, 100 aa, Homo sapiens
MSVRSGGALPGSQGASLGEGVLGIENSLGSNASVRVSSHFPGVYVWPSLHFPANSLWRYVGLHWVDQGGEGGWPRGATMAGETVNPCGPGGPWGCQETLE

SEQ ID NO: 984863 - protein, 38 aa, Homo sapiens
YRIPLAKRTLTTSFASFIAEAAVSSSQQIQAARRLIVG

SEQ ID NO: 984864 - protein, 41 aa, Homo sapiens
LKIINLYNLSVALKSAVDLLRSWGRIHLVSYKDAQYLQQTC

SEQ ID NO: 984865 - protein, 45 aa, Homo sapiens
RPHCCINQGVNENSLSDHQTRYSTRAKPIKYSLIVHYKPVYEDIK

SEQ ID NO: 984866 - protein, 34 aa, Homo sapiens
VLLHASSASQALAPLCSYAGPHDSTSGSFSSSSS

SEQ ID NO: 984867 - protein, 96 aa, Homo sapiens
RISRLLQDLPEIAVAIHQALEGAYLIGHAESGSDDNTGKVPYIVIDKSHESYQAPSNTFLLEKTAQMLCMIHRIYDKANQGHHERDSEYGKITKKR

SEQ ID NO: 984868 - protein, 101 aa, Homo sapiens
AQKLNSRTDAGDEIEKAPKARIGELDGKKYLCSHSDLTVGQFYFLIRQAEFISELEDALYILVNNVIPPTSATIGVMLYQEHHEEDFFLYIAYSDESVYGL

SEQ ID NO: 984869 - protein, 89 aa, Homo sapiens
YMERELGLQRGLGEILGLGLAWPLRGTAEPLDTGTSTLPKLGVGNVGKSIELAADTLWNLGLNLLGLYEGLDGLGTCTHGLGMVGLHLL

SEQ ID NO: 984870 - protein, 44 aa, Homo sapiens
EKWHDAGLSGVVMDDMLSAFSLMPVGHLVRGTVRDKALGDLQTM

SEQ ID NO: 984871 - protein, 32 aa, Homo sapiens
NYKLKHGPRIHSDRQAMHVPRVMTRTDMWQDT

SEQ ID NO: 984872 - protein, 48 aa, Homo sapiens
MKPWNGVWSQDLISLPETPGRPPCCGSLVQIRMPREHLLQRELHQHEM

SEQ ID NO: 984873 - protein, 183 aa, Homo sapiens
IFLCLSCFVVRVSPASVSRPAWVGLWVFDDPKIESVFALQELLLVALLAVSMPQNEYIELHRKRYGYRWHYHEKKRKTASREAHERSKKAKKMIGLKAKLYQENSVMVRKNTNDTDYHDACKENTKQKTAEKTPQGAVPAYLLDRRGTISSYSTFQYDLTEKKREGGKLGSPSAFKYVPNEKR

SEQ ID NO: 984874 - protein, 52 aa, Homo sapiens
AALLPSMKQIHVVRGDDDELQSDDIGDDDEDIDDIKLELNILHSILSEAVPC

SEQ ID NO: 984875 - protein, 87 aa, Homo sapiens
CTPCALPLNTLVAGANCGYVSKSLGSAKRNLELLTRNFPRIALITRTKDNQGYTQACTGYLPSDGLSQPPTGLATVLSSSTDVCSSS

SEQ ID NO: 984876 - protein, 69 aa, Homo sapiens
YSNNALSSAAFSDVHSAFRERKNTVDSPSNGCSAACNGAISVRPTTPYGWVGISYNVLYLDANSPGSCD

SEQ ID NO: 984877 - protein, 50 aa, Homo sapiens
CPTPGHPENMLRPYRHGRPAAQKLGSVTSQHYNGSNVACNCGGYVSTTAL

SEQ ID NO: 984878 - protein, 49 aa, Homo sapiens
RGHVPTAVCISALPQMQVKTITQWSKDRQKEKYLELLSSGMVDNMTKTC

SEQ ID NO: 984879 - protein, 53 aa, Homo sapiens
KELTVNHVMWTIAPDDIYTLLKYVMVPGLQTCSSTSVPRKAVVQPGIYLMYAS

SEQ ID NO: 984880 - protein, 100 aa, Homo sapiens
RGPCYVVVWSSVYSRAGSPPGNTNAFISSWLCEWLLPPIRQYPMPWDSGGSGIPAIGFILSPYLSSITRGYNKREDYTIIRLWFLTQKLRLGTVAYAQVC

SEQ ID NO: 984881 - protein, 99 aa, Homo sapiens
SSPGYRESPHEVYQQDLRDQSDLGVSGTGQTQGCSQCHGGNWTYLKVTSLIISVPQDIAENHEEAKEPLKTHNRCQKVQSPEAKCALWTSFGYGLGTCF

SEQ ID NO: 984882 - protein, 36 aa, Homo sapiens
LGVYTELVATEAPQCSGKKQWRDKLGPQPRKHEVWQ

SEQ ID NO: 984883 - protein, 69 aa, Homo sapiens
RLSSSLRSLVRAPAVLRKLGSEVVCPSCAEVLDFFLQTEDLFHLLIFLLSLQYTGQYSFLRALRQGFEF

SEQ ID NO: 984884 - protein, 87 aa, Homo sapiens
LTPGYRAGSADGHQANMFCSWYLRRLAQWGQPFFATAWQLWWKTVLHSAHLTVVSKLKGEDDVVVLADLADEAALCAQVAVVDMLVG

SEQ ID NO: 984885 - protein, 37 aa, Homo sapiens
AADNSTYVHVDVKANKHQLNRLVLELLRKELGSQVNT

SEQ ID NO: 984886 - protein, 44 aa, Homo sapiens
MDMASVALGLLWTGPPLVASAVFCAFRGCGLSGLCLRWLLVQWS

SEQ ID NO: 984887 - protein, 57 aa, Homo sapiens
RIPLLAQSIDTFPEATKPGFPGLGRDMRSSTRLLPTLPAKGGFQCSHCSPDYLVSTR

SEQ ID NO: 984888 - protein, 36 aa, Homo sapiens
PGGAQKLGWVTVSTHTAPGHGQQLSAPVEGLIEVAL

SEQ ID NO: 984889 - protein, 34 aa, Homo sapiens
DTTQEDSSNRGLERPCGSPEKGPSDLSSPSSLGH

SEQ ID NO: 984890 - protein, 51 aa, Homo sapiens
RQAVLSHEHQCSGYGWKHCTQSTSVRQTHWSTVPRATVYSRCREHCPQSTS

SEQ ID NO: 984891 - protein, 102 aa, Homo sapiens
EHLYVHNSPRHCGGGAKPFPGYSDLPFEQSGHWVQQAVPRSRLNHRIQPTICPHSITRPSNPCSLDSSLLSLRIRPQWPISLHPGKEPPHKAHGVRSSEFGN

SEQ ID NO: 984892 - protein, 82 aa, Homo sapiens
PEQKQSCPRHHAVVLIALPSRTHPLHHRRGHDPSLTIESICPPFGTEPNDVPLTTGEHKSSTPEHTPMVWQGTPSRSRPCKA

SEQ ID NO: 984893 - protein, 87 aa, Homo sapiens
MINPYSINPLSLRRPAPVNRLFAQIGPFIRRISQKTISLHSFPTHSISHPSHPSLLSLGGFLLRSLDLCSALHMLWSLGPSRFTNRS

SEQ ID NO: 984894 - protein, 109 aa, Homo sapiens
ASWITRLCSRIQAILLPQLPSSWDYRRPPPHLANFVFLVETGFHHVGQAGLKLLASSGPPTSGSQCARITGMSHCAWPYLYYLNFIRPGKHAYLGVCPFPNTHNKTNYY

SEQ ID NO: 984895 - protein, 56 aa, Homo sapiens
RQEVTATDELLITPLHSSLGEQQDPDSVAKKKNERQEEMQDRRTLQHGHFYIRPGK

SEQ ID NO: 984896 - protein, 52 aa, Homo sapiens
NLGPTLPSLTAALFKDSISSSHLTHILSVPGLLHLYSLFVESPTITIVPGPD

SEQ ID NO: 984897 - protein, 37 aa, Homo sapiens
VAGNGRHSPSAGHLRTVSVCCPRVTSCPPDLPLTTPE

SEQ ID NO: 984898 - protein, 141 aa, Homo sapiens
IADIIKNTSEEVGGPVACRRQIRHPVKLQTSGARAREHLSKANADDRRRADQAHTRNDEVCIEFSFTSGTTLAVNHLLTRSPFLCSDKVASAIGKPDATDQDSQENQGYKDGCHDDPHIRSTASMRTAFEVNGCPIPIPCP

SEQ ID NO: 984899 - protein, 76 aa, Homo sapiens
EKAEGARGTRRCRFCASQSAGIIGMSQHDPAWMPVLYQICVSHICPPRFVAACFLFLVPGCSLLDEFGPVILLGAL

SEQ ID NO: 984900 - protein, 102 aa, Homo sapiens
TIQLVGPDQSPNAHRCGLCHITALSWSQMLSFFAIANPPQSSHGLQASGTTGSLSDRRNPKARVVPEPAVRPHTPQVGQCIPPIPIRTTHTPPIKKTSYQSP

SEQ ID NO: 984901 - protein, 41 aa, Homo sapiens
LEDPGRSERKAVREGRFAGFVPFSKDNKESFPNSQLNPFWN

SEQ ID NO: 984902 - protein, 53 aa, Homo sapiens
APASYKMPAPPLPLLSRGWRESHKHYEVPVLNKGGGCLSLKEEEVKKGGSPSL

SEQ ID NO: 984903 - protein, 155 aa, Homo sapiens
YGVLTGDARWVFFVPVALVSDNLVLWCNGLAWDSGVENDDLCNADSLEFVVGEESRSALGTELDDRRLSSLAFWVSSLLSPRAALPDAVSSLLFSLLSYILRITEVGVKEGESMLVMEAAGAGEEEFPRCTGAGDFGTRCCLYLNPSLVLSSFGL

SEQ ID NO: 984904 - protein, 42 aa, Homo sapiens
LEDPGRSEMEQYYCAPGRRGCSEPATLLPPLQNQQFFSNPPK

SEQ ID NO: 984905 - protein, 35 aa, Homo sapiens
LNPRIRGHSFVLLVCLAFSTFESLSLSSSGIVTLM

SEQ ID NO: 984906 - protein, 35 aa, Homo sapiens
MVSAVLSGRRYMDGARSCPASVLQALKPSFTEPCP

SEQ ID NO: 984907 - protein, 34 aa, Homo sapiens
MILERLLLKEAVHLAETTGSLVRLGGSALGWLPS

SEQ ID NO: 984908 - protein, 89 aa, Homo sapiens
MVQAVASMLARAAVCDAVAAAGADLGGRSKYSNETFEGLKGRRCPIVNMQVEHVVKSALRDGRSAVPNGRGDAILVAIGLIERESGSRS

SEQ ID NO: 984909 - protein, 38 aa, Homo sapiens
GSIDSCQKKAQNIMESFENPFRMFLPSLGHRVSRLSGQ

SEQ ID NO: 984910 - protein, 33 aa, Homo sapiens
QSWTSHTLDPSSLHIPFPQPPQQSYYPQQLICL

SEQ ID NO: 984911 - protein, 70 aa, Homo sapiens
MPLANSGRTRQTVEQAGVRSCPCSEILPTAVISCLTCVASFFHPSPEVALSFTRVSDVSDLPLNLYFYSL

SEQ ID NO: 984912 - protein, 37 aa, Homo sapiens
MRSDTLWRIQMELQFEESSDVISFHCLGYNTESEEAE

SEQ ID NO: 984913 - protein, 41 aa, Homo sapiens
MYARTSLPPDSQCSLTSTHTISASSLFFILKPDGLRTSPGG

SEQ ID NO: 984914 - protein, 35 aa, Homo sapiens
HHSLAFRVGMFALEHREVKITLAIHERQHQADCHS

SEQ ID NO: 984915 - protein, 89 aa, Homo sapiens
FYTDPPRILVQYFGLQNKVSFQTSAATIIIHYFFGDRVSLCSPMLKCSAIIFVHYNASISWVQVILLPQPPELLGLQARTNMPGSFLYL

SEQ ID NO: 984916 - protein, 37 aa, Homo sapiens
LKAPPKHTQVQIPHNTLSLSEPPFCSSFSCSILEDYT

SEQ ID NO: 984917 - protein, 100 aa, Homo sapiens
AAVVCLGIHSSMVEVIIDDRLECTGAISAHCNLRFPVFKLILLPQSPEEPGLQAPATTPRDFRDEPGMMWDTEHVGRVLVQHIEMTGITLSFHRYAQVGR

SEQ ID NO: 984918 - protein, 144 aa, Homo sapiens
RIELCTCIPGHTRRAYGRQGWVWVHTKASTIWDWHTWQSQCMGVCAALPREKTCQNFPYEYIRTHPSKVCMLCGSCPVFTERRAGGLLDILLGPRSAAHGSIHSARVLRWFWQLNLLHSGLDYTYNKENAPSCDHRLRFIPHTT

SEQ ID NO: 984919 - protein, 41 aa, Homo sapiens
NQNHRNADQLRHGGFECNPAMLLSQRQPIQHVLGVPIRPGK

SEQ ID NO: 984920 - protein, 68 aa, Homo sapiens
GYIGVLTYSLRSLCVLSVHLLLSGGPMAMAHHLPFSVQAGDMHPISNHGGDPYTGQPPRMTIIMEACC

SEQ ID NO: 984921 - protein, 114 aa, Homo sapiens
WLLPTNDPSFHHCIDSLGGTFCNTLPAIAVIASDTAAGECRGVVAALCVTRALLSVVSTRLAGIRVIAEHNSCYLNFIHISYLRVLLVTRLHCQLALTWSSLWQVQVAYLDLAW

SEQ ID NO: 984922 - protein, 31 aa, Homo sapiens
MSLTLSPRLKYSGVISAYCNLRLPGSSDSPA

SEQ ID NO: 984923 - protein, 40 aa, Homo sapiens
MIYCCTAPQMDKTGPRAGKDDMVGTGLGCMKLRYSLSEPC

SEQ ID NO: 984924 - protein, 72 aa, Homo sapiens
MNCELKDEKKPVNVQIWGKFLSGQREQLSKLLRVGKELDMQNGHLRKSSLLECREQGGVGGGGWWHNFGIRY

SEQ ID NO: 984925 - protein, 127 aa, Homo sapiens
VLLCSHKVQVVSKNGASLLPSVPKSCPVNLHISPYLEIESSQMLLRILAALGSMAHACNPITLVGRAGCISRSADRDHTGRHGVPLSLLEIPQQNLGRPWWRAPEVPATREDDGREWRESGPPRGYP

SEQ ID NO: 984926 - protein, 83 aa, Homo sapiens
INTETGDQQLPDKISGAGRVGSSMCTKRQHGGVNWHMTWEHLTGKGRMPQVSMRTSVNKLRMRPLRSAGSATGHGVLYLGVCP

SEQ ID NO: 984927 - protein, 45 aa, Homo sapiens
SVRGKLHGPYNRKESLSSLSLSYAHTHTHTHTHIYAQVSIGKGYT

SEQ ID NO: 984928 - protein, 55 aa, Homo sapiens
WYRVGVRNVIAIRPHQADCEKEQRCGGPPAVGRPGYMREPCFALQGGDRRTRITL

SEQ ID NO: 984929 - protein, 36 aa, Homo sapiens
VPKDTLKVKIHRRDFRQYCQMTRGWVIRWHPACSCI

SEQ ID NO: 984930 - protein, 51 aa, Homo sapiens
SVVTAGSTESDVTEDGESLKIPQDQRVSCPRREKADQQPLSGKRSQSLRPD

SEQ ID NO: 984931 - protein, 41 aa, Homo sapiens
SSYQEAPLTHCSCCPADTVLTPDFLNRCRMHAISGCRLLSH

SEQ ID NO: 984932 - protein, 68 aa, Homo sapiens
CHGDNSTRGNRKLPRQVAASPAANKEVVELGMMVDRSVWHECAYDATEMPYVSLSVRGASRVLSVEAI

SEQ ID NO: 984933 - protein, 40 aa, Homo sapiens
GCGVRPVGVVFVWCGVLLSAAGGLLYESDPAGLHSLDLAV

SEQ ID NO: 984934 - protein, 54 aa, Homo sapiens
DSTPKARDFVAELRAVGAGWDGEVLGKKLEEKGFDKAYVVLGQFLCYRKMKTSS

SEQ ID NO: 984935 - protein, 114 aa, Homo sapiens
HFTPGVHWLATSSSSSGLDTGLWLGLLFPIETAQHLGQPGPYSPCITTVNAQPIPSLQCVGQMASPTCLTALLAATARILTGCACLTNVHAENDNEDPKKILHSTTQHVCHSGH

SEQ ID NO: 984936 - protein, 49 aa, Homo sapiens
MLLKKPRCWWLLETQMGTGKIGVDEFSTTGWLKAKKHCLPLVFHLSALN

SEQ ID NO: 984937 - protein, 103 aa, Homo sapiens
IKREAHESLGRREFTSTPYSGLCPLVSSPLPHSRRTFKPLGSSSVVQLRGREIWGKPLPLSDLTFPPLYSRTLHNLMCLQLDIYLLQARETEAQSGAEMCLTL

SEQ ID NO: 984938 - protein, 72 aa, Homo sapiens
RIRWRGASDYWDLEHTDFKTNTQTYRENLRIALRYYNQSEAGSHTSADDVLAATVGPGRGALLLRGITMYAY

SEQ ID NO: 984939 - protein, 69 aa, Homo sapiens
SGQMQPSRAKADQGKLTTMRIAVICYCLHRHHRVPYLVKHELIRGSSRGRAALQPNTQYAVATWRKALT

SEQ ID NO: 984940 - protein, 43 aa, Homo sapiens
MGRIQSPERQPHSLVGYVVYSVLCIHAWVLYTTSSADNDSPVY

SEQ ID NO: 984941 - protein, 130 aa, Homo sapiens
DHRGADDCCAELADVIMTFAQYGDYPPSRRAVWRSSEQLAAIYAVLEQLPEAKHNSLERLIFHLVMVALLETVKRISLGALAIIFAPCLLRCLDNSDPLTSMKGGPQDHHCRWLLEQPHKSGIPRIALGN

SEQ ID NO: 984942 - protein, 44 aa, Homo sapiens
MLLSASVNSISIMPSAVYQCRKGLRRNMGGETAREMRLNSFWMA

SEQ ID NO: 984943 - protein, 112 aa, Homo sapiens
CSRGEHLYFGVVEPLLSLSWETWYPFLQWTDSAFADVGAFAEVAKVTLAQAGLVEIGQAEQMVVLLLLLLLSAVVVAAAAAVVAAAADVGLPLSSAAVAVVALHLNSAVVCW

SEQ ID NO: 984944 - protein, 73 aa, Homo sapiens
RAGTLSLVTLPEKQVQPRSPGWPRYGRRDFHGCVGFHLSPGIIAVPPHLTSLLSRSLLLHRCHTLAALTSPIP

SEQ ID NO: 984945 - protein, 89 aa, Homo sapiens
MAQFYGCWQTIVLVVHHLKTKLISEAKLFKGHANLISHLFVLLSTMSKRIVISEQEGGLACCGAHPGTLEHIEIHPMYVELRVILMLDF

SEQ ID NO: 984946 - protein, 33 aa, Homo sapiens
IYAWGVHVSPSCCVVACVSLSVSKPLSRASGRP

SEQ ID NO: 984947 - protein, 38 aa, Homo sapiens
RRLCEAHTLICERLEYYLGLLVTGNEHPEKSLRVLWTQ

SEQ ID NO: 984948 - protein, 101 aa, Homo sapiens
MLDIAYNQITDTEGISHPRSCKPESHKGTVIHMVERSRTPQKLIQPAHKWSFGGTSWKAPWTINLPKLEEPLPGPKTCSKKVEGEEDLSNLSNLPLRDKQI

SEQ ID NO: 984949 - protein, 51 aa, Homo sapiens
GLLMVYLCVGLAQISRRKVAPVRVVRGDDAQTQASRVVGMLDAPPSKTLTP

SEQ ID NO: 984950 - protein, 79 aa, Homo sapiens
MARTKQAEESRMSGLAESSGLRFSPVLDASCSGTSDSKFFSFWTVGLTPGVCQGLLGLWPQTEGCTVGFPIFEVLGLGL

SEQ ID NO: 984951 - protein, 38 aa, Homo sapiens
LALSSYGNPTSVYAELVKYFVNYLLNISFCFNKPQGAN

SEQ ID NO: 984952 - protein, 50 aa, Homo sapiens
LSPGKLKLKIKGGVAAPLFFLSTPPSRLFDQCRSETHLSAPLIFPRRLLS

SEQ ID NO: 984953 - protein, 67 aa, Homo sapiens
VVCYQTAKERSLSCRRSSRVDGKALERFLQDYFDRQTVLKRYLKSEPIPRRAMMGLCAKRSGSRESS

SEQ ID NO: 984954 - protein, 75 aa, Homo sapiens
EQSAEGAPPYRFARRAGEVEHERTCEDPKDGELCLETEEPDRTVRELQHAALGGSSYSTEQLSRSSLFEPSSSGY

SEQ ID NO: 984955 - protein, 66 aa, Homo sapiens
RRTQDEFELQWRVHQLQPDLLTGPPLQGQCPDEKPSYCDSRRCKKTFRQCSNGRCVSNMLWCSVAA

SEQ ID NO: 984956 - protein, 35 aa, Homo sapiens
ACEHFQNLIEGELRGWHGCGRGLDSLHKNSVSQIS

SEQ ID NO: 984957 - protein, 106 aa, Homo sapiens
MSCSLSVGPRCLPRPRRGCSQKALLGVTCPSSASQSSPALIVLPACQPHNSALLLVMCLAVCWVQASPGRAQWGAALTHSPQDISCPSSLPSSTKHWHSLENTALD

SEQ ID NO: 984958 - protein, 90 aa, Homo sapiens
LPIGAVDQLSCDSSPATEYASRMRNGGSCVQPGRCLLPAGWRGDTCQSDVDECSARRGGCPQRCVKHRRQLLVPVLGGAQPVCRRYTLFA

SEQ ID NO: 984959 - protein, 129 aa, Homo sapiens
STFSGWVEAFPTRIEKAQEVTRLLLKDIIPRFGLPLTLGSDNGPAFMAEVVQQLSQLLKTKWKLHIVYHPQSSGKVQWMNQTLKHLLKFCQEPHLRWDQVLPMAFLQVRCTLTKLTGLSPCEIVLGGRK

SEQ ID NO: 984960 - protein, 101 aa, Homo sapiens
PDTEGIGSTARVLRSLPAGYAWMIYGIDLGGGAEFGLVALSVRTKYCLYFTDEETEANGSRHLPQTIKLAWEFCLPSDASSYSLTRCLKCWREIGTLSSGL

SEQ ID NO: 984961 - protein, 54 aa, Homo sapiens
ILGISNRKSAANLGYNIHQEDVLRHVTLRYMTGTSGTNRVDTSLTTDKRDKVSD

SEQ ID NO: 984962 - protein, 34 aa, Homo sapiens
CFTERGVALLETREESPCFSDERTSPCFSDERSR

SEQ ID NO: 984963 - protein, 47 aa, Homo sapiens
DGYRGQAIETILASTVKPCLYYEIQRIVPGCEWRVPCGPMLLGRLED

SEQ ID NO: 984964 - protein, 56 aa, Homo sapiens
MAKSEIWDLVLAQCKPFLFLITSAHQMSRLRIAVEISDGDVVIMVISVACVRWSSA

SEQ ID NO: 984965 - protein, 51 aa, Homo sapiens
VPSHSYLNEVRSSDVANGYTEDIDTACPTLYAEADHDSLRELLVTENFCLL

SEQ ID NO: 984966 - protein, 66 aa, Homo sapiens
YRGSSITGIWSVSTLLTECQALVQGGVHLSGKLGGKLDGQGHQQAVTEELDVDRVHPKFVRVAGRS

SEQ ID NO: 984967 - protein, 71 aa, Homo sapiens
CGIREGRAMTSSEIAMRGKVKADPAALMVSLMLLPSATPKLEIKYTKIFIHPDWQNSAVAEVYPVCKSSHR

SEQ ID NO: 984968 - protein, 46 aa, Homo sapiens
SLLSAVVYLGRVAERRLNNATSRRNTRCRVESFWMLSSERVRPSSS

SEQ ID NO: 984969 - protein, 54 aa, Homo sapiens
RLGGGDCGASDEAVETTNPHFMLVLSPSILPARPLFHNSRPKPVFMGEENKILE

SEQ ID NO: 984970 - protein, 111 aa, Homo sapiens
ADNSVYWYQNRHIDQVAQNRGSEITPPSTSSDLDKSDKNKQWGNDSLFNKWCLENWLAICRKENLDPFLTPYTKINSRCTKDVNVRPKTIKTLEENRKCHSRHCIWEIIYN

SEQ ID NO: 984971 - protein, 61 aa, Homo sapiens
MLEHSACAGTHTCTLSCWRIQSIWSRLLETGLLSKCERIRGRRATLVGDPDQCTLTYHSPG

SEQ ID NO: 984972 - protein, 47 aa, Homo sapiens
GLVSTLASIEGAADARGSETYRNVLHLKASMSEIRPDFHLSGNALFQ

SEQ ID NO: 984973 - protein, 53 aa, Homo sapiens
LRRICQQLLDTSEPAIPIATPNVCFLQSWRVIHTVTSHSHDSTLSFGSSSTYD

SEQ ID NO: 984974 - protein, 56 aa, Homo sapiens
VSTLLDVSTELVQRGMHRSGEYTSTRLHLNDIWRSARKSHVSKELVQGGMHRSGEY

SEQ ID NO: 984975 - protein, 58 aa, Homo sapiens
YSTGSSYNDILEVSTVLTYLTELVQAGMHRSGEYTYDLCSIFSDILVVSTCAHVIDGT

SEQ ID NO: 984976 - protein, 81 aa, Homo sapiens
CSSNNKELAGYRSNGRIPTRYPQRLNLPTTRSACTTDSSSVGSSGNTHDRLYVMKDFKPANSKDDILPMDLGTFYREYQNP

SEQ ID NO: 984977 - protein, 35 aa, Homo sapiens
CPILLGAFKGEVLKLCPSGGDRWRCVELRLLWPGQ

SEQ ID NO: 984978 - protein, 191 aa, Homo sapiens
TYIKTPMHPSSILSGSLWLSVTGIKAIVCGPLCKACMDTKSYEIILLIISQMIHISQAPLTWTTSSECLFCTILHGLYPRLETISRPRSQDPYSHNARYACLPGASAHSSAAEPLTLIWTRSLLLRDHSLTAPQTEYRNNMICYVACTIINCQSLLQEQGNPELSLRRASLSSFTDPAYLWVLREYWATSV

SEQ ID NO: 984979 - protein, 34 aa, Homo sapiens
ASAALWGVLADTCGVYWTDHLEGHLDGPLTAYWT

SEQ ID NO: 984980 - protein, 79 aa, Homo sapiens
TGVWTEELSGSPTYASGSRFLTARFSEILTFYVYDGAQDLALGGVPGNSDSSGLENSFFGNREFTHLYSILLNIIQDST

SEQ ID NO: 984981 - protein, 46 aa, Homo sapiens
MQLTELLLDGFGISEETGTYYRNGFPKGKMKCCQVRWITPVIPAVW

SEQ ID NO: 984982 - protein, 36 aa, Homo sapiens
NPITIYQERDPSKIKWGDAAAEYVVKSTGVYTTMKK

SEQ ID NO: 984983 - protein, 151 aa, Homo sapiens
DEPPIDFQTDRHACEVKADPAALMASLLLLLSPMRKLEIKYTMIFINNEWQNSESGRVFPVCNPATGEQVCEVHEADEVDIDKAVQAVLALPSLLVLCGEGWLHLERGRLLDKLADLVERDRATLAIMESLNGGKPFLQAFNIDLQGVIKP

SEQ ID NO: 984984 - protein, 48 aa, Homo sapiens
SAPAIPSIWTVSTVLTCRRNLYMGRACTCSGEYTYDHGSSLNRYFGWS

SEQ ID NO: 984985 - protein, 38 aa, Homo sapiens
AADNSIMQSRREGEIFIMGPFIIMCTGKLCMQFEIFLM

SEQ ID NO: 984986 - protein, 33 aa, Homo sapiens
MMRGVLCAMFRLPQTGISSLSEELLHFILQHDN

SEQ ID NO: 984987 - protein, 80 aa, Homo sapiens
MTVSSKDMRDEVLEHELMVADRGQKREIRELDTGMYKWQVLVDRIIGLSSPEFDNQRLAVLVHRIDAGPDALALDHPDPE

SEQ ID NO: 984988 - protein, 70 aa, Homo sapiens
WSTQAGQALSQCNGEHGLNLRESKMLSGVCSFVLGLLFLGAGLIIYFRNQKAHSVLQPRGFLFLSTESSI

SEQ ID NO: 984989 - protein, 50 aa, Homo sapiens
EESKKRSVNHIWPGIGGFMVLTGDNPTHCTKKGPAAQAEVFEVGMGSPDE

SEQ ID NO: 984990 - protein, 39 aa, Homo sapiens
CWPVYGFQACVRMHRQQAASIVDCCGGIPSGAAVASTQV

SEQ ID NO: 984991 - protein, 34 aa, Homo sapiens
VYSGENIFCPQENTEEALWLLLISELNGQPGRCA

SEQ ID NO: 984992 - protein, 34 aa, Homo sapiens
ALELLAVIAVVCQAVSIVPSQMYGFITDFSYIHV

SEQ ID NO: 984993 - protein, 111 aa, Homo sapiens
RGLGPQYGASVYSPPACRRHGGTCGGPPPPGSSAFLRGPRTPDCYLNCPDFAFDSVTVTAYRGRLIVNFTPVLSGLLELDSGQHHVGGQCPPSARTARGSSNISSPSLAQL

SEQ ID NO: 984994 - protein, 81 aa, Homo sapiens
ADRVGVRNTGPRIVVCLTHRLCSTCPSTLHLKNTGSKARLLRISRWRQQRGGHTLEADSACAIAGRMLPLCVITDFLRGSS

SEQ ID NO: 984995 - protein, 108 aa, Homo sapiens
MGALLCVRLYGAVRRYYCTSRYVMYLPPVSLRPDDLHHLPTLYPQVARHRVPRLDPGQVVLSRAYIAASQLCQLLLGHNHVLRALLVLRDVNHQLLLQILLQDVLGGH

SEQ ID NO: 984996 - protein, 73 aa, Homo sapiens
VSVQEIPLTLAGDIATAGTEEQKIVASSHDHGYTTLATNVTLFEASEVEEILDGHDEKYNAVSISTEPPITVS

SEQ ID NO: 984997 - protein, 60 aa, Homo sapiens
MSSTLEQPGRASSVWMSSLFIFTFFPFSTSSTMASSPSSSFKAGWAQATLVWKASPNNAS

SEQ ID NO: 984998 - protein, 48 aa, Homo sapiens
AFRSLPPVPAASSLAIAIYSQSACPPPDCLTYLTAGPALVRVLFVFLA

SEQ ID NO: 984999 - protein, 62 aa, Homo sapiens
RDPRLVVPRCYSHCESLVLIYCLSRVYRILQKEDNSSLFQILKVLHYFATHFARDFRMFGII

SEQ ID NO: 985000 - protein, 59 aa, Homo sapiens
MSLRLSIHLVITGTAYVSSSHGSQVNGIPRKNTILEDLTMTRKCQNRQTSVSDMSTASG

SEQ ID NO: 985001 - protein, 35 aa, Homo sapiens
MRGPLNPVAHPYSCIDLFNCIAASRDGEKVTGGLE

SEQ ID NO: 985002 - protein, 65 aa, Homo sapiens
HINGLAGTGFHGPRIIGLPQSRAGSLRHQWNDSVRLAVLMFTQTPPGCLTLNSVKVTQKASGPNV

SEQ ID NO: 985003 - protein, 135 aa, Homo sapiens
MAAGTLYTYPENWRAFTGLSDRLLMYSVGSWSDVLYRTTPTSISGQTNRHPLDFSATFPGRQASQTFERDDVDSVLFESNASCLLMLATEELREKYSNSAAALLAQWVSFADSDIVPPASTWVFPILGIMHHNKL

SEQ ID NO: 985004 - protein, 62 aa, Homo sapiens
RGRSRGSQRRLVLPFHSPSRLFDQFFVSSTCGMSDLFPSVYFPEIPSTFVPPSFAGRRLRRG

SEQ ID NO: 985005 - protein, 47 aa, Homo sapiens
IVSRGIPRGDFFFYAAAPFFCGITIVGLGPLYTFPETLEGLQGSHTA

SEQ ID NO: 985006 - protein, 55 aa, Homo sapiens
KTIIPKLMAIIGNHNGKLPKSSKASHAKAFIVLHSTAQHRVSEELPLQSSTRGQG

SEQ ID NO: 985007 - protein, 117 aa, Homo sapiens
MAPIHILRISLEWTALLYAVYSEYTSIIEKLLSSWYKYRRMHARYRSIQCYFHPILNMSFILTLISMEGSIYHNLAAHTFLEVRIILKALTVSDFTLNIGTFKEVIIGNSLMSCTYG

SEQ ID NO: 985008 - protein, 43 aa, Homo sapiens
TPSVALVLGVWVGRHNLPLPMLECRDSILTHCILRLLAISPFS

SEQ ID NO: 985009 - protein, 131 aa, Homo sapiens
MVGIRSRLKVDSMERERPAQYAGVEGYPKSSWPTFLFLTLFTSFMEPLSPWIAVEQPSTYPLIDQPTHPPVHHPSTYRPFTLPSIHPLIYPPIIHLSLIHPSIIYPPTHLSTHLPTHAPIHPPTPPLTRAP

SEQ ID NO: 985010 - protein, 59 aa, Homo sapiens
LESSSAPCLTDTLAVSTVLTVSTELVQGGMHRTGEYTLTRLHVNRYLEVSMVLTCRRNL

SEQ ID NO: 985011 - protein, 47 aa, Homo sapiens
IEPYFSSSCPASDIKSFYGCIVFHGVYVPHFLYPVISVMGVRRWLEV

SEQ ID NO: 985012 - protein, 47 aa, Homo sapiens
MVPGIWKLATSAILRCRWAGERVSWGTGPAEPPGQLLCLVELTRPPP

SEQ ID NO: 985013 - protein, 47 aa, Homo sapiens
QLMNALEEDDLTSGRISAYAFAKLRIIGAPYKVQHACEMVMAILRER

SEQ ID NO: 985014 - protein, 36 aa, Homo sapiens
SWSRILVRACHSLHIHIPVAVQAVAGTYQKYGSMTL

SEQ ID NO: 985015 - protein, 31 aa, Homo sapiens
MQNESGFTAGVDQAPAPSWATQALPVLTAKT

SEQ ID NO: 985016 - protein, 39 aa, Homo sapiens
VVGSSGITYSIEIYVSPFRIEMSVLCLSHHCILEVIVPR

SEQ ID NO: 985017 - protein, 35 aa, Homo sapiens
YYPRDGLFGFSAIRHRDLAARNVLVESEHHVIVPL

SEQ ID NO: 985018 - protein, 69 aa, Homo sapiens
RVNPPESFLGAAPSVSLLLAAPFHSGFSTDLRVFDIIRRCCFSQGSPGHSTAGPHFLLLIHKTMFHDFN

SEQ ID NO: 985019 - protein, 39 aa, Homo sapiens
RSQKVPLVVPKKPEAPPATVLSSKEVVQNRKLICPRLGI

SEQ ID NO: 985020 - protein, 35 aa, Homo sapiens
EDDPDHVMRASTVPCHVLLPSRPVLSLYASGRITW

SEQ ID NO: 985021 - protein, 33 aa, Homo sapiens
DDDKVRYNGLKASHIHGTANGFSPVVDPLMLSK

SEQ ID NO: 985022 - protein, 132 aa, Homo sapiens
PVVNEIHSLSMSRGPDRSSYMPHVRCPPSLRIFLVHNSTDILCVNFYGDFRRTGSLEIVKGYRLLPTFLLTVNVSKHSIIYKLTYKLGLGGRSFPTPQSYNIFFTCLVEIFIVYAFHHFVLTSVLILLFVQL

SEQ ID NO: 985023 - protein, 30 aa, Homo sapiens
MVLLMQMSRMPPLLLFLFELLPSMEEQSLK

SEQ ID NO: 985024 - protein, 43 aa, Homo sapiens
QRIPGSTRQQHLIKGRTKMPIQICLASNTTSSQAKSFMLQCAS

SEQ ID NO: 985025 - protein, 38 aa, Homo sapiens
FPKQLTPSAITKSTRDSQSHRDYHQIFHFFLTVCAVCF

SEQ ID NO: 985026 - protein, 95 aa, Homo sapiens
TEPVTQDAEDNTVSLLQTNGAISEPSLSVGPEADNFTVLNLAVDRCIPIISSKSICSTHASSNSTSLTQSNNLLMFPSPATLQQHTVHGGSSGHP

SEQ ID NO: 985027 - protein, 47 aa, Homo sapiens
EDLRKAHCNTSMLVRDAQVSVGNVLEECGLALAIGSYQPVAAAGYNV

SEQ ID NO: 985028 - protein, 148 aa, Homo sapiens
MTDRGPTLMQCSRQTGNDQTGRSTLADYEEWHQDYRNCRETTMYLIMGLENFRRRKLYYDSWLFLICAYSENKRTLVLTAYTEDMTEELISLYRRELLAKINMTQAAGHSSNLERIEKYNNGLIILNDVTCPILAIITGGLKWKTRIY

SEQ ID NO: 985029 - protein, 71 aa, Homo sapiens
MCELDSERQNQEYQRLMDIKSRLEQEIATYTAACSRDRKITTTICLAPRSSEAAGSGASAVLWRVVFWVEG

SEQ ID NO: 985030 - protein, 64 aa, Homo sapiens
MALLGQLQVALQLPIRSLQVQAHLLLLLQGSFQIIHLLVQVDYGLSQGETLSSSAYEVIQSLEV

SEQ ID NO: 985031 - protein, 64 aa, Homo sapiens
AILAHTTISSTLGLQLESNRSIPDQGLSRRSAYPPTKTEHQVQGGLYLGYSSQTGCVHLPAIYQ

SEQ ID NO: 985032 - protein, 68 aa, Homo sapiens
MKPQTFGLRQLARLKRLGHGANLVDFEQEAVAGLLVHGLGDPLWVGHCEIIPHYLDSCTGCELLTSSP

SEQ ID NO: 985033 - protein, 75 aa, Homo sapiens
SAFFPRNVDAPLLRGTRLMSCSIDVLTDALFVSTTPVGCLVQQPLYKHTAHLYSFPFILEEVGQSCVFLYKQMIH

SEQ ID NO: 985034 - protein, 38 aa, Homo sapiens
STRRFLYMLLSMRLIPSVQGLPDVDDVDASALTVIVPR

SEQ ID NO: 985035 - protein, 61 aa, Homo sapiens
NTLWSLLPQEYLDVVAGGPRDLFAYLMPEQGVDSWVHSVVSSHRVTPFTTPAVVITFTLLT

SEQ ID NO: 985036 - protein, 104 aa, Homo sapiens
VQSEQDHQVFLPAHFLSHCPVPGAWHCMATLFFSLCHFTFHFPILPSHTLDAMALVILAVVFGALVNLVVFLCKHILGSGQVTACPSCSWSLPFSAIPVLFLVT

SEQ ID NO: 985037 - protein, 146 aa, Homo sapiens
YKSQRYRYLGDEVSKDQQDPHHVSPVAVTAILDCITKSHEKPRIGFEQGNDEDLILYLISCTSCSQQTSNDGWVGKALGSQQSSQLRLFQSISGSSNIKSCFTVRHAGAGQVVQHRARKPCIIFCKVAAKCSIADGFAVGHVQGKV

SEQ ID NO: 985038 - protein, 100 aa, Homo sapiens
LRLLLLKHKDMKDEDFYDDPLPLCEWSIYFLILMMFFFFFFFVEMKSVLCCPGWSGGASLRVTATSASWGSGNVSCLSLHSSGDNGHAPPSRANFFGYFK

SEQ ID NO: 985039 - protein, 55 aa, Homo sapiens
RYYYGKSESGTICPGFGAEMVGLSDPGLAMVMMVASLPVFYHVPQPVFFSLARLQ

SEQ ID NO: 985040 - protein, 88 aa, Homo sapiens
SAQLLSQLTKEERDVTPPSSFSELLAAGDSPGWPVCGPARRWLRSQMQLPPGGACQQARVPFCRSLSLLHCPMDSTEQARDGTCALVA

SEQ ID NO: 985041 - protein, 52 aa, Homo sapiens
NAWSSLKNSPPAQRLVLRSTMDPQHTTMSYRSTMVLSSTMVLSPTLVHSYND

SEQ ID NO: 985042 - protein, 37 aa, Homo sapiens
APYLFNALYFLNALYFPALYFLNASHFISRYEVYSVE

SEQ ID NO: 985043 - protein, 35 aa, Homo sapiens
LVSQHTTRSLTGLHGGAGSRIYSSCYVVVAAAGTE

SEQ ID NO: 985044 - protein, 49 aa, Homo sapiens
LITGSSQHSSTAPSTTAQPMPVHTGPASSQLHSSTPRQATHSCPSRLTV

SEQ ID NO: 985045 - protein, 58 aa, Homo sapiens
CDPRIGGAVVPSVADMEAEPEAAMALGGGAGSGFGYGGVSWCVALGSVGDLALEVASV

SEQ ID NO: 985046 - protein, 57 aa, Homo sapiens
MPAGLAVSSCGALASASEFWDLEFHTWTSEGLTCSHFTDEDTEGSEMCRNVSSVMKL

SEQ ID NO: 985047 - protein, 33 aa, Homo sapiens
VDLEDPSRNNTSIKGYSKGAASSVSTKQALIRD

SEQ ID NO: 985048 - protein, 71 aa, Homo sapiens
GIPQIENLMEELLPEEDHEEEMNALRGQVGGEINVEMDAAPVLWTLSRILNDDADHVVVWRQMKNLQVMPE

SEQ ID NO: 985049 - protein, 43 aa, Homo sapiens
DNLSSCEHSAARSGPATVPSQICLQAACAAEECRRSEIQSLRA

SEQ ID NO: 985050 - protein, 34 aa, Homo sapiens
QYKSNFTFFRDIPVQVLSKMRALFPEKFYVIVPR

SEQ ID NO: 985051 - protein, 46 aa, Homo sapiens
MHWALNHTSLKTTGGVISKPPRETVGGTDIFKVASVYFNGTAFVIH

SEQ ID NO: 985052 - protein, 91 aa, Homo sapiens
ESQEIQDQLSYIIGSTSLPKNNNNNNDKKPGMGDDRHLVSHYWKTIRYGRIACATGVRGAVNYDHAPAQGNRARPMSQKIKNKKNTYNRIK

SEQ ID NO: 985053 - protein, 108 aa, Homo sapiens
MAIYQGFHVFGEKSYGKTSDVHFPVNTERKTIFIPQSEVKTGFWGDHNGGKLDNGSNNPRQQQNAYDSRPYSGECLSKLIMIFGEIFPVMGSWASNKQVPVLQYFLFS

SEQ ID NO: 985054 - protein, 181 aa, Homo sapiens
HRHLGQTPHPRSQRRRSGDQMMRSKRTRRTTAKGGYHPVKMGDLFKGRYHVIRKLGWGHFSTVGLCGDMQGKRLVAMKVVKGAQHYTETAWDEIKWLKCVRESDPSDPNKDMGVQLMDDFKISGMKGIHVWRVFEVLGHHLLKGIIKSNYQGLPVRGVKSIIRQVLQGLDYLHSKCQIIHS

SEQ ID NO: 985055 - protein, 72 aa, Homo sapiens
TTSQMEVGFGCWERLASTGGDIAISAQLVDHGYNTHRFRKPPARHQYGLKVRRRDVGRPWHILRASEFTTVK

SEQ ID NO: 985056 - protein, 101 aa, Homo sapiens
SMYGHQVRAPRRSFACHDHSLCEQQQASRIRVDILANCYHTKACPDRSRERQMVVFAIEKSQKCIYPIIRAQSAQQYLQPSHLFNPPGFSYAHWNEILASL

SEQ ID NO: 985057 - protein, 43 aa, Homo sapiens
ILFRFQEVSIEKGKRHMTYYNTGTQRLKARRAIRSIHQVIVPR

SEQ ID NO: 985058 - protein, 55 aa, Homo sapiens
MLPFNQEKAFSGFTRQQTALGKISFPAIQAAPSFSNSFPQIFRDRTDIQCLIPCA

SEQ ID NO: 985059 - protein, 38 aa, Homo sapiens
INEMWDVKINSFIFLYDLDINNIVELLQEVGVQVDCSC

SEQ ID NO: 985060 - protein, 42 aa, Homo sapiens
PGSSTRETFSIHCLDQSLGILKALTKFFLGLPTSSSSVARIG

SEQ ID NO: 985061 - protein, 92 aa, Homo sapiens
DFLQETLISVTITVKPRRRIVAVSGDCAIALQPGEREKLSQNKKKKKRDRISLCLLGGIAVALFIGFTVPFDLPVGNKLISLCLQAFPEVNL

SEQ ID NO: 985062 - protein, 40 aa, Homo sapiens
ASVPFSQHSGPRLYPSFWETEAGEHCHPKEVTNVESDCSP

SEQ ID NO: 985063 - protein, 56 aa, Homo sapiens
LVCPEWPEGPRSQPSSRLALGSEDGQLFLQVLLAPESIIQVDRGYPLRIDLSRRVP

SEQ ID NO: 985064 - protein, 37 aa, Homo sapiens
HVRIHSNMGHCCRISQRSVVYTPFHQETKTVRSDCSP

SEQ ID NO: 985065 - protein, 34 aa, Homo sapiens
IFTAAQACVQAAVHLQPQQASIAAPGYLQRLQFC

SEQ ID NO: 985066 - protein, 125 aa, Homo sapiens
EPAIAVQRFIMESGAKGCEVVSVWETPETQRAKSMKLVDSLMIHSAYPVNYYVDTAVRHDVQLMTGLCWVIKVKNHAALVTQPGKNWPKVSPMTDHVTHCRNPKDEILSPSTPDLSNRTLVGNPE

SEQ ID NO: 985067 - protein, 73 aa, Homo sapiens
MVWTVPQPPQLVSYKISVWPEVYLANLEAREYSCLSSVRLDEAEQLGLEGGKKQIQKREVEGTGAGRRGSLDA

SEQ ID NO: 985068 - protein, 44 aa, Homo sapiens
MEGKYSKEGHSMYKSLQLVAFKKLSSLGLGTVVYTCDPSTGGRG

SEQ ID NO: 985069 - protein, 115 aa, Homo sapiens
LEDPVRYTTAEGLHGCWTAPPSTSPCTIPRSTCSSGVGSPVHPMQAGYADGRHLSMLLCLGVTAAPAREYTLFLPSVMSMEEVLNCESLRGTGPWMGVTLGPELGPYGLQMWSDY

SEQ ID NO: 985070 - protein, 36 aa, Homo sapiens
RTVSLGLVQRMQLHIVASRGNELRRQSNESKGAELE

SEQ ID NO: 985071 - protein, 43 aa, Homo sapiens
LFKQHISFKPISKHIFSSFPFLVNQLQSSGLSFFITGQGVTVS

SEQ ID NO: 985072 - protein, 86 aa, Homo sapiens
MSLISLLVLSQNLNGVSWQHEVHQHQCLQVTCKGFLQCFIPGAFPVSEICCFDPVDSCALFRLVRMSMMVASSTPLTIMALCKAAT

SEQ ID NO: 985073 - protein, 138 aa, Homo sapiens
STFGHLPWVSRETRGLVAKTDWLGPFTVWYFLREVARVSSGKRDAAGKLALLGIQEHQLLASTQEVWVAWNGCGFILTVSSLKCPLIEYLAYSGHSHGPMRHRGSMLLRTTGGSWKRPGPTRCTHVWIIFKPLQVRAQ

SEQ ID NO: 985074 - protein, 86 aa, Homo sapiens
MWARMVSISGPRDPPASASQSAGITGGATAPGLSSVQFLKRNLNPVVFFQHKQGYFSESAQKLSSVDSVTKGTRPRPTLWVSETNL

SEQ ID NO: 985075 - protein, 103 aa, Homo sapiens
IKMIIPNETKTPGAMEHELVLHQLEVNGVLKGIRICKERIPSRILYADFKQRYKVLNASAIPEGQYIDKQEGLTEKLLASIDIEHTQYKFGHTKVFYTARSSG

SEQ ID NO: 985076 - protein, 118 aa, Homo sapiens
RVCLGEDCWEFSGSCPLMHFENKNLMPPLRSGARPCPYNSTATLSVIRDYLVQKLQKYVQNVTGPGQRTIVELRTIVELRTIVELRTIVELRTIVELRTIVGLRTIVELRTIVELRTI

SEQ ID NO: 985077 - protein, 66 aa, Homo sapiens
MLVEQTFVAARCPITSLVGKKGLFELCPPSQVGDTRGSTTKSSLLVGGPGSPIDPSNILFCSFVHF

SEQ ID NO: 985078 - protein, 70 aa, Homo sapiens
LFCKTRDLYQPPKNYLPFRLNHLPPLSTQVKVRPRSLLLFLLSFMTLTLFSPDLLGDPDNLYPESNPFKH

SEQ ID NO: 985079 - protein, 42 aa, Homo sapiens
SRGSRCCYYYPGVWRAVPRTISGPGFMLRNNHVNSLKTSIHC

SEQ ID NO: 985080 - protein, 56 aa, Homo sapiens
MRLEKYGWASGGCEAIRFLTGEQAEDKMSPEWLVLPGGLLRSLVTSGNTWFPITLC

SEQ ID NO: 985081 - protein, 92 aa, Homo sapiens
LRLLLPAFTEEEMEAQGQTHHQAEMQIHMVWATGSRLLITTHGLTKASLVLTGISPITGEKGHLFWMDGLWDFCSRPRLGEVYKGGSMRNRF

SEQ ID NO: 985082 - protein, 161 aa, Homo sapiens
CRYYYQNIFKELEKTFENSYGTNKEPEKPRQSSAKRTKREATLPNFKLLLRATITKTAWHWYKNRHRDQGDRIESLEIKPHTYDHLFLDKADKTSSEEKESLFNNGGYGLGYAICRRWKLDSFLIPYTKINGRWIKDKVKPKTIKILEDRPGTVAHAYNAS

SEQ ID NO: 985083 - protein, 39 aa, Homo sapiens
SIYRISYPELNGKLTGMAFRVTTANVLVVDLTCRLVQPA

SEQ ID NO: 985084 - protein, 138 aa, Homo sapiens
TDDVVAEILGYILEKREVPKADWYSIDSRVRNPSLVVKGLKENVDYHFRVSAEKQYGISKPLKSEEPVTPKTPLNPPETPSNPPEVLDVTKSSVSLSWSRPKDDGGSRVTGYYIERKETSTDKSVRHNKTQITTTMYT

SEQ ID NO: 985085 - protein, 66 aa, Homo sapiens
TVARLDLSDDGRGQLKQSLTIVIKIPATISCGTYLFLITWNYPGKRAQINLPLYLKLMLKQDTVNH

SEQ ID NO: 985086 - protein, 146 aa, Homo sapiens
MSSEWSSIAVPREVYTLHLNPTAAHPPKEPERRSQLYLNWREEVESGKSGTCSNLMIEDTELKQVAYIYKCVNTTLQIKGKLTSITVDHCKKLGLVFDDVLGIVTDNHTSQDVKVQVMGKVPTISITNTDGCHAYLSKNTLDCEIV

SEQ ID NO: 985087 - protein, 33 aa, Homo sapiens
LYRDWQYKVSGDVLAASLQYKFCSRRLPEAVRR

SEQ ID NO: 985088 - protein, 110 aa, Homo sapiens
MPSLYPFLSRRAALCLTPNIAQLQPDRVSRIHQYPSYACMSLLVDVYSVLRCMPSLNKFRGHVSTVLELTKYRKDWSLVDVYTPMRCMPSPCTMYRRHVSTVLDPPIIVK

SEQ ID NO: 985089 - protein, 44 aa, Homo sapiens
MSKSRSEIGQLIMLGYVGLVVRLGQGLCFMRERLEHSQVYEVPR

SEQ ID NO: 985090 - protein, 36 aa, Homo sapiens
TVVIGAPSVQELTNVDGQASACISPIRRHTVSALGA

SEQ ID NO: 985091 - protein, 44 aa, Homo sapiens
MTLRIPAFDSSWSICARGRKGMTIKPIRTMMNHSTTEVFFDDMR

SEQ ID NO: 985092 - protein, 59 aa, Homo sapiens
MARECWSISFCARTEAPDGNALTANEVICPWGTSSGSPSIKARTEPTIFPYSSTDMYES

SEQ ID NO: 985093 - protein, 106 aa, Homo sapiens
CSVHLHIDLTTPPGSQWCPSPPLWFFFSVGQLLLAVFSLCISMVVSGQCQLIQHPVQCIDVWLHTQCCMWPALSQHWCWKSSAARWALSILVTGCWHCPTGGCECI

SEQ ID NO: 985094 - protein, 65 aa, Homo sapiens
CVQHGTVEIICHTGNRTTPSYCGLHWTPELAHLGMLANEPLWLLEPCRHTCVLRRMLADLACNVL

SEQ ID NO: 985095 - protein, 46 aa, Homo sapiens
SSGSHWIHFSRRAFSVALINSLQFFNLQLMLLLQRALAQQRELTAR

SEQ ID NO: 985096 - protein, 75 aa, Homo sapiens
LQASSSPARSAGASSWEMAWLQLWYHATQTRVLHFQTGNPDDELTGVSAGAAGGPGAWASSQGFRDVLSGSRKVT

SEQ ID NO: 985097 - protein, 183 aa, Homo sapiens
LSITLLAHLNLSFQLPVPGPPGFWDLAASHPSGPAAQPHPEGAADPSGSGSRFFFIRSRGARVSGSFFSSSAIRAASVRAFWAFSSGMAGFREKVLHLSWHWGNICLQLLLGVDQAGVLGCAVAEHAHWASRSSGSGDFSGSSLVCSRGARSSSISAGSRLALRSTIASCSFRSSWLRRASSR

SEQ ID NO: 985098 - protein, 76 aa, Homo sapiens
AQVTIVRGQGAIVIVERQVGHVAAEVTEDVVARLGEGDLVDGMADEASFQQVAGILAGLPPVREAFHMVVQPVHHI

SEQ ID NO: 985099 - protein, 103 aa, Homo sapiens
MGISPHLYNGLHSAIAGPVVGKPLHREQKVPTTGLVCRSRLGSRSVLRTCTQRRVATVMPLGKEHRASGKSSPGLDHVFGTHAVLALRGGRPVELCRSRPLGR

SEQ ID NO: 985100 - protein, 176 aa, Homo sapiens
EDIFKDFYEREPHKYQNKTMGITPRGGLVLCKPGRAEVMAERIGEDFISDLDQLRKRLSLGDDEACIRDVAKVRQENKWKLAAYLERDYKVSTVNPKSLFDIQVTRIHEYKRQCLKGLQVITRYSRIKREPNKFVPRTVMMGGKAALGVPHGQEDHQSSVTAIGDVVKHDPGGGEP

SEQ ID NO: 985101 - protein, 53 aa, Homo sapiens
SEDPGAQLILKEQIHRDDALRSQEDLKDQRAMVERRANRLQAEIEELRATREQ

SEQ ID NO: 985102 - protein, 36 aa, Homo sapiens
METGKLNTVVVEVARSSTAMARLPASAAPRGARSWN

SEQ ID NO: 985103 - protein, 104 aa, Homo sapiens
MVLSQVVGFFLVGALWSFRLYSFTYWIFSQKAYVTPISISGAFLQRDSWSRVLGFPNSDYHSLANTDSMVLYSARWPHLAGDALSILHSGNGLQVGNGGITGAG

SEQ ID NO: 985104 - protein, 62 aa, Homo sapiens
PRWLMSPSVDYSHTNHKDIGTSIPIYFVCIVPVAPSAQFRDLLIRAELGQPGNLLGNDHIYD

SEQ ID NO: 985105 - protein, 144 aa, Homo sapiens
LTAMDAIRYTIYEYGALTIDGEYYIPFKQYAGKYVSLSRVPATVSLTGQYIELNALQEELAPFGLVILVFCWKQFGKQEPGENSEILPTLKYVRPGGGFVPNFQLFEKGDVNGEKEQKSYTFLKNSCPPTSEPLGPSDPSWGSS

SEQ ID NO: 985106 - protein, 33 aa, Homo sapiens
INNLQEELDTSGGNGSLDRSEKLRTVGIQNIWV

SEQ ID NO: 985107 - protein, 91 aa, Homo sapiens
GAQLILNKSSSLKIIDFFFLKTDNPPASGTQVVKLILTGEINKRGKRQRWMAGRVISDTSGQSLARPSFKGTKKRGGGAYAGNLTTSGSGG

SEQ ID NO: 985108 - protein, 69 aa, Homo sapiens
PDCILLRGISMPRGTSEDRSSQDGGPNVTSLSPGSRVPHTNVSFSALRASSLLYDESPWQAFFIRSRDR

SEQ ID NO: 985109 - protein, 74 aa, Homo sapiens
TLLLPNSASTDFVTSEYFYYVLIGARYQKLRLVTLWRPNGKVEYSVHEYFILQRADSRGTWEDSLVSILVFSDH

SEQ ID NO: 985110 - protein, 54 aa, Homo sapiens
PGDPGSALDLPASSFALRGHQLFTTGVRFWLPTQLVLGTCLRHFLEEPWLIGGG

SEQ ID NO: 985111 - protein, 55 aa, Homo sapiens
MGITIGCIRPHKVGQFHWHLDSYQLGWCTLLLSPLVFLSLVARDHSLAASRKHFA

SEQ ID NO: 985112 - protein, 52 aa, Homo sapiens
SYHSRAHARTRARSRAGARQHQEALVCQMVTTEEEGDKEDTCEVAFLGASES

SEQ ID NO: 985113 - protein, 32 aa, Homo sapiens
GFSLHNNPDFHLAVSINHKLVLQKLLTEVFFK

SEQ ID NO: 985114 - protein, 108 aa, Homo sapiens
GRLSLPKRVLQHHPSNGDQLLSSDQVDPPNHRQEEGVRKTLKDDRKGDFSENRDGDKREDWEDNSTPEPKEKGEEGCHQKGLALPVVEGEVLSHSLEAEHRLWKGTEL

SEQ ID NO: 985115 - protein, 87 aa, Homo sapiens
RGGLDPCIRYDDIFNGRSGERVRTVLTGYGENLTKTFKKVTSKLSSDLGEQLVAGGGEQQMQRPEGRSILETFGGQQGGHGGKTTKE

SEQ ID NO: 985116 - protein, 63 aa, Homo sapiens
LRLTDPRLESLAIRCIKPANNPSSAKPSYGHVIRAFLDLESWFWVTGYNKRVSYIGWLECQDV

SEQ ID NO: 985117 - protein, 43 aa, Homo sapiens
SPALARDDFWTHVSWRPTVCTNQNLAPVGISSSEHNPNNDTPS

SEQ ID NO: 985118 - protein, 43 aa, Homo sapiens
NRKIINTHNIARTNPYTFVDKELSSNKIERESQRLRPPNNRRA

SEQ ID NO: 985119 - protein, 109 aa, Homo sapiens
PTLTAHQAVCWTICRIPQDIMYKKTAVSGNMMKLIVSMRMWGIEEELKQIIKLLPTRRTDYDSFLPPKLEKLEDLARISLNTRSHCMYGYDDALSEIHSGMVFNRGYVG

SEQ ID NO: 985120 - protein, 66 aa, Homo sapiens
RCHVSFSFSSWLPLPRLLAAAGRGRPDVLESPAGIMPQFPGGAIHSLLVYRDSHGLVSLSSSTIPI

SEQ ID NO: 985121 - protein, 60 aa, Homo sapiens
TIYEYGALTIDGEEYIPFKQHGGKYVLFVNVASYVRPDEASTYELECTTAKSLHHVGLGH

SEQ ID NO: 985122 - protein, 59 aa, Homo sapiens
SDIFGMAKVIFIHDAEMQKSALQIIINCSVVGPDNRISSIGKYYTLDSYGDKLAYRNPK

SEQ ID NO: 985123 - protein, 73 aa, Homo sapiens
QLLARLVHRVYFPYLVVHIAETAFWRYYSYTLKNSGLVRGNIYTPLLNSRDLFCISPPIYRIRNIPRVHADPS

SEQ ID NO: 985124 - protein, 51 aa, Homo sapiens
IYHSFMGQLLQCESQVLGSEIVRQRLESPAIGCRSTEDNSTTTRVHITPYS

SEQ ID NO: 985125 - protein, 63 aa, Homo sapiens
MRTHRPHLQSSSWAHKLFLMQRSKFSLIHLELLYIFYPLNKISSGLGEPPIVGQEAPRYHRYT

SEQ ID NO: 985126 - protein, 66 aa, Homo sapiens
MKVQCKGSTKVEDEALLSMLGLQAKGMATGRKPQWEDIFSQFAEPVNNSVLMKALVSCEEITRQSG

SEQ ID NO: 985127 - protein, 46 aa, Homo sapiens
FFNEHHLDTDACLNCRIPELMSNPPYFVVKKQEQAHHTPQSYRMKE

SEQ ID NO: 985128 - protein, 36 aa, Homo sapiens
TLHNHVAYNESNSYTLHFIFRSFYNFCRIIFVIIDR

SEQ ID NO: 985129 - protein, 57 aa, Homo sapiens
IFILSTLTFLYAYTILNAYTLNALYFLNAIYFSFSYSRYRSIKRREDMKLLRKYKAL

SEQ ID NO: 985130 - protein, 40 aa, Homo sapiens
NCARPNLSTSSSSSSSSSSSSYLILFIFLIFLLFLLFLAL

SEQ ID NO: 985131 - protein, 92 aa, Homo sapiens
LIIILLNAYYLLTLYTSQRFILPLNALYFLNALYFLSTLYTFSTLYTSSQRFILPQRFILPLNALYFLNALYFLSTLYKSLRKYKGLRSIKR

SEQ ID NO: 985132 - protein, 78 aa, Homo sapiens
RTVVYLLTMICADGYSRVGRYTEGRRFEALHTESAMKSTKIVFMLVNRQILSKILCHHSRFPPIASLEPPASDLHRPP

SEQ ID NO: 985133 - protein, 48 aa, Homo sapiens
MPHQRQYTIINAIILLNALLLLNALYYLNDFILLIRFILSHRLYTIST

SEQ ID NO: 985134 - protein, 38 aa, Homo sapiens
KKAKPLIGRGLVSVSVFVEPELRLNGANHTPVISCPSN

SEQ ID NO: 985135 - protein, 38 aa, Homo sapiens
VLISYTSYRETEKLEKYKALRKYKALRMYKALGKYKAL

SEQ ID NO: 985136 - protein, 45 aa, Homo sapiens
YLYFLSRSYLYLNAYTSSQRFILPLNALYFIPGMKYKALRKYKAL

SEQ ID NO: 985137 - protein, 72 aa, Homo sapiens
GPSSLYFLNALYFLNGLYFSTLYTSSTLYTSQRFILPQRFILSQRFILPQRFILPISFPGMKYKAFRKYKAF

SEQ ID NO: 985138 - protein, 45 aa, Homo sapiens
MLTRRLGDFLNNRRFIEEQLTNKKAVTGENNFTDTMRHMLSSRLS

SEQ ID NO: 985139 - protein, 46 aa, Homo sapiens
PLFKRREGQRDRDDQRDRRHRRDDEPRETRKLFFTGRFTTNVLKTF

SEQ ID NO: 985140 - protein, 39 aa, Homo sapiens
MPAGLTCIHQCGACHPMKKFRRHVSNRAELQNIVKLEPG

SEQ ID NO: 985141 - protein, 56 aa, Homo sapiens
YQQLEILEAQADKYSTKEDNYEEEIKAVGRITCPPWASRDFKLLVTIFSSSSRSPH

SEQ ID NO: 985142 - protein, 68 aa, Homo sapiens
MGGGSCAIRGGYGSRAGGSYGYGGAGSGLGHGGGDGIGLGRGGGAGLAGGFGGLVSLCAPWRHPRGSV

SEQ ID NO: 985143 - protein, 55 aa, Homo sapiens
SRSQAARRLVSISDPSKSLLRYSSELSSKASSSAATRREDISDNTPKDVTVLYSG

SEQ ID NO: 985144 - protein, 50 aa, Homo sapiens
AGIPFHQQHKRQAGQATIPTTNLSSNSGQAPSQAAGQAGRQASMAAQGSR

SEQ ID NO: 985145 - protein, 43 aa, Homo sapiens
VEPAPTPIAAPVTVPVVWKRKQKPKHLRQEAAKPKGPIKGVPK

SEQ ID NO: 985146 - protein, 38 aa, Homo sapiens
ILTDWLITNPLVLVSRDYAKSEKNSHHPKDNSADKVVR

SEQ ID NO: 985147 - protein, 33 aa, Homo sapiens
MALQPVHQELDSFSEEATGSGPPAGTALPIEGV

SEQ ID NO: 985148 - protein, 68 aa, Homo sapiens
MIADAFATAICAQAVGPIEDFLDRIDLRRVDRDRAELGGQCEPIGMAVDHEDLGCALDRRRMSPPSAQ

SEQ ID NO: 985149 - protein, 154 aa, Homo sapiens
GGDPRRVSLAADRGGTDCGPASNPSHGQRHQFPNFSGELLLNGRLRTSPPAAVNQPIERGSSSRQIALDKEVKLPPCHPSQRKWVSCLRQKPANVLNDAQTKAPGREWPLSTNWGPVIDGHFLREPPARALKRSSRVEVALVIGRSQDDGLLNR

SEQ ID NO: 985150 - protein, 78 aa, Homo sapiens
DFGFRHDSTTTRDIAPILSALQDSDSPGTSRATGAASPDSPETLIPRSPRVLVIVGLIVRRLIADLIRHVPARGTELE

SEQ ID NO: 985151 - protein, 33 aa, Homo sapiens
ILITFQSRYFQRSGNGFCSHFPQLYFHEVESLA

SEQ ID NO: 985152 - protein, 38 aa, Homo sapiens
RLKTDISPLPRTPTTQRSQTQTYQPKECDDVRLYQVGD

SEQ ID NO: 985153 - protein, 34 aa, Homo sapiens
RVFCDVSALVLTVSTELVQRRHAPKWLNTLSTMA

SEQ ID NO: 985154 - protein, 55 aa, Homo sapiens
IHANRVFGGQHWCSLCRRNLYMGGMHRHVVNTLSTSAPVLYDIVDGHARVLTVSD

SEQ ID NO: 985155 - protein, 153 aa, Homo sapiens
VRPPGDDLLVYNWAPGQMVSHLDESILPNVSPPDAYHTILFTEDRDIRHQEKHTSIGNQAEDQDVQMMNENQIITNAKRKQSVVDPALRPKSCIREKETRRRRCCLVKEGELVLPLWWAPSAAPLSACCPTPQSQELEAKHSVEGSRLEEGTR

SEQ ID NO: 985156 - protein, 62 aa, Homo sapiens
RARVNVFMYQAPENYGHGSLELLADVQFALGLPFYPGYEGQFSSGGEEPVGENRAVLFPAGS

SEQ ID NO: 985157 - protein, 70 aa, Homo sapiens
RMSSLSSMCECGRMPVPGRQSSCWESGSRCINPAAWRCAELCRASRCLGSHGSAGLRDVMPEHWPPLQAA

SEQ ID NO: 985158 - protein, 50 aa, Homo sapiens
SDARWDRRTLLTTGDGSLTRHAWTVGTTLTTVYTPLSCPGHCRQRDDVPT

SEQ ID NO: 985159 - protein, 119 aa, Homo sapiens
KCTRDPPSLSLTVRPPVRCWAWVLPYGDHTDLAGDGEDKLRTPELVETQATGDGTFQKWAAVVVASGEEQRYTCHVPARGVAEAPFTLENGQPSSRARPSPSWGIVAGLGCPRAVLQLS

SEQ ID NO: 985160 - protein, 40 aa, Homo sapiens
TSLASFLQTTSRSLYHSQLKYNWLSFDHCDFLFQLFLQNR

SEQ ID NO: 985161 - protein, 39 aa, Homo sapiens
AHLHGKHSDGTWPMQPPCSAPSTLIFFWSVATQQACTHS

SEQ ID NO: 985162 - protein, 115 aa, Homo sapiens
CALSLHLGSTLLGSLITSGLHDTVATLCFSRFTLWTRTTLVPAAGCGALWGLRAAQLVSSRPPTSRLLPGGLNATTSAGCVLLGRTWPGRWTAWDVGTVWWPRLGCPSGVVRTAD

SEQ ID NO: 985163 - protein, 43 aa, Homo sapiens
MPDLRPDDACEWLLARGLSWDTVVRLTDVLLDAGRWWWHVTGR

SEQ ID NO: 985164 - protein, 56 aa, Homo sapiens
YLVRASPDGRFDGMDMSPLMAHALSLSVCELKADKDYHFKVDNDEDEHQLSLRTVS

SEQ ID NO: 985165 - protein, 181 aa, Homo sapiens
TDGGRTYELTDFTVSLHHLLSSCADWVHGRHRPRCTQTEDYRTLTTYKDFSQFVRPLIAAQPPKIAVSKMMLVTGAQWREYSTNNPFKGRSWGIKWQLRQQQLVAVVESLVQATEVAPSPTPVEVPIRQDKTTAGQVSHCSEDAQKADLVSLDAKDCYTQESTPLKIMLGGNGSTRKRSSK

SEQ ID NO: 985166 - protein, 68 aa, Homo sapiens
MWYAPVVLCYLVAEVGGSLETERLRLQKALIQPLHSILGKMSNDSVSKKKNYSTNNPFFLVRKGVFVA

SEQ ID NO: 985167 - protein, 39 aa, Homo sapiens
ACFTTAVVASLYTFRRPVSTVLPSQYSFRWRLVASRGSS

SEQ ID NO: 985168 - protein, 104 aa, Homo sapiens
PTCRTQGHPEGPRASGSSRCPSVSRSHAANHAGSHFVSSSTKISIGSCMNLRQPGRHLFAPGSTEHHDLLLVGGHAETFPGHPDACGAVQASLSHSSKNKGFMC

SEQ ID NO: 985169 - protein, 84 aa, Homo sapiens
TWYTAMTKCDCVIRSGAPLSSIPCIHTSQVTQLCLGFLTDPQLDTDQLTSGIFNVGSTLPGDWFLAAHLPQCHGQISVKGLQDE

SEQ ID NO: 985170 - protein, 111 aa, Homo sapiens
EDLRSWTAADTAAQITQRKWEAAREAEQCRAYLEGECAEWLRRYLENGKETLQRAEHPKTHVTHHPVSDHEATLRCCALRFYPTEITLTWQRDGENQTQDTELVETRPAGD

SEQ ID NO: 985171 - protein, 72 aa, Homo sapiens
SVVPHGDVHGPAPRTRECGLTEKGVFADIIKDLKIILHLGWVLNPVTWVLTRERSGEEHRGGGHVTPEQIGV

SEQ ID NO: 985172 - protein, 45 aa, Homo sapiens
LRKLGNKKSSSSPRGGDLSPTPWRRRRFLISQVLGHRFGLPSLLR

SEQ ID NO: 985173 - protein, 62 aa, Homo sapiens
CRYYYQSRGTCVSCPRGARDKRMKHPVSYHFEPSSATYISPDLLPWLFARKELCSIPPKRDT

SEQ ID NO: 985174 - protein, 66 aa, Homo sapiens
CPYYYQKQRVSHPPEEYGCDVGPDGRLLRGHDQSAYERQGVTSAPERGPDAPVTAAGHLRLRITHA

SEQ ID NO: 985175 - protein, 50 aa, Homo sapiens
LHVALKLQMDASDGLLSGHHTVPLTGSPWSRGLVAAVSRIYSSCYVLLGG

SEQ ID NO: 985176 - protein, 39 aa, Homo sapiens
SSRQERLVRGSQLVCVSGHLAHSRPLGIREQQQVIPSGL

SEQ ID NO: 985177 - protein, 40 aa, Homo sapiens
LEDPAALYYLVFPVPAISLEVSVRVLKRRLTFELVDWERQ

SEQ ID NO: 985178 - protein, 66 aa, Homo sapiens
GNKVMFWWPSREGKSAISAHGNLGLRGSSDSPFSGLSLPSSGEYGHRAEGLMVYSVGPFSELGKMI

SEQ ID NO: 985179 - protein, 40 aa, Homo sapiens
CGDYRREPPVQPWFNFLKALARSPRLECRGTVIAHGSLEL

SEQ ID NO: 985180 - protein, 41 aa, Homo sapiens
SDYGEFVIKTLMSAVWGVRKCMPQMNYDKLSRALRYYYNKR

SEQ ID NO: 985181 - protein, 110 aa, Homo sapiens
KLHQQEHPLRSPSTLWTLVLSTLHNKSCCCSLFGSASPLRAVNLTVKVRGFILEVSRTTNPPEEKKLWTHLKEETPDTPSLRAVTVTAKVRGFILEVSKTKNPLLPSLLR

SEQ ID NO: 985182 - protein, 52 aa, Homo sapiens
EDVGCDWVRTGAPPRVYQFAYAGKIDIALNEDLSSWTAADTAAQITQRKWEA

SEQ ID NO: 985183 - protein, 48 aa, Homo sapiens
MRLPPALALNDRKYISAYFLSLRSSCSLKKVSWRLSSASLLSSSLASR

SEQ ID NO: 985184 - protein, 35 aa, Homo sapiens
MGVSQVQPLFTGLPALGPAPELATLFPALALFPSP

SEQ ID NO: 985185 - protein, 35 aa, Homo sapiens
LLRDSTRPDHGFGGGLTVWDVTTRARAHPITPRTG

SEQ ID NO: 985186 - protein, 46 aa, Homo sapiens
ADGRLYDVTPPNALDLFTPPTTGHRDAGFTTRRDTVTFYPYLTDCC

SEQ ID NO: 985187 - protein, 58 aa, Homo sapiens
TFQQANTPAVRAQVSYTLLQESPSTVHTPAGRASQSPRHTPAWMSPPVDCTLSCTGGG

SEQ ID NO: 985188 - protein, 130 aa, Homo sapiens
TVQATQDIGKNKTLSPHYSWNVYAPCVSPQVDGSEVSGKGYHCVHTDLDQCLSEPYNKRIVVLINTEGSFAGSGPSNEGDQMSVHMGTSFILAVHASLKKLTSLQDVGIHLEVLVGPQQEHMTYDINLPY

SEQ ID NO: 985189 - protein, 64 aa, Homo sapiens
VVPVGPQVKVAPIVVPSSTELEGRVLRCQPSELHIGCAVGVVTLSGALALNFYCIVLPLRKIII

SEQ ID NO: 985190 - protein, 58 aa, Homo sapiens
MSYRLSSWEAQRTLDWKELIQDISRLQRRTVGTGHLEVPGPYYAARYSVLPPMFDPGD

SEQ ID NO: 985191 - protein, 61 aa, Homo sapiens
THTTDRENLRIALVYTTRARLVLTPSRRCFGCDVGSDGRFLCGYHQYAYDVQDYIALKEDL

SEQ ID NO: 985192 - protein, 56 aa, Homo sapiens
RLSKLGMQSTFIGQKLSVTVLNNSCLPTQCPGGQTIISSCLGILDDLFGQFCGEPG

SEQ ID NO: 985193 - protein, 66 aa, Homo sapiens
RLSDYTKTSGRKFSSKRPASGSADPAQYDRYVNKDMCIQELAVLVSGQKKAQVLKLFVTADAWPLL

SEQ ID NO: 985194 - protein, 45 aa, Homo sapiens
PPPGSSADQAEMEEPANIAGDSSSLPEGGARNAIKLAGGVVTLHP

SEQ ID NO: 985195 - protein, 69 aa, Homo sapiens
GNDSFDHHEFPCLTWAVAAGFSRIFLIVVISFEGVIDSNLGPPPLSYPYLSSSYIIPAYQQLASSEDLP

SEQ ID NO: 985196 - protein, 121 aa, Homo sapiens
SDQLGKHPVTVCTAHHDTVSTSPNHPHSLQPPQVSHTLSTSSNPPTVCNLPKSPYVQPRKISPTMCNLLKSPHCVHSSPNPSHCVHTPLVPHCVHPPKIPPMLWQPSSNTPLNASKLLQIS

SEQ ID NO: 985197 - protein, 38 aa, Homo sapiens
GTRIGGVLWRIQSLSENHAVLFPACPDGVILLEIDSAV

SEQ ID NO: 985198 - protein, 40 aa, Homo sapiens
TRRLSSWDTLNANVPRFQCPLGSRIIPAEKPRSHNIQLAQ

SEQ ID NO: 985199 - protein, 49 aa, Homo sapiens
ESYRLSSWEVTVSDPVDVDRRAGRATGNSSHPGSPRAGAASDSLSYATL

SEQ ID NO: 985200 - protein, 83 aa, Homo sapiens
DRGLPVETGLMLNNKYASATSIYKILHGWMGRASHAGGTQYPAPKVLEEVIMSVLGLVGLPPSFAGGSRKIGVTEGGFYTEEG

SEQ ID NO: 985201 - protein, 51 aa, Homo sapiens
VLKPRTDVLVVPGELLLCSFSQQDPLLVWNDGRLLLVGTLSLNFGIFPVCQ

SEQ ID NO: 985202 - protein, 32 aa, Homo sapiens
MSCQVCEVRPWVQMPARGDLWLRPMDPQELEV

SEQ ID NO: 985203 - protein, 46 aa, Homo sapiens
SRTVERLSDSGNAVITGLIVVMAFKVQIATVVSFFSQCTIPAAPGT

SEQ ID NO: 985204 - protein, 74 aa, Homo sapiens
APFWGGGSSGLKSLEIQGEGFIHMASSDFLTLHGGHWFSSSAGERGLTCLRSFMPSTRYLGFPRGPLSVQCPRL

SEQ ID NO: 985205 - protein, 34 aa, Homo sapiens
ETGLMHCVDFSLFVPGWVTAVLRVVVALMSLGEQ

SEQ ID NO: 985206 - protein, 48 aa, Homo sapiens
GGAQRHAWVIPIGAPTRQFSNSSQRMSCNFHGYPSTAGGPACHPSAAP

SEQ ID NO: 985207 - protein, 68 aa, Homo sapiens
MAVARRVLGVQWLQRASRNVMPLVHGQPPNMSKDMFPVPYPRSPEERAAGAKKVEYAVWKDYEHLTRD

SEQ ID NO: 985208 - protein, 44 aa, Homo sapiens
HEGCPVAVGALGTPRRLCAMNLEVFMCIMTRGSRLWWEILDDPR

SEQ ID NO: 985209 - protein, 140 aa, Homo sapiens
MRSLSQRQHCPEGPCCEQFTEVKKLDLLNGNAGCSNPVSHNLMCNNFFLKAILGVARSRHDLQSAFRQTYGSHPEVDSARSKAGLVDFKSPSLTKYKIGGRKSHLIRVDLKMSSMKIIGVAKNGERPYDVYSRCVQGNKN

SEQ ID NO: 985210 - protein, 62 aa, Homo sapiens
SAYRVSCHHVISPQWDASVLGTASVCVGGRNDRRSMLALVLRYGVPGVGPLLKKIKKGIVSS

SEQ ID NO: 985211 - protein, 81 aa, Homo sapiens
DGAQHPVILFLNKQDLLAEYKSLLGKSKIEDYFPEFARYTTPEDASPEPGEDPRVTRTKYFIRDEFLRISTAREDWCSYSY

SEQ ID NO: 985212 - protein, 88 aa, Homo sapiens
RTYGYSCSARAATAPMFVQHPDLKALSAPVPAGKMCSVDYADLLQITRFQYDELTARWFCQIQVKTFGTLVSIPVCNKSSVQVGSLDQ

SEQ ID NO: 985213 - protein, 134 aa, Homo sapiens
PSCGFWNLTKVSQEGVHVLQILGVTSSPTLDMTNNYHMGVYNPCDIRSNIILYPTGYYEQYHRGLYIPCHIQSKIILSSPEYYKQYPSRVYTTCNIRSITFLFLSEYYKLYHSGVYTPGSNIILSPTGYCKQNH

SEQ ID NO: 985214 - protein, 40 aa, Homo sapiens
KLESSSCNQVRSDQEDDQAGILIQSKFRSYYEQQAISCRA

SEQ ID NO: 985215 - protein, 37 aa, Homo sapiens
GFVNGRPLGSGPQRIVDLATRCNGPATSLASSAVSNG

SEQ ID NO: 985216 - protein, 42 aa, Homo sapiens
MSVTDKCSPIPGNHIYALLTEGLSEGSTHPTGAILGVATVMG

SEQ ID NO: 985217 - protein, 44 aa, Homo sapiens
MVLETLCRQEGDAWQRQLQGPEVGMTLTWPMCRNGLTKCGWSGA

SEQ ID NO: 985218 - protein, 116 aa, Homo sapiens
QCSELQQQSAAKLGSSRTEWHSWKRSCALPGRAIAEQRQNCVQSAEETRGSCWQPCKQELELVVVRAGVLRVGEEEELHAVKLQTEKKRLQQHIQELEAHLEAEEGALEKLELEGA

SEQ ID NO: 985219 - protein, 157 aa, Homo sapiens
AGPVMSQIEERHCSHDCVDANLELAEHVPCCAPGQHAPASASSSELMLCFTGSKSSLVSPRVNSSSRDWKRFAAQVGVLLATLSGQVADEDLVVLHQIIVAHVDLPVRDRVHRFDVAPELLGGYDKPALNGRLLGPEFLYLVEQDLVQVLALIGVGD

SEQ ID NO: 985220 - protein, 129 aa, Homo sapiens
QSSKARVQACSPLHHGSLKFSSQTAMVRSSLLAGHTDLLQMGTPHGQIQVQTITQHINNSQQQVSACACHRIPGYGRAPGQVTAFVPVLHFSTFKKNPLRFNIAKTRACGFSFSKLSSRLHPETRPRSH

SEQ ID NO: 985221 - protein, 45 aa, Homo sapiens
VHAAEHVDCEPHQPALQLLEPFDKWDGKDLEDLADPHSRSTGTVY

SEQ ID NO: 985222 - protein, 52 aa, Homo sapiens
MCAVFERIPSAGPKFRLQSRFCFSALFLEARSDSRSSWNKAEKQKRDLGASW

SEQ ID NO: 985223 - protein, 41 aa, Homo sapiens
MLRSFYTDPPPAGPQGKRAAHSQPGYVLGMGGAGGSACPVG

SEQ ID NO: 985224 - protein, 38 aa, Homo sapiens
LQLAPKLHGPKLTLPQHAACQCDVWRKEKNAGRNQMTK

SEQ ID NO: 985225 - protein, 32 aa, Homo sapiens
MDTARDSIQMASRVGRKSYVTSSRGAGGTGAR

SEQ ID NO: 985226 - protein, 109 aa, Homo sapiens
SSWPPSQPHTACDSQNGSAWRFPILSNIPHGPFSLPHRTFNFPSFSFPLAHHPLRNFVLHPAQTPGPYFALSGPSTAPGPHHFHHTLTPLGATRDGVPELDMRNSLVTT

SEQ ID NO: 985227 - protein, 106 aa, Homo sapiens
STMEDFSRAIWPPTLAEEKKDPLQPYEREVLCLSVLWLISVNIMSPRLIHMVANDRISFYKRLNSIPWCIYITFFIHSSVDGHQGGFHIWAMVSSVAVNMAVQISF

SEQ ID NO: 985228 - protein, 46 aa, Homo sapiens
TQSVLVPDCLWTTARCDSAVTLMLLVHLKATRNSVPVPCHWCIKCK

SEQ ID NO: 985229 - protein, 67 aa, Homo sapiens
SGRGVKAEGPGGRSGWCGDPGPQTPNRVGPSVVWVNEPAPAAPSVTSSGGLVPSECCISHKSTGELG

SEQ ID NO: 985230 - protein, 43 aa, Homo sapiens
SEGKAQAARGACSLTRLPGDRALSLGCATFICTGPCAPPPHPP

SEQ ID NO: 985231 - protein, 60 aa, Homo sapiens
GPAVETIQTQGTFSVQFRGKMCSVDYADLLQTFQVFILDELTARVFSQIQVKPFGTLVPI

SEQ ID NO: 985232 - protein, 71 aa, Homo sapiens
SSGPQAGGGRSQAAQEDRTRPKAERLGPLFPSGIPGTRPGGPPTYARLSRSGTTVPSPTPASEPALHRRLP

SEQ ID NO: 985233 - protein, 44 aa, Homo sapiens
PAGPQARAVTPLSPSQGRGTDPQVGGGQTPFSCLDLVTCRIRGS

SEQ ID NO: 985234 - protein, 47 aa, Homo sapiens
DPVVLMVGCCTRTGDRTADDADTGLGWARWDGPTDVSAPGTFCTPLT

SEQ ID NO: 985235 - protein, 58 aa, Homo sapiens
MLTLKMSLAGDLGVLLSGYLASLRPPGHSCGLCQLVIRKSTHHTGMQHVVACALGGLE

SEQ ID NO: 985236 - protein, 42 aa, Homo sapiens
RGPLSCPKLVESLTNDNGGDARTPRELAVRGCHGPGPWTTGT

SEQ ID NO: 985237 - protein, 84 aa, Homo sapiens
DRARYRLSSGYWEFPCRNSPAAVPAGVSMICLPREHQERVGWVSDGLVDAASRRDCSKFIGEVVPVWVIPHESLPHAFTTGQCG

SEQ ID NO: 985238 - protein, 76 aa, Homo sapiens
TVVPSDVDSSTGRIRLDQQDSRYTDIMAVSTVLTVSRELVQGGMHRSVKHVDQAPGNRYLEVSTGAHVSTELVQGG

SEQ ID NO: 985239 - protein, 60 aa, Homo sapiens
GWRREIGVHGKQRLNSQDSRQHEQAQLRAPTVHTAHTSQARSAFGELAGYIQADGPLPTS

SEQ ID NO: 985240 - protein, 37 aa, Homo sapiens
GWDRNLNRSLALMASQRHLKTPDEGYEEETRDLARSK

SEQ ID NO: 985241 - protein, 67 aa, Homo sapiens
VALDGLPLQLAPQQSAGLSGQPCLAGPMGPGAQAARHALLAMGPVHPSCHQLGGTCGPWGPAGGVTA

SEQ ID NO: 985242 - protein, 136 aa, Homo sapiens
DPLSWPHVAVSPSPSKEAVLPAYPTYSVLLKMWYRLFISEIGIEASALSSLLEQFEKSEATKECPPPAPADSLAVGHSGGVDIPQEKTALERFKPQTLANVAGLTPPATPPQQLWKPLAAVSLLGKAKSPKSNAQA

SEQ ID NO: 985243 - protein, 92 aa, Homo sapiens
SWPQELLMVICQWTSTWQSAWNPFRPIQLSGVWAGGLFSPINGILGVHQSSPELRSALVLTCRFGRKSLQEARSTDFVLTFSSFVALGGQLE

SEQ ID NO: 985244 - protein, 37 aa, Homo sapiens
RSGQVLGVHMLPAPVREALPGTRALELGQAPVDAMQA

SEQ ID NO: 985245 - protein, 77 aa, Homo sapiens
KDPPQLAPKVHELVQLLLAMLSQAMLRGMLDADGNQFVAYFLPVEETLKKRKRDQAAALAYAPDDVYDYKIAWGPAG

SEQ ID NO: 985246 - protein, 126 aa, Homo sapiens
MPTPSTSHSSLTREAQREQMAPRCSGWGYDGPEESVFQAVTAGLKVSEEVVGGLFTSLCTVGSKQIRIDHESSEWNYETCLATPVSLAPEVTHGNTLMTYLFRDAALMQASWGAPAGRLHTGDGTG

SEQ ID NO: 985247 - protein, 75 aa, Homo sapiens
MMCTAQFLEVQCFHGWIPVCLHKSPVTTAVPGLLFQRLLKSLVSHSMQGGPLLLTFGIQCFPQSIQPCSLSFCSI

SEQ ID NO: 985248 - protein, 44 aa, Homo sapiens
EGQFVGYFLLEKTTLMKRKRDQDEEMDYAPDDVYDYKIAWGPAG

SEQ ID NO: 985249 - protein, 93 aa, Homo sapiens
QELPGSGGPRWDLAVTVLAALGCSLRRHGTSVPHSSCTHIPFLDKPCETSVWYTWTSLWVLKSLDAGLDHSCPFVTILVSGVLVSVPCPTMHA

SEQ ID NO: 985250 - protein, 67 aa, Homo sapiens
TRTVALSLSPRWDWLDSKDQVMGPGVSYLVRYMGCVEVLQSMRALAFKTRGSGPQCLQSGVYGCAGC

SEQ ID NO: 985251 - protein, 90 aa, Homo sapiens
PSLRCLIPCMESLFPAECLLLLFFFIVIIIVLNLIFVVIIDTFADLRSANPKTEEILKRICFICVLERDKFVNNNDRCHLRNTIKLEHNM

SEQ ID NO: 985252 - protein, 40 aa, Homo sapiens
SYTSPLGWRHGLRLRGSPVPSATLHRWLLPRLWGSAGGVG

SEQ ID NO: 985253 - protein, 34 aa, Homo sapiens
SVSRNHHRKMSPGGSHNHLLQLHDVRMTQAAQQR

SEQ ID NO: 985254 - protein, 39 aa, Homo sapiens
VTELGTGMACTCFKHLATGNYLAAEENPSYKTVMPHAPK

SEQ ID NO: 985255 - protein, 133 aa, Homo sapiens
MRLGVDMRACLMCVLEHRHSRMRKQIGEFAMWEGREKPGGEDVLVAAPRLLVWDLEDCDGEVGEQKAGGELVDTALHMDQEAAQRLEDADVLEQEVLVRAQGPFQSQALLLGLFILLFVLLFPPTGHLRGYRA

SEQ ID NO: 985256 - protein, 124 aa, Homo sapiens
MMWWDIWGGNWNGSIEGQSCGVGVSESSCCDWVHWLSLLVVLIILADWGTLSSGATALRGYIRGLLLWTVCGRPVGFLFWGLRRRPPVSVFMTLKTVNHMYGSASRLTDALVAQGGHLRGYRGS

SEQ ID NO: 985257 - protein, 41 aa, Homo sapiens
VEGQAAGEESRASCQPNERMMQAAVSPALSILVCIGDHELA

SEQ ID NO: 985258 - protein, 76 aa, Homo sapiens
MAVGQVRVRKPITRKMFSRWFPTTTSFRLHDVRMTQGSSSVISRKLLMGMPSFSLSIRTFFRATISSVWVSRARYT

SEQ ID NO: 985259 - protein, 39 aa, Homo sapiens
MVSSVRILTQEPGPHPVAFLSKQLDLTGFSPSPTCLACE

SEQ ID NO: 985260 - protein, 128 aa, Homo sapiens
MRFPQLYSTTPFMWPQISREELSGSSPSSILETENCACWSWFCHSPFVATTGFARQLLSLPACPLSPQFRTLHIHSRVFPEIFVCPARGFHDNAALRNASRSLRGARQWVLGDSSHGMGSSAGTRTRT

SEQ ID NO: 985261 - protein, 75 aa, Homo sapiens
GLWTTGRFHFIEGFNAENSNVDALCESSTLSPGAKAGVRVRDGMNIYFYTIKPIPATQELLVWYGRDFAERLHSP

SEQ ID NO: 985262 - protein, 49 aa, Homo sapiens
MIAAVLSRLPWVGPRAGAGTAPAPALVARRPVRTTGPFPTVGRCGGAFV

SEQ ID NO: 985263 - protein, 45 aa, Homo sapiens
LQDPLEDGWLAEESSNEMNTLQQKAELSSRVCFSGIAAPKMNGQW

SEQ ID NO: 985264 - protein, 54 aa, Homo sapiens
MAVGPPIMLSYSKTQPFFLSCLMEAMRKYTNLDPASQKEPLSYSLRFISQPAIF

SEQ ID NO: 985265 - protein, 118 aa, Homo sapiens
VAGGEDWAMKWQQRASHTAGTAPSEGEFIDVFQKIKLADLTCLANAADSTSMNPMRRWSSVATSSSWPRGPWCLGAVCGMGAAAWVVGPRWPLAGISPGGRGFGARSVACLWAGPGSR

SEQ ID NO: 985266 - protein, 36 aa, Homo sapiens
MTSSWMPSCSKELELGAVPVKTTVQYQCHKWKWQCV

SEQ ID NO: 985267 - protein, 88 aa, Homo sapiens
AVRSYCLAHGIQPDWQMPSDKTLGRGDDSFNTFFSAPGAGKHVPRAVLCRPWTPHGICCRSPGHLPANSSTLTQVLTGKERLLPIHYC

SEQ ID NO: 985268 - protein, 74 aa, Homo sapiens
HFPLRILSMLPKELLQFWTLILDWDLPRGLHGFSPHLALTHASPSYPTPDLPCTDATVCPTHCHCSTPTGRLSA

SEQ ID NO: 985269 - protein, 63 aa, Homo sapiens
WAGEEGWGKRGDRGTERKECLAQDTAERDLGSLVYLLTFPPLWSHDPAKSPSVRNTQALFPSP

SEQ ID NO: 985270 - protein, 140 aa, Homo sapiens
MLPKSINEYHLEKISAFPSMETRLCEFAYHLALEPWLDASWIFLPKEGRLEGSEPQAKEPLMQTLESLAQRRCMGPSGAEDKQNIMTTAEMYPSEDHLAYAAAGVAQPSLTWGRRSSGQQTACLCREMSWGPLLSLKDAE

SEQ ID NO: 985271 - protein, 34 aa, Homo sapiens
GDEGDEDWRDLPPTSYHPKSDAGGDSEMPSQLFT

SEQ ID NO: 985272 - protein, 76 aa, Homo sapiens
MTTTDHDTFLMNDYRTRTTDCTYGTVTTPRRRTREHVFDRRGTLLGTRAVDGWRRFRNGLESHCTTLVRLPWTRTF

SEQ ID NO: 985273 - protein, 60 aa, Homo sapiens
MCVSGQEELTFCRTLVLPAASPLRGDFSGYGPPLQWCGHSPLEPSLFPPLLFPGLLWPGI

SEQ ID NO: 985274 - protein, 41 aa, Homo sapiens
CYTSSRPAGCPRDFDTQQRLYASTTPPYHHVLTTHGADHDV

SEQ ID NO: 985275 - protein, 145 aa, Homo sapiens
CGRSTRIPLGGTTGHPGLRVCGTRGTVVTCAGWVTGASVCGQDCEWHEVNSRRGRNLMADAQGGVGATSCSPSKPLGHLNGTTWGPHDCDGHTWLRPLQTGGRERSCEAQALCREKRDLGPMNTQKPPWKEQYGGGASAASQAAH

SEQ ID NO: 985276 - protein, 30 aa, Homo sapiens
PWGDIGSHLPLLHVGAEWAVDLGGNKRYLS

SEQ ID NO: 985277 - protein, 37 aa, Homo sapiens
RVSSAHQARSPSPRMAFVPKPLTQSILSGVSQAFHCQ

SEQ ID NO: 985278 - protein, 48 aa, Homo sapiens
AYGTGRRLRDGQAASGSWLPNQDPYWTDHRRRSLAHSMTAQPRMHGAR

SEQ ID NO: 985279 - protein, 47 aa, Homo sapiens
SLRCFRRLPCGWRRGPDGLHADLTFGAGCCAPGVLRRVCLPAGFPAD

SEQ ID NO: 985280 - protein, 60 aa, Homo sapiens
GLGTRDGGVVLTRLTLCCFSGSPPTLCALSDVTLQPQTLGLPFPLSPDPQTAHPPAPLPQ

SEQ ID NO: 985281 - protein, 37 aa, Homo sapiens
GASTTDSPWAGDRRGTRHPGRQTVTTVRRHLVHTGTL

SEQ ID NO: 985282 - protein, 76 aa, Homo sapiens
MSYADLVRCQVHLDAPYAYRQAYLPKHFPLPVRPTDVVFSTVQDALRLVLYPALARIRYGWAEAVAVHWGLGASWR

SEQ ID NO: 985283 - protein, 34 aa, Homo sapiens
PAWPPSIQVMVCLRWVQFGQKESSLTASMLRVDV

SEQ ID NO: 985284 - protein, 81 aa, Homo sapiens
ALHERFTVVELQQMVARPDVVEMHDVTAQDPKLLDQLKATRNSVPVPGHWCDQTQILQCTGGIAASPPSAACRDFIQTHRP

SEQ ID NO: 985285 - protein, 72 aa, Homo sapiens
DIPRSSVVHLRILPNDRVLASLARPGWASRGGLQLPFCPIEETTQIPLASFPLRGNVRVMVLYDVPSCVKHV

SEQ ID NO: 985286 - protein, 43 aa, Homo sapiens
WTYESAFLPPGEYLVCCDCRGSCASYSPPDQVWSRTLGWEARI

SEQ ID NO: 985287 - protein, 93 aa, Homo sapiens
PAGPKHLKLVLRYKPFSKDASTAGAQGYGSISNAHSEQEHRACGPKPPPSQGSQCEPGLAVRTVANCLALWKRREGPLSNCSLGACVLGGQLE

SEQ ID NO: 985288 - protein, 60 aa, Homo sapiens
QLAPWLPVVKNSITKNQWLLTPSREYATNNNEWGSGRGTNLAKELKDGRHGTPSTGKQYL

SEQ ID NO: 985289 - protein, 72 aa, Homo sapiens
GWGRGDGILSPRKSGERADSADCDLLGHMLLGEPFSPRGFMDATMLPTDPSGQGTDSATASDELAMISTAVF

SEQ ID NO: 985290 - protein, 63 aa, Homo sapiens
RRLEDPQTSRGATRGIVVRGQYGMKLPGMEYVDGDFQCHTFDSSNVSDASPHTVSLTPLFHAH

SEQ ID NO: 985291 - protein, 44 aa, Homo sapiens
WAGMQGENQDGELGSHEPTESRGRAGATSAKTWVRGSQQTQSLP

SEQ ID NO: 985292 - protein, 175 aa, Homo sapiens
IGNLSSSDRSRWLLLLQCVSRIPIPSEYRSPMAGQLRLGLPVEEGIRQFLVVDVTLAHLRPNFLSHFGLHGLLFCLLLQGLSHLLDACALDEVWQFEGGLLNALLALQVLALKTPVAWHRHRVPSGLAVNQELRVLRCQIVHLHDIGPSHQLIEFRPSEADHSAQLLLGQLGGQL

SEQ ID NO: 985293 - protein, 43 aa, Homo sapiens
LQLAPMRLRGYIFSATGRSLFCTIFYSQTCFGTTGTLCFLTLT

SEQ ID NO: 985294 - protein, 108 aa, Homo sapiens
MVCVVLLLDTIVMVPRAHMDSHRAMDPFLEANCSWMFGLRNSFRLQGSLLGGGLRRFGFGQAVRQQPGASKLVGEGVAGGVSPAMLASNWGYVNRSRGPLLLGNVNAS

SEQ ID NO: 985295 - protein, 50 aa, Homo sapiens
PAGPKVANEYGYVAFHTSLKRVDMAKFMKFMKLGMLCGLFREGGLGGQLE

SEQ ID NO: 985296 - protein, 85 aa, Homo sapiens
PNEKIETRWLQEQLGLGNEHTRLLGVGRKLGLAEGDRSLGCQLERAPKLTRHNMLHASVMCGDKNRHAGRNQMRNLEASGRTCRE

SEQ ID NO: 985297 - protein, 64 aa, Homo sapiens
MAGWVVEGVVIMAAGLLEDWEGHRFLPSPPPPPATTECRLCVALAHPWGGIYSGKSSKHGRQFG

SEQ ID NO: 985298 - protein, 99 aa, Homo sapiens
VVLEDPSKMAGWYETADDWGPHLPPKKRLDFDLEKLCSISLSNTSMLMPVWCGASTFKAGVGSLSAYIHRVEFQPPRFALNLQQPRSFTGLRRPSNADR

SEQ ID NO: 985299 - protein, 67 aa, Homo sapiens
MAGGHLEEVEEEEEKKKGVWERIRFKLSSQALVEEFSYVTDRSRDSNMDTLGQGERDGLVSNHEGDK

SEQ ID NO: 985300 - protein, 68 aa, Homo sapiens
LLRCSTTAPSPLAVGVCYVLRAARRYGWGDDSDDRRTAVTYGRTPTDRRGVGYWGYWHGGFVLDGSRR

SEQ ID NO: 985301 - protein, 88 aa, Homo sapiens
ALDGSPHRLAGWAADRLDLAAASSPWRRRSSGRPCVRPLWVDRHLGDTTSTHFCHVPTAWCVHHPTLRLLATGCTTGRTTVAWRDRRY

SEQ ID NO: 985302 - protein, 45 aa, Homo sapiens
MHLCAIFPAVRSRIAEITTLINGIAFQTNILAAQRRGGSGARRRT

SEQ ID NO: 985303 - protein, 84 aa, Homo sapiens
VRHELLASLVDADLNLLPMLLPVPLPCHLESTATVYANGAMLQCDLYQHAVLCHRAMLLLTVIWAVGSIYESAPACACNALCTW

SEQ ID NO: 985304 - protein, 78 aa, Homo sapiens
DELGTIRRHLQYIEGNGSFAYALPAQTYDEISMLIDRGIKPYLEAPPPSTPHGALGGLCRQSIFNPGGRCPVRATANP

SEQ ID NO: 985305 - protein, 100 aa, Homo sapiens
EVFWPAAVSVQADAATVIAIVAGEPVQPQWLSCLQVCSLATRSSRTGGRNEKRGWGSAPVSAAMRNISMASVRMGAPPASRSGSVASSKRCSSRADRMAS

SEQ ID NO: 985306 - protein, 47 aa, Homo sapiens
AEIALCNYALRDAIDQQTDIPWAITAQSNISDLQQFVHHSMEVVSID

SEQ ID NO: 985307 - protein, 35 aa, Homo sapiens
MNGTVALSSCSSIGEADLGGAGAKLGGELGHDTGI

SEQ ID NO: 985308 - protein, 71 aa, Homo sapiens
HTFERGRGLLFGKCDIALFSRMLHVDEHRLVVRGEGDAGQFAGLRPHHETANFAADRIAHQHLVVALPGVI

SEQ ID NO: 985309 - protein, 30 aa, Homo sapiens
MLPGYKNVGLVSWAAFAMKVRVHKDLSFES

SEQ ID NO: 985310 - protein, 35 aa, Homo sapiens
SRYLMHVARRIDHHRIRDEKVKVLRSLRRIDQTNV

SEQ ID NO: 985311 - protein, 184 aa, Homo sapiens
GARYRLFCLGCGAQKAHNCSRISKALAAMNQALIWALHEHRQVTARQQQGAVEVLFDHGAQHKAEQDGRDREFHAVMRMAPSHTECASTSQIWKRLFWVLNTPTAMKNRADGNRKRYGTCMQLDPDADQRHVEHHQQHVADPEAGDQAPEDVRMLGDQLRAGLDALDQQRAQDQRHHRVAGNAQ

SEQ ID NO: 985312 - protein, 65 aa, Homo sapiens
NIAELFAVCKTMRALEKATSRTVSPPASTLQPVPWLLVQYEAAFRQVQASEISSIDEFCRKFRLP

SEQ ID NO: 985313 - protein, 122 aa, Homo sapiens
VILEDPDRAGGGFLNAILTAVGRDEPAIVAVTEVHTGCAVDRLTVTSICTGFTEERFDESGMGKGIPGWLDISGRQWLRKRLQQCRHLLCLGEEVRLGKTALPSAASPAIGSGLGLWGAFSR

SEQ ID NO: 985314 - protein, 33 aa, Homo sapiens
QVMSRGQRVAHYSYRRSQKEDGLADFRGFPLKV

SEQ ID NO: 985315 - protein, 70 aa, Homo sapiens
TCTDGWTYSCIFTSSWSISTLGISGVHYYELCSYGTPRLIRSFHYRTLLLGLALCQGSLDIFRSTQKTDS

SEQ ID NO: 985316 - protein, 34 aa, Homo sapiens
GGGYLIYAYFHDQASASWNPRRLKVSCAAIPLHA

SEQ ID NO: 985317 - protein, 105 aa, Homo sapiens
MCDAPRQIHVTAAAGNARDGYWPAGALMETDASTGKWQELTPTLSNSCEVFPHSRTRVQAQQGDYAWALWRPYSCCRRRGQVFLGSVDFMEEPTMNASLPDFLRR

SEQ ID NO: 985318 - protein, 90 aa, Homo sapiens
LAVRLVRVSGLAAPAAWRQRCLALCVRPEGRTRTASTGDDRCDHAGVGLQYIGECVGDATRGRLTLAVVAGVRVVRIAAVVAGTAALTAS

SEQ ID NO: 985319 - protein, 43 aa, Homo sapiens
SGQVGRDARFESEAYVVDAGKRHIGGTDYYGHTSQLPKPPIID

SEQ ID NO: 985320 - protein, 53 aa, Homo sapiens
DSERVNSRQAGLKAIFFMMAVTTSPTQVPVSISKAIFSHSTSFNAAILQPVSL

SEQ ID NO: 985321 - protein, 65 aa, Homo sapiens
MAQSLSTRGGKFRLTASWAVSGCSLLYGLLSIRSTAPLANTPGAALSAGARAFSTDTTCLRQATA

SEQ ID NO: 985322 - protein, 35 aa, Homo sapiens
GFILPPILVSLPASVSGTLCPRAPPGDAALSGYSG

SEQ ID NO: 985323 - protein, 47 aa, Homo sapiens
FLARWLSSTLRSLADGLLRQKTLIWIGLVEPAQSNGGKIPQPDSTKG

SEQ ID NO: 985324 - protein, 56 aa, Homo sapiens
GGQAGRLFIAPTAVFPTLRSLARRIAPAKNPYLDRVQSSRRKSNVWENSACRLDKT

SEQ ID NO: 985325 - protein, 63 aa, Homo sapiens
MLHPRLIIAVTLNEASPPLAGVYVYATLVRALISYAAFMLAVVADAATLLGGATAFCDDVDFS

SEQ ID NO: 985326 - protein, 37 aa, Homo sapiens
RAGRWRTCACRLVGLSAVTQLAEPRVLSLMMGTWFLA

SEQ ID NO: 985327 - protein, 41 aa, Homo sapiens
LQLLSCEHCSTVGCLGGGVAVGGAVVTLLLPFLPCGRTYSS

SEQ ID NO: 985328 - protein, 36 aa, Homo sapiens
MGRADSAIIKVGHNGKSSPSGEKRRRSKFGDNAARD

SEQ ID NO: 985329 - protein, 101 aa, Homo sapiens
KRGQLCYKVAFAEFGEYPSKCSPSMLIRDARPEDALCMGVLGMQVFLDTYATEGIRDSIAAEALQAFAPQTISALIAQPGTAIIVAESNGHLVGFAQVAMD

SEQ ID NO: 985330 - protein, 34 aa, Homo sapiens
IVRAFLCLYLACRLSQIRCGGEPVQAPCSMQNTK

SEQ ID NO: 985331 - protein, 38 aa, Homo sapiens
LSAIMGVDDHVGLQQGAFQVDSGAHSEPCRAQRCRASR

SEQ ID NO: 985332 - protein, 63 aa, Homo sapiens
IFRDLIESTTHDPYPYHQHYHYSLSRTTTHDPNPYHQHDHYTPIEQLTDRNTTHYPYPYHQHY

SEQ ID NO: 985333 - protein, 66 aa, Homo sapiens
MVLVRLSQLIPDRSQLSAVTTPWGIELHKDVFFLIKSHVFTVLPNKHLDRLLVPILRQLLAHQVGL

SEQ ID NO: 985334 - protein, 38 aa, Homo sapiens
CCSRGSRRSQEEEPDSKKVEEDLKADEPSSEEGDLLHD

SEQ ID NO: 985335 - protein, 89 aa, Homo sapiens
GNAESHFMNKSTYDSGPTSSTWLMSRIQATSPIVPIQDNPGRSIPFHHDRVVRITLRALIVSIYEAHFLMLTILLPSSSTSIVYELTPC

SEQ ID NO: 985336 - protein, 34 aa, Homo sapiens
MKDQPKRTRTGWYHGNPGKRGLQKGEVIFWRVPE

SEQ ID NO: 985337 - protein, 58 aa, Homo sapiens
SYKSTKHGKKDTIIIHSTNAVRFKLTVVHGLGNLCSSQNSHIKMKATKSELINYINTW

SEQ ID NO: 985338 - protein, 77 aa, Homo sapiens
AFFGERALLFCEARLVCRSLNRGHFLWSRVPAVEEEYPARFRLFFNFLLVHGIYSDTPPQFLKFCLAERGGSVIQAL

SEQ ID NO: 985339 - protein, 32 aa, Homo sapiens
MCPAAHWACLITQQWQKEYLPDASYHSILSPH

SEQ ID NO: 985340 - protein, 87 aa, Homo sapiens
VPKNQMFMSPRGNSALPVNSYTTSTSPAEEQAEVMWSTAMPVEEPATRMLNPRIPVSVYESQFCLASKGMRVLPPEERSVHSEAFSF

SEQ ID NO: 985341 - protein, 44 aa, Homo sapiens
SFYTEERVIPREPVFTGHRVTPGNRLSPGAGIHWGTGYTRGNRI

SEQ ID NO: 985342 - protein, 118 aa, Homo sapiens
MRVTRADVPKEKAGWGEEAGLLSLSGPELMPLLSLISNTPWLFVLSSASCCPISPLYIHLSFSMAVSVSLGFSGRPLFLPCHLSRYIQLWGIRLAVDPARRLQALSTGLIVGQQSVDL

SEQ ID NO: 985343 - protein, 44 aa, Homo sapiens
MLMANTESECRSVLPYSLCLIFLTTLSPFSLHQNSFSPHSFILV

SEQ ID NO: 985344 - protein, 71 aa, Homo sapiens
VKRAINVTEEDKYSDYGGLNNNSYILPGSYLEPCELRLLDVNESSSTPDGSPHSYNNYIYKTSCTHELSPH

SEQ ID NO: 985345 - protein, 86 aa, Homo sapiens
TQARAPIRLTREDILLVGYSYCVPAIGPWKPYSLVMRDVYSLRNVLEGLLVIEAKVRALDSSQGLILSSCGIVSPHTTTFLFSCPP

SEQ ID NO: 985346 - protein, 88 aa, Homo sapiens
VVNRTDSEDNGAIRIVLLLTCVIITSVSGILLVEVQSVLSDSCSILDRPGRQGDTPAAVDISLRISDSAFCSVQIQTVLSVPLCEWLV

SEQ ID NO: 985347 - protein, 47 aa, Homo sapiens
LQNYAWTFYFCAPPWGYAPKTHWPSNDMCAGIASQVARNSELRSTIL

SEQ ID NO: 985348 - protein, 98 aa, Homo sapiens
ILTCRRGENPVTGLTQIHTPVPNCWTKTTNTTEKSYKTEDNSEVKTAKSGVDDPKARLTHSMQKDNDDNHSNNNNHNKTKVQVKSSAWGVQLQAGEGA

SEQ ID NO: 985349 - protein, 50 aa, Homo sapiens
VTSGPLFPESDIHISSRNTGQRAVLKDTLLPLVASSKLLAASLLEPSLSA

SEQ ID NO: 985350 - protein, 47 aa, Homo sapiens
GGEGLRRQLTRKQRITETESPYQELRGHEVSDVYMRPQHTAGPYYKL

SEQ ID NO: 985351 - protein, 53 aa, Homo sapiens
LTPGTGMPTDKKKVWAITPGDSKKQSRIAVARCFNSCAECWGRLEGVCLPVLV

SEQ ID NO: 985352 - protein, 49 aa, Homo sapiens
AGITGMSHQAGPPRALSVGELWGSTLSSFTRPGEVPLLVDRFRSFQQEE

SEQ ID NO: 985353 - protein, 111 aa, Homo sapiens
TVRKSESLLCPDISQTNREDEKMCDHLIRAAKYRDHVTATQLIQKIINILTDKHGAWGNSAVSRPLEFWRLDYWEDDLRRRRRFVRNPLGSTHPEATLKTAVEHATDEDIL

SEQ ID NO: 985354 - protein, 118 aa, Homo sapiens
MILRISVVHCYPGKPSSYNYYYYYYYYFLRRSLALSPQAGVSLYLPRLECSGTISAHWNLCLLGSSNSPASSSRVAGLQVHAQLIFGIYSRDRVLPRWPGWCETPDLRQSTCLGLPKC

SEQ ID NO: 985355 - protein, 78 aa, Homo sapiens
QDYSIISVPLPTQMRVSSYIRYKQLEWSLYTALCAEGKLPLVKNKGSEGIGPPHPDEEYNDNDNIYRSTECVAYGSMF

SEQ ID NO: 985356 - protein, 100 aa, Homo sapiens
ITFTSINQLDQQEKVVGCIATMFRDSNVQEEISREKKKCQSKIKSQSTYATTEHGSSYIFIQPVFIQSSRYMSRCKSLAPLLPFLYPSYQNFTYQSRIYL

SEQ ID NO: 985357 - protein, 143 aa, Homo sapiens
STVSVLVNFFFLRDSVWSWWSRRECRRKIILPGSRKLRTSKDPPILASSVAGTTGAHYYTQLLVYLLILEMDSGSVARLEGRGAISAHGNLRLPGSSTSPASASRVAGTTGTHHQAQLILVFLVLVETGSHPVGKAGLQLRTS

SEQ ID NO: 985358 - protein, 78 aa, Homo sapiens
AVLRIPRCLVQNTENGAQCRACCWQRAEGRAAQLSSRSSGKPSYRGPCVETNNEEHGGPVGTPTTLHSLHVTMMDDLA

SEQ ID NO: 985359 - protein, 62 aa, Homo sapiens
MVSGKNGRNTGKQEVTTGSSRGHEGTGEGAWDGDGPGRTATHPWNHSKGSRILILILTIWPG

SEQ ID NO: 985360 - protein, 53 aa, Homo sapiens
LDLLLLLCPWSLLVCHGEGKDLCLGVTNAWKLYLVPHGFIWHQTGDPWVLPSH

SEQ ID NO: 985361 - protein, 83 aa, Homo sapiens
MERRRSALRHIGIDILIIRVLIYRRERRKTDFLFLTGKGMTHLRQTWKPKIEVHIMPPLESLDQPPRLQCNGALLAEAVRIAR

SEQ ID NO: 985362 - protein, 52 aa, Homo sapiens
VTSLSSTEADAVVELVTLHPRQVLCGVKARLCFSKPSAASGFFKLSSGSLIL

SEQ ID NO: 985363 - protein, 81 aa, Homo sapiens
RNSRSRPGCPYCLVEGELDLWEGAASCIAERARVRWSVWKEEGRDEVERGGRSQRGIWPQTALANDQDRQAVWCSGCSEGR

SEQ ID NO: 985364 - protein, 34 aa, Homo sapiens
MAAYPSDTQAIHVPKQIHGLSPRLSLQTCIAVCA

SEQ ID NO: 985365 - protein, 55 aa, Homo sapiens
LGRIGEQRTLYRQYEVYTSYRYIVFKETSAVAEIASLVSLTISSEVVPPLSGLVL

SEQ ID NO: 985366 - protein, 53 aa, Homo sapiens
YLWTKRRERAKSVWYYFGANGKAYKRSDSATGDVSLKTINGKKYTFNTDGKMQ

SEQ ID NO: 985367 - protein, 45 aa, Homo sapiens
MRPRTELLKKILNQAARVLRIRRLNVRRMDRKDSLLLLLLKLLKL

SEQ ID NO: 985368 - protein, 72 aa, Homo sapiens
SIRMSGHYQYPKVPEIQYVPIHNDEFFNCKAPYLPLGTHIKGHSGKPTMHQYHISAKADLSDKFFATSEGFN

SEQ ID NO: 985369 - protein, 84 aa, Homo sapiens
ALSIVDKNWLMQTANGRRCQQRMTLWYLKDYGHTIVVTVWQTIREVFAMLASLSGNEYEHVLWQDDFDNTPPNTLLEFIQHDIL

SEQ ID NO: 985370 - protein, 39 aa, Homo sapiens
MGPTTTKNASNSNETGGGGPAKWYPRLCPNMGCEQGDPS

SEQ ID NO: 985371 - protein, 107 aa, Homo sapiens
SSSAQQSLLSWLIREEQQHSSPGGMHRQTQRRPMDDYEGKDVATRVGEAWQESLELQEVAKETQLYPLINLQIPAPQSGRAAPADLSNLSDKRVVAAACRLIHTGGT

SEQ ID NO: 985372 - protein, 111 aa, Homo sapiens
GYLASPSQHEPTTGTRVRARAVQALAHLARPASRSSLDFMHLVPVSHSFPISAASNFLHLSKWGMQLTCLFRHCFSAISTKMSKHFALQHPKLHSTGHSSVFVPLLSHSPL

SEQ ID NO: 985373 - protein, 38 aa, Homo sapiens
KSRYWALSKGREGYIVECALNLDLTGEPNGTRNVSYCF

SEQ ID NO: 985374 - protein, 79 aa, Homo sapiens
VTPPGYLQKNLSHAVLRNAALLRWAQSLWQKSWIGVQRGADQLCNPAGTAKASALPPAKCPICSQVCTGPLSALRHAYQ

SEQ ID NO: 985375 - protein, 130 aa, Homo sapiens
MWLAQRDSQELGLRFWLRTFGGFVQLVLHYGNRKNLFAVPKNYKNTAAGGEEESLPGRIGPNNVCRCPALKDPERDFASFSVCCAQRGPSREHCMEGGRSSLAVEKPDTLSLSQVIKVNIDNNKPVRQHI

SEQ ID NO: 985376 - protein, 96 aa, Homo sapiens
MAVMVKVFAAEMLNFRVGKVVTGPWLEIFTLQYQRYCLPRNSLRRTEVFLSSWRVGCSMEPTFFPFLAKAVPFPQPIGATLVGLEVWAEVFPWVPW

SEQ ID NO: 985377 - protein, 88 aa, Homo sapiens
SNTRTALQLTRGPAGQEAGTDAGQVWDPALLPQLGHDGINPREACLALSPLGQGLRIAVPGDLDADGVPLHAVKPGVVGSCRVEELSP

SEQ ID NO: 985378 - protein, 32 aa, Homo sapiens
FKTEQKQKSEKSNPHVMDQHWNYILGDSSSQE

SEQ ID NO: 985379 - protein, 37 aa, Homo sapiens
MAALGPKGGRTNLLLGLGKRQTSGYPGPASGYHLLRE

SEQ ID NO: 985380 - protein, 57 aa, Homo sapiens
RIRYAFISVIIFDFLSHIVGSFARSLNRNRVSSVDPAAGQSLSAFPMSAAFHSLEQL

SEQ ID NO: 985381 - protein, 104 aa, Homo sapiens
MRSTNCVLGFSYILKVLFIHLTNINKGLINGPRNIGGIEGKKKNINSVNITESWEVVYHFQNEVILQMSETPGSITMNVFIIISKVKNSNNSPHTQSELYMKTA

SEQ ID NO: 985382 - protein, 53 aa, Homo sapiens
SLLSFFPFISLLSILGRSFFFLLSPVLLLLHHFFLSLFPAAFSSTFSFYSFRS

SEQ ID NO: 985383 - protein, 61 aa, Homo sapiens
MRLSALFSPFELVFIYCCYVKVNFISLACGYPVFPATFVKNLSFFPLNGLGSPFPKIPLTI

SEQ ID NO: 985384 - protein, 120 aa, Homo sapiens
GLYVICNNFFETEFCAVQAEVQWRDPGSLQPPPPGFKRLLCLSLPNSRNHRCVPPHLDNFLCIFSKDGILPCWPGLSNSWPQAICLPQTPKTQSAGITGMGHHAWPNVTNFFFFWRLHFT

SEQ ID NO: 985385 - protein, 72 aa, Homo sapiens
LYNILGASKGKEQDYQANGKQKRTKVASLILDTTDYNNGQKGQRRALHNDKGFNSSRRLNYPKDTCTQHWSI

SEQ ID NO: 985386 - protein, 37 aa, Homo sapiens
AEPVLSQLRYRSSRTLYVPCPPPPSTDTSSGYKGKTR

SEQ ID NO: 985387 - protein, 106 aa, Homo sapiens
MLNSAEQVWEAAKETEIVVVVDEERFELWISEFERLFTSSGIRYVVDPYLPFGSSGVMEKLLLLVLLLGASGAAQPQSFEMPLPPAQILPASIATKLWDADPRVES

SEQ ID NO: 985388 - protein, 77 aa, Homo sapiens
MMYDDIAYAEDNPTPVNCDATVPNGTDVYQGVPTAYTGEDVTPQNNHCCAERRCRSTVKGIRSGKVHEKRAPSASRV

SEQ ID NO: 985389 - protein, 34 aa, Homo sapiens
PRYPQDESPTTRTTFADGRQVTSTSIGHQGTPAT

SEQ ID NO: 985390 - protein, 37 aa, Homo sapiens
MHPVKLKVPCEDAGYPRQDGNDPMELYSSLVLGFGNT

SEQ ID NO: 985391 - protein, 126 aa, Homo sapiens
ADFRSLTTGALWRSSFPLGMGLPESWAAVIVIALLGLATQLGYQAWDAAGECLRRVLCCDPSSGLPAMGSSTCSAGGGGGVKWTLGGSLVVVLLSALAFSNAGYAAVKLSRGQTRDLWTARRLRCL

SEQ ID NO: 985392 - protein, 48 aa, Homo sapiens
KHRNHKLLWRGRRWLQEERLARPSHRNQGQDKVQRNKRGSTERSSLGN

SEQ ID NO: 985393 - protein, 31 aa, Homo sapiens
MAELALHGVPLALGHSNMLCPRVSPFPPWPE

SEQ ID NO: 985394 - protein, 34 aa, Homo sapiens
RILKVAGPFGLEDQRYKAEEGQELDSKENDLLVT

SEQ ID NO: 985395 - protein, 36 aa, Homo sapiens
MVLQEILGLARMLGQMLINVADLRARGQGSSPVAMQ

SEQ ID NO: 985396 - protein, 120 aa, Homo sapiens
VRLILFTKHPRNHPHNSHGPMVGAQPLYISTGATFQKMFFLIKHGKNSTLREEKRLKKGLIFPGGEKRLKPLSERFTFLKCIYFINHRLASQTSPQRHLADRDILETHWRQLIYLPLLQD

SEQ ID NO: 985397 - protein, 108 aa, Homo sapiens
VWRSRGSLHGRRRRHLLQSESPGCMPQPGGNRLNGTQEMGPVGMTENCNRKDFLTCHRGTTIMTHGNLAQEPTDGTTSNTEMCEVGQVCQETLLLLDEDSHQPCLRTY

SEQ ID NO: 985398 - protein, 36 aa, Homo sapiens
HRFAGQHVLMKRLHARYPEDLANVLIDVGGYITQQI

SEQ ID NO: 985399 - protein, 65 aa, Homo sapiens
MLAGRKAALFLQRFDSIDTTGPAVLASLFHPSVLYLPFPHVLEFLFLRTPESQTEGPGGDGFLDW

SEQ ID NO: 985400 - protein, 104 aa, Homo sapiens
MLSHHPFLEHLCFLLQDLHKLKVQEYLMVQERDLKPELFVGAVVAVTVLELPLLDELDEPPLLLDAVEFERVAIEGVALDTVDLTTTVEVPGIIISEGAFSPSI

SEQ ID NO: 985401 - protein, 32 aa, Homo sapiens
MVRYASFSFTFHHDGQFPEASQPCFLYSRRTY

SEQ ID NO: 985402 - protein, 138 aa, Homo sapiens
VGDLEDPTYMAVHIPYDLTTRCPEHIQQSVAAEPNFCWLILVPLTVRLIDRPTISCTLASGARCINYFESLYCPRKVELINLLSLFLSPYVLYHFLLPPFPYFLLFVPCVLPDLPFVSSLYNPILCYLTQCSLPLLSF

SEQ ID NO: 985403 - protein, 142 aa, Homo sapiens
MAVDQSSISPGNRKALDETLKKALTVHLEEVVLALVKLQRNCVLMNFVLPGRGLEPDEDTLIGILASRTNKEIRDINRVYREELKRDLAKDITSDTSGDFRNAWLSLAKGDRSEDFGVNEDLADSDARALYEAGERRKGTAI

SEQ ID NO: 985404 - protein, 34 aa, Homo sapiens
HGDGSCTFFRGSEKLLEVGSPGSSRRKQGLGIFA

SEQ ID NO: 985405 - protein, 43 aa, Homo sapiens
LEIRLASLWNTRDFAQGLVSLQAQDHLPKVQRQLPGPPQCCLL

SEQ ID NO: 985406 - protein, 50 aa, Homo sapiens
LDDRLLNGCHSLLASVQMKLLQFVPVILFQSDPSITLLSYPRVSKETLLR

SEQ ID NO: 985407 - protein, 100 aa, Homo sapiens
DPKYAVSPWCAGICLNFVYDGLWYDFCLTRPDNSQEFGRQPRPLQPCDSFDSPTYMLPTCCCKEGHHMLLKYCSENTEVNIIIITCNWNMAGSHLWKISM

SEQ ID NO: 985408 - protein, 57 aa, Homo sapiens
MKCRCSVHNPEPENQDEHYHDPQEFSAYVFGKQHANQLLCPSQGSQVCKELRGAPIP

SEQ ID NO: 985409 - protein, 71 aa, Homo sapiens
VDCIRIPHIDLIVRIDRPSYRDRDYDNPTAAGGRLLHLMEILNVKNVMVVVSRWYGGILLGPDRFKHINNC

SEQ ID NO: 985410 - protein, 45 aa, Homo sapiens
QGSVYESDQLRYAYGTATLDCTARMMSDIECHTLVDVTLVSDSLY

SEQ ID NO: 985411 - protein, 117 aa, Homo sapiens
LYNVSAILLHQQECMGVGMVAQIASLQSIVSQGSIFICELEMKSQCKSRQRNCSKSRLLSCYVRRFQAIKVELWHCELYRLLSGLQQCSHICKVGEPLSIPRHFMFKPSTSRFSTSK

SEQ ID NO: 985412 - protein, 70 aa, Homo sapiens
LRTVYVHDQDVFEATREQYKYCVLCGKDIEPSCVHFEISCVSLNMLITSEPCEIVPCVAEDQSMLRFQGV

SEQ ID NO: 985413 - protein, 98 aa, Homo sapiens
MRSGTSLVIPNAATLVTLYACETAYICFCRPSIRCGQVCEMQVLEFTSSLPFKNVHFRDRLFSVTEAGVQGLHHSSLQPPTPGLKRSSQLSLHSSWDC

SEQ ID NO: 985414 - protein, 99 aa, Homo sapiens
MKYSLNVTEHLLEKLTALHWAVLLGADLLRVEGRSGLFLPELWHQGYSRAWGLNYSSEPVPPDRAHYIDDDKFSRVCHDLEGLLVFGMSCRVIGHLTKA

SEQ ID NO: 985415 - protein, 90 aa, Homo sapiens
PGELRVRGVDARSTGAFRVYTIEDGNKQNTLEPEIDPSSNTSKYPSQETSGLHEYLCRMRSEMILWIIPAGCHCCTTFSDHIHLCHYAYM

SEQ ID NO: 985416 - protein, 43 aa, Homo sapiens
MSKDSLWNSGFQCQCFEGDYEEAGSTILKSFGKAPNNIVNSGV

SEQ ID NO: 985417 - protein, 72 aa, Homo sapiens
RERCDLNTLLIEFSLLTYPISPLTIATFHRAVGHQHNICKKVNAFSTDLSPSGASPESPFIADTPKSLSSST

SEQ ID NO: 985418 - protein, 68 aa, Homo sapiens
AHRGGWLPPSPPQGRKGPRQLRYHTHYSTALAAACVQILFTYAASVFDPSRTAKDLTDSINLAIPHHP

SEQ ID NO: 985419 - protein, 56 aa, Homo sapiens
MSCASDKSSLVTNTNRKKLKKAGVMVAHACNPGSWEALQGGGSPYGREYTTSRGNL

SEQ ID NO: 985420 - protein, 72 aa, Homo sapiens
MHRYYIISRLICQILSKTKLKSKLTEKVDTFYSHLILVNFPGIFGQGIFPNRNDNTIPDSRMLSRIPSCLYR

SEQ ID NO: 985421 - protein, 60 aa, Homo sapiens
PWSCLVTYKAQLELVASRAKKPKVQSGSESVIQEYVDLRTHYSELTTLTSQHNEPHEHKN

SEQ ID NO: 985422 - protein, 64 aa, Homo sapiens
VLEDTFLCWRVVLGVASVVAWVLAWWWFAGGDGFWWAEGSNSLNTEKTLCDNNESKTGPDKNHT

SEQ ID NO: 985423 - protein, 82 aa, Homo sapiens
CGSVLACRNFKTIHHHQGLPFSTFVYLTVILTGGHWQQGSGRMKLVPGNGIGIQSRLAFQALNAAGMKVKSFSSVPTSKEPH

SEQ ID NO: 985424 - protein, 37 aa, Homo sapiens
DLEDPFLCWCWSGGMLVYRGSCSQTGASSFQLFPSKE

SEQ ID NO: 985425 - protein, 92 aa, Homo sapiens
EDPRGVLMRVCGYIGVGESERKILTLVFLAWEEPSFFHYIIILLSSCGADPYFYPRSGASARQSKAYKTKYFSFRHLCSDGQTRNSRPSQSS

SEQ ID NO: 985426 - protein, 127 aa, Homo sapiens
SNDVTSNGISCYLLRITYILQSKISFLISLLSVPSVSTPSSESFTISLFLCATLSVPLPVLTHNRYPAPRPRRGPTFFLQLPLSHPYNPLYRPRPTHNAVHAYSFCVRDSALPNQFPLREVAGPIFR

SEQ ID NO: 985427 - protein, 35 aa, Homo sapiens
TESLSPHQPANLPQHQRVRTEELQQIKTLNNKCAS

SEQ ID NO: 985428 - protein, 38 aa, Homo sapiens
NESTRLPYNLQNRTTASRGLRTEEREQLNTLNNKCASL

SEQ ID NO: 985429 - protein, 37 aa, Homo sapiens
ARVGIPTSCILKGHQQTEDAKESNTDKGSHYVQSTKL

SEQ ID NO: 985430 - protein, 131 aa, Homo sapiens
VLVSSPRMVGTPASWVHTLPFTRVNLAWGYIRRRREPGQAHCHQWELELVEVGSSPQLEGPWPRCLCLCRGGLGEAQHLAAVVPPGPHPWQRGGGGGSHGGLEDTVGLDGSDDDLLQLLQSVSLVPAFQHK

SEQ ID NO: 985431 - protein, 44 aa, Homo sapiens
SRGPDMCLTWHNCYSLAGPVGELSQFTVICIGYGFSTETVSPSW

SEQ ID NO: 985432 - protein, 35 aa, Homo sapiens
AKITSDPVIVRTITYITLSCRYDGFLEDVKTVGLD

SEQ ID NO: 985433 - protein, 112 aa, Homo sapiens
LGNEAGVWCCCRVKAAMGQDAGLLNLAADEQKGRTHLLPYSTVCKHKKARPVPGPGAVLCPPLFVLALLSAAMQAVAGQGREAIAGRDDVARAGQGGIFSDCTDKAQERDSW

SEQ ID NO: 985434 - protein, 44 aa, Homo sapiens
HEQEPSMHAWLKVDVYHHCGACLPVQVRRHVSTVLTIQISLSWS

SEQ ID NO: 985435 - protein, 69 aa, Homo sapiens
QYPSMHACVQGRRVYTTAVHASLNKYRRHVSTVLTSKYVKLEPGRRVFNIAVHVSLYKFRRHVNTVLHS

SEQ ID NO: 985436 - protein, 46 aa, Homo sapiens
MNSLTLRLSFLALLPMTKVKKVVTTVINGLLLALSDGSAAFFRGEQ

SEQ ID NO: 985437 - protein, 32 aa, Homo sapiens
CGSFLAVNTEVNSTKIFPQPGTSTPSTVPGES

SEQ ID NO: 985438 - protein, 56 aa, Homo sapiens
LVWLQWGCVDGNQPKESTLETLHPARVWVAWVCHSAPAPAGPTPELRVSDVTQCLA

SEQ ID NO: 985439 - protein, 79 aa, Homo sapiens
TLEDDKSSVIIYTELYSSRTKLYKLVHTDNTARSHKNYEPHIPRQYKYMVELTSIHITNLSITYYNNWPRYPNMKLHSS

SEQ ID NO: 985440 - protein, 59 aa, Homo sapiens
MLNLLGMQPSRSQPYFTQPLFKNGVALIQITLTLGQTPRTQTQHGGKRCIASGLQVKDE

SEQ ID NO: 985441 - protein, 78 aa, Homo sapiens
MEQALHMWVEEMNRKRVPIDSNMLRQKALSLYQDFCKGCSETDTKPFTASKGWLHRFRHRFSHHYKKKKKGKYVTTSY

SEQ ID NO: 985442 - protein, 59 aa, Homo sapiens
RYLCGAEAAEAVATQETRAQVDEGRSFSPSTTVVAPSFLTSLGSADPALCSWTYTPQRE

SEQ ID NO: 985443 - protein, 72 aa, Homo sapiens
PDLSVGDHRKSLLSSHLEHSRAHGTLAQGSLTDSLPDTSMAERLKNDTYLIASEAPWTITDAELPVNSQSGR

SEQ ID NO: 985444 - protein, 38 aa, Homo sapiens
MQHSDDRCTFADMMIASNISIYTQIVVGPQIDFNKDRL

SEQ ID NO: 985445 - protein, 104 aa, Homo sapiens
NTITGSQIQAFIDDTSNIQIQSEPVDVAYREKVPVLSLKSVVPIARAYPRLIASLEKYCALSARIEAGPLMGDIVGPCFAKDLAMKKRVALVLGSGGARGYAHS

SEQ ID NO: 985446 - protein, 35 aa, Homo sapiens
MRAHAWQGQSADSDPLMTILGKSSKCNLQWVHLTH

SEQ ID NO: 985447 - protein, 114 aa, Homo sapiens
IQRHATVKHVHESQQDVTILIQYHNDEQTDLEDLLLGSDSETHVQQLTGLRDASGVSFNWTPLKWEERCSRTNLAFLCGFYRVSSVLPGCAEPCNHGKTFNCTACLPRVHTYLG

SEQ ID NO: 985448 - protein, 64 aa, Homo sapiens
MSPSLEAERLQTIYLQVDRFQTLMTTEQPRLRVPGCKPDLDVQTKLYDCLEEHLSESNSSNLNP

SEQ ID NO: 985449 - protein, 53 aa, Homo sapiens
SAGSTDWGSPYCCSQPGCACWHFLLLLPAPLPIDENGQGEERRELSVCTAVRW

SEQ ID NO: 985450 - protein, 45 aa, Homo sapiens
SWDGWAVLLVPASDPGTVVAGLHLVAQTVRDLVYHVVALHRYCMV

SEQ ID NO: 985451 - protein, 135 aa, Homo sapiens
MTDVVYSTAVTGLLSTGGNEGPGATPSRGCSRESSSPKQARWGCVCSVTCAPVNRLGAQLLRNLSLRRCCKLSFPCWASAGTELGFSSSGQSCDLQSPPSLELRAERSQNHREAGDRVVCMSLGFRIQTKGRSVY

SEQ ID NO: 985452 - protein, 67 aa, Homo sapiens
LYRSPRANHLDVNATYRKQLEGDECRLNWRWPWTSQHLCGAVHRSPVVYGRCQVVSARGFRPVVELS

SEQ ID NO: 985453 - protein, 144 aa, Homo sapiens
RVHITCIVSEEGGDSSWEVKGRAHRVLCLLSHDLQLSSPPLPTIGDRAVLTCSEQDGSPPSEYTWFKYSIVMPTNPQITRAFPNSSYVLIPTSGELVFDPLLSLWILDHFRCQARNGYGTPVTSNAVRLDAVERNVRVIVAAVL

SEQ ID NO: 985454 - protein, 43 aa, Homo sapiens
LTSELPRLQRKLQHDVLKLEFERHEPVDGRSVLRGSLVACYLP

SEQ ID NO: 985455 - protein, 63 aa, Homo sapiens
YVDLEIPSQTYLSIISLLALGFIVGLGQQHWVLLRCHAQARCTNRSGARIFSTVVPTLIVSRL

SEQ ID NO: 985456 - protein, 46 aa, Homo sapiens
LLLEIPLQVQPLFSDGGAAQKLSDELSCNQTGEGQAERPPSVHQTV

SEQ ID NO: 985457 - protein, 75 aa, Homo sapiens
NAQTQGIGRLFGAGGAGYSHADLAGVPLTGMNPLSPYINVDHENTLRVGYTLCTCTHTVTITHRVIFHLTFCTMD

SEQ ID NO: 985458 - protein, 43 aa, Homo sapiens
LLYRLSERLMELLISSAVWCKDISASSSLLGIFTWSVTGGRRE

SEQ ID NO: 985459 - protein, 73 aa, Homo sapiens
ACSDDSVSICASCATTGRTKAGTQQGTAAAYQEIDVNWSTNYAAHTNEEKDNAEFKLQLKGSPPGIFQSYALA

SEQ ID NO: 985460 - protein, 59 aa, Homo sapiens
DSPDNGRSGWERLRSRGRRPRRHWTPPLSGLPHSCTYGQPAPSRDLNPTAYTVLRPENA

SEQ ID NO: 985461 - protein, 59 aa, Homo sapiens
ILEDPSFRSLSVCCFLAKVNLLVMVWPRSSAGTKEVLPILLHLRDDLEVAGLFDYIAGD

SEQ ID NO: 985462 - protein, 49 aa, Homo sapiens
KLDLADDANLLCCLRQPRSLNDASCDELRSPVFLASSSCRNRSGGNNVP

SEQ ID NO: 985463 - protein, 89 aa, Homo sapiens
ILVMPWLPRIPVRRRQTGTPGECGMRFGQEDITRDRFRINIPPDIDLTVAAAPRSVQLVNQSAAAFIAFFKKLFDLTAVMPFGACKDIG

SEQ ID NO: 985464 - protein, 52 aa, Homo sapiens
APTDVLQVTAGRHGDDHAQHQRRRLLEINRMIQTAEHLSIDHDQDSSCANHA

SEQ ID NO: 985465 - protein, 103 aa, Homo sapiens
FSLEKLLAAGSLTALTAESPPEVFGAYCWRELKRLGHLRGCCRSFSYDCRPFQLKILLQSPLSSTKQSSDISSTRGQGAGVRHLGQVHLSSGIRDLPHRESVG

SEQ ID NO: 985466 - protein, 108 aa, Homo sapiens
GQSDVRAMYGCGDRLPTATLLEGEELPAEWLHGVGHMSTISVVQSTVSSVYGGASGVGSGLGPGGAKQLLLWQWSGREESGYQFQHREESLRVASASLGCGSSTIKYI

SEQ ID NO: 985467 - protein, 127 aa, Homo sapiens
RGQSDVECVKKHLRWAMEGPASSYSVLGDSTSAGTVDSEVTDGCRRVHSRSILRSGRWRVTLDLSWMHGVASAGDLVICMSVSVSQGYIVVCRRLPESSTYAVLVLAGGVKGQHGLDGHVLSRTSVL

SEQ ID NO: 985468 - protein, 91 aa, Homo sapiens
TSYANVKQWLQEIDRYARGNVNKLLDGQQELHSPPKKVVDNNTAKEYADSLGIPFYGDETPSMPPMSNRAVHEHGCCLGHVSDAHSGVPNM

SEQ ID NO: 985469 - protein, 46 aa, Homo sapiens
GVSRMWNQHLGYVLTWPSNLGTGLRGGVHCYNWRTVSKQPKFEVDP

SEQ ID NO: 985470 - protein, 55 aa, Homo sapiens
TEFSLWGWTLHLLGPRNEYQGQVLCVHSWGSCTSCDDVQGLGREADTLGETGSVP

SEQ ID NO: 985471 - protein, 125 aa, Homo sapiens
RASYGCGDRHLPQLLEGEECRLNGKALRQVNVSVVQSTISSGYRGASGVGRGLGLGGGSSYSYRSGLGIGGGFPSSSGRAIGGGLSSVEAAVPLIKYTTISSSSRKSYYHHRAASSSRSHIRTGP

SEQ ID NO: 985472 - protein, 132 aa, Homo sapiens
QYGCGIMLRLQLYRTAMMGWGVRASADHPIRVTFICEYVGELISDAEADVREDDSYLFDFDKDGEVYCIDARYYGYISRFIYHLCDPYIFPSGFFMLHHDLRFPRIAFFSSRDLRSGEELGFDYRDRFWVIV

SEQ ID NO: 985473 - protein, 87 aa, Homo sapiens
WTDVVVGDDLVAWHRTDRLRPSVEMWMEMLMSGKCEGCSSLQERYARCLCWAASFHSSDPPATPGLRSIMAALIDCASHGSHCAVAM

SEQ ID NO: 985474 - protein, 38 aa, Homo sapiens
YRFLSVGGHIEDSEVQDMEEADGAQKHRCTPRMSIRKT

SEQ ID NO: 985475 - protein, 47 aa, Homo sapiens
PATDVEENMCPAAVTRMTCQLQVQAEQDNLADAEGALCISCIKQLVF

SEQ ID NO: 985476 - protein, 112 aa, Homo sapiens
RQFVCFSLSTSWVALNSWEISKGFLVADWMENNVGGGEDESRTEGKTRGGHKYSLDVSCLLVEMGSLGCVTSGLCVISDLHLTLGFIVVFNLGLVLVLQFDLRAPGLIHIRT

SEQ ID NO: 985477 - protein, 40 aa, Homo sapiens
RVQINEDAKWEERGSELAEMLPHLRHECKLLHLTSEVAGL

SEQ ID NO: 985478 - protein, 36 aa, Homo sapiens
RVPSTDVWAMWMLKGELRARMKIPSNMWVERLAKSD

SEQ ID NO: 985479 - protein, 148 aa, Homo sapiens
PVVDSLCHPRRPCRLWYPVGSGASGIHNPSLCRAYRLLLILLKLRPWLGKPLAPAVQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQ

SEQ ID NO: 985480 - protein, 58 aa, Homo sapiens
QLLLNPEFEALQPGPCGGELGGTVGDRSIVAGRGGPDRGRGVDQFKPLIAQEHPHWIR

SEQ ID NO: 985481 - protein, 57 aa, Homo sapiens
GVTYGCGQSFSNEHYGSCFLDPIAWSLPTVKDMAPGDPCIHRSHTENTALLRCCACR

SEQ ID NO: 985482 - protein, 63 aa, Homo sapiens
LTVSLSRLPAFTRFLPRAGVFSDRYHDVCSAWRLYRLGLACTDRCSVHVFECPPPTSSGVTLL

SEQ ID NO: 985483 - protein, 78 aa, Homo sapiens
WPSRMWKEGRKQQSLRASREGRTEKVCVVWLRNPHSDGAFLVPMKDAVAGPQLTIDHQASQGPQLFSMSMVLHIPSEP

SEQ ID NO: 985484 - protein, 54 aa, Homo sapiens
HLMPWDSLQCTENPHGVKAVTSGQLLCQYALVVHPVTLEHSDAGQGAVQMTLVN

SEQ ID NO: 985485 - protein, 42 aa, Homo sapiens
CLPLWHCVLFHMDKRNNNNNAITGIYPPFVSVSYDLVHLCTN

SEQ ID NO: 985486 - protein, 76 aa, Homo sapiens
GEILIRAISIPGGIIFNRPEVNTEENLERGRRAVTHPTEAILNKNNSVTSHQKPSEQDGMVVLVNNVAFANMVLVS

SEQ ID NO: 985487 - protein, 58 aa, Homo sapiens
HLLIGGGVAPSTPDGVYSEGGMRDLGEKNDTETKYRERNKGTQGNQTLTNSGWIPASA

SEQ ID NO: 985488 - protein, 39 aa, Homo sapiens
GPTAGARCDEERLDIMKVLITGPADTPYANGGFELRLAV

SEQ ID NO: 985489 - protein, 110 aa, Homo sapiens
ETQTLPCHPNLSLTPCAPATTGSDNMTRGGTGVEVTVPAGAIWEIPRRLQTRPGPLPLPCGTRSSIRAGVHPYSASSATLPGSHLVPSIPLGSTVPTLTGFSQGMGTHYG

SEQ ID NO: 985490 - protein, 56 aa, Homo sapiens
MHIQADTHSCMHTTGEHAHRWPHTRQIHTITCTHRSTHSRMPTGGHSHTQIDTQLH

SEQ ID NO: 985491 - protein, 59 aa, Homo sapiens
RGCGLTWLVGDRAVENLVPQVLNGLEVGTVVFDLSSAADDFRTKYETELNLRMSVEATV

SEQ ID NO: 985492 - protein, 75 aa, Homo sapiens
LTQVRSLTCIEYVYPDTDKSRGLSGGKYQEHELIIIFSPKPGMIGRKGIHTTFSSAFGIENMDFPVVCSHKSLVK

SEQ ID NO: 985493 - protein, 73 aa, Homo sapiens
VRVFDRGFSDTLVAFGTDEAHCLSHGRFLVRDLPVRFGHTPPAALNMDPVRPTAAVVLSEVTGRARLHPYTMH

SEQ ID NO: 985494 - protein, 84 aa, Homo sapiens
TEKCRDPIDRTQGVVVGRAEFSILTLLPSGHVILDQRLNHVGPLFSHLYNMGLICLCKQKKDPAPELSIKDAQWAYSQHTAILY

SEQ ID NO: 985495 - protein, 155 aa, Homo sapiens
ELVQHEGGAEVHRQGGALCILPDQDTMAAVDAMLLPETLTRRRDSLEYREIGELYCQSNPSRGDYNLERHNFSSCGIEEAFISKADLSGITGDKEPTQSPKVDHTAVLDVFEEGTEASAATAVTITLLSALVETRTIVRLTGRFLMIIVPTDTQN

SEQ ID NO: 985496 - protein, 57 aa, Homo sapiens
EAGDAESVVFYLKMKGDVTTRYLAEVDTGDDQKRLLDSARSDYQLKAMDISKKEKPR

SEQ ID NO: 985497 - protein, 117 aa, Homo sapiens
FTLIWLPSAKEAVTAADIMVTERIRETDVAEKISHICRGMKSPEEMRQQAHIQVVSTDPGQPGTTNHAPLLIWGARTIRHGYAVQHRHRPCANCGKHLADFSAHYGPTIMAGGILSE

SEQ ID NO: 985498 - protein, 41 aa, Homo sapiens
PGHVLLLSSSSSSSRSSSSTSSPKPIGREMASEICWAHIME

SEQ ID NO: 985499 - protein, 130 aa, Homo sapiens
IVRLAFKEQETLIIEPEKNASQYVNLWNKKRLMNEEEGQDRMSLACSKEEDEEDDSESEAETDKTKPLDYHVTNANTIQIHNAAPDRLLQHTTADHQNQDNNLHHHIKKFPTTDYKTFLPTEDERKDESP

SEQ ID NO: 985500 - protein, 120 aa, Homo sapiens
MDWDNLMCPSLILLMKGDMGRGKISKEKSFLDLVVEEEKLNLVAPDQLDLLEKCLKNIHRIDLKTKIQRYKQSVQGAGTSYRNVPQAAIQKSLKDPSNNFRMITPYAHGPDLKILGNGSM

SEQ ID NO: 985501 - protein, 80 aa, Homo sapiens
MARLSPKGWMWLSERCVPVQRRTGADSGKWRCVLKIGEHILLKPFAIIVKMPMYLARLLPVSLPGIIGPLLPIRWSLEIP

SEQ ID NO: 985502 - protein, 63 aa, Homo sapiens
YGMDLAESHHGQSCAMLVTQKFSHEEIAMETSTALRRTVSPVVTRISFLSGGQSEEEASINLN

SEQ ID NO: 985503 - protein, 55 aa, Homo sapiens
KPGVPASELERYKLERYRGREVQLIMQAEAEAASVRMLCGKLSAFAIGCPSPRPE

SEQ ID NO: 985504 - protein, 62 aa, Homo sapiens
MVVTLDPTRDQCFGDRFSRLLLDEFLGYDDFLLSSVKGLAETEETKGFLPECGVRAEPLPPW

SEQ ID NO: 985505 - protein, 77 aa, Homo sapiens
EPSDACFTTFLSHHIWQVSLDGRSRSTTDTLCSGDTGRPCRGSSRSVSGMTIAHMPWWSPVRGREFSSLSSVDPLSS

SEQ ID NO: 985506 - protein, 82 aa, Homo sapiens
EFRLLGSSAIVLWLIPAVLCALPAVLRNYRDSEPSVDAPIVPSRRPSSSSDTGLISVSSPSELSDGTFSVMSAYSVPQYSRN

SEQ ID NO: 985507 - protein, 145 aa, Homo sapiens
NSGSLEEKCCNGSGGAGGLQHGHRLLASSSHDWDDAEEEERENEEEQAAEEEAEEDEEEEEEEEEEEEEEPQQRGQGEKSATPSRKILDPNTGEPAPVLSSPPPADVSTFLAFPSPEKLLRLGPKSSVLIAQQTDTSDPEKVVSA

SEQ ID NO: 985508 - protein, 34 aa, Homo sapiens
KDEEKMELQEMQLKKAKHIAEDSDRKYEEVARKL

SEQ ID NO: 985509 - protein, 62 aa, Homo sapiens
VGSVPHIVAGERVKGEVRIRLNNQISCELTHYHENSKEEILPHDPITSYQCPSPSTGDYNST

SEQ ID NO: 985510 - protein, 39 aa, Homo sapiens
TVDRVLLHRCSNRRITHQSQSPFTSLLFLGLWLLLALLD

SEQ ID NO: 985511 - protein, 39 aa, Homo sapiens
NSSLDFNLSWALEPQQEQLWWLQPQGQSATKADGSAKQG

SEQ ID NO: 985512 - protein, 85 aa, Homo sapiens
GRFRKEHTERILKTSTPASLLIDDVSSGSSSRKEQHFSEVTSYYTYFYCHTPSQNEDSPCDHRTAQTVIPCYQYRSINHLCFPIN

SEQ ID NO: 985513 - protein, 67 aa, Homo sapiens
IYQMESVMLMARLCLGLPRRRCTRVTRGLATSISQASGRAPPKTTVCKITVATDTDTVMVATATATN

SEQ ID NO: 985514 - protein, 73 aa, Homo sapiens
DPLNCKLPSIQRVRTRSASRSRPSTLMFASFIDKVRFLEQQNKVLETNVDPACRSRAPQPVSAEPGARCSEQY

SEQ ID NO: 985515 - protein, 121 aa, Homo sapiens
MLVALPAGGGGGGVLDGRNCRRPTELRPAPVGLALLELEPAPTPRSLPVGVAASSTSGLSHCLTPVAPPVATGDGGLTLLNVDLSNAFAIQPALLALQELAVSGDLHIQQLDVHQLLVLLQ

SEQ ID NO: 985516 - protein, 63 aa, Homo sapiens
TEMQEVQTLNNNPDIYKSDTIQYEVLSLPVKNECGVQNYKTLCKIYSSTKRTHATLTSSSTLN

SEQ ID NO: 985517 - protein, 91 aa, Homo sapiens
GGSDSLMAVRNSAIHRSVVPPLRRQESLRCMKKLACEDQDCYKPVLQVFPSSEIRVVSQSPVNVGIPWRDFRGPSGARGLLIYGSRIEDGT

SEQ ID NO: 985518 - protein, 70 aa, Homo sapiens
HYDLPALSEGKACGDHEVTEVRDQAGHHGETPSPLKIQKFSRARWRTPVVPATPEAEAGELLEAGRQRLQ

SEQ ID NO: 985519 - protein, 47 aa, Homo sapiens
MYTCAGRNLNLLDKENINQTQDMTKWILHGLAVRIFSYLCNTVFLQT

SEQ ID NO: 985520 - protein, 142 aa, Homo sapiens
RISSTESEVSPLSHRYQRFTNSAGPPPPGLRSEVQRTTEYWPWCNNLVKAVHLTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 985521 - protein, 132 aa, Homo sapiens
KTYQNTEEGQAGWLHACNPRHFGRPRQVDHLRSGVRDQPSQHSETLPLLKIQKLAGYGGTRLWSQLPRGLRQENRLNSGSGGCSELRSHHCTPAWATERDSVSKKKKSSYVHLPSIFSPNQPQNFGLDPFLF

SEQ ID NO: 985522 - protein, 133 aa, Homo sapiens
VKRYENVKEIETQKTLQKINESRNGFFEKINKIERGLARLMKKREKYLIGAIKNDKGDITTDPTEIQTTIREYYKHLYANKLENLEEKDKFFDTYTLPRLNQEEVESLNRSIMCSEMEAVRTSLPSKLEFDLR

SEQ ID NO: 985523 - protein, 115 aa, Homo sapiens
MLSLRGFLKSRGLKDLPASASLSLLVHYQSEPPQSAPCFMSCYSIPGAYQLGPLCFLTKVSTSFMNRRHSSSSHGRAMHCTVTRSPTDPLTVSEKFLSELISVVPLVEGQFLLVL

SEQ ID NO: 985524 - protein, 52 aa, Homo sapiens
RVVHVNICMQSFEPIHVKRVFEAKLKTFLDYMLMYLEYPLDEARDEVPTLAI

SEQ ID NO: 985525 - protein, 106 aa, Homo sapiens
GLIRLLPEYQELTERRSWPWHVEIATYRNAVWRARSAGWDGEGVGQVNVSVVQSTISSGYGGASGVGSGLGLGGGSSYSYGSGLGIGGGFSSSSGRAIGGGLSSVG

SEQ ID NO: 985526 - protein, 45 aa, Homo sapiens
DGVKKVMEERWNQAESQQLPFPSDSLSLWGGDSSTSQRPIIDYNL

SEQ ID NO: 985527 - protein, 50 aa, Homo sapiens
LTERLYWGSNSFWRPALSVLGPHLHCTETSSLVSLSLYTSFQRSSMARLG

SEQ ID NO: 985528 - protein, 108 aa, Homo sapiens
MGRMDIAYWNQRSSLTLHRSSQQIVEVQAVGLRHIGVFSSETWMALCTFSHGTEKGIIFITLAIKAKSQVNEEERHHIPSDFRSYAVISITLSLSFFTHDPRLIILTS

SEQ ID NO: 985529 - protein, 62 aa, Homo sapiens
RYMRMTYTHTDNPDRKYQTALGTTRSILEQQISVVSPQKGDGNCSTPSSHSSAPNFYNTKRR

SEQ ID NO: 985530 - protein, 62 aa, Homo sapiens
ENLSLRWRLLRASSAQRTPRQFPVRKQPLDDWCHMAGLGVVLQEDLQYPCLPSLYMSSLSLN

SEQ ID NO: 985531 - protein, 42 aa, Homo sapiens
MRKHSASSSSLFPFASSFIWRTIMSKNSSKSMVPLPSSSTSS

SEQ ID NO: 985532 - protein, 41 aa, Homo sapiens
LEFSSILYSWFWHSISLLESRISLGLDAADESLDLLQLQGI

SEQ ID NO: 985533 - protein, 123 aa, Homo sapiens
APNQPLTLLGSHMRAATTCTCHHSAQLPPTPHEPTTHSQQPAAQGVLAPANCNHLSNLANGPSSSKRTSKLIPCFSFLLTLYGLANNCCPDLPGPSFYTNPGSTGAAPDCPSSGTHTSAPGTS

SEQ ID NO: 985534 - protein, 74 aa, Homo sapiens
TIKSTAGNTLLAAFFVMWDNILGTYMPYSLEREERREVSKPGQSNSRADEIIDAFLGFQLKHLFCILLIYCSDC

SEQ ID NO: 985535 - protein, 83 aa, Homo sapiens
MSDDDWLKKFTGKTLEENKEEEGSKPPKAENQEGEPIAKKARSNPQVYIDIKIGNKPAGRIQILLRSDVVPITAENFRCLCTH

SEQ ID NO: 985536 - protein, 118 aa, Homo sapiens
FVSRQEGAVQPQSLADIPLSSSDVNLSIITDVAWLSQTRLCVLGRAIDAGVTTPYEIAVDGSGATSMGQLTATSMAAVVALPKETGTEAVVLSEDGILLRHEDSFRWRQILQGVSAVA

SEQ ID NO: 985537 - protein, 124 aa, Homo sapiens
GKPILSCDGGNPCELLSLKRHAMGDESEEDERTVHVDHAFREELMTVLQAGKALGGEDSENEEEPLLWWDEAMMALDQSLASLFAERKLRIQARRDEKNKLQKEKALRRDFQIRVLDLVEVLVT

SEQ ID NO: 985538 - protein, 37 aa, Homo sapiens
ASVPSIVAWSVSHIIPTLQQLLQVPAQLAAQWFHMLQ

SEQ ID NO: 985539 - protein, 44 aa, Homo sapiens
PPDMCLITDLPYRCSELKKDTGHQRPSELDKKNLEQTVKDLQHR

SEQ ID NO: 985540 - protein, 48 aa, Homo sapiens
MRRGDLGSAGGCMVLQDQAFFMAWKREMSFPEEGFLVPSDGAPLADSS

SEQ ID NO: 985541 - protein, 102 aa, Homo sapiens
MRRPLTASHIALLFTFKFTFKFTNPGLQFLDLLLPTLQGQLLRLIQTMLQVLHRLFQVLLHPLQIGAGSPVTFFSSSDIMAASVMDFLAFSSALRASQLNNL

SEQ ID NO: 985542 - protein, 136 aa, Homo sapiens
HGLTDGILNLGILNLLSLAVTSLSAKDRSPSNCALSSLALRAWTSTSTLGRDTSTSGTLTSTLGSFRSSLGPLMSIWGPLRSILAIFKLRFSTLGKFLFKASSLGQVALRELHIHLVSLDLQVSRSGLNAEVSGLQ

SEQ ID NO: 985543 - protein, 105 aa, Homo sapiens
MTHRYSDMSVYLCKIKLILNSVIPHINDYLSTSNAHEKRPVYLQSANVLDYHKQNARGKIQAQEETLMCRAKAQNQDGDYKEIHDNPAQYTYKKHLGFLISILYL

SEQ ID NO: 985544 - protein, 82 aa, Homo sapiens
YDDRDLESMLQKLAERLAELLLMTYCVRSQRPLIRHQLTAPSPTHAPLQHGAQARLRTQPWLTISTYLMHRGLFINKKLNRQ

SEQ ID NO: 985545 - protein, 36 aa, Homo sapiens
ACELQKVQELQQQSCPRSCGSSSVLSGTAGRGVALR

SEQ ID NO: 985546 - protein, 61 aa, Homo sapiens
RLSTPPTLTGAGIALNDHFVKLISWYDNEFVLQQQGVCDLMCPHCLQGVRPLGPPCPSNEH

SEQ ID NO: 985547 - protein, 34 aa, Homo sapiens
LLETTQLWYDTAASYPGDMWALCSPEVAPSTDDQ

SEQ ID NO: 985548 - protein, 53 aa, Homo sapiens
IEHQVVPDLHSRTPTPPALYAGAGVALNDQFVKLISWYEPTEFGYCDWVVDLM

SEQ ID NO: 985549 - protein, 111 aa, Homo sapiens
GLQFLISGCGVHMTVAVAVATVILVTCGLRGCPPRWLAYGVWPVPSSPSCIFSWEVQVSLAISMMNSSNLRCLSAFVSRSSMYVFYDLFILILLLERIVLIFSQQLFDFPL

SEQ ID NO: 985550 - protein, 35 aa, Homo sapiens
HSSTFDCGAGFALKEHFVKLISWYDNEIRRTGTGL

SEQ ID NO: 985551 - protein, 42 aa, Homo sapiens
YAVQPVEISDYISSIEAQLSELAAEMECQQPSSTTMLLAHQA

SEQ ID NO: 985552 - protein, 103 aa, Homo sapiens
SLAPPLFRGLHGTVRRGDSSVVRGLSVAGAPQAVEGLSLPLVLLLGLVVQWSYSLEAMWAMRSTTLVAVSQFLSFQANELDKVVVEGNASPSSDVDEWESLVV

SEQ ID NO: 985553 - protein, 38 aa, Homo sapiens
RALLRLQRARCTCAIQAVLSLYASVQDHLASVAGLLCD

SEQ ID NO: 985554 - protein, 45 aa, Homo sapiens
KGHGQKSGYFSRRQPRTKLTWSSSAAHDLASMRPGGKTAYRPGRG

SEQ ID NO: 985555 - protein, 70 aa, Homo sapiens
ELVRRQGDSIFMATPSWDELTTSLPHHPRAELLQRDDAVPITSLFFFFILLSLLFLEFPCSFLFVLDETS

SEQ ID NO: 985556 - protein, 54 aa, Homo sapiens
VTFPDGDRRWIWDQQVDVYQLMAKLAAGAGIQLPSTAAAAAAAAAAQAAALQLN

SEQ ID NO: 985557 - protein, 43 aa, Homo sapiens
TRYLAAALRGSGNSQSCSLRPLCIRLFAYARHEASSKDPNHST

SEQ ID NO: 985558 - protein, 50 aa, Homo sapiens
DAYIEWHVSCAFCNAFIRFRKFLIEKDKLFSTHNISDTHCVGFPRPLQFS

SEQ ID NO: 985559 - protein, 89 aa, Homo sapiens
LLTPMLIEEYVNESILGLFVVRGVSLYIILPHMDKCKEGVRLCVLSGGFQLDVRRFIPSDSPSYKTILSATYYWIPCPRAAIMGYRCSI

SEQ ID NO: 985560 - protein, 38 aa, Homo sapiens
LRGLWAPLTCATMNGGGVFLIPYVLIALVGGNHSHWST

SEQ ID NO: 985561 - protein, 147 aa, Homo sapiens
APYAARTSDRLCVHYTQNSLAAPLISDHRRSLVTNRLGWRVGAGETVLPLGPVLTLVHRNQRGMSVPSPEGLPGSPLLASWQSVRPLVSQGWSTALPENSYQELLSYLQLTQAFIHTFPRTAPRAALARSASLILFFFCTFSVKLEG

SEQ ID NO: 985562 - protein, 64 aa, Homo sapiens
LDLTASRDPSRISSPQYARLTYIAFLVGTEFSPFGQAGLEFLDSSDPPPLASQSAGITGMGHHT

SEQ ID NO: 985563 - protein, 65 aa, Homo sapiens
HIGVVTFWLMKVNSPFISLENCPISTDGDYHGNITHEIKQRTSLHRLGRAIPVQETCGPAAYRGN

SEQ ID NO: 985564 - protein, 43 aa, Homo sapiens
LRIPTVVTLCCTRGDPQYSSGILHPALTLCKWSDIDDRYDITV

SEQ ID NO: 985565 - protein, 141 aa, Homo sapiens
MLPFISFYERESCSGVQAGLECSSMIYGPLLTSTSRVQTILPLQPPKAAEITGTCHHAWLTFAFLVQTGFPHVDQAGLELLVSSDPPALASQSAGIIAVSHCTDDGKFLYGEFVYTQDVGKVRVLFIGFLAGLGGKVLWFS

SEQ ID NO: 985566 - protein, 38 aa, Homo sapiens
TEHADVAVRSTPCNPRNFGMPTTASDYLTLGIFEDLAC

SEQ ID NO: 985567 - protein, 35 aa, Homo sapiens
MANQEHSKAPRINLEITTKAREQTVTCCKEHYKSR

SEQ ID NO: 985568 - protein, 38 aa, Homo sapiens
CGTVVQYTTAQLTVQLAHRTGELQSTKGLQDAQYTYCL

SEQ ID NO: 985569 - protein, 69 aa, Homo sapiens
CRDYQAPYKRYLVCSSVLIVGTELVQGGMHRSVEYTSTRLHLKIFGGQHGSHVTTDLVHGVMHRSGEYT

SEQ ID NO: 985570 - protein, 81 aa, Homo sapiens
CINEELHATSETENHVHGALFSRGVVRQAATIFTVLPDTDQPLLHKKNAFLILHLCLDILYGVTGLHLEGDGLTSQGLHED

SEQ ID NO: 985571 - protein, 40 aa, Homo sapiens
LSSPDTRVGGCRCMQGVAGFPVPHLLLRATESYPLMPLTL

SEQ ID NO: 985572 - protein, 122 aa, Homo sapiens
YYHLRGNKRMHVRVVLPFHDLGLMGLARWAGSPGTVISWMLIPGTSQAEVTMTTNVATEGARRLRVMLSFTRPSPVTFTEKGLPGTLLVGKLDVDDVVAWLCGAVGDPARPVLQVLCVDVHL

SEQ ID NO: 985573 - protein, 130 aa, Homo sapiens
TDDAIRSKALSHPDRLPAEPGKKYVNSQERSQGESETTQPQTRFHGLTLRNCLNTNTDRSISEVMNSRLLCRDRTGPGRDRMKAATDREREQQQREQSRGKSALSAMGRRDTLYQGVQGHSRVSARRDTL

SEQ ID NO: 985574 - protein, 71 aa, Homo sapiens
MPHDSTSMKFKNRQNYHDRSQESGVLWVLKGGEKGLGTLVGEDSVLYLDMSVGHQAIHFIFVYVNYLSKGL

SEQ ID NO: 985575 - protein, 60 aa, Homo sapiens
DIRRSARCSWCRRNLYEGGMHRNWGIHVEQAPALTILGGQHGAHVSTELVQGGMHRSGEY

SEQ ID NO: 985576 - protein, 86 aa, Homo sapiens
ADDRRHKVDTIYLFAFKAEAEAGYRAALGEGVIRVLGEDADNLVSQLGKDAFQHNSVIDLAITSTIEQNHLIAPGTFLQECLRGTG

SEQ ID NO: 985577 - protein, 49 aa, Homo sapiens
AWPARDSWLLVVYRSPKSSCLGGKYLAVIALPALAPGHTEWLLGEEALN

SEQ ID NO: 985578 - protein, 67 aa, Homo sapiens
QDLGIEWHVQECTGMGKGRLAWREGRFAGFRPPYSKVPTKSPSHNSQAQPLFGNYCVGGSGHLMSQH

SEQ ID NO: 985579 - protein, 138 aa, Homo sapiens
DSLGISTIPSLQKIQKLAGHGWCMPAGGAAWEAEVGGSKEGRKGRRERKERKRERGRKEGRPRERRQEGRKEGRKQRKNGKERQQKEKERKKSNERKRAAVLKVWLRAPKRPFPGASRDFTWLFHSPEVYNGAHIMAG

SEQ ID NO: 985580 - protein, 35 aa, Homo sapiens
MRYYSNPGSDDSALTTVGISGEWGKVVEFWAHIME

SEQ ID NO: 985581 - protein, 53 aa, Homo sapiens
MEWHVKMCAECLEVRVTEGGVGREKPEPLAGAESTGICKPHGKSLDYILKAVL

SEQ ID NO: 985582 - protein, 63 aa, Homo sapiens
NDHVYDDVTCSSIMAEAAELAVVELVLDCILRTVIGKVKSFFLWLSTHLVHICGTTRIESVYC

SEQ ID NO: 985583 - protein, 50 aa, Homo sapiens
MDHARKAPPYAPEETVGPRHPLKKALPPFISEDLPPRVDGARDPNVRLLC

SEQ ID NO: 985584 - protein, 105 aa, Homo sapiens
GIRRGINSNALNSNCTFYRKVLDCQLGLPSPSVRLYLECSISYLDDDIKISGTNTLVLVHFFLINVLLFDSSESYTTDTYQMSSTSSDPTSSILRISSSSQSSSA

SEQ ID NO: 985585 - protein, 53 aa, Homo sapiens
GVWLQMLLFHRGIDRKRHHHVSGACELNFDVNTGKVSPWPVTRNRTEIQIDYA

SEQ ID NO: 985586 - protein, 78 aa, Homo sapiens
LVSWRTAGWETFFPTGSCYAEGPRGTEWHHNKPRAQSSPATACLLSVSSKSSLLLPTSFTHRVSRPTGGIRMWARIME

SEQ ID NO: 985587 - protein, 32 aa, Homo sapiens
MAKRFVEECSTSLIIGKIQINTTMRYHFIPVI

SEQ ID NO: 985588 - protein, 118 aa, Homo sapiens
QIKLSLSLPHKLFSEYHEKRMLVSGLEARDVKCPGVSFGLSSCLCERAGLRCSSLQLSGDCSEECWVLGYTGDVVGSGEGGQLPTVVSPHVWWFPKASSHTPASESSGELKIQIPGYL

SEQ ID NO: 985589 - protein, 81 aa, Homo sapiens
MSGEDQVHPPLCHFPQMSLQHQLLSLELSVLPRGAIPWQDMTAASVYRLPPRGTCVVLTRAARLCPSMMETGLCGVTGAAD

SEQ ID NO: 985590 - protein, 42 aa, Homo sapiens
DLRLPLRRKTKKKKKGVSTLCEEHVETETVAAMLARTEKSPS

SEQ ID NO: 985591 - protein, 34 aa, Homo sapiens
FSFRPLQNCPSTVIRPTPQSSILGVAIHNPHPHT

SEQ ID NO: 985592 - protein, 48 aa, Homo sapiens
TVLLQSNCRASLVTQWSCWHAFLCNPADGVLALHQALGTFPFQEPQHR

SEQ ID NO: 985593 - protein, 118 aa, Homo sapiens
AVNGILGINRHQPPVCSTSAGDSHVIVPYVPRVVFFLFFLFLTIRVIVLFMAVRPLAIMSTDILASSRVAAQDSSCIIPPPPKHITAFSNALVFMSSKGGNTHSVCLFPHDKLYQKPF

SEQ ID NO: 985594 - protein, 130 aa, Homo sapiens
WRNKGDSAETEGDEQWLETVDMTASAERARAAGLPREKYDWHGGRWLSDYVVLPGSAGLLAVLACLVGDLARWPVVTHDPRARVIDLLSAPRVTCEVWSSSRTFEDGTPRRSWPETYDMNTSEPKTEQES

SEQ ID NO: 985595 - protein, 126 aa, Homo sapiens
LVLCVAARRLIVLTVLLIIGSLALFRFVPQQFFPASGRLELMVDLKLAEGASLSNTADQVKRLEALLKEHAGIENYVAYVGTGSPRFYLPLDQQLPAASFAQFVVLAKTIEERESLRTWLIETLNE

SEQ ID NO: 985596 - protein, 82 aa, Homo sapiens
TLQMPPDSHLFVVAMVQQNTPLIRSHARIPYVSGEISLFIYYDNERLPTCRTHLRHTYPAPPSRSTSISFCSPRRIAPESEG

SEQ ID NO: 985597 - protein, 73 aa, Homo sapiens
KNNRETTPPRDTQSAGITDMSHCSPAARMYLLSDILQKRYPCLFLTDFFSYDPINEQAYCRKRNVVHFIMRYI

SEQ ID NO: 985598 - protein, 114 aa, Homo sapiens
GPMTWLAPAPRPGGDAEQRHAQHMGMRAACSQRIGDVMVTQQVQLYVLVTLRGMQGEGRATTGVGLDIRGMEIGSGVCATAKLKTLLTGGTYTPGFEGLVVEVQHGSAGCVEAF

SEQ ID NO: 985599 - protein, 69 aa, Homo sapiens
YTLMQNTVSLISIGNLPSAFKFSSLTDEFLLAMTRSCVSCGLEPWESGVGKSLLTFVNCAYVKWAHIME

SEQ ID NO: 985600 - protein, 110 aa, Homo sapiens [sequence omitted]

SEQ ID NO: 985601 - protein, 61 aa, Homo sapiens
MYQHVSPACGFGIKMSVSHVVHGQQQEGGRGHGARTQTQALSIGGSLGIAACTQKLGTHYG

SEQ ID NO: 985602 - protein, 66 aa, Homo sapiens
YIAWQMLDGTRNVLTQLARKEVVIDSRTREADLTSGVAFPKDVMTLVTAEWQSVSKTAMICSNCYK

SEQ ID NO: 985603 - protein, 106 aa, Homo sapiens
MAYMLKENRSFYKWNMYLNVHHHAVQESKDMESTKVLISGGGSGKENVVEIHYGVLQSHRKKNEIRSFAETWLQGVVIILSKLVQEHKAKYGMSSLISGKWAHIME

SEQ ID NO: 985604 - protein, 41 aa, Homo sapiens
EDPSVKILRWSGEQVHVADDEPAGRHLLMSMCLPWASSRLF

SEQ ID NO: 985605 - protein, 33 aa, Homo sapiens
SRRPCNAILHILAVKAKCRLFDFWETQSPPLRM

SEQ ID NO: 985606 - protein, 80 aa, Homo sapiens
MHVLQVIEESLGTWNGGSKAEASHTYPSPLQRYSEDPTVPLPSETDGYVAPLTCSPAEINQQMFPQPPSPREGPLCLLPD

SEQ ID NO: 985607 - protein, 148 aa, Homo sapiens
VGPGMGIWLQISHWEHCLAAAVHWHREHRGRIRRFYRQLLLTADDRVNPCIGGVILFHETALPEGWMMGGPSPNVIKSKGGVVGIKVYKGVVPLAGTIVARLPTQGVGWAVFIAVPSTWKDGACFAQWRCVLKIGEHTPSALAIMENA

SEQ ID NO: 985608 - protein, 68 aa, Homo sapiens
ESTGLWIGIKYTSLTLRGRACAPRNATEGFHNFNLYRAWEMGLQRRAVPTPGTNVNSIGISITAMEFR

SEQ ID NO: 985609 - protein, 49 aa, Homo sapiens
YWAVVPMWKTLQEVELQIAKDEMTDIDLYWILMTEDEKVTEANEANGKQ

SEQ ID NO: 985610 - protein, 36 aa, Homo sapiens
VVQILVEVEAEGSLQSQEFNDYIQCAMIVPLYSIDR

SEQ ID NO: 985611 - protein, 36 aa, Homo sapiens
MTVSASARRPCKHHIWDIRSLLNSFASAYSGPLATL

SEQ ID NO: 985612 - protein, 50 aa, Homo sapiens
WALCLLCGNEDLPNRLSLFQKYVYQYAPSGHLEMDRTGCAIYAVRTPSRN

SEQ ID NO: 985613 - protein, 55 aa, Homo sapiens
SLSSVPNSEFDMSDEADTIIVIIHEVDLSHEYILRALIVIKNSPHSSRRQLSVRA

SEQ ID NO: 985614 - protein, 65 aa, Homo sapiens
RVSHGRAERMLAVLTWLEEIPKPTVVLKTFWVLSILHNPEEGPKEEGDFFSCLSLTWNCFGTLAV

SEQ ID NO: 985615 - protein, 105 aa, Homo sapiens
SQLPDVDVTVHDAVVGGLVNDRRLQYRLRSGWKMRLQAVEALVADGDDLAVWQLVFLFQGGGGGESSPSRSRSPGPRSTVFSLMSRTISRSAVVTKEELTLSEDL

SEQ ID NO: 985616 - protein, 102 aa, Homo sapiens
RGSIGRLFFPSCNSQLAIYPLPVLQTGVLRSRHLRAVLPLEALGEDPSCLSQLLGAPGVPGLVAASLQSLPPSPRGLLLCVSPLLSLRRTPAIAFRAHPTPG

SEQ ID NO: 985617 - protein, 45 aa, Homo sapiens
TAALEVTIGTTDASVEAVSPREENIVVIADDVQGVDPHPAMEAIL

SEQ ID NO: 985618 - protein, 118 aa, Homo sapiens
SRGSLRQKITPGVIMLAGGLCACGMTLAVGFVCVRDDACSGVWCACGDTLAVGFGVRAAMTLAVGFGVRAAITLAVGFGVRAAMTLADGVRCACGITLADGVRYVCGDDACSGVRCVC

SEQ ID NO: 985619 - protein, 108 aa, Homo sapiens
MTREQACIRARLMSRKPPKAPTRAFPTCKAPCSTREGKLAYWRPCVSPVTEWDMWDWAGLLRVRCSLSTCAHAKCSDGQRIETPGHADLGPQIAAHMETASCTHAEQL

SEQ ID NO: 985620 - protein, 32 aa, Homo sapiens
MPARSHAEFFMYDLAFIRSTLHLLPVASDTSS

SEQ ID NO: 985621 - protein, 52 aa, Homo sapiens
VRPLPVSVADFPLSCARDIDDNIRGTVRIHQKVWYSYSTDDTLPPAPGCEGG

SEQ ID NO: 985622 - protein, 75 aa, Homo sapiens
VCERNTQGISYKNGLMPPSKDMLPPRRENKKETEGASPYKNGLGSVPMDMGPPRRKQDSPSQGFGITLRNRGGTG

SEQ ID NO: 985623 - protein, 59 aa, Homo sapiens
SAETLRSHSSISARRHCAPKLTPYFLLRKRSLRTLLESTQSLSIAIALPALYQDFYKEY

SEQ ID NO: 985624 - protein, 80 aa, Homo sapiens
MSALHIVGLNPQCADVGGCMVDDHDDWPLYNNLLGRAEEAHAVIGDEVCEVILGVVGAVLLFHPVPTQRVVIKAGVPKES

SEQ ID NO: 985625 - protein, 95 aa, Homo sapiens
LGKRQLDLRQEVHHGLSEGCKETEKFGQGVHHTAGQPGKETDNYVQVAHHAAAQACDESGGFAQEAHHVRGRPEMRLVGLPRWSTMVLVRTVRRQ

SEQ ID NO: 985626 - protein, 66 aa, Homo sapiens
EQDGGYWASAKSVHSGPGLIGSGTQHLLPPRAPVSCSSSYAPHNTLRLTQTFYILTLHCHPARLAQ

SEQ ID NO: 985627 - protein, 44 aa, Homo sapiens
VLMVVDVWPWFQEMRELRRVERLEEDEAGEKGKQQELAAWNSRE

SEQ ID NO: 985628 - protein, 48 aa, Homo sapiens
YWQSWGEMQNITYHAGRGVELRGMAKVHQLQRPECWPYTQDWVTALRR

SEQ ID NO: 985629 - protein, 52 aa, Homo sapiens
GVAVLEDPIPAAFLLLARELLPPPLPLPPPRPRRTAPPPRELFLLLPRESLL

SEQ ID NO: 985630 - protein, 54 aa, Homo sapiens
RSLTGHSASRDDGIIMASVSMRISPVRQLLECLPWSRESRWHAALMCGWPLHVS

SEQ ID NO: 985631 - protein, 38 aa, Homo sapiens
LELTVQQESRGGSSEQQQEFSRAAGILSSRNSRGGSRN

SEQ ID NO: 985632 - protein, 67 aa, Homo sapiens
RAGSRNSRESSRNSAAGILAGQQEFSREQQESRESSRNSRGQEFSREQQDISREQQEFSRDQQEFSR

SEQ ID NO: 985633 - protein, 40 aa, Homo sapiens
LSRGSRENLSSSKQSSSRNSRGSSRNSSRNSRGSSRNSRG

SEQ ID NO: 985634 - protein, 76 aa, Homo sapiens
RLQRSSLSQNSTVGKLTVQPSVCGRRSKSPWQNTGVSPRVQKLKNLESDIQEAEGIQHRGKVKAGRLNTCSYLIFQ

SEQ ID NO: 985635 - protein, 58 aa, Homo sapiens
PVSPGLSHKLLLSQIVSQQGIHEVQNDFCTRFYQEPSRIKKAAYERLVWVLHVELPEK

SEQ ID NO: 985636 - protein, 51 aa, Homo sapiens
MLGAQLTVAAVHSEILKYFQSVTYQAVAMVTIFLILIVFFIIYVVYPCMNP

SEQ ID NO: 985637 - protein, 32 aa, Homo sapiens
MAGMRSREESLQSQSQPAAMSERSRKRGSKRD

SEQ ID NO: 985638 - protein, 50 aa, Homo sapiens
TGFHLHAHHCGGRLTTSHHIIPELSSSSVMTPSPPAPSSGFSSFGRFTAE

SEQ ID NO: 985639 - protein, 35 aa, Homo sapiens
MLFRFHESLPADSMLKPRFPIVWPSRPLIHFSRLL

SEQ ID NO: 985640 - protein, 34 aa, Homo sapiens
GLRLNKRINPDKGVAYVSGGAGEHPDGGQVRERA

SEQ ID NO: 985641 - protein, 124 aa, Homo sapiens
SISSSSENDESVSYSRTLSNSCLLAYTRKALDVRGQNSNGRALNVVMKAARVILFINMHHQPFMSFPRTFICSIRFSFEIHVLHFSPTLATLIIFTISSRVFFCCIPCFFFPFICFRSSTTCDT

SEQ ID NO: 985642 - protein, 56 aa, Homo sapiens
ICQLDCGFMTSFLMTWEPGNVGISTRAAGHRFLDRVWAHRAAFLFTPTDASKEVFD

SEQ ID NO: 985643 - protein, 57 aa, Homo sapiens
MADITLLLIILPDKQHMLCVSTQNSTIIRNKNQVSNKVPDLNFISLKEAQKGKDNLE

SEQ ID NO: 985644 - protein, 38 aa, Homo sapiens
QTEEKPIKSETALLWPSASLNDHPKGDHKILELSDIIT

SEQ ID NO: 985645 - protein, 69 aa, Homo sapiens
NSFSDLLGRHNSELQECTGQREPSISSTSMTSNCSSCATPMEQSFSADTGGGRPREQHPPDPELCNDFN

SEQ ID NO: 985646 - protein, 80 aa, Homo sapiens
MVHGILSRTQILYFASKVRNEESWRMLGRGESRVGLSMGRSIPGSSIMARYNVPRPVWEVERTRSQCQLVAIRSEEKWSN

SEQ ID NO: 985647 - protein, 157 aa, Homo sapiens
PLSSEALMSTKRTPTQKPHSEAISIKAQRKINTRRMRKSQCNNAENSKNHNASSPPNDYNSSPARAQNWTEMSLRIDRSRLHRWVITNSFELKEHGLTQCKEAKNIDKRLQELLTRITSLEKNINLLEERVSITEINQAEERISEIEDQLKSNVKTK

SEQ ID NO: 985648 - protein, 120 aa, Homo sapiens
DLIGSGSTVLLHRSYNNGQNFYPIMNTSPYVFKLTIKRIKTAARFLEGILPNVQAEQVEGHVYPGLLECLFHAELEVSILPSLQVLLICDSEYKPHPTKIFVFLVHSCFTHTEQAQAING

SEQ ID NO: 985649 - protein, 74 aa, Homo sapiens
ATVIRDKEAREMSPDDSVITVPLINKGGISILEDGDKQAIDDKLPVLSLDGAMEYAMGGIIYEHVNHVVAVKEG

SEQ ID NO: 985650 - protein, 109 aa, Homo sapiens
MWLGQLMGVPRSIKPGYAPAFTCSRISEPDVTTPTPTYPVYCRVLRVPRMGSKKWAPQEKPLSSPPKPRMGDCSREFNKIEQLRLIIEFTQGVLHAGRNCKNRGSYKSG

SEQ ID NO: 985651 - protein, 49 aa, Homo sapiens
NILSSVEAQYIQAQSQVAPVIPQNTLKKRERKQSPKRTEDIQTTLTVPA

SEQ ID NO: 985652 - protein, 65 aa, Homo sapiens
QIQNMQNRVSQGPHPKSQGDDIPEERRIAGHAKPGSTPQSQTLSSSCPPLINKADTQKQTLYGYT

SEQ ID NO: 985653 - protein, 67 aa, Homo sapiens
GVNRLSSSVAFCYDGDEMPIMTLVPAKRGLQMNVIPALELVEPINEALRSHATVLIVYLCRLCDIPW

SEQ ID NO: 985654 - protein, 39 aa, Homo sapiens
PYSRQVETVSGCDILRSGVWDSLRYFSEFFCTASFTVLV

SEQ ID NO: 985655 - protein, 58 aa, Homo sapiens
DCRQVLIQYNPAASCTLRRSPVLWLSHVNGQCRQRVPEQEVQHAAHQAQGCRSSSEDG

SEQ ID NO: 985656 - protein, 61 aa, Homo sapiens
MLVIVSTLCAASVCSADLQVRLPTPPLCELGGGSAGTGGVHGEGFCVMKDDSDLLGPKAVS

SEQ ID NO: 985657 - protein, 59 aa, Homo sapiens
MVEVSTCLDLWGCHVTLQVQLHHGTVDAPDETYCRRVTRLSDLRGCFHVFPLPPVPTHH

SEQ ID NO: 985658 - protein, 37 aa, Homo sapiens
VRIHLYTKFKNYAQYVTMLLRRLSEEDHMMPTDGRRL

SEQ ID NO: 985659 - protein, 34 aa, Homo sapiens
LSSGDPSGGGYGSGGGIGGSGSRRFYKQSEEGYS

SEQ ID NO: 985660 - protein, 65 aa, Homo sapiens
VLADDECFLVVTEKRNLPFCKPCAFLVTIAEECMRAEFSNCSSSCVALGCFSTTCESPWFACIFL

SEQ ID NO: 985661 - protein, 71 aa, Homo sapiens
GCHGSRGMKEMYAVIPFLRSKQQVYSSEMSSRNVGLCLISPFFLFFFYFKERNSQQVAKVEVRGSNSRFPI

SEQ ID NO: 985662 - protein, 34 aa, Homo sapiens
MALASQGQTEQMKRKKTELEFWDQAVGWALSRGK

SEQ ID NO: 985663 - protein, 80 aa, Homo sapiens
MHKKLADYLKVLIDNKHLLSEFYEPEALMMEEEGMVIVGLLVGLNVLDANLCLKGEDLDSQVGVIDFSLYLKDVQNLDGG

SEQ ID NO: 985664 - protein, 105 aa, Homo sapiens
MLRGLQVDEVCIRYEHMYYFSQCKFSQHSQINSLIGWELQIHMPWEPKGRKVYGTKRWDASGNICTVTLNMNAQAGAVAHACNSSSLGGCGSLELMRSRPAWATE

SEQ ID NO: 985665 - protein, 111 aa, Homo sapiens
LSQSRDRVKPQALAGYTASPLTPPSQNQLCSKAQAQHLRTSVSPDAALISTNPPQPLDKSWTQPYLPLVDRPIRTSLTLPGYGFSGHAKGFRVHSSASQHHFRLRQPPSPL

SEQ ID NO: 985666 - protein, 127 aa, Homo sapiens
MGGAGSSCESAGAGEGIYQVRTLCPSGVGLLGLHRGWAASVLVCEGTCSCCGHHLAIVHIHDLGAHLAAGGGHISWIHCDPKGAHWERVRGGRPRPSYQAGGSVAISVLLAASSTVLARYLVRPWFS

SEQ ID NO: 985667 - protein, 31 aa, Homo sapiens
MDFYFGQVWYRFATPHSVVLFFNYPYSPVTE

SEQ ID NO: 985668 - protein, 111 aa, Homo sapiens
RILYLSDFCRVVGVIQILLCSSCCCNVGGIWLITWSLPVLRDEDLPVGKLQGHSYHHREDHEELFCKLTLLTLDPSVRLDLDPQKSSFHDDVRWSCTLVLEETTGVPMLDI

SEQ ID NO: 985669 - protein, 34 aa, Homo sapiens
RINPICCTVVFSSGIWAAHFRIHSIRALLTAPLC

SEQ ID NO: 985670 - protein, 115 aa, Homo sapiens
RSRDLLADAKMGKQESAGKQQLQKGETVENRRSRGHEQMLKEGGSRAETAKVKTAAAKSSTGNTDDTQTTKLADAKTGERKTSAGKNTATDTGDTIRTTRRTQTATAYFWRRAGV

SEQ ID NO: 985671 - protein, 77 aa, Homo sapiens
AECTYGDRGDTVKREAKHMPTSLWGRSENTDGRCHDSESPSSLRRGPHPKTAPLITYHVLRIPPNTVLSSHTRQINP

SEQ ID NO: 985672 - protein, 88 aa, Homo sapiens
MKLQDSSLHQHGGYKDRPGGRTLWVLSVRTHKGRWDFLTLMKWEKYCMISNDRLFSSRDKLPLIGWVDGKPHGKLNIRQHLQAAMDVV

SEQ ID NO: 985673 - protein, 102 aa, Homo sapiens
DSLLDGMGSEPGKCTAQSTMWDTRALLLKLGLTNLQILPLLLLICKCHLLACIAHCNHCQHKCIVLGTQKSILPLLLPGPTAQRLPKDLRAYKHLRKPCRGP

SEQ ID NO: 985674 - protein, 63 aa, Homo sapiens
RARCYMMGGLDQEAPERQGPDVGGAMGVEEYVILGQLIITRAPFVRGTRFSQAIPACPALTST

SEQ ID NO: 985675 - protein, 58 aa, Homo sapiens
ETLSREEMEELEKELDVVTQTGVFPCGCGRETRGEQSRVLQPGAMLNFCEKEIKSDYQ

SEQ ID NO: 985676 - protein, 69 aa, Homo sapiens
WEAAQSRATATGGYASDRISVQDARTRTAGEAQGIAAHVPRGKPNATATATSTSGIHHRDIHGSHSPRA

SEQ ID NO: 985677 - protein, 107 aa, Homo sapiens
MGGEVVDGGRGRGDCVEEMIESTAYLELSLRSISEPAWLRTYPGIPVEHGHDTHSILDSLVARMGSNSRLCMVSLSLFRTLLNLSCEDVLLQLVLRYLVPCNHVMLS

SEQ ID NO: 985678 - protein, 99 aa, Homo sapiens
GVNLYDFCSKQVKPCPSYTFRPVLQQVSHSPGLNLKSLVLSTLTFKADNIMLVDPSRQPYRVKVIDFGSASHVSKAVCSTYLQSRYYRAPEIIPWFTIL

SEQ ID NO: 985679 - protein, 44 aa, Homo sapiens
ANSRSGTNTSLKKVVKETSYEMMMQCVSACWPPPPAQETQERLT

SEQ ID NO: 985680 - protein, 113 aa, Homo sapiens
TPEERIYSKMQQHGYENPAYKGREQLRTRPPPQQPLKSDSKPIASLTHRCPFIDYCGKKQTRIMIYSLSPWGQLCCNTSRCLQLELIHTSVMYTILSLHFGLYTTLYNGLRVL

SEQ ID NO: 985681 - protein, 45 aa, Homo sapiens
RCRLSARVLSMSSNSSMQHMVRKASSMSMFIQHAGLHLVEFALLF

SEQ ID NO: 985682 - protein, 84 aa, Homo sapiens
MRHQLIKSTISFSNTSKGDAASVIHLTPTLIQYFWAFQIVQHFTITDVTSYYQFISAEILSATHEGRVLFYTLLYPQHLAEYLA

SEQ ID NO: 985683 - protein, 114 aa, Homo sapiens
GTEDDGSHIVEALDPLAAFIGLATHVKHVEAVTLRTLELGLNRFQHVRTRQRTRVLIGSRHTSACCDQVILSREVLGTVNQLVLVGAFVAGTHSYILPESLGMLIAFGRQVKVR

SEQ ID NO: 985684 - protein, 178 aa, Homo sapiens
MTLRSWLSPHVTPQAQRIPTGSPQQHHFSISLPSYPMITDVQNSFHIYGFPYLVTHMIQDTPKVTFPSTGYPAEQSRWGRDGQAGARSARMVNSRPIKQLKTPSAGDGRTVNHRPRPSGHEVRATYIYLNKRHATQHDLSSPSHPKLLVHDYPGWGQKAMAQAPITLGDFSVPPQSHA

SEQ ID NO: 985685 - protein, 114 aa, Homo sapiens
HPQQVSKSGCQSGLNNAHELSDRKRGWLQARFRRLASSSGDKLLESNSNPMQVVGIPLQPHEQGPHRTRTQKRRVAAFSRRFISLILYNFSINYILKLVSPGKPIISGVVFTII

SEQ ID NO: 985686 - protein, 53 aa, Homo sapiens
TWVYGDDMTEQVYATMKALREADVDCLTLGQYMQPTRRHLKVEEYITPEKFKY

SEQ ID NO: 985687 - protein, 34 aa, Homo sapiens
RAHGGRWPSITGPSSARAITGQELGLGSLGHWKA

SEQ ID NO: 985688 - protein, 146 aa, Homo sapiens
MILVRESVTCKPEESVDSEPIPSHRQSGGGVVTEMLRTLSFGIQRSLRPGLRAAGQKASWRLMCKLVQCADLRSPQHRAGARQASTLSCPPPSRSSGNHTVAGLAELGLVLPEMSALKFSLGLFPVRNSTSEVSVETELAMPLGAA

SEQ ID NO: 985689 - protein, 74 aa, Homo sapiens
CCPSTPSGRRTVIVMDSGDGSPTRWPIYEGYALPHAILRLDLVGRDLTDYLMKILTERVLLFHHHGRAGKSCAT

SEQ ID NO: 985690 - protein, 123 aa, Homo sapiens
MPIVNCAELVTMTFIKDALLKANLMTDDLPCNFTSAFGAGFCTSVIGSPVDVVKTRYMNSALGQYSSAVHCALTIAPEGGALSLLRGVHALLSPLGSLDVVMSSPIAVEEPHAADFREVLLSS

SEQ ID NO: 985691 - protein, 53 aa, Homo sapiens
MANPFRDERAFWSYGITTVLVYQQITESTLDVSELRVLSEHAIIVYISVRCKM

SEQ ID NO: 985692 - protein, 65 aa, Homo sapiens
MGGCLEQRETAFTLLLLFPANNAKQPKLLKYSRKHFRQLTHGGLHVPCEEGGCAVLLARGVHVAD

SEQ ID NO: 985693 - protein, 167 aa, Homo sapiens
LFAGEVLKCEYRGAKSFQAQESEVNSQGAPQTVKSKGLRMQSLMSASRACSTLLVPACTSEGISCLSSASTQRCYCVDAEGQAIPGTRSAIGKPKKCPMPCQLQAEQSFPQDGEALLSNSSMLPPFPTPHPTVQHLMAVDAKCNELGLPSSLRVVQDGRLRQGQDLT

SEQ ID NO: 985694 - protein, 84 aa, Homo sapiens
SHILSMSHEYQGRDRCQCTASPSGREKLLLLESNMKVSIMFFWPLWSRSIRVTLCLNGHCNSESTSPRMTTKYKDRCDSWKCPR

SEQ ID NO: 985695 - protein, 110 aa, Homo sapiens
PILYAKDGFHVPMIPDYLSPQQQGDLGLGTPDQKPYQDLESRTQQPSTNPSVYYEGHLTISRASQDLKALNTSYQSQLIKPSRMRKYPNRPSKTPPHERPYACPVESCDR

SEQ ID NO: 985696 - protein, 38 aa, Homo sapiens
SRGSFAIRRPKRVSRPSSSRAPSVYSGSMAVIKVSIGG

SEQ ID NO: 985697 - protein, 57 aa, Homo sapiens
SYSLNCQQTLIRSQVKSHRLEMNSASDGCFPLQWHSSRRLLGSLHIIRMHIQWSRNE

SEQ ID NO: 985698 - protein, 39 aa, Homo sapiens
SESYGNNCSSRRRKGQERFNLLVLTGMTVAGVFCWAHSS

SEQ ID NO: 985699 - protein, 82 aa, Homo sapiens
YRSLVSPLNLLFDSKYQRFTAEKREQIKDPQQQSVASFIDKVRFLLSSITMVLETKWTLLQELSSKTVRQTSGACCSSMYIN

SEQ ID NO: 985700 - protein, 118 aa, Homo sapiens
LSPQHLLPSLLEWRIICLSASKAGLSQIHLIRLSKCQTCKSDHALSIHKILPRLFYMDIVGITHRVKFKYLGRTYMALHHLASPSPHTMPFSPPLLCPLPGHTLWSSIMCAQSRGSLF

SEQ ID NO: 985701 - protein, 38 aa, Homo sapiens
MSITRGCFHFLLTTLLLCDSWKCPAYGIQIHKVETREN

SEQ ID NO: 985702 - protein, 54 aa, Homo sapiens
GQISENTYHEKNSCVVVVLNLPTNLLNYNIHSHQNLITISLSSFEDHTLSTTVG

SEQ ID NO: 985703 - protein, 45 aa, Homo sapiens
NQSIISSSWGILSAVGACQAMPSSGLLACSFSHTYVHQGISGINN

SEQ ID NO: 985704 - protein, 137 aa, Homo sapiens
TVTFLSPVEKCALLIDSSAELEVLGRETSLFEPAACRSWFPSWHQWTHLQPRARCCCPGFSFRLFDAVPGGTYPGILWASSERIGSRLQHSVLQYDVPLIALSLATILEPPENLFQRAQLALGTGRIQKGSSSAPPQ

SEQ ID NO: 985705 - protein, 40 aa, Homo sapiens
SGYQFPPGAVYDRGAGGGGDPFPPAACSPESRASGGRPPR

SEQ ID NO: 985706 - protein, 81 aa, Homo sapiens
SVCEAENFVKDAGSYSKKVVGTPVTRSQAENSRTLFQLKQRRNVPMKPPDEAKVGDTLGDSSSSVLEFMWMKSYPDVSVDI

SEQ ID NO: 985707 - protein, 35 aa, Homo sapiens
YICVFCAHIPFMTNLQVWATSGYHLMITCQVQTRA

SEQ ID NO: 985708 - protein, 70 aa, Homo sapiens
DVDQVAKIHKAVVEMANSFNLGVNEDDIEELLAVVPEELTNELLEIEQATAEEEARENKTAENHHQENLQ

SEQ ID NO: 985709 - protein, 59 aa, Homo sapiens
SEEYPIMIAISDRCHFPCLFVPGQPQMSSVEHHILATISLPRFSSIAPGIPLQGPLALN

SEQ ID NO: 985710 - protein, 46 aa, Homo sapiens
ASVIGAHDRRPSVDDLDKAAKEFQEKHKKEVGKLEEHRTYSELHKY

SEQ ID NO: 985711 - protein, 107 aa, Homo sapiens
MEYSGPIMAHYSLKLPGYKQSYHVSLPSSWDYRYSIVTLSELSFIFCSRDRDLSMLPRLTLKLIALKGYFLALDSQSIGITGMSHSAHRLWFYNLLTSLYTSFKECL

SEQ ID NO: 985712 - protein, 86 aa, Homo sapiens
RHNSSKENQEKHKTAEGRRTNKDHTEINHRGAEEERTADKNTSRADRHAQQPKKVDKKRKEEAKQEPQTEQEVKEQGDKEHKKIYN

SEQ ID NO: 985713 - protein, 72 aa, Homo sapiens
RDHLCSSPVGIIFSTACNSLPSISHFTSHSAIFAGAANHHHVHVRASHACRTQQLPSQAPLTTIKAIPIRPH

SEQ ID NO: 985714 - protein, 35 aa, Homo sapiens
VTTDEILGLRALQQYVECGESAKYFDAVWEYARVS

SEQ ID NO: 985715 - protein, 96 aa, Homo sapiens
IHPAALGQVGLSQDLEETGYLWSTLAVTCSLRQSPLPSFQKQGSWLQTRELEIQGCNNSQSEPIWGHQDRTLKQAHTVDSVLESCRAPSESRHCAS

SEQ ID NO: 985716 - protein, 69 aa, Homo sapiens
LTLVFLQANEVEASGVSAESAGSDYVHSEAGAGPVVTSPEHIPMDSGGIDSFRFRGRDHSDLLKSYYTS

SEQ ID NO: 985717 - protein, 49 aa, Homo sapiens
MNSTAQYAGIRLGSVIGAKSRKAQDNIQQTLGAPKPRASIGYARDGLGV

SEQ ID NO: 985718 - protein, 122 aa, Homo sapiens
CEKGSSKLKAQEGEAHCSRNPVLEEELAGIPDLACIPEQATVQAGSTQPPKSQVEKTQKEKVLATCFKTSLVADQKLRYPRWLNFAKWLDIILLKVVPRKLLKPTAKKPFSQHPENNCEASN

SEQ ID NO: 985719 - protein, 83 aa, Homo sapiens
LEDPGIEWHVEQYMRLARLPAAVAINDLADFNKLGKLFTQILRVKDRDDFPVVSAGNKADLESQRQVPRVRSLCLRRLPSHGH

SEQ ID NO: 985720 - protein, 110 aa, Homo sapiens
EWHVNCSIFGFEGVSLGACCFRVGGKVGWAGSGARLGWREFTAKQTGPTLEARIPGSGRTTRSKARHTRLNGHGAEGSCAGSLATSTHMLLPPRPPRVTRCSPLAQLNAC

SEQ ID NO: 985721 - protein, 39 aa, Homo sapiens
MVILGSHKQQMRGEDVEKWECSYTVGGSVDWLHIVRGQL

SEQ ID NO: 985722 - protein, 37 aa, Homo sapiens
MIPSSPPPPEAEALSSSLLLLIRGPLEYVPSAKVEVV

SEQ ID NO: 985723 - protein, 42 aa, Homo sapiens
NSCQVVEDTLMEGSIYAMPLLLCPKAYPSPKHEILTKNRVWL

SEQ ID NO: 985724 - protein, 101 aa, Homo sapiens
QYRRKPDHNELYEIYCLRLAESQITYTRTQILHIRKTLTDPDPYTMHPDPTSSDTDQIQILTTEPDPTSSDIERPRSLYQGTMLPPKTLTDPDPYTCTRIK

SEQ ID NO: 985725 - protein, 52 aa, Homo sapiens
MSKREDHCSPGVRDQPGDIVRLRLYKKIELASCGGAHLIDPRLLEGSDGEMD

SEQ ID NO: 985726 - protein, 180 aa, Homo sapiens
RVTQALFAKEVSCPMSSSQEVVSCLRQKPGNVLNDAQTKLLAVSGPFHYWGPVIDGHFLREPPARALKRSLWVEVDLLIGSSQDDGLINRAKAVKQFEESRGRTSSKNSLFQALQNSLGGEDSDARVEAAATWYYSLEHSTDDYASFSRALENATRDYFIICPIIDMVSAWAKRAEERSH

SEQ ID NO: 985727 - protein, 32 aa, Homo sapiens
LVSQTVRVIMTSVVDCRYRCCEIVSSEYESDA

SEQ ID NO: 985728 - protein, 70 aa, Homo sapiens
TLVDPPNTCNLDLDSIIAEVKAQYEEIAQRSRAEGESWYQTKYEELQVTAGRHGDDLRNTKQEIAEIAVF

SEQ ID NO: 985729 - protein, 31 aa, Homo sapiens
IRVMSMLNGAVQHKVEEWVEALQGFHASALP

SEQ ID NO: 985730 - protein, 159 aa, Homo sapiens
MVHTNLSNLYLTCDFSLPSFGQQYEWVAGNGRRSGSKPGRVFHSGPVDTLDLLCDGRLILACLFRLWQINHDISSSSIRLSMLTVDSPQGSQIQTHPCAPLACPCPLHRAHFLSSWLICSFHSNITILGPPVQKVCFYLRIFIYFALGSMTTTFLNHSP

SEQ ID NO: 985731 - protein, 122 aa, Homo sapiens
GLQGHTYAGHLISPPYHVQISPQLPAALTFASLHQLRVLSPPAPIQGRRDLSRSWARHHHPCLDAPQPTLFSKGSLRGPGLSRKVSDGERPGPTHTGSLSYLGTSPWEESPRDCSVHPTAPR

SEQ ID NO: 985732 - protein, 99 aa, Homo sapiens
QPVHTLSDDKKCQMPRKKGCMTIDLGGLEYGFLERCDIQTEYWNDMSKRLIRTKYEGVYSNHEGTVSDTNAQNGKIKALEYFERNCKSETTNKYAIPVT

SEQ ID NO: 985733 - protein, 89 aa, Homo sapiens
EAVYCATDIHGLEESKRLESCKHWEASFTGWTQSSQSCWIQGPQGELLHSVARQLLALCGGGRSSSSSVWQLDSIAFCQFGNALTTSTC

SEQ ID NO: 985734 - protein, 95 aa, Homo sapiens
VASFMDEADAFLADSEPLEEISKDLRARRERLLYHMGQHSNKFMLVLASNLTEQFTVTINSRIDVMVHFDRPQQEERERLGETAFGQLWYLRPAT

SEQ ID NO: 985735 - protein, 59 aa, Homo sapiens
MGFFCVDEGRLPHTQRLLEVISVCDMPQSAVSMAATPPTTADRRTAAQWTCIVWEDRDT

SEQ ID NO: 985736 - protein, 41 aa, Homo sapiens
SVPGRQDTGQQIRRQMRLQADVPGKCQARTDHGADIVSRLP

SEQ ID NO: 985737 - protein, 82 aa, Homo sapiens
YGDLLRAELDGMSPPEFSNMVRSEVNKLMAAASKAGHNRFTHFEYQRIQLRLGTPTQLHRVAWQRQWAGQYAQAGHLRNRFG

SEQ ID NO: 985738 - protein, 111 aa, Homo sapiens
DLLLLLRAESSVGQESQIHVRVRALVCVILSGQDWVVVVHLDPSLSYAALAWCVSGLYSLPFTQARGNQPSFLAGEAEEVGAFALGFAEHQQRMSLEKMKREAGGGSCYES

SEQ ID NO: 985739 - protein, 48 aa, Homo sapiens
MDLTDATRRKQTVRGERLRQRRPRRHVRLWCRNARTVGGDGGLLYDVD

SEQ ID NO: 985740 - protein, 45 aa, Homo sapiens
PKPDNYVTERLISMAYGQIGMIQALGGFLYYNLCRYLAREQASYP

SEQ ID NO: 985741 - protein, 50 aa, Homo sapiens
MTSLANNCETPSLLKTTKTYGRCGECAPYYSHDYSGGLSETGRRMSETRT

SEQ ID NO: 985742 - protein, 61 aa, Homo sapiens
HCWCWPGWILNYLNSSEPPDSDLPKCWDAGVRQRAQPEHTFLMEPTHEDVGAGEILIVIDL

SEQ ID NO: 985743 - protein, 32 aa, Homo sapiens
MVRSTVKSPKLSHDRGKAAIYKGFPMQTRHLM

SEQ ID NO: 985744 - protein, 71 aa, Homo sapiens
DIPDGVQKILQDYKSHPGYHCHPGYEMNLLRKTSETVSRARKIQRILSQPFQVCIEVFTGHMGKLVPQKGA

SEQ ID NO: 985745 - protein, 59 aa, Homo sapiens
VLRVELEPRCVGLELKRSARAEACQNAPAMHTSKPCTCHVSCASLVVYSSSDVSTCTAM

SEQ ID NO: 985746 - protein, 109 aa, Homo sapiens
CHSLGTAKAMTEELTAFPQAQDQVQGRVFLDGVVRKSAAIFQLLACKDEPLLDRRDAFLILNLELDILDVATGLHFQSAGLAEEGLHEDLHTTSQTQDQMQVLLLLDVV

SEQ ID NO: 985747 - protein, 95 aa, Homo sapiens
DWYQQNKYDSDREGRDATGDGTKEKPYTTGLHGFDDSREQEPFPTIYVASQTEHERWPVISTNQRLTEPLKQMWHYGNQTEDVTLPGTKTTTADT

SEQ ID NO: 985748 - protein, 133 aa, Homo sapiens
SAYSSAGTSSNICDAEYLQSGYDVHLEFLDLCVEGMRDDHLYFSQIHLELTLPGKLQQHGKELMCTGTAFPCDTAIMKLWNLTMPFIQPSSTLKESFDGQMTEDNIEVWQSAMQAGFRRLTPTEVQDYLAAIA

SEQ ID NO: 985749 - protein, 44 aa, Homo sapiens
MNEGGTQQDTEGEGGTEEGLGYLNPSVCQRQKEDINITTVSWLP

SEQ ID NO: 985750 - protein, 34 aa, Homo sapiens
DGRNCVYYCAKEGGYLLWFGELCLTVWTSGAKVT

SEQ ID NO: 985751 - protein, 78 aa, Homo sapiens
MSARGATGISRAVRDLCLSECSQHDGLSPHHLCNTPTLGAVRLYCSYADYLTTRCTTYVCTGQNLADLSGSRERRPPH

SEQ ID NO: 985752 - protein, 56 aa, Homo sapiens
WGACPDNRGRIQDYMNSEVLAHMGIKACRGFKTLTGDVKPRNCLVKHVVNADTKGK

SEQ ID NO: 985753 - protein, 80 aa, Homo sapiens
MIPQCIKEEDTPSDHDRGICMSPESYLGSPQHSPSPEGSPNRSLPSPGVLCGSARPKPYDPPGEKMVAAQVKGEKVDKKL

SEQ ID NO: 985754 - protein, 184 aa, Homo sapiens
ASSTIESEPPKHVEGVWWTSMVDTLSDHTRPVVWCPTLELLTPQSAGCQLVLQQLLVEAIFRGVTAHQEQRQASAGSKGVTSNGEQLHGLGGLLLPPLQGGEVEDPEITGDASSGKSPQQIHGTTDSGHIMRLQWKERGDGPGPPSSAPASICVQRRSLTEYLYRFPSSPWGRPGPKYHKVHRV

SEQ ID NO: 985755 - protein, 163 aa, Homo sapiens
IQAVQAEPGTLTDQDDREREPELPAHPPRSSTLDHNTLARMPSGLPELKLLQVVYLHSNNITKDGCQDFCPMGFGVKRAYYNGISLFNNPVPYWEVQPDTYPHAVTDRLAIQFGNYKKKRQLQPPRGLSGGLWGTQIDILMGRQRQEAKPGPSCVQPSPPPRV

SEQ ID NO: 985756 - protein, 69 aa, Homo sapiens
PPIHSVPRQCVSLLTQVSARLGDKQASSAPPVSSAKAGTEHANGPAIRHTCQGGDSTGGQEWVHTMTGP

SEQ ID NO: 985757 - protein, 109 aa, Homo sapiens
YGQSLALPLLEHAHGLRGTRELAWTILSHLHMKYWNALDFTRLLIPLQMRSASWEAHQTSALCFSWPSPSTHAPSYDSRTPSFTDDDGGVSSCLRALPVRYALPGTHPG

SEQ ID NO: 985758 - protein, 40 aa, Homo sapiens
RRYRGSPSRAEHYPRQTMNQIGACIRQWGVTLLLLAVFTS

SEQ ID NO: 985759 - protein, 136 aa, Homo sapiens
AAAMHRHAPSSVWPVHIITCSSPISSRSSLTFPVWPFPVISMCISCILVHSIVLLAAASACSCCQSRWSTMHAQLEVYIFHFNFSQVCSSVAGHIQAKQHNNIMFSHFQSRAHSQLAVQTQWQNSIVLNSTQQAQH

SEQ ID NO: 985760 - protein, 102 aa, Homo sapiens
NAQVTNIPQVLNYQTCIQNFGWGDLGAEPNLTEQYMLRLHQSTRTTILNRSNNLTNGPRYPRDTSQSYTRVHINKRVYELNIGSGHPDGAAAITGSFVRRLP

SEQ ID NO: 985761 - protein, 84 aa, Homo sapiens
KEEEEEASSEPAVGITRHRTGGQAQRLTPALPATQEADAGGYLEPSSFEMSLGNMARLALQKVLKNSWVQWHVPIVPVIQEAEV

SEQ ID NO: 985762 - protein, 31 aa, Homo sapiens
MGIIGTIFIGLIVGLLARFLKPGDDSMGKST

SEQ ID NO: 985763 - protein, 34 aa, Homo sapiens
MFGSTYICEQLFSIMKLSKTKYCSQLKDFPDGIL

SEQ ID NO: 985764 - protein, 100 aa, Homo sapiens
IVHVKELGIPGLMQFYWVHYRLSQDTDNQTKVYAVITHRTKKKNHLTINTDIFVVSLYKKQIRAFMWGYSYVPVVTSRSPNSSGYIILVTWPLNTGNRAR

SEQ ID NO: 985765 - protein, 69 aa, Homo sapiens
MAPLPLLLGISSGSSSRSCGAWRLATLRGCQCLLQLDHQYVKSQLIKIIDSDQPKPGIAQLAPTGEKGG

SEQ ID NO: 985766 - protein, 75 aa, Homo sapiens
MVCVVTVSVCDIITVGVMPSWRLCDINMCDVDMARDVDAASRCDVNAKFPMSVCDVLHLNEAIAISLRDVTWPLN

SEQ ID NO: 985767 - protein, 57 aa, Homo sapiens
MPNTNSPIRPRTIHNTNPPIRPRTMQNTYPPISSRTMPNTNPAISPRTIPNTHLPAY

SEQ ID NO: 985768 - protein, 77 aa, Homo sapiens
REAILVIVYYTPGAGESSKMNDAFGGGSLTASPVKKHRLVYVSSLHSKQMSFRITERTDLLGKQNCSTKVFALRLTL

SEQ ID NO: 985769 - protein, 52 aa, Homo sapiens
QRLERGNKNLLVETTSRTAPQLGSGLFQSLQSIVLNLEILCVSWPEEGGSRA

SEQ ID NO: 985770 - protein, 70 aa, Homo sapiens
QDTKSCSRPTDMLSTYHCYAYARFQTKLFISFFYLWVHLIINIIQVWITSPGILCSIFFIHLATTVLSFK

SEQ ID NO: 985771 - protein, 40 aa, Homo sapiens
AGVADMSHRTWSDTPFSFNELSGAVATPLLCGMQVVRDGL

SEQ ID NO: 985772 - protein, 84 aa, Homo sapiens
YVSYYPYRTHLPYRLIYLYRLILPYRLILPYTSYISLTVLISLTSYISLTVPHTTLTVLNMSTISSHHSPIPLHRYHSYTPTVR

SEQ ID NO: 985773 - protein, 52 aa, Homo sapiens
MTHSSVHVFRLSELRGPDETGDVAHGKPAGPGFRTWPQARPTRVDANFNAIP

SEQ ID NO: 985774 - protein, 103 aa, Homo sapiens
QVDAQSEAQALSWTGFLSQDPSLQASGSRHQGGGWDSVSGCGWEGVSGRGDPRVLGVIQSSDGLKVPRWRKEESLLLACLPSCLLQDASSHRLWTKVWNLHQP

SEQ ID NO: 985775 - protein, 112 aa, Homo sapiens
MQAGAVHVGLLCGASVKLLSGAVAASKPWCYESVPQAQGPQAVLLMAENEAKQLPSLEDSTGVEAEGPFQGRAALGAAAGARALFYHTGTGTQVPALSAGSQEADSPVVRSH

SEQ ID NO: 985776 - protein, 45 aa, Homo sapiens
LEYPFLMEPQATDASTRLGRGVSEDQVLQALLDDFDYKLRAAASC

SEQ ID NO: 985777 - protein, 33 aa, Homo sapiens
MVLYLSSRKSPYDKTGRLLLCSSICFYVLFIIE

SEQ ID NO: 985778 - protein, 77 aa, Homo sapiens
KLTLVALLLWADRCHVVRDRDLDGGHHPQMSLSQQIENIGAQRRRKEPAPTWRDLKMCHSDWKSGEYWIEPNQGCNL

SEQ ID NO: 985779 - protein, 74 aa, Homo sapiens
TFSTSAPTVCVTPAVLSDSNSRTYLESQGCLLAESLSPARLCLACPCLVQLTMPPLVPCFPKFCCAALNISSRL

SEQ ID NO: 985780 - protein, 39 aa, Homo sapiens
MCPLAVWLFRVPSGPFSVFTQGRPSLSFLSLAAWHSARW

SEQ ID NO: 985781 - protein, 40 aa, Homo sapiens
MTGVPGPRGRSMSRTSHSYTLSHGPGSHAVIDSRVFRSQT

SEQ ID NO: 985782 - protein, 37 aa, Homo sapiens
VTALRRHVPPLSLGSPFLSGGQSEEEAVIKLNAIGPA

SEQ ID NO: 985783 - protein, 44 aa, Homo sapiens
ILVLESAPGPGLQHHEQWLVGGPCLMSLQSQRRLSPEIHLPHFI

SEQ ID NO: 985784 - protein, 30 aa, Homo sapiens
MDQLPWVTPRVLQTLCLDTCIHVAIGPGGG

SEQ ID NO: 985785 - protein, 113 aa, Homo sapiens
QAEMEVIAYVMLSIQPHYIGGVTVQRWRKVRADMSETVTTPVLPQSYSSLPSTETKWGPTEISTSNTCWLNHVASARGCLTHARGRLTLTRGQIPGFNTMTLASKVPRKEAPS

SEQ ID NO: 985786 - protein, 45 aa, Homo sapiens
FNNPHTGNCNEGLKNVTAGANPMDLKRGIDKAVAKVVDHINGFCR

SEQ ID NO: 985787 - protein, 107 aa, Homo sapiens
RAGTSSGPPLRPVNSLQAFSAWVGSKNSTNHRKVALVPHTKVPRGKLSRLRGPWVDIMVPISASLTCTARLPVYHGFQWERPVHSNSFLCKGDKVLVIGFGIPGLRA

SEQ ID NO: 985788 - protein, 85 aa, Homo sapiens
QFWPPLLMITPKKGNQGIIDDTSIPMFTACTASQPPRLESELSVHQQMAGTENVGAYDTVQYYAAIKRNEILSFATTWMELEASC

SEQ ID NO: 985789 - protein, 64 aa, Homo sapiens
VPYTPPPGFLPSLVYLVCGPAAGAGATPLRDLLRVVYHGSASPGGLLTHRPPWTSTRRTGVPAL

SEQ ID NO: 985790 - protein, 52 aa, Homo sapiens
MILDIVLSQSLKTCALVRIFSFRQEMSCASEFLIILVLSQDTVTQFRTVSFI

SEQ ID NO: 985791 - protein, 124 aa, Homo sapiens
GDSLRARVISRIALCGTVVLQVPGRCSAVNVGVQGQPGVVKGCRGMLVTRPWVGESTLVKESASGAKEAEGDGGLGRVTYLCPMLLMRLSIAFPYSCILMALILFASSPFQEFTAGGTQNLPQL

SEQ ID NO: 985792 - protein, 44 aa, Homo sapiens
ASSNISTSEKGDRKKGLTNQSRKSHEDKSLLVLSWVISVLPRER

SEQ ID NO: 985793 - protein, 66 aa, Homo sapiens
PELMMSDGVTTYDGMARAWCRLNCLVPQGLVLPQRAGSGGDCAQQGSRRSLEERPHMCRRKYSRKD

SEQ ID NO: 985794 - protein, 50 aa, Homo sapiens
MSEMEQFYPKTFPTSWNSCLPLNWSLVPEQVGDCWLRQPPFSDEHFELGN

SEQ ID NO: 985795 - protein, 39 aa, Homo sapiens
TRYRTEILRNCGKSRVVSGRQWDLRATAAEVGLVQALDV

SEQ ID NO: 985796 - protein, 39 aa, Homo sapiens
PRHLAQKFSHEEIAWRPSQRCADSAPAVTGITFLPLGQR

SEQ ID NO: 985797 - protein, 72 aa, Homo sapiens
LCCGRSDGLPLDDPRLTELTRWEAALRALEGLVYRSPTATREVSVELATRALWRSPANPTTQVFSSRCRGTE

SEQ ID NO: 985798 - protein, 36 aa, Homo sapiens
WQGEARKIMPLHRHLTQIGAKDSPCQLDGINRYVAK

SEQ ID NO: 985799 - protein, 52 aa, Homo sapiens
LTGHTLSSGHKLSPDPGHTLSSGHTLSPDPGHMLSPNPGHALSPNPGHTRVP

SEQ ID NO: 985800 - protein, 166 aa, Homo sapiens
GREVMREEKTLSRIAFMQQDVLDRAREQLSATAEEIQGPKSIDQIHKEAAMAEHREHIKVQQLMAEGRDQASGLVLQALPSAVDFPLLDDGGWNTVPISKGSRPIDTSLITKITKPGSIDPNNQVFAPGGRLSWGKGSSDGSGAKPSDAASEAARPGTSTLNRFSG

SEQ ID NO: 985801 - protein, 44 aa, Homo sapiens
EDPLRIGCILIEYYLGFTVFPTHDSKEHLAVIERILRPLPKHMI

SEQ ID NO: 985802 - protein, 193 aa, Homo sapiens
MTALSLSTLEAPVAAVAWGHWLIPVVFPCVDRRHPDTHAIHAAAVLVTVIRAAHVTAVIALEALLTYTFALDNSGPDCDSHWGTVAGCSPPQYSPHHTHNLPIDTAAMATAAIGTLELPTVSSSETIITLTPPVYTAATIVTVSRTPLLAAVHTGKRLITYTLPLLTPGLGVAGMWAGGFPQSSPVRLLRRPG

SEQ ID NO: 985803 - protein, 139 aa, Homo sapiens
SGVQIILLPQPGWETQAEMDTQGGGGPSDVQGVKTVMLSKHNSPISSVQSQPSQSVRSVSSPKVPAFESGYTQISPEQGSLSGPLYAEQGAQPHEGCAYRIQTTLKQGGGTGASVTWGRIESTIETYENPKKYDSSDGR

SEQ ID NO: 985804 - protein, 67 aa, Homo sapiens
GRIVQVQPQVTAVSAKRQPEEHLQRRCQYSHQSRPMSSLIPSRRCRCWFQSHDRVVVHSLRRWTMPP

SEQ ID NO: 985805 - protein, 52 aa, Homo sapiens
SKDPVQPSAEPDPLRCMPGVAGAGRATIRPCSTFVDQQRFSRPRNLGELCQC

SEQ ID NO: 985806 - protein, 38 aa, Homo sapiens
IPMAAPRSAASSTGLAIRQQGHTHILFQVGKGSRSSHI

SEQ ID NO: 985807 - protein, 40 aa, Homo sapiens
WQDSANSLKIISNASCTTNCLAPPGKVIHVQLWYRGKDSM

SEQ ID NO: 985808 - protein, 40 aa, Homo sapiens
MLDDRDWGMQPQALLNAHGQEGQLGQVVPFNLYRFTVPQK

SEQ ID NO: 985809 - protein, 52 aa, Homo sapiens
LAGHAFMDTAWVGVHNTYKLEEFREPRGQVQWTVVTDNNAPGNFSRIMNKEQ

SEQ ID NO: 985810 - protein, 41 aa, Homo sapiens
YTKPAQCGTLVIVNNYTADRINFSLARGELARVLNGISLDN

SEQ ID NO: 985811 - protein, 38 aa, Homo sapiens
MRLSNSGRSQLSLPQKLLQSSSSESSPHPLSLGGTSSN

SEQ ID NO: 985812 - protein, 68 aa, Homo sapiens
MAYPAGVTLIPPAAVPEFQTPHFDALSPTQVEPGTGGSTEEAGVRRIKMATADKIVKLMLDHMTNTTN

SEQ ID NO: 985813 - protein, 78 aa, Homo sapiens
TVSLVMSEQLHLLLSRCVSFSSDQELAVLVQTGHRSAHLSLQAAEVETPVYTAAGLWGMLFFTPYAVAVVVVPLGQRG

SEQ ID NO: 985814 - protein, 35 aa, Homo sapiens
FATRCRRMIMIRMHLPGSCDRTYVLAGTPLLSLHS

SEQ ID NO: 985815 - protein, 48 aa, Homo sapiens
RPSLADMPCGWMVTDTLTDSHCNPDLQQSQLPLVCHWASVSQASAIGH

SEQ ID NO: 985816 - protein, 72 aa, Homo sapiens
MCTECDVNETDKQTLYLHPNWYRHTDKQTCAPTSMNGWINQTLHLTIPSDGMDSHQTLQLIHERMNKQTWHL

SEQ ID NO: 985817 - protein, 75 aa, Homo sapiens
MLSRRERTPHFEGSHKLCLLVEGPGAASGRSTVQPLRVEEGWAVAFTLIFAHYAVKDDGKALSSEARPAAEAFSI

SEQ ID NO: 985818 - protein, 56 aa, Homo sapiens
IEVDLSGTQFLLSRSGFYYFIHFIYFAGQSPGRNKPGQFLINEFHTNTKRFCHWAS

SEQ ID NO: 985819 - protein, 84 aa, Homo sapiens
MAHTITKKFDTLKLQKKARKELLGKGELQPQLDSALRDVNDMYLLLEETEKRAVRRALIEERGRFCSFITFLQPVLDGEPTMLG

SEQ ID NO: 985820 - protein, 134 aa, Homo sapiens
TPLGNGGVVSEGQMLEEQVLLVSHQRGIGSNVRRRSRYSSETCSRTLSSASSSCLKVGLCEGAVCQHSRISAYSSGGQCGGRSIGCPSRSRENSSSTWIAGYGEAPKGERFSHSRIPKDHTSLLCVLPPGQTRP

SEQ ID NO: 985821 - protein, 39 aa, Homo sapiens
SLPVTSESMYIMDCMRWVTAGNEMELLIKTKNGECPPSS

SEQ ID NO: 985822 - protein, 41 aa, Homo sapiens
MYRPAGIYSSLCPAGHSSNCIKPDGLLEFAKQLARWGRGAF

SEQ ID NO: 985823 - protein, 54 aa, Homo sapiens
LSVGRPKLTWNWTNDDKLTFLNDLDLNLTPLYLLLDYADDYYFTYTLPTILDMS

SEQ ID NO: 985824 - protein, 142 aa, Homo sapiens
VVVLGRSLYAHCVDSETPIPMWATFESWESACVLIAHGFPRSLGPHLSRVRSLELDDWPPLHRKVMSSIVNDLTNSIWEGSSQGQTKPSEKSTREEKEQWIRSKYEEKLFLAPLPCTELSLGQQLLRATADEDLQTAILLLA

SEQ ID NO: 985825 - protein, 42 aa, Homo sapiens
TRTTFDSSLASTLAGAAAAAGAAVVAAATGAAATKADGSAKK

SEQ ID NO: 985826 - protein, 33 aa, Homo sapiens
ACRPLALPQAPVRSFSCSACAPPRALILPLGQR

SEQ ID NO: 985827 - protein, 52 aa, Homo sapiens
MARLRGCVPIFSTQRHLAKSAPSFLYLGTAAQTSPSNPWWVVSPFVPAIGQR

SEQ ID NO: 985828 - protein, 67 aa, Homo sapiens
GAISLLKEVEQLRMECYRLLSSHNTMVLGLIVDEAEVVRTLITPPAYGTNSEDSLTPHEIESEGKDN

SEQ ID NO: 985829 - protein, 34 aa, Homo sapiens
NGILMRKLLSAALPVVTMLGFSKVLPGRRGGHSE

SEQ ID NO: 985830 - protein, 107 aa, Homo sapiens
TLLSNATRVNYSWALWLTPASQSFRKLRQENHPNPGGGSCSEPRSRHCTPAWATRAKLCTPPPPKKKEKTNTSLLLAFKKTDHQAGHPTQALDHYKFKHQKPRVPIL

SEQ ID NO: 985831 - protein, 56 aa, Homo sapiens
LTIYHTPGLNPSADTALWEGQRKEKADGLTDTTEEQESSLGPMEEKYEPLGILASV

SEQ ID NO: 985832 - protein, 74 aa, Homo sapiens
ANPLEVEQDSIITEYLEVSTGAHVRRNLYRGGMHRIGEYTSPGSILTIFGGQQRCSLCRRKLVQGRHAPKWVNY

SEQ ID NO: 985833 - protein, 33 aa, Homo sapiens
RDEAMILARGKDPGDTLWKAAVPSIIIIIMTQL

SEQ ID NO: 985834 - protein, 50 aa, Homo sapiens
MIVCDHVSCLQMAVLSRMKYSLQVPPFYLVRKPEQALASQNSDLGLDAGV

SEQ ID NO: 985835 - protein, 38 aa, Homo sapiens
PGTRLDPGTALYKKAGSNDDDDDGRHSVLTTKGDLGLV

SEQ ID NO: 985836 - protein, 120 aa, Homo sapiens
LSVTRRDQFFFMKASYLVDRLISHNMGRSPALSIAPSLAPPGSHAIIWSGPRQKYPQSPTQVSQHGHCIDNHSHLPIGSKPHLDPCLSGGPSREPSGVRLTDTDANFSAGRSTRKPFTHT

SEQ ID NO: 985837 - protein, 36 aa, Homo sapiens
VSWNANHLAVFQYSSSPVIGATLQKGHTEYPERSHG

SEQ ID NO: 985838 - protein, 62 aa, Homo sapiens
MAADCLASDPAEKLCGACANFDGNQTNDWHDSQEKPAMENWRAQDFYPMLWLESVIHQERRF

SEQ ID NO: 985839 - protein, 94 aa, Homo sapiens
MIVTWIRKRVSDSTMCSYVFAKLIRLKVTVEIESSQRSGHAARLTQVKQRGVDDPGSGSVREKLSCVNSTVVKRGGELAALAVHVGLHVGDAVV

SEQ ID NO: 985840 - protein, 39 aa, Homo sapiens
MRYVNLQYRIFKFSLTLIFLPPFSMSKGHMYWANRGYRA

SEQ ID NO: 985841 - protein, 46 aa, Homo sapiens
MIVCDHVALKQQWPFEKPYKSLVTSSPILPVLKPDKPYKLVQDLGL

SEQ ID NO: 985842 - protein, 68 aa, Homo sapiens
MAPRTERRVTRDLMSDAVPNSSANICATREIWSWGGMINDIMLVPMAAGRLQALNELLDLPDLHVPVG

SEQ ID NO: 985843 - protein, 125 aa, Homo sapiens
MLSAKPGNSFALSLVSRRYGWQLLQFLSNLQRLTSALQNLKIYLLDSHTNLHQRAHLFPIPSGWLHAYIDVSTGVREVDPPLHCCAGRLKTTKPLRQGNAIIPVITLYVHTVFPSISLSTPLCNR

SEQ ID NO: 985844 - protein, 61 aa, Homo sapiens
SVLEVCCLSLVIRNLQSLCKEVIALHTCGAGGEVERQCHSRSTLGHVFLHPICCGSGGGAI

SEQ ID NO: 985845 - protein, 72 aa, Homo sapiens
EESAEAGASSHRSDTESYERATRQRLHILNTYKPQKDSWKSRQVILFWRPYLSRVTHEIITRNLDQDTETSI

SEQ ID NO: 985846 - protein, 38 aa, Homo sapiens
KTSRNSGVSYTVYVSVVRCLVMSRYYNASQATYGSTHS

SEQ ID NO: 985847 - protein, 96 aa, Homo sapiens
QTEKQQSQNCSRRLQIPFHSLNRDSHEKSKEVSPSWHNLTARVPKPLAEDQYWSVACWKWAAQQKVNGGKQALPPELRLLSNPWWHYILMGAGTLL

SEQ ID NO: 985848 - protein, 41 aa, Homo sapiens
ESISAPLRIRETCELPACVCSTSLSYFGIMSHRWYGISAVR

SEQ ID NO: 985849 - protein, 36 aa, Homo sapiens
APSMYTAFAAAFALLNCGMAVGPWHEEALLIVPGLL

SEQ ID NO: 985850 - protein, 63 aa, Homo sapiens
MYPLYTVTRSSCLLIDYVRLEQLHFLRELMDHIRFFPVWRLSVSTVSSGSPVMMPSLICGRIL

SEQ ID NO: 985851 - protein, 78 aa, Homo sapiens
MFNHVFYLQIPGTGLRKSKYQTKVVEYSTSGRNAEQLIYRLVAPARPPGSPLLKVTITTNSANLHTLPLTCFAKPQLR

SEQ ID NO: 985852 - protein, 50 aa, Homo sapiens
KALVSSFTTVIGCLFLNLEAADKINVPYFPAMLVRNCPALGYVLSLAIFP

SEQ ID NO: 985853 - protein, 86 aa, Homo sapiens
ALVLKAHEGTPQQHRQCQPDLQHAAGAFLQGVVSDGHGDAGTDQQDGIEQRQAPGADGALGRRKEFRVGVVEQRPDEFEVRRVPSS

SEQ ID NO: 985854 - protein, 64 aa, Homo sapiens
RLIIQPSASILARSWCVDAFSFFQHLLQVHDTRGFPPGLLYCYGAVVYTGKEPFRQGWCFSPGA

SEQ ID NO: 985855 - protein, 33 aa, Homo sapiens
MFNFLHLSKDYSTLTQISATPNVLVLYYYQQEF

SEQ ID NO: 985856 - protein, 61 aa, Homo sapiens
HKDSKEQALMSEKKKNRALRALNDQLLAELARIASVNQRLLFEMAELKAVSSGKVVALTQK

SEQ ID NO: 985857 - protein, 168 aa, Homo sapiens
DRFIPWHHQVDALKKMCWIRGASPGVSRLLSPTVGALTWTVSPGQVGHNYSGIILMPLSPTTIYGRLSRQAKFYLVPLHYRWAGCPMCRCNLGTHNLSWKAHRGLSVASVHRFHLCSGCGLTLDRSGQLPYQRAQKSHSQGDTMVRVGPLWCSLQNPASQPGAVRYWS

SEQ ID NO: 985858 - protein, 34 aa, Homo sapiens
RSSSAPCLTDIWRSAQVLTVSDGNLYMGGMHLKW

SEQ ID NO: 985859 - protein, 95 aa, Homo sapiens
SPTRTIGSSTPCPEHRNNHQWLSQDTTPLSTLVTRLPTTISRSTPTSESTYTTSPSSSVTDSTSKIAYSTSMTGTLSTETSLPPTSSSLPTDEDH

SEQ ID NO: 985860 - protein, 166 aa, Homo sapiens
VQDTDFVIRLKLGHRPRNGGTRRVVTSVAFMLTLPILVCKVRDSNRRKMLPTQFLFLLCVLGIFGLTFAFIIGLDGSTGPTRFFLFGILFSICFSCLLVHAVSLTKLVRGRKPFSPLMILGLAVGSAESQDVIAIEYIVLTMNRTNVNVFSELPVLVAMKTLSPAH

SEQ ID NO: 985861 - protein, 80 aa, Homo sapiens
SCCTWLRHHGKVSDGALLQVLSAPTYVIVRPPGPGSAHSFSRHKFQDGLGALYSAHVALALATFHCFSLAFSDASTLYSP

SEQ ID NO: 985862 - protein, 106 aa, Homo sapiens
MAVWCSRSPQDLPGLVMARQAHSSGRSNPQFSGTTIIRELQVLLSSTSPYIVSFYECVLQQWRRSSICMEHMDGRSVDQGLKKAGKIREQVFRKSQDGCNKRRCRI

SEQ ID NO: 985863 - protein, 35 aa, Homo sapiens
ELLRALTLFVMTERDMRWYTELNDPMRDGRFLNEQ

SEQ ID NO: 985864 - protein, 72 aa, Homo sapiens
ALPRWPDGTLTAFFLGMESCGIHEYTFNSIMKCDVDIRERPVRHTTVLSGGTTMYPGIAERLQKEITAIGPA

SEQ ID NO: 985865 - protein, 52 aa, Homo sapiens
EDFPTPVERLSLVEGSFPTPGVRVRSLVCRPVPKLPQSLEPRVPQAGIHGLH

SEQ ID NO: 985866 - protein, 77 aa, Homo sapiens
TLQYLTSCPPYFPPSSTGSLTQDPVASFESIPPSLSEDGSPLMLIFVVVSSSSFYNGSRPGSLQVAMEDSSRGVPSK

SEQ ID NO: 985867 - protein, 42 aa, Homo sapiens
VPRCQCNGRVYVVRIVCTFWPRTHKGDWLLKGESVKFHIVCP

SEQ ID NO: 985868 - protein, 58 aa, Homo sapiens
NEDATSQHDDDNIVNYQWFFFKSFGERYNCSKEHFIATFGGPQKLNVLTHSHSTLPVS

SEQ ID NO: 985869 - protein, 80 aa, Homo sapiens
SIMRKLECKHGLGLTMLGFRKGAFQVDVVVTSEPCDTQPDTFSVTYWQRYKSWSPSERISGSMMGTMPFCWRILRIEPSG

SEQ ID NO: 985870 - protein, 110 aa, Homo sapiens
MVFRVVKTVRWSDISGSGNEMTSLSNSESSLSLVRKRDRIEEMSALQAVLNMGFKRKSVFWVIWRMVIICVHLISNNSLFLFCFKHPPMVLESASGQNLFIICLQTLMRV

SEQ ID NO: 985871 - protein, 67 aa, Homo sapiens
TVTPAITDIMEVSTVLTVSTELVQGGMHRMGEYTSDQAPVIRYFGGQHGAHVSTELVQGGMHRSCEY

SEQ ID NO: 985872 - protein, 177 aa, Homo sapiens
VGMYPMSSPLHLIVAVAQRNRIQLKYLILRLSCGDVFQPYSSVTSGKVLQRTLSARMRRTRAGEVSRFFVNEENTTSNEKGLLAFLLVYSPIQSFHDVLRDTSKRVSYLNRHSCSQRNQDYWLDEMTKDAALDTSSTVESLEKLPDILNMTHIMSLNSTATSFTHYHQFRHNKKQQT

SEQ ID NO: 985873 - protein, 58 aa, Homo sapiens
PYSLRASSPLAGSRALSAPAPGSPGVTWLYAQVLASAGNRRGCTSSLHEALEDAQVGE

SEQ ID NO: 985874 - protein, 51 aa, Homo sapiens
GLRVQDAVGEVGQLQVGIPLLPIKACTACLGGNDDQFLPPPVKGFHHCTAR

SEQ ID NO: 985875 - protein, 66 aa, Homo sapiens
MAATTANPANDIRCTITVVQHIASWKLMDLEIQGWTEPLVQKALLQRATSGLELLNEWLDERDTAK

SEQ ID NO: 985876 - protein, 61 aa, Homo sapiens
MHIYHLDTGIHPQLRCQGVCADYSQPPSVSVCTLLSGRGHEKKDDDPVRSWDSVRLTLGDP

SEQ ID NO: 985877 - protein, 69 aa, Homo sapiens
APQMFLCDPSNDHLSPHDVSTGYVEQGLVCLRHHWLWERGLELPETLWLWERGQVSLRCSGYGNRAWYA

SEQ ID NO: 985878 - protein, 106 aa, Homo sapiens
MVPTEYIPYCLRQLLRMNLKAEDSLTTPTQTSSCSASDVVSPIILPERQCRNGCRQLRCHCPRAPIILVGTQSDLREDVKVLIEEDKCEEKPVPEEAAQLCADAYA

SEQ ID NO: 985879 - protein, 79 aa, Homo sapiens
RAGDESNGTGEQMGVSAYVREAFCPGNSHISRYKGQKRRSGGLRQVLQQTTPPYCRTIYNASICDIVGKPRAGKMQIFS

SEQ ID NO: 985880 - protein, 102 aa, Homo sapiens
GEQNRGLVYIVGVRLRGHATLAEVSRSYLGSNLYTEIANNMPYFLKGIPHDVSSLSPNTGKWCLFPFFTRSFYLEVYKKLAWVSFLCTTYFSVLNFMDFRSL

SEQ ID NO: 985881 - protein, 36 aa, Homo sapiens
RASVGYGLSTQGQNHHIVYLFFPPFLGSPVSTGARA

SEQ ID NO: 985882 - protein, 144 aa, Homo sapiens
MLESDHFSNVRDEHALGNLCNNPEAKRHPQLMGCVLWDGTAYIFGLYSLRLEGFGSKHHHQISPQLSPFTSVSTHKKVTMSTNNMAGKAQIMLQLIPQVGISSLAGVGHDSWLAFFLSFGYHFSGGLTTLVPATGALCGGILEA

SEQ ID NO: 985883 - protein, 32 aa, Homo sapiens
MTEAHTSLGPVAHGPAEMQRQLILLPKRDDGR

SEQ ID NO: 985884 - protein, 124 aa, Homo sapiens
SRTVFAMIPNATVSEHLLLSRIQANVHERSGHVRARGPQVSQGSISCDEYLSPFFLGPGHLIRMGKYFRVPLYKSVFNFSPVALLFEKHQLIFLSKSGGSKKGNFTICIRPLVPQRMITNGLAR

SEQ ID NO: 985885 - protein, 70 aa, Homo sapiens
PVRMFLSGSFHPTSPFPFTAEVWGSWGLDYFLDILLTGSMGSNIGTWSLAFQPRFCNQFLHNLRKVSSVI

SEQ ID NO: 985886 - protein, 43 aa, Homo sapiens
YPLAPSSWDYSFTSNLIFGKAGSLLVGQAGLKLPTQVICCSAP

SEQ ID NO: 985887 - protein, 32 aa, Homo sapiens
MHGFCYSPVNSCGSQPILPTSDYLQSGVPTLE

SEQ ID NO: 985888 - protein, 189 aa, Homo sapiens
RECPKKFFQQRRTINFFQPPLYIKMCSFDTTGYAVFFFSSGSTRDRFMQHLKVLFMWANGFHINLNSGYLDGGTSPFPWSFSLAGIFFTAALRIPAWLTHRCGGSVTPRRFRSATDLSTSSASGANELPAVQEGDQTSYKPDEPSDLCISKSLHEVLRKTPRTPSALGILVIIRVFGFTLGSRGSLGLP

SEQ ID NO: 985889 - protein, 68 aa, Homo sapiens
SSLYLNSWSQAIYLPQLSKCWDYRCDAPYAAGQWYLEPRSGVADFKNLIWSQTNGPASSASGNSLKAI

SEQ ID NO: 985890 - protein, 35 aa, Homo sapiens
ADPWCHACLPSQAFIQILLTDMRKQAVDLRALKGQ

SEQ ID NO: 985891 - protein, 101 aa, Homo sapiens
MRARYRCLSMPPCAGGEGAVTLITLDLNLPFLQVGALYICYQANVSRTSVWVLLCYGHLDPPSPGYRLRLSTASVYLTIVSIQDGDLSCLVSDPSSMSIVS

SEQ ID NO: 985892 - protein, 41 aa, Homo sapiens
LVPRPEWNNATHRGHEENGTCAAGYMQPPHVTVCILITPVV

SEQ ID NO: 985893 - protein, 37 aa, Homo sapiens
SGVMMHTAGPESLYKVHETCVCIAKSHILRVPHSMVE

SEQ ID NO: 985894 - protein, 54 aa, Homo sapiens
MSWYLVLNCSWINVPPFFRRFGAANFIGLIAGRMLFYLGGSRLLIAKSVMAIMI

SEQ ID NO: 985895 - protein, 103 aa, Homo sapiens
IESARYRCFMMHYVTHSHAEMSPTFYNIRVDRGLGLCLEVDVGEDGHYDLTVTLITRSLLATDFDESREIEGTESTVSHWVIDSQIHHRGRPCMDLQDLVTDA

SEQ ID NO: 985896 - protein, 66 aa, Homo sapiens
GLTYLAPCYAVRSREDEEQGLPSLQYPPGPGMSLTQGRTTTHVESGLQRGSSCSRKAYGNIELTAG

SEQ ID NO: 985897 - protein, 154 aa, Homo sapiens
GGVVHGSIRRRNCLYSWDHADYARRDGRRRREWEQYLLSGSVSTPRRGTHPGGCPSQGRLWGSGSLLRGGDGTNWACVLATRSWLGRMDSDLPTVGVGQGRLSYDKHHSPILRCRLYSLCVLVNMSNTYFPRRTLTRAPEIWGLAQSKGYGTFA

SEQ ID NO: 985898 - protein, 38 aa, Homo sapiens
SWYGVMMHGGGSADRLRSYSCARFAFLRNHVDKPDIAE

SEQ ID NO: 985899 - protein, 51 aa, Homo sapiens
LAEGSRLEEQAVQAFFLPFLPREPVRKVSSSPILSALDCRGGAVGAVGLVG

SEQ ID NO: 985900 - protein, 57 aa, Homo sapiens
SALSRTGVVDDESSMTRADGDNPPGGEGHGGLVWAVPDAAWARTRCPGIPVAEGTEL

SEQ ID NO: 985901 - protein, 37 aa, Homo sapiens
MRVSMTRADGDNPPGGEGHGGLVWACGRSSVGPNTMP

SEQ ID NO: 985902 - protein, 72 aa, Homo sapiens
MSEHNRLTPWPGGGDPRATYLLVAISPWPYPDTRALLHKTPYQHPVYWEPCASWMEVQLGVWIPEGGSSKLH

SEQ ID NO: 985903 - protein, 35 aa, Homo sapiens
SLVGSPVCSGLAPPCWLLLPHSCYSEYLEDVLEEL

SEQ ID NO: 985904 - protein, 61 aa, Homo sapiens
FNKLTVRGEGRRVVYRDSGPRRGVLTTNTDGTRDDYPCNDGTVRDGVTYDDDTQRRRGRRH

SEQ ID NO: 985905 - protein, 85 aa, Homo sapiens
STKQKSAVLTLQTMCSFESQHRTYISQPQVGFQSGDETGLMSGTFRQTEVSDSREIAGGSSADMGTTQNVPKWTGLKQPLKRDGS

SEQ ID NO: 985906 - protein, 106 aa, Homo sapiens
MARDACTQVEAEGRGVSVYPTLLKAVAGGWLTDTSLFRVLWGLPVECGEDDTRRALGSGTLHRVDSKEESKDVIVMAVAVGVAVLALGGWSNSAASCSLISMFIRG

SEQ ID NO: 985907 - protein, 76 aa, Homo sapiens
MGVIPEPFHSPLREAATESGEVERQFPCGASAQVLRNCNRKCSDAGQTPSENGNLHLLHMPIAYMEMVTSYHSHSF

SEQ ID NO: 985908 - protein, 49 aa, Homo sapiens
PTSRQVPDQPDSSRVFIMPPISGVFARLGQRHPVPARSYLATPPCRASR

SEQ ID NO: 985909 - protein, 33 aa, Homo sapiens
EDSSYSAGEAWLNPVLVSDHPPLSCTRLSRQAQ

SEQ ID NO: 985910 - protein, 52 aa, Homo sapiens
MRGPQTRCEAADDCSAGYTRPWFLGMAGTNRSFGDGVFLGSSLFPTGKHAHG

SEQ ID NO: 985911 - protein, 51 aa, Homo sapiens
SVRDRRIGTNNCSPGDNTVIHPGAVMINIPPHSCHRHCSGNIEGDGKSGSV

SEQ ID NO: 985912 - protein, 46 aa, Homo sapiens
PPACTSSNDVQPMAHATRSSGEQLVPSAPDVKCVAPFPFRGDEACG

SEQ ID NO: 985913 - protein, 36 aa, Homo sapiens
TLSYYSHRLRIIDLSSLSIFHLHVLGEAVAAGEAVA

SEQ ID NO: 985914 - protein, 41 aa, Homo sapiens
VGGTEVPGPGSRYAPSVHRAPVDHLCLVPDTSTPSVVSPIA

SEQ ID NO: 985915 - protein, 69 aa, Homo sapiens
GKRTVCPNVDYHQQHESRLGESAWTQAHGSDCRALTYAPCCSYSIVPIYIHNRASSSDPFYYSLSVCKK

SEQ ID NO: 985916 - protein, 112 aa, Homo sapiens
MKEQERRGTLLEELTLCEAWSAHLQPRHTFSSLSSTKASHVAHTFACSVKAQNTQGPNCLPTAPASWLARQGQKDQIISHISPFKEAVIDHGAHAQIVPLGSLSSRGSQFLH

SEQ ID NO: 985917 - protein, 39 aa, Homo sapiens
VHGDSPWALACVFCQMLGAAYVSRKRGAYTFSGKPVAWV

SEQ ID NO: 985918 - protein, 46 aa, Homo sapiens
EDPVLKASIALRQIIWSQLYFWGKLAERRLNNATSQGATPGAGWTL

SEQ ID NO: 985919 - protein, 83 aa, Homo sapiens
VYAPSWCSYGGQPQMTTEVPVLVMVTPINEFSPDLLPLATFRVQEDAAPNTLLGSVVGTDMDYPHDNIEYYTSGGPTTFAVDR

SEQ ID NO: 985920 - protein, 30 aa, Homo sapiens
MGLAAGCLHAFCITGWQWNLQLVLLVLDCD

SEQ ID NO: 985921 - protein, 37 aa, Homo sapiens
SRGSLVASIITQADEAGFELLVDPAVPGVIPVKVVEG

SEQ ID NO: 985922 - protein, 53 aa, Homo sapiens
MARAVRVLGGVSLPSADILNRSVLQPRRKAWGGAAALPTLRLRGFPVRSARRG

SEQ ID NO: 985923 - protein, 60 aa, Homo sapiens
MGVGLRRYLLLPLSVGSGVVIPEVRPWEVVVSVDVRADAPQCMLPSSVPHTHVEDWYVGS

SEQ ID NO: 985924 - protein, 76 aa, Homo sapiens
EGAASWVVAAGVRDANMRILVKTLTGKTITLEVEPSDTNENVKAKNQDKEESHPDQQRSDMGRTNSVEDGRSSLSN

SEQ ID NO: 985925 - protein, 76 aa, Homo sapiens
GPRPRLGGESPAQLSWLERGRSSISSSGIVRLRSVISVWLGLDHFCVGGHLLVQLLSLAEEPGLDIPAVLLRQGLV

SEQ ID NO: 985926 - protein, 84 aa, Homo sapiens
YVKCVAEEWDTYFLSFVQCKVREGLCKSHSILSLLPCGRDGIWLENEWVFLSSSAVTMDDVTARHHPVMSVFLRCYAIQPFAPG

SEQ ID NO: 985927 - protein, 51 aa, Homo sapiens
RDISLKEYKQMTERTSGTFAYTGPSCGDQWGLLYVLDANGDGDIGIIAKEA

SEQ ID NO: 985928 - protein, 87 aa, Homo sapiens
MERVSWILACLAQRVDGGTCGSNLATDQVLGNPEQAVGDLCSLVAVQVTYVTPSRLVWNRGILGADQILVNPKQAVKEIVESLGAST

SEQ ID NO: 985929 - protein, 61 aa, Homo sapiens
ALIASRRYSLSALGSPYKDEVPCKENDFYFQAKSGKLTPLRNWFRLRGSGRRSSNMGLGLG

SEQ ID NO: 985930 - protein, 60 aa, Homo sapiens
MRCTVGSPLRIRPTLNIILYLYGEDIQTLGQEDSGIVPLLHKGKSSDASMLLAATCCLLQ

SEQ ID NO: 985931 - protein, 90 aa, Homo sapiens
VRRDDSPVETSSVWLSHVRHSFRETIYTISIRRQALTHTLHFTVRRHIVLQYVHMLSNIYCLSTVHWRSVVRWRLGRLGGSLTAPQYAAV

SEQ ID NO: 985932 - protein, 48 aa, Homo sapiens
RIQALIASHLAVLDTLGSIPVVEYNRRQKVGILEVEKIPEIVHISQRL

SEQ ID NO: 985933 - protein, 159 aa, Homo sapiens
SSCSYLVWKKSVVANISPELVIPSYLLAYTYASATLLPRQLPPQTTAHCKSGVQIPPLTGAVLILSPSSSCITQLTGPCTSTIDHYSLLDIQFMTIASVGPQLSTCSLHYLSNVFSPLASLYRCPLPSPGRDATAGYLSLVQQQGIALTEQLKQEAQLS

SEQ ID NO: 985934 - protein, 46 aa, Homo sapiens
QLLHTCQTAGVANKFLINEKIGSHGEKNDNAALVFRLTAEALETKT

SEQ ID NO: 985935 - protein, 37 aa, Homo sapiens
SRYLFFSIYSSNHSSRDTDQGEQASNDAHDGGITRSR

SEQ ID NO: 985936 - protein, 42 aa, Homo sapiens
MAEVRVRIEVRFFHSTLSLSSSLVASPPQPAQACASYLSSYS

SEQ ID NO: 985937 - protein, 103 aa, Homo sapiens
MAPNVLVLRVLSTVPDPGCFFEMGSRTVTHVGVKWRDPPPRLKQSSPSASQVAGAMGAHHHAQLKYLVETGFCHVAQAGLELLSSNDPPALARHEPPPHAWIA

SEQ ID NO: 985938 - protein, 104 aa, Homo sapiens
AYYGYDLAFLKDHKDGGVGHTGHAAIIEGVAPALLGRRTDKGGIAPDELAHQHPGQEHRVGLRVGFAVVVEYGSISGKVAPLAVGSAMNTTDPPVKVLLADGVH

SEQ ID NO: 985939 - protein, 46 aa, Homo sapiens
MPSGDTDESFRRYTYGEITTGCVPEEHPCGQEGGGHVAFTDQDMLR

SEQ ID NO: 985940 - protein, 35 aa, Homo sapiens
EVIIRNHVSSDDGLHGRLHLLHLWTDTYLDSAPEV

SEQ ID NO: 985941 - protein, 46 aa, Homo sapiens
HEAAAMGKSSGLFVVVVVVFEEMGVSPWVAQYGMGKGADLNCTGNA

SEQ ID NO: 985942 - protein, 104 aa, Homo sapiens
PVDGSLAILLSSLLHPGVDSHMPGTSRPTSNEPERPTIGQTYLVELQQRTTYTGSSEPPSALFYVVEAVGIAVNITYETVQTRPGLAWLQWSSIPRTVRQKCAW

SEQ ID NO: 985943 - protein, 92 aa, Homo sapiens
SSTPPQVVLERERPLRLAGALERERPRLAGVLERERTRLAALLERDLPLLLPDDLLRDLRPTGDRRLDLRLASVLDRDLPLRTGALDRDLRL

SEQ ID NO: 985944 - protein, 160 aa, Homo sapiens
MRLWRLLALAVQCRGFGAARSLVWGAPQKLLLGLGGTGMSLSRPCVRRRPSDSVSYCHVAACPDIGALTPLGVEGGIEPSSFLQSPPEVGEIMRLVNAYWGNPVLTVEALSQVFSSMPRSAEIASPPRQRPGLDEPRDGLAAGGGCRTEPAMRSGLPSGR

SEQ ID NO: 985945 - protein, 45 aa, Homo sapiens
LLDPLELASTPSIADPALICEERSPDVSMNSLALSRQVVEKCAWV

SEQ ID NO: 985946 - protein, 77 aa, Homo sapiens
MNVFLFLMISSSTFLPLAHFTVRMHHHARLIFFAFLVETGFLHVGQAGLKLPTSGNLPASASQSAEITGISQYNLPV

SEQ ID NO: 985947 - protein, 137 aa, Homo sapiens
ARCCVPEVAPVQYADGWMAARVWQLYIWRHPQPAPAEYKALACLGLLRQHWLPAGCSTVALWHCGEPSAGAWGLLHEIGGLGSCLVLALACRNHMWPVCTVMGWPFAKSLEREWDTKWPWMQCTWPWHEHGTCDVPL

SEQ ID NO: 985948 - protein, 40 aa, Homo sapiens
CLTSKRLSALRWSKRTGLRMCDSPHRPSGGLHGMHRSAPG

SEQ ID NO: 985949 - protein, 74 aa, Homo sapiens
RIAVCLGNLVPGEPVMFSASACTCEHSVLEIYLGTHSACADSTPQSQEGRDEYVTLKVASPGVHIHTAPPHPRH

SEQ ID NO: 985950 - protein, 35 aa, Homo sapiens
MEVTEGASLDKYRANTGGSERRKAYKKNIPVFSFQ

SEQ ID NO: 985951 - protein, 97 aa, Homo sapiens
QRDAHEYRVSISGGFTIATNFFPSTGRIYFPSLCQGWPCDFLLTQQKLQASAFCALEAITEKTSYYETTMAVRKPKLATEQGETLHKGTLAAQKCAW

SEQ ID NO: 985952 - protein, 103 aa, Homo sapiens
RSFKGNVVLDMQRHGNSLGRIVKHLEGLSEEAIIELNLDDWYTHCLMNWHKNYAAYQAHAVLGDEETVRKAMEAVDSAQDKAKEQSKAGEKGYCPQEHTSLPV

SEQ ID NO: 985953 - protein, 67 aa, Homo sapiens
ALCVDVPRGGAASLCSVRLLWDWATVTYRQAIYTCGGPEEVQCTACHVTLYYEALCGGWQAFLIREL

SEQ ID NO: 985954 - protein, 39 aa, Homo sapiens
MHISSKLPENFFRPGTPLLISADSIHPLSTWTLRSSYTI

SEQ ID NO: 985955 - protein, 98 aa, Homo sapiens
SYSRGIPATRRTSPAEEEDAAVAISCSTSTVDVLTASPLLLAHDFPSRTVAGASSLASAHVMESFMTVARLRIPDQPRIQTAEMALRGCGVTLVRLGP

SEQ ID NO: 985956 - protein, 34 aa, Homo sapiens
TGSLNPNYVQYGEQGVFTVHRTSPGPFTLFQPGR

SEQ ID NO: 985957 - protein, 135 aa, Homo sapiens
WCRLRGNNSQDMNAKEKFLKDINSANSSEQTNDKKMKQSYCLYGKIFMVWIAGQTSHKIPLSQSLVQSNSLKAERDGEAAEEKFEASGGWFFKYKEISHLHNLQVEAASADAEAATSYPEDEGGTDSPLGDQCSW

SEQ ID NO: 985958 - protein, 149 aa, Homo sapiens
HPGALLLFLPPLLLLLDVPTAAAQASPLQALDFFGHGPPLDYNTGHLYLRGPLKKSHAPLVHVTLYYEALCGGCQAFLIRELFPTWLLVLQILNVTLVPYGKHRKQNVRGRWEFKCHHGEQECKFHKVKTCVLDKLYMELAFLTIVCIE

SEQ ID NO: 985959 - protein, 76 aa, Homo sapiens
MRLREVGYLAALTLGRVLHRSIKVDWHIWAPFTGHNDVSLLRAGPVCTVGVPGAVCQAAVCDVHAGVALVAVALPV

SEQ ID NO: 985960 - protein, 74 aa, Homo sapiens
TQAHFWTWVQLLVRTSDRALISALGRTFHGVTNHNLEHHTKLPLHLPPGDGTQVERFPLSLCQRPQYHRGPRAG

SEQ ID NO: 985961 - protein, 68 aa, Homo sapiens
YQASPSAQDTQSIASDGTPQEEKEKEQRPPELPLLSEQMNLGELWDMLGECLQELEESHDQHAVLVLQ

SEQ ID NO: 985962 - protein, 107 aa, Homo sapiens
TQAHFWLGLPHNAEESSLTTQGVDVISKMLIDADIAEDEDDLAYAETENKTRTDSTFDGRPAWMRTLHSTASSSLPLIPHTLSHLKRSVPHIEDPLSRFFERQVRLG

SEQ ID NO: 985963 - protein, 130 aa, Homo sapiens
MYAGLADVLLLVFKELDILLGNLKSTGIHVLEVYGPSTSLPCRCASRSIRSEPNKHVGWAIHMGHGDVDSPQAPFLQAASDGLLELVLHLWRCDLFQKSLGLFCRHTSLLCSRQDALRLGDVFIPEPERY

SEQ ID NO: 985964 - protein, 145 aa, Homo sapiens
PPGALLAVPIVLSHPGHTPVTSLVLGPQWWAAALSFTRGCCYPGMGCLIRDLCPPSLLSRRWGDQPALVPSTVSKILVYPLLQLSFESGRPRCGLVRTCAWVRTQALFSAMGDDQARVWLLKRARAYYYRISKYTSFITCLLPCS

SEQ ID NO: 985965 - protein, 52 aa, Homo sapiens
SEHVSLPILDESLTLYPVSHCVRALSYPVLHGHNHLGSGTLGVGASDLSKPS

SEQ ID NO: 985966 - protein, 69 aa, Homo sapiens
MLIGLRERESCVAVVTAEVFYFSKMQAGRRGSHPLSQVHVRGSLEPRSSRPGWATWCEPVSIINEEINP

SEQ ID NO: 985967 - protein, 33 aa, Homo sapiens
LVVGPAAHRPLCFRRAPARIVGHEAEAVFFHFL

SEQ ID NO: 985968 - protein, 69 aa, Homo sapiens
MVMFAESGLGSTMSQNLGAWDNKSTDFLSSHYLEVRLSICLLDRSDCQNNSNICIQSCCRQMCTDIHRS

SEQ ID NO: 985969 - protein, 45 aa, Homo sapiens
SSSVPIPSNAADCSQRWMHVSGVGCMSAALDGVSGVGWSQRRWMQ

SEQ ID NO: 985970 - protein, 41 aa, Homo sapiens
WSYSTGIPATQAHFSSRLAVRAWYFPANLVSQAPPDLANFL

SEQ ID NO: 985971 - protein, 113 aa, Homo sapiens
RIPPGLLRSATVSAVHWGLEVARALWAGVHGADSSPESPVPHVPTLPTMMVLQAGSSRPCARGAEGHWSSSIPCHALPLLNVSSSQSPCVCRMQILQTGDVLRWPLYQSYPPL

SEQ ID NO: 985972 - protein, 97 aa, Homo sapiens
WGDGVQVIPSKEYRKWRSGLVIDSEMCYRARREEERDVRINLGSGRWQQRLHVLCAAVTIATARSSPLRRSRMSSPHSHRESAAWRATTVLGEVRLG

SEQ ID NO: 985973 - protein, 71 aa, Homo sapiens
RGSPWLALVSTLLTAYWEGDAWRVLLVERLGYVSCSDSLALLRTGEEFWSSELICGTQLILGDNFANVPDI

SEQ ID NO: 985974 - protein, 121 aa, Homo sapiens
HQAHFWPHILRVAQPKDVTETCLSMSTLTNAFKVKTLDTKPGLYTAYTAHLHRDKALLTRVLPGVHEKRPSDLQSALLRWPLLELTQSFIIPLEHSIASLMPLQKCAWVQKCAWVQNCASV

SEQ ID NO: 985975 - protein, 91 aa, Homo sapiens
GSVPVTVGCHGSHQRDGVGGALQPGLHSVLSCARVTDSTRSFPTGDPKSFSRSSKGSHFFSIPNSQYCMVYYLEFYGRKYWSRSRSIIMKS

SEQ ID NO: 985976 - protein, 108 aa, Homo sapiens
WLLIVLPQHPKYWDYMCEHHSLPEDNLSIDSGRERKETWVSQEAKGTGALKEIAGVMRASCEPTGVKVTSGGQAHQVWLVFLELKEINDNLDCRVFRALLVQWDTQVP

SEQ ID NO: 985977 - protein, 68 aa, Homo sapiens
QARLPYPANLLEVGHRENDCRHHPGSEQEWILSATTSGIFLHWMWSTLSVKALARGKSASAEELRRQA

SEQ ID NO: 985978 - protein, 44 aa, Homo sapiens
MRMRGPVLPSTVAASASLPEMFASFLGRLCSRSVASGSYQRHAD

SEQ ID NO: 985979 - protein, 30 aa, Homo sapiens
MHSAWGEEARAPQPLSPEKVILLSHDCLLW

SEQ ID NO: 985980 - protein, 48 aa, Homo sapiens
MQYELNRNNVTDPSLSEMVVVAIQILRKKPKGFFLLVEGRDPGSDERG

SEQ ID NO: 985981 - protein, 77 aa, Homo sapiens
LRATTLTSEALGGLDESPTERYLTGDCEAVSESPGPKGNHAHTEGSGSRATPAASDAVSCVVSTMGCQKVLPSGART

SEQ ID NO: 985982 - protein, 34 aa, Homo sapiens
APSYDYTVLTCRAELVQGGMHRSGEYTSTWIHVC

SEQ ID NO: 985983 - protein, 109 aa, Homo sapiens
SSRYQYDGDSLEQQQFIHMNGCYLLEHQLSQALSYAIKRGSVNLLAPFNALMGRVVMKLFPAIFINDSVRSEHNLGYEALVLCDRSHCRSDTVPVVNDLIFDHVDSTMT

SEQ ID NO: 985984 - protein, 62 aa, Homo sapiens
YEIPPGRSGLCPVSLFQSELDRDANYCCSALIHSLRFDNRHRVKKTIGGPPCDSSPVTLVHC

SEQ ID NO: 985985 - protein, 71 aa, Homo sapiens
SEQRNKSNYVSTRQSFPSGSISDRSSVRKVTLIAFMATNALLSSTCPKKMAHKIIIIIIANIIELFIGYHS

SEQ ID NO: 985986 - protein, 84 aa, Homo sapiens
MLASTDYCYNRPIPKLKQLQLSGRSKPAVCFLPLMNPSLPYRISPVSELLSTGRVDGAMAHLSLLVTKQNMPSFLDGSSGGLHD

SEQ ID NO: 985987 - protein, 59 aa, Homo sapiens
MAGPEDLTDTPHLTDPGNPRYGSDDNQGERRRMKLTVIDTPGFGDHINNENCWQPTVDK

SEQ ID NO: 985988 - protein, 49 aa, Homo sapiens
MGHHFIYKTGYLYLRGPLKKSNASLVDVTLYYKALCGGCQAFLIRELFP

SEQ ID NO: 985989 - protein, 78 aa, Homo sapiens
LACSGLPKCWDYRQEPAHLAMSTHSFVGTRSAEGYSEPLRPSLLGVPGPFLNRRVHFQEPYVLGNAPRRCWNLAPSPV

SEQ ID NO: 985990 - protein, 158 aa, Homo sapiens
ELGTTCPRLAKGPKKIVAQLQAWNGFIRQASTSVLHSRRAHSPPIAQMSLATAFWKLHSFRNEQMQLAERRQKAFQKAAGNEQVENAFTETLAKDPKHSVKGVQSLGVNLLDLQKSVMDSFSEMKYFLQVDITGHAYTSPGPLLSQGTIFRVFGKHLD

SEQ ID NO: 985991 - protein, 116 aa, Homo sapiens
TRRTSYLPPGSHALLRTGITLGRSSRPQHSSCPQGQRLPVQRVPLEGPLPDASRLQLGTRNYCFLLWRNQSCQCYIQPARPQSFPYQVSTGPPEPWRLGTAPLPQLSWTIVRLQPL

SEQ ID NO: 985992 - protein, 51 aa, Homo sapiens
YFDSGIGGSLQHQRSILTILGVSARCAHVSDWNLYRGGMHRSCVNYTVDHG

SEQ ID NO: 985993 - protein, 94 aa, Homo sapiens
TQAHFCTRPTSSQLMVLPVRIFVNTRDMEGTITLRKWSRVTPVENVKAKIQDKAKASLLDQQGLIFAGIHRLEDGSLPVPRLTASSKCAWGAHP

SEQ ID NO: 985994 - protein, 97 aa, Homo sapiens
SYFLCLTFFNVPETLWQDFSVISHWAFECGSAHWCIIDLESDGVIGDEHASEPANRDHHRMSNVCASYPPTLPDMGKATSSLNNGRDLIQDEPMDAS

SEQ ID NO: 985995 - protein, 94 aa, Homo sapiens
YQFDGDSPLARDGCMGPIAAMRPSIFRSSRVTIVQSECVTHSLVGFAISMDTVLRVYINQKLNWGLMSVGVGRLIPAFGVIPVSQFCLPQVALL

SEQ ID NO: 985996 - protein, 43 aa, Homo sapiens
GFSEDLSPRRSYVLVHTVLSYRHGADGSPWTGLKEYFCSMLDV

SEQ ID NO: 985997 - protein, 143 aa, Homo sapiens
MESSQPSDSSLTDITETRRQPMPDPVPDCPCLTLLPTWLGPPWYMLPKPMRSREPHFLLLVIKTIAPGVLASNSDQLEDQALAQIKPYSSSKDSSPTLASIVHQLERLLNMLRQDLKNEKEDQAHLQADVQHLREDHLRLQEE

SEQ ID NO: 985998 - protein, 71 aa, Homo sapiens
NRARYQFDGDSRHCPIIDNDESELIFSLASTGAKLKQSSHHHTVSSLEGYMYPNLPSPQLSLPREGAALTI

SEQ ID NO: 985999 - protein, 79 aa, Homo sapiens
WHPRMGDCRKPPLQLYYCALCCFPYRLSYRTSTLDALWIRGLSVCGNSLTSHFDSRPLIALIRYLKAFKDLLTVSFTSP

SEQ ID NO: 986000 - protein, 103 aa, Homo sapiens
TYRILLAGSARQARSPGQELQAELLQQCRPCGHCIGLQVQWHLERGVLGEEDGKEAVRSKPCSLPGPYRAEASFVEALDYDDSGDVKSFGGEKYLEKGPLTIW

SEQ ID NO: 986001 - protein, 137 aa, Homo sapiens
WRRILGLALRSALILELCVAGHAFSPASPQLHPASTLDLSPGLRPLLLPTCQPLPGVPPGLQRTDQRHGCPGPVGAGSGAFEWARPLPRAPVALGGVTEYTGTGAGSGSRADSVSPGTPPALGLRNTTLHRNPGAEG

SEQ ID NO: 986002 - protein, 74 aa, Homo sapiens
MILARILARILARIFGADFGADLRRGFFGADSAYGCGGQTCYRSRTCQDACTEGDSGRVCVCVCVCVCHRQCLA

SEQ ID NO: 986003 - protein, 30 aa, Homo sapiens
MTEAGSDLLTLGLAGVSEKYPGLRRRGYEL

SEQ ID NO: 986004 - protein, 79 aa, Homo sapiens
EVDLNVRNNPLKQAQSAGLSFESRHSLHDLIPEAEQQLRVLQSTKICGRHGQNDGVRGQLYPGHWILLDTPLTLQGGLP

SEQ ID NO: 986005 - protein, 98 aa, Homo sapiens
QACAAGGMHLLIAVQGRSGMIENILAGKMRNMRGYACNKNGGERLAVHAPRLSSVRFSRRQIQTLVHCCHRNIPWHQKVPTRFLTRVGHTDTWVVCSR

SEQ ID NO: 986006 - protein, 36 aa, Homo sapiens
LGGGSEEAAGDGAEDEEAVGLIMLTRPLTKLKRGSV

SEQ ID NO: 986007 - protein, 106 aa, Homo sapiens
NAQADVENAQAAKERNRASPDPRRQRIEEALSCSSRGPISLRAEARSAAVSLFSPGRWGCGYTMGSPSPPAHARRACSSLSSWCPLRVILCQMLLILLTPIHSAKA

SEQ ID NO: 986008 - protein, 114 aa, Homo sapiens
SVLSDATDGGASEPGEEVHEVMSSVKARTTHFHFFCDSSVTSGHLDVYVQAWAQRPDNYLPKAPLPSFSFSFFFFFGGRGLALSPRLEYSSTIAAHCSLHFPESSHPYLSFLSS

SEQ ID NO: 986009 - protein, 74 aa, Homo sapiens
NVEDPQAVEEGRKHLSVYAAARTKLKRDLKHTDSHIRSVNKNRHESIKQVHAAAGTETMDCMRELYNSCTSREE

SEQ ID NO: 986010 - protein, 51 aa, Homo sapiens
RSLLIMYHKKVHCLTIHMYTLLHSITVKSSLCARSLKISFSLASKLGKRRS

SEQ ID NO: 986011 - protein, 97 aa, Homo sapiens
MSRIPKAAEDGNTQRDSCQDDSVEPLGCKLNGTWLQADELSCREGCAQPNRPGIYTRITYYCELNPPLCPQKAVSQAWLDHLHHWRTNPCCPKHHCF

SEQ ID NO: 986012 - protein, 104 aa, Homo sapiens
EDPLGCEGGVSKTNLNVLSGTESPGGKTDLIQGAPLRNRTDEKEEMRLSYGKSQKNMMCSGVTMAGFPEEETPELTPKDDSELMHDTAPDGEAACANVQKIPTA

SEQ ID NO: 986013 - protein, 110 aa, Homo sapiens
GGPASCTYYFSVDSDVALNDPISLRLLIHLTKNVIAPLIIRHVRLWSNFWGALSAYRLLCPVPEHYVHIVHGRRVGVCNVPYISNIYFIKGSALRCEPQSSDLFHHCQLN

SEQ ID NO: 986014 - protein, 80 aa, Homo sapiens
PARSVGTSMTRTSRFTRPAGMETFQIWAAVVVPSGEDAEITCHVQYEGLPQRVSLRWKPASLLTILIVVASLLHWFSLGA

SEQ ID NO: 986015 - protein, 72 aa, Homo sapiens
WVSDAQKVRALLSAAGSPSHQRCLYSYFVAQTTTHETLATGHFISVIHILDAAEQKFAIIAICSSHYHLPDP

SEQ ID NO: 986016 - protein, 112 aa, Homo sapiens
RIPLVTTHGKLLDLGVVLNWYRTVGRRNTFIGTPYCMCSKVIACDDNPYATYNYWSDIRSLGITAIDDAEGAPPLCDLHPMRGLPIGQSMHRPPRPAEQVIVDLQIPISISI

SEQ ID NO: 986017 - protein, 45 aa, Homo sapiens
SIEYPLVFAFVGRQGMSRELGPRENPTQHPDLVPGPSTEVGLVNL

SEQ ID NO: 986018 - protein, 96 aa, Homo sapiens
SDEYTDYGGLIFNSLHTSPHYSYEPGDLRLLNVHDLVLLPIEAPIRIIITSQVRLCISLDLSPQLCLTKQYTTSRYALKPDPPFTGFTDRWVILRV

SEQ ID NO: 986019 - protein, 39 aa, Homo sapiens
MPAVVGCVVFVDKACRVNLRMRCFTSQLSIEHVSTSVLL

SEQ ID NO: 986020 - protein, 142 aa, Homo sapiens
QPRMAGAEEVDIVLVSVGVVPVCHPLILAQQEEEQLVGQAEPDQAGLVMRLLQSVLRGRRARCCPSRFPVSCTRHTSLSLLSQCSPGARNVWVTPMRGISVCSRHARNFRNPCVHCQLAIHVMPLSSWPYWFASCFTNHWII

SEQ ID NO: 986021 - protein, 58 aa, Homo sapiens
FPFCPSRFEPCGLTQLSRLKYGRCRLVRRTVRAGCDTVCSLRRCHNLVRRHRQRASSF

SEQ ID NO: 986022 - protein, 136 aa, Homo sapiens
SGDTSACPSSVRLSALPASGCAQSFQSFLMVRFHSRDRFVFLVVLCDSVTCCFSSPGPAYPCVPPPQWFTNSYSFGPGPIASYHVLRLVNLHAFSVPMLDVLHAAHYLSVKPQRDFIRYSITSFNTYNCFFKLSTS

SEQ ID NO: 986023 - protein, 36 aa, Homo sapiens
CSSLTDILEVSTGAHVSDVNLYSEAMHLQMVNTLSD

SEQ ID NO: 986024 - protein, 67 aa, Homo sapiens
DPPAIHACQGLFMCGLCYGHCMTKEATTELFLQRRNTCRIITKDRMVMPVDESINEADQFPCLLLLS

SEQ ID NO: 986025 - protein, 87 aa, Homo sapiens
ITQVVGAPFPKLRTEGTQVFRVDVPSRGGVHCHRPSGDSWAAPGDRGDEWPRRCSGCERDVVARELGTHSLIPVPHHPSAPFSDIPP

SEQ ID NO: 986026 - protein, 72 aa, Homo sapiens
MKVVNVKKVNSTDSNSGWSNTSLVLSDLSLCESTWKVTFKQRFEGEEDMSYEAMSGRRDAGRYHPSADKVEP

SEQ ID NO: 986027 - protein, 54 aa, Homo sapiens
YLSADCVTMLVVPCGLAVWWGLTAPQEETCDDPSAVGDGHCQTMRDLRCGQTIE

SEQ ID NO: 986028 - protein, 34 aa, Homo sapiens
MSTLESRHGRAGLAATGGKCPTTGTRRTIDTMAK

SEQ ID NO: 986029 - protein, 36 aa, Homo sapiens
MTHMNRIAISELHFLERAKTAHTAVHIPNHPELANT

SEQ ID NO: 986030 - protein, 65 aa, Homo sapiens
EDPGEQEICECQGLHHRGLRKVPSWAWTERAHVAQLLMEQVAAEGSGPFLYLLYQHLFFNFHLRT

SEQ ID NO: 986031 - protein, 103 aa, Homo sapiens
CNPRMRFMKRARENLKNERDMEEHQRIGHGAPCVYTDPGCVDPPSSSGALGLHFLICYIDARCCVREHAQGRVRITTTITITITTITIYRHPSIVITIIYHFH

SEQ ID NO: 986032 - protein, 49 aa, Homo sapiens
MLYKTASICGRGRVVSATEDEADPAQRTIMCRERIPSAGEKDHHVKRLS

SEQ ID NO: 986033 - protein, 34 aa, Homo sapiens
QRLEVPVEMNPEGYMTSRTVREASGLLSLTSTHY

SEQ ID NO: 986034 - protein, 36 aa, Homo sapiens
MVGEYAKQAPSESYRTWLNPPPWTSKGSLHEATVVL

SEQ ID NO: 986035 - protein, 142 aa, Homo sapiens
VEDGAHISEGRTRNRRFHRAPAHCSWGLIWSWKMTCASHCPVPQRPRSVGNVSLPRGGPGPGRCSRSGHVSVLGRRVHAGTVPGMGLSGTRESPLGPLRQTHSPRGHLTPPQPPGRATPRDNRCHGYLRLTPIPPAAVEGEG

SEQ ID NO: 986036 - protein, 58 aa, Homo sapiens
SPWNPRMAWEGTRKTWYPKGNCQREHKDSIDTASNMGVEWVLILRLQNAMICVVKHKT

SEQ ID NO: 986037 - protein, 40 aa, Homo sapiens
FLDRKHKLIHCTFPGLPELRRVIQQGPGRRAEPEFGDVES

SEQ ID NO: 986038 - protein, 35 aa, Homo sapiens
MQVDVYDTTAVIASLYKYRRHVEHRADLQIYVKLE

SEQ ID NO: 986039 - protein, 70 aa, Homo sapiens
SQQYSSALVKSCPTSKVDGSTRWILIGNDDVFVCCGNRYGVINVEVSRTAKWVRFLAVSTDLPVTDGTDE

SEQ ID NO: 986040 - protein, 39 aa, Homo sapiens
WPISGLSFWVCLLSPGIWRRSGACARFPVLRCAGLPGDR

SEQ ID NO: 986041 - protein, 80 aa, Homo sapiens
MCLAWSTLGQRETPLHRLPRYFLSIKVAGGGDIHQGFQISYSPNSEQRLARRYLLKDGQQATLGKQSCDFLFNLIEIPAK

SEQ ID NO: 986042 - protein, 56 aa, Homo sapiens
KIKSMAAASQAELNSRSPCTQFFGGYEESWIKEKKLLVGSEDYGRDLNWRADLSKP

SEQ ID NO: 986043 - protein, 89 aa, Homo sapiens
MTQKLRSRLASTLVATSALLATNGSWAATLFGGVTDDSVCDVGSTEQRKGGGFGPPEEFIERQCRNGQLLVGVGVFAAGGMSEPLITAL

SEQ ID NO: 986044 - protein, 31 aa, Homo sapiens
MPVEVAADVVPGLAGAGLDDPDQEQGEPAQH

SEQ ID NO: 986045 - protein, 42 aa, Homo sapiens
MAKHSSVPGGRRVYTTAVLASLYRSVDHVSTVLTSKYRYAGA

SEQ ID NO: 986046 - protein, 44 aa, Homo sapiens
SLCGDGDPQRWDQDRSRERPGRRGGKERQEEGERRKRQGYLTLE

SEQ ID NO: 986047 - protein, 54 aa, Homo sapiens
SEPSPLTRMLLCPCSGAVGCCTQQCSWSQHTLRMAFCTKQASVNGTVEDYGSMS

SEQ ID NO: 986048 - protein, 42 aa, Homo sapiens
MSCGCHVTLHDGVEGSFVDATEIHAQDGRLEECLRAAEPLIA

SEQ ID NO: 986049 - protein, 44 aa, Homo sapiens
TRYRLILQHLASISILLIMSTPCVGKEDSLGRSRGRPSQKCAWV

SEQ ID NO: 986050 - protein, 66 aa, Homo sapiens
ICYQEAIRAITVWLQKCAWLRTQAHYLPSLRCGRPYSRATLYRQSAPCIPRSPRGHHGQSTADYHS

SEQ ID NO: 986051 - protein, 76 aa, Homo sapiens
WGAAALSLHPWTAAIRAMGCLNRDLCSPFPGFRGGGVTNLSPGPRHGSKILATTPSAVLRALAQAQMCHLCRKCAW

SEQ ID NO: 986052 - protein, 111 aa, Homo sapiens
HPGALLAWACPQQTPKRVLLTTQGVYIISENAVDADIVTDDDDLVLRRDLRYQDEDRLHVRRAPCLDADTAHPPRPSRCPSSSHTLSHLKRTVANIEDPLFRFFEREVRLG

SEQ ID NO: 986053 - protein, 62 aa, Homo sapiens
MRVVSIDFARLLGTIAGWSPHLLETGYGGHRSLLRHPIPSIAASTGEAEISRPGSELEVLLM

SEQ ID NO: 986054 - protein, 113 aa, Homo sapiens
PGALLADRAGYAAPSNTKRGQAALDRLTVFDGFPPPYVQEKAVWLVPCCLSRIVLSERLQAQFAYPGAPWPHRSVGLVSYHGRCHATTGSEKVRHEVHESAAWVAVECDLGSE

SEQ ID NO: 986055 - protein, 54 aa, Homo sapiens
MYPRTQAHFCCSLPPLLLLLARPHGRRCRRPLCKRYTSLRNGPPSSPTKTRQLY

SEQ ID NO: 986056 - protein, 115 aa, Homo sapiens
STAWSRHTGPGPRQAVVKTGARPQHSEMLHSHLIGPGLAQALSPVNLLLAEALLTRLQPLLCGSIHGLFSSTKALRFPFNPHCPTVLVAKSFFQSVRCSFKRIAITSHHAWTASG

SEQ ID NO: 986057 - protein, 149 aa, Homo sapiens
AIPRMGQHAAQTACLSRMTGLALRPCDLDRCLPASEVPCGTPGSLPQFAHPGCGVRRIGQHGTFTWQASTLCPVPSWALPTHSPPSLLEGPGLALLSDSRPPGSPRVQRVCRVLPRGSSSVRASFTPTSVPAGSGPQLVTLSPACIAMR

SEQ ID NO: 986058 - protein, 43 aa, Homo sapiens
MHRAEVCITTTITITITTITIIVTTIVITTFTTASPAALRGSP

SEQ ID NO: 986059 - protein, 88 aa, Homo sapiens
IVDLDGSPGRRGRAASMRSSSSYSFMAFSMRSLARPRHTLLEGFQLVVMKPSMYWRSDVLILVKNCRKHGPGVHHYRLLASSRIEVRR

SEQ ID NO: 986060 - protein, 46 aa, Homo sapiens
MPVISMVKQKKDSKQLYYHRAPFHEALWVPDGVGYSVTRWSVRCFP

SEQ ID NO: 986061 - protein, 108 aa, Homo sapiens
MREISRIHVTKTLLIKQHAVKMPAKSHQNQDGNKGDLYVILTAQLYANCIAFSMLKDTSTNAMTVYRCHGNAKTLSYMAKKGEESSVPGIAHPFPGKLMNNPGNGWHR

SEQ ID NO: 986062 - protein, 81 aa, Homo sapiens
PYACCAVQEVKRSQRGCGWKRRCPLWWLKFSDLIHPPGNGEPSGLPQHGQLLHKEPLFLITSTLISLLGLSGMVVVADNIS

SEQ ID NO: 986063 - protein, 39 aa, Homo sapiens
VLEGAESDGHAVSGEERTILIACPMIGQQVDFTLPLLLL

SEQ ID NO: 986064 - protein, 37 aa, Homo sapiens
ERIWIMKEAMVQAEEAAAEITRKLEKQEKKRLKKVQV

SEQ ID NO: 986065 - protein, 34 aa, Homo sapiens
STCPVDGRALLGVDEVPIGKVGSLQSVCNCLLCT

SEQ ID NO: 986066 - protein, 78 aa, Homo sapiens
IPGPSPRRRQRVVPEIQGLALLPRLECIWRDHSSLQPRPPELKRTSCLSLLSFLSSCDYRHVPPCPVIFVFFVEGPGM

SEQ ID NO: 986067 - protein, 125 aa, Homo sapiens
YWRISRVTGSSVKIFGWSARVLTCRRNLVQGGMHRGGEYTSTRLHVCVIGWSARCSRVERNLSREVCTGSGEYTSSCGHACLLVVLELILYTSIQVPVLNEYLAGQHRCSLCRPELVHGRACTCT

SEQ ID NO: 986068 - protein, 33 aa, Homo sapiens
NCPLRVTEQQFEICIVEPETVPLHSSLCDKGTP

SEQ ID NO: 986069 - protein, 107 aa, Homo sapiens
YSYVTRVLSECFHKSIRFRTSSVPIARRSRDFSCPSTHPIDRSITCTLQQRYHKVSSSVQMEPSAHQQSYFPVAGEQEKDRQMARHVQKTRLSTNESSPSPSPGVEA

SEQ ID NO: 986070 - protein, 110 aa, Homo sapiens
RPKREASSLRAPVACTSACGLPCPEPSFSLGFQEPQLLSACSLSQQTRSPRPGQLHTHDPPPPRPGSPKLGTSLCLPTPLDLDELSASAADSGAALTLWPACARQRQPER

SEQ ID NO: 986071 - protein, 74 aa, Homo sapiens
RDSSIPMTYFSRPTVTKTHIDVAPDFLHSMGYLFIYLTVIYDPLSTTTPTFMSRERLQIGAATTRQTQTTIAPS

SEQ ID NO: 986072 - protein, 46 aa, Homo sapiens
MVILQSPARPLGLWQLCPFQGIPHSIASEQEIHLRLAAVAHACNPS

SEQ ID NO: 986073 - protein, 33 aa, Homo sapiens
MDIFRDLLLNARPDGKPRSTHEATVNPQATVNP

SEQ ID NO: 986074 - protein, 107 aa, Homo sapiens
MPSVGPDRESRLKRSVTHNSRKAVKETSNSSDLKVSHKPLCKSFGIVYPGPSRMTLTFKRIKISNIVGGKRQACWGEGEGRPQDCAENHVAICITPKPNPSARKGST

SEQ ID NO: 986075 - protein, 59 aa, Homo sapiens
SSRGPVSSPSCIILPKGQILRPSSRMTFRPPQSSLFITGPSASFGTWYKVTGGGCILVQ

SEQ ID NO: 986076 - protein, 96 aa, Homo sapiens
FSAVHLAEHLVPIVALSSAASCTCGFQRCWRIFQMLRTVFARGPPTCDAASCLAIVACILILLLIVCILFSVCIRLSDQRVRQHPGGHVEPQCCHH

SEQ ID NO: 986077 - protein, 75 aa, Homo sapiens
EAPRFDGSGAEVHVGVPSQVTVSYSRAGGLNSDRWMICLGPCCSEGLHMIRELVLEDQRDSIPPSSGIGGFHLLN

SEQ ID NO: 986078 - protein, 174 aa, Homo sapiens
PRVTVWQGQTSRAVFYSKCSSCKVHKKSRAQFVERRNAQGEHGREVFDSVELHHVGVVCWACQDPYMGCIVAISNSSREHCHSVGPGGISCCHSTESTETSVYQDDHRLCRFPAWYHAVLKSSIAQQSPRSSPRFGWGLPPDCSDVHKAQQMGLLRDHVPVARQIVVMLPYCSS

SEQ ID NO: 986079 - protein, 37 aa, Homo sapiens
CVTRLPVVMQHAPGLTRTCHLSGMLWVIRLEVDPAWR

SEQ ID NO: 986080 - protein, 81 aa, Homo sapiens
MVAAKVKGEKLDKKLKKMEQNKTAATRYRQKKRAEQEALTGECKELEKKNEALKERADSLAKEIQYLKDLIEEVRKTRKSR

SEQ ID NO: 986081 - protein, 44 aa, Homo sapiens
WLTVACREASTIRLAASSIKSAPLGRGASWAETMLGTEGVLLSL

SEQ ID NO: 986082 - protein, 39 aa, Homo sapiens
RRPVLSMPPIRSQPVDYVYVRDFKLMRVCACVCMWHLIN

SEQ ID NO: 986083 - protein, 153 aa, Homo sapiens
YRCTEAKSSLLSNVGSSTKARQLCSREALTHSYKCPLRKQRAACSGFTHICSIWLSHGRALTNYEHITMWQRGSKPDFSFRTFKMIIGKLAQELLVENGNLKTLLPRISNTNIENHIITLHKLLTQLNYEPPCTCGQNNLPPDNSETNSRYHI

SEQ ID NO: 986084 - protein, 51 aa, Homo sapiens
MHKLKEVQSRSDVIVFDLQDRGEPADFIREAHGQHLGEGLNQPPLSLWRKM

SEQ ID NO: 986085 - protein, 38 aa, Homo sapiens
ITPCLKLAFEMLQLAQQQQVLLFKVGQATVNPQATVNP

SEQ ID NO: 986086 - protein, 69 aa, Homo sapiens
LINPEIWEHQMEYLQARTTRSKKLFSCLACLGPCNPYMRPLNEDTSDVSNILTNLCHQHSIVRNKVRVS

SEQ ID NO: 986087 - protein, 67 aa, Homo sapiens
WSPSTSVAYVPFATYHSDDTSREMGIKYVSCRTFPHGRSCTRKGLFLLSQGKHQKSLHSRFCKFKSQ

SEQ ID NO: 986088 - protein, 74 aa, Homo sapiens
PVEDGRLGKEEVRPTPGQAEGQVVPGMLQLPADEPVLEELVYDAGRAADVVLHDIQHARLMPVDLQQLDYAVTI

SEQ ID NO: 986089 - protein, 86 aa, Homo sapiens
RQVTGEISQSITALYTTVRVAFYSTSPYGSTVEGDIKASSVSLLSGENTRAKNSTKALERLKSPLSHTVIIHEISRSLGDHYAHDT

SEQ ID NO: 986090 - protein, 90 aa, Homo sapiens
MLSGATVRGAYKGGVQELGRATAPAPRATPTVNEPGRQAHLKDKRQELDGHDHNRINPKSFFILHDINRDADLDEQELLALFSQELEKVY

SEQ ID NO: 986091 - protein, 54 aa, Homo sapiens
HSTWLLPGHPEHLEGGMLVARPTLHSRACAPTEEGAGALTCLAQHTTPKTQRSP

SEQ ID NO: 986092 - protein, 37 aa, Homo sapiens
KSPGFGLCVCFSCKPRLWPCIRPTRTAGHVTSPVLTQ

SEQ ID NO: 986093 - protein, 94 aa, Homo sapiens
ATPPGCTQATQSTKEGGSVGCPTLPPGLCPSPRGALDPQTLADPTPHLRLSAASEGLPQGRGLKAERGTRPRLTPHRLALLLEGLSLYEADSAS

SEQ ID NO: 986094 - protein, 62 aa, Homo sapiens
TGDAVEEDPDLLILFRGRTKDELLRRANASNSITIYVLNINHPLRKAYCEHYSLQKHTSHIE

SEQ ID NO: 986095 - protein, 33 aa, Homo sapiens
LWKTGDLGKKKGGLQRDIHGGPRDPGPPRIPTI

SEQ ID NO: 986096 - protein, 54 aa, Homo sapiens
AEDAPRSRGRAERPIGMLERPSHPCTHTCAALAHRCTCVVLRKQYRLLLQALAC

SEQ ID NO: 986097 - protein, 50 aa, Homo sapiens
RVMRLQAVSINWRQTPRVSLRISVHKDCHRYGTASNGLICSQDALGSCHY

SEQ ID NO: 986098 - protein, 49 aa, Homo sapiens
MRMQQAETTAVQASLGYRGRRKAEGEGEEKKIMKKLYKPAEFCQRPVLS

SEQ ID NO: 986099 - protein, 39 aa, Homo sapiens
MTPVLTGILSCLPFSPRYSAHSHPKRYTVLTLRLTVIPS

SEQ ID NO: 986100 - protein, 82 aa, Homo sapiens
TGDAVDSEEMTLNISGDLRQLSAMLIVMRIIIVLKSLELYAELAEDTEKYKRFYEAHSNKLRLGTHEDSSNRRRLSELLRYH

SEQ ID NO: 986101 - protein, 46 aa, Homo sapiens
MNASITSFIAKYGDELFLGQGAPGHGVKMTHTLQVLLDVLAVVGDA

SEQ ID NO: 986102 - protein, 68 aa, Homo sapiens
TDAVVVDLEARGSVDPFQIRLEPYALIIRGESYIGITERKAYKMWSHSDVDASAACEDMISDCRIIEG

SEQ ID NO: 986103 - protein, 37 aa, Homo sapiens
KPPKELPERIRPPGVKGSRRVKGSRRVKGSRRVKGSR

SEQ ID NO: 986104 - protein, 58 aa, Homo sapiens
MCHQTRLIFLYLKKIFEAVVGWLTPTIPALWEVEAGGSQGQEIKTILANTVKPRLHQK

SEQ ID NO: 986105 - protein, 91 aa, Homo sapiens
LDYDEQQGSGNEIMKTESSPCTAVVCFSANPGSDLATGLQHSWPCGLTAVISLDFTLDSEDPLDSRDVVKNCALSLHSLTLACIVQVFTNL

SEQ ID NO: 986106 - protein, 78 aa, Homo sapiens
TGDAVGHTQVREVVQEPGLPVLAHKADEGLHLGLGDVLFQELAVVAQQGSDGVLGQDVRANLRLHHPKLLVNVLVRLA

SEQ ID NO: 986107 - protein, 52 aa, Homo sapiens
ALNCYSRKKQPRGWWSEQEADVFSSKERAHHLQGTGGTNGDRARDTKKSCWP

SEQ ID NO: 986108 - protein, 79 aa, Homo sapiens
RVMRLVMNKMARMLTLPDDQNTAQQEETCNICMQDNHSDEGLHEQHYRMHVRLAEIGSADTIDELLMRITHSDERSHVP

SEQ ID NO: 986109 - protein, 70 aa, Homo sapiens
SVYDVHVVRVRGRCAGESPQKWSPCDDEHRSACVPVGCSLTGGSESRRAEPGTFRGCLRVGVSLLYVCVG

SEQ ID NO: 986110 - protein, 39 aa, Homo sapiens
PSFFSQGAWTCLTCTLDAPAPHLHFTCEHSSTAHNRITR

SEQ ID NO: 986111 - protein, 38 aa, Homo sapiens
IAQVALRRYSTALDSTLLCRAVGATALSQQNKASIDTC

SEQ ID NO: 986112 - protein, 34 aa, Homo sapiens
NSYSKDYSFPNLIGQTAEQLMPWNIVKNNRTAIN

SEQ ID NO: 986113 - protein, 31 aa, Homo sapiens
MDLADLHVACTCTSPPFHLHTHRQLTTASPV

SEQ ID NO: 986114 - protein, 71 aa, Homo sapiens
KILMTSEGPLLKAGGMLCGGPVTKACFQNVHAPFTVLRQLFKLVWYQLMLPSLCEFVFELVQCTFSCLLPV

SEQ ID NO: 986115 - protein, 45 aa, Homo sapiens
MRQKGGLKHVMRSFIEAVCSLFAARSTGSQAQSAPTLVWYEDTAQ

SEQ ID NO: 986116 - protein, 52 aa, Homo sapiens
MHGGQIRKLADVGSHLTTEESRKMTVPGSCRQRGNSFPRCFSSSEWAVRLLL

SEQ ID NO: 986117 - protein, 92 aa, Homo sapiens
PRAFQDERDAALGFQRAFEQWPLLDPSSGCNTAMRSPPSTIGAPPAHSHQEMEQTPGTHKWMVEGLIARWPPSELCTHTSGFPAVTRMVRHA

SEQ ID NO: 986118 - protein, 65 aa, Homo sapiens
MRVPAYTSYRRYVATVLCIPATHLSIPVPGHYSWDQHQNPEPGSILRVKKCAGTQVDLQVIGGKL

SEQ ID NO: 986119 - protein, 101 aa, Homo sapiens
MSTASLGVALGEVRSQALPAAARARFCTEPGSTQRGPGPPAMRGPVRPRSRPPPPAPAGGSPAAEVWAGALKRAEQAHGAGGRTLRKEAVLSQDWSEHFLA

SEQ ID NO: 986120 - protein, 60 aa, Homo sapiens
TYSCSADVVTAKNEGGNCVMRDRSRNWPHSSYTRRRCSRKEPHLILCSLGCKLILGLVEG

SEQ ID NO: 986121 - protein, 72 aa, Homo sapiens
MQRVYKVQKDRADRVPLSSQQEACGMVEHPHGAIDHNTARGEVWAFELTIRALDGTHGCCTLILGMQDLPDC

SEQ ID NO: 986122 - protein, 64 aa, Homo sapiens
MPTGLVYTSSSIEPDLCRLLPLKEVLGSVLLRPALAEFRSHATCPCSSPREKLSPVPATTDARN

SEQ ID NO: 986123 - protein, 107 aa, Homo sapiens
MDAGGLALYTARVAAAGAAYSPPRTWGRSCEVGGRGVDLTPRNLVNDRPGLADSGDSFLDASLPPNGQVFLLLDNMLSGMDPRELLRLVSKESSLPTDDISRSRWKS

SEQ ID NO: 986124 - protein, 36 aa, Homo sapiens
TTYALDGRLTSALNRTNSDRLHTSALSTKPQDPYGG

SEQ ID NO: 986125 - protein, 44 aa, Homo sapiens
MPTVFDMFCAWYDLLCRGVVMLPCQGRGYAAVDRGVDDAVGLVG

SEQ ID NO: 986126 - protein, 77 aa, Homo sapiens
MTETITGFQVDSRSRQMPDSIQRTIKPDVQKLTPYTGLQPGNDYMIYLYNIEVTSARRTPVFIDAYQCQFDATSNLS

SEQ ID NO: 986127 - protein, 57 aa, Homo sapiens
MMRARRGLCIAEGLTLKPVELGMPNTPCCLGSDLFTPMLTENWQHHSVHVKGYAPTI

SEQ ID NO: 986128 - protein, 50 aa, Homo sapiens
YSGSLRCLSWLGACVKVALAGARSERIPGVTSQLPLRGAQVVWPSFTSSL

SEQ ID NO: 986129 - protein, 57 aa, Homo sapiens
AQECKIEYVEYSVTDRAPGLKVMPPDLSLGLGRPTLVMMMSRMVMKMPKNQGPRCTG

SEQ ID NO: 986130 - protein, 58 aa, Homo sapiens
RVSRWDRIPGHHRLLGRLCPEEAWAALEKPAVIEVAASVHNYRALELLVGTTMQTNRI

SEQ ID NO: 986131 - protein, 82 aa, Homo sapiens
SSVHSAAIPYRWRSAGGAYASRLLIFGVYERLRYNRYSRTIASMRKFKALISIARRSVMMIIAIGSIYRARVIITSGRRPMF

SEQ ID NO: 986132 - protein, 38 aa, Homo sapiens
MSDNALGVWGGRSTTNYPKIVGGGMGHSYPRSQTWVLP

SEQ ID NO: 986133 - protein, 33 aa, Homo sapiens
MSPAEQLKQMAAQQHQRAKLMQQKQQQEQKQQQ

SEQ ID NO: 986134 - protein, 41 aa, Homo sapiens
MRILRSGKVKQDHVCWTNVPEPRESGGKPGDGRGARGCDAE

SEQ ID NO: 986135 - protein, 116 aa, Homo sapiens
LTTPDASDPAEGCSVGLASLLLLADPGPGLAALALYFKGSDHVPSSPPHLSQTPIDEMSPGEMGKASVLAHSSGGDLARHDPPDFFCPPGDFGHFVSSGRIDNGPPMDKSDLGQKR

SEQ ID NO: 986136 - protein, 114 aa, Homo sapiens
VGPINCTRANSVSFNQSINQSIIKKLAGYGGGRLQSQLLRRLRHKNHLKLGGGGCSEPRSHHCTPAWMTEWDSILKLLMVTPVQQAYIGGVPGKPGCRVPLLYMKCWISHLGGE

SEQ ID NO: 986137 - protein, 116 aa, Homo sapiens
MCVLNRSPNCRSCFHTQRIGQRDRGTMWRRMRLMVRWGISPASDLIESSTDSIKAGLVTSWAPLHTATIDVSSPLGAGPCMHMFGYLGAVLSERQSVNVLLRIALVAVALPVLAGD

SEQ ID NO: 986138 - protein, 32 aa, Homo sapiens
MDVDQPSPSAQDTLSLASVWNPHRGARTRKRK

SEQ ID NO: 986139 - protein, 36 aa, Homo sapiens
MVWKRASGDHGPELVVLSHLLLPFLSFCQFPPFQSL

SEQ ID NO: 986140 - protein, 69 aa, Homo sapiens
MDVHQPSPSALRYSIHLPPYCDPHTGARKEKEQRPPKFPLFSEQLNLDELCDMLGECLKELSNPMTSML

SEQ ID NO: 986141 - protein, 111 aa, Homo sapiens
SLGFARGLARSAYKIIKKLSSGEYEFRNAPSVEDHDATVIASSFEFARHNSYEDVSPWAIMRMTAPVKLHGVRMRMAVTTRRSLWLIDEYAMSDLRSVCRRPHGACSHYAS

SEQ ID NO: 986142 - protein, 96 aa, Homo sapiens
KVSGKGCNVQTVRIVKGTSHTPTRSSLTDVPTGVGNEFLSSITTEDRVRQRRRSKGRPQDKLQVVTVETLCSNPSLALTLGPGSMSPPGLAGWPQC

SEQ ID NO: 986143 - protein, 36 aa, Homo sapiens
MPPASLKHTGQSFITCSQSCTVTTSQFEDIFITSER

SEQ ID NO: 986144 - protein, 34 aa, Homo sapiens
LYRIFPDEPDRAVGYSGVGCSRTFMTQLGQTHNR

SEQ ID NO: 986145 - protein, 60 aa, Homo sapiens
MVVMISVWKWWAECLPLCIGMAVGKPAMRGAGACRLELVYTLALCSGGVSRINCHSHESE

SEQ ID NO: 986146 - protein, 39 aa, Homo sapiens
MLKQENHLTREAEVAGSRDRATGLTVACGLTVTVAWLTV

SEQ ID NO: 986147 - protein, 78 aa, Homo sapiens
SVTRASQLIQHPQLTRASCRYNEHPQLSPASSGQASILRSHQHPQINPASSDQPSILSSFQQPQVTPASSAHSNILSS

SEQ ID NO: 986148 - protein, 30 aa, Homo sapiens
MAQSRLTATLASQVQGILLPQPPEELRTIV

SEQ ID NO: 986149 - protein, 42 aa, Homo sapiens
RLCVSNSLFMLGLWFSGHSHPPAHTLTAPPSVEAQGLGKCSL

SEQ ID NO: 986150 - protein, 83 aa, Homo sapiens
MESLSLPTGGKKCSTSGYTNIHKVASVTCHQRGTNHILKRVKTTEKSFMRVGGTMVFIMSTESCSVAQARSAEVQHSVQCNVC

SEQ ID NO: 986151 - protein, 121 aa, Homo sapiens
IPVRSPFVIKTRNRLPMFGSQCAPFLEASPFIYRQDAPGKKTTGISRRLMVRTVEEFYVVLLVPLVCVCVWRRPRPLDHLLELVVQDQHEGAPHAPQDVGPRTLEEGLAPLISEDLPPTVD

SEQ ID NO: 986152 - protein, 127 aa, Homo sapiens
MAPPIYTDVLEFDDGRGLESPTPRDAFPVFLGPGGPAHFLSGASSVHVSGGFWAPSVLRMSGGGYSPFDALCRGSVCFTEGGHDPRLDMSLRIALTACRWPGTPATMSQIAKDVCTFLRWASEPEHD

SEQ ID NO: 986153 - protein, 43 aa, Homo sapiens
TLEDPSSIPLRVSIRLRVSFPLRVLIALRVGITLPAGTTLQWM

SEQ ID NO: 986154 - protein, 82 aa, Homo sapiens
GASQPKVRLLGSRRQATQALYAALIRLASACVLSIDVCAPQVAGEHVMWHVPTVSRVPGDIVPMQRKMDRPHYGILPISVSQ

SEQ ID NO: 986155 - protein, 37 aa, Homo sapiens
SNLQIPTCSFQSIVNHITTKSTNTQINTTMPRFHPTN

SEQ ID NO: 986156 - protein, 48 aa, Homo sapiens
MRVGTTAEELKGLVECDTSYCDWIASGCRNTKTKQTVHCIHMNSMRTE

SEQ ID NO: 986157 - protein, 106 aa, Homo sapiens
PYRILRLYVQCCDLGLHCNAPPSRVHTILLPQRSAGSSDYRRLPPRPANFCISITDRVVTILAQAGLKPLSSGYPPTLASQSCFESQDVSLCCPALFSPFLAYRRD

SEQ ID NO: 986158 - protein, 69 aa, Homo sapiens
CAYCYSMVYSTSAREAEDDSLQYDARDLREYVGYLRVTQSLSMKIHYEQISPHIKLLHDLISLYFLAII

SEQ ID NO: 986159 - protein, 53 aa, Homo sapiens
ERSAIARVHMGQLLHQLLLVLGICLLLSTTKGGLKPGEWLLTSEVPCRTPRCA

SEQ ID NO: 986160 - protein, 50 aa, Homo sapiens
IPLQQHSIYKHIDAPDYPQLGDPLLYPLAYADLYLSNTLQSTRISLARKS

SEQ ID NO: 986161 - protein, 111 aa, Homo sapiens
TGDAVAHARNPSVSGIGGFLVSLTSRMKPRTLAVSVTVLKGGVSRVCSFCCSDVFGVSSFWWVRGLAGSGVKLQTFVVSVTALKAARLELLVPPGGLLVSLASGVKLQTAF

SEQ ID NO: 986162 - protein, 140 aa, Homo sapiens
DSIQHINTSKPHDELKLPSVPIPWSPMPTAAQTSTNEEFGNSGTKILIRIFELILYTKLRTSHITYAGSCCFKRQTDGKPSMHMLGKLTGTCNESANNRAEYYHLLAEKLSKIQKELEEKRRTRLQKQNMLPNAAGMVPV

SEQ ID NO: 986163 - protein, 150 aa, Homo sapiens
EESEAEALRGGWRSEAEQLEQTKRDESKAREGEADSGERAGGAGQRGERCCCRAKGDSEHKRKTVEAQLQELQVKFTEGERVRTELADQVTKLQVVLDNVTGLLSQSDSKSSKLTKDFSALESMLQDTQELLQEENREKLSLSTKVKQVA

SEQ ID NO: 986164 - protein, 130 aa, Homo sapiens
CLASRLEGPEEPERSVCLSRAPHTARTSVCLTGGSPYSKDVCLSHWGLPIQRECLSVSLGAPHTAGMSVCLTGGSPYSGNVRLSHWDLPMRLRHLSLAGSPTSKDVCLSQAPHTAGTSVCLGLLIQLGPR

SEQ ID NO: 986165 - protein, 49 aa, Homo sapiens
WRARCLVLDEARYGSASGWVVRPEHVRKRFIMRLCACRNVAQPVNIMSH

SEQ ID NO: 986166 - protein, 99 aa, Homo sapiens
WGGVSLSPGSFSRFPLPFPGHSRQGGDEVGAERMEAGDLRFPEYSGWGLRASPVPSLPPCLGFLPPSTPPGATGLSGAQAVPGALLLLPTRPHSRWTGY

SEQ ID NO: 986167 - protein, 69 aa, Homo sapiens
MGCGGSMSQHQLRVPQPEGLGRKRTSSEDNLYLAVLRASEGKKDERDRVQKKTFTKWVNKHLIKVGGAC

SEQ ID NO: 986168 - protein, 57 aa, Homo sapiens
CGYPAKRKRKSNWYVPRLQSMKYHRNCSNEAPNICITADSGIDSVKELHLYPRGPLL

SEQ ID NO: 986169 - protein, 70 aa, Homo sapiens
RIHCNIRSHIKVILLLSLPRSRNYRCPLPCSDYVCIFSREGVSPCWPGWSRTPDLMIRPPWPPKVLGLQG

SEQ ID NO: 986170 - protein, 137 aa, Homo sapiens
MLHSCDWLGVSTCSRVMSEDVTRRADWLGLSTCSSVMSEDVTLLLTGWDMSTCSSVMSEDVTLLLAGWGVSTCSGVMSEDVTLLLTGWDVSTCSSVMSEDVTLLLTGWGVSTCSSVMSEDVTLLLAGWGVSTCSGVM

SEQ ID NO: 986171 - protein, 107 aa, Homo sapiens
MVIRWFSIQEPITRNYELDLILVSDNYETELTNGTAVLFVAHSPFLSYIILYDDGAFTTAALLYVTIILYLYIKEDNSIYSWYSLNTFPTLANFPYVTDRQYFTTIS

SEQ ID NO: 986172 - protein, 33 aa, Homo sapiens
VKNEGQDAPGTNTVNGITYLSQIHLFQLAPSSN

SEQ ID NO: 986173 - protein, 64 aa, Homo sapiens
QWVLMDEHMVNEAGLYIDAHLSKYICIEKIHRTYITQGKARRECTCTPVRYVSECTLRECKVRD

SEQ ID NO: 986174 - protein, 90 aa, Homo sapiens
RIIERGLIRTHQYTRLPRKQQKTAVDPWNSSTKYDGAHEDPTAKLPVLMNSNRIPPPHNVKRYSNITIPRHSWFILDNDQNIFTRTHYRC

SEQ ID NO: 986175 - protein, 65 aa, Homo sapiens
MTSRVILVLRTVDAQCCQVVRASVLVWCQAAALRIVKRYLITQLINVIRAVDEKIGHLVRFIETT

SEQ ID NO: 986176 - protein, 32 aa, Homo sapiens
MPLVGSLASCASYPATLQDTCLTLGGHSHQSA

SEQ ID NO: 986177 - protein, 86 aa, Homo sapiens
MSVSGSPCLCDDTLLNRVSIDPPPIYGCLLFNFVGRLIHLTGPLQSVPFRLSLCVFLSSSYCDSSVVDRSALSGQLAARKNLVEWL

SEQ ID NO: 986178 - protein, 108 aa, Homo sapiens
RVQRLTAATVSTKPRDSMVRVGDRNTESEEGGKAVHEVEVALKHNRFTIGDLLLRQSPCSGSRTPSPSAVTWRLSASPRRDWAEITLITLNTGIVSGFRRTPKKGPGS

SEQ ID NO: 986179 - protein, 81 aa, Homo sapiens
MCHQRAPLGGSLWPQRYTSPRAWGYCRDAPLPSSHGVSSSVNINDSDCTTSMYEAWHRSSSIVPHPSVIEYPSQASSGCSQ

SEQ ID NO: 986180 - protein, 37 aa, Homo sapiens
RVMRLLSEKDVDPVRTTSNDIVEIFTVLGIEAVRKAL

SEQ ID NO: 986181 - protein, 73 aa, Homo sapiens
MSGTYQRLACHWMRLESVTFFELLVMCEIVISFVVTGDVLDLDLLRLIAKFCFEIASWFLVESWIWTQNAPHG

SEQ ID NO: 986182 - protein, 139 aa, Homo sapiens
PLWSRLRHDDSPGCASDRNYSRTIAPPGSHPYSPKIDGTITLRDEEENSPVTTNVDRMRRDQIINWIVQLSNIIPDCNANYSQTGASIGGILSQACDYIRELRQTNQRMLENFIEAERLQIDDELLRPQIEELNNENAL

SEQ ID NO: 986183 - protein, 85 aa, Homo sapiens
YEACWNGLGLKNLFRRVFHGTYLKNFCSIARLLGTTTCKQVSSVCSEESLILKLPTDELMTPLTEEEEKAPIVGCTLQEDSAEER

SEQ ID NO: 986184 - protein, 139 aa, Homo sapiens
FGRVCGHLQVIVSRSGRVMNIIEDVLSDDAPSSLSYASTLQANREDSMNILDPEDEEEHTQEEDSSGRYEDEDDSQDEEELRRRKMRKIIRRMINVQAREMKHYDYYCSEMESDEDYPDMNASPLVRFERFDREDDLII

SEQ ID NO: 986185 - protein, 30 aa, Homo sapiens
MPLLQPDDSTQNAPNGSRVSNSPNLVFASF

SEQ ID NO: 986186 - protein, 76 aa, Homo sapiens
MVFRLPPLTSMLEMELKFGVNPVEAATEEIQTHKWIRRGHVLMPVPEGPEGLATLLRAGRPPARDLAEKHPVEAAP

SEQ ID NO: 986187 - protein, 125 aa, Homo sapiens
SMITSDGPSAPQLLAAERAWRDAGPLSSLAVKVHGIRSSENSTVHLQSPRRPSTNIMCLTVSATLSAAIWCGALFFSLEHHPVMLVPHNYRLSCSRAGPSSAHSLVSSQGSITPSTGASHNAPNA

SEQ ID NO: 986188 - protein, 55 aa, Homo sapiens
GSHLGPDCACSPVNYRLEVNTVRLPGLEPRAISLLRSCGSADGVLASPLHAERPL

SEQ ID NO: 986189 - protein, 55 aa, Homo sapiens
MCTRLWYTACLHVVRVCDTQCDYNVVLPLLQPDDSTQNAPNGSLSLEFPNLGHSL

SEQ ID NO: 986190 - protein, 81 aa, Homo sapiens
PVVWDTLKPTFRCAPGSSLFTTLLFPAPESPLSTTGLGPDMPHCLSSPASTCAGLSRPQGAFSTVPSQPVFSRCVTSAPQN

SEQ ID NO: 986191 - protein, 123 aa, Homo sapiens
MALCVSLFSDNRILKSCRQIWEAHYSCRYSAFADNDLISLPKEIGVASPLKELHIQGNRLTVLSPELGNLDFTGHMQVFKPDNNPGVTPIADQFQLAVSHVFEYIRSETYYYLYCRHMQAYAE

SEQ ID NO: 986192 - protein, 85 aa, Homo sapiens
MAALGVLLREQKHLLPEDQLLTVSMIIVHPPFYTAQIEAHFALLQLEHLVMVSRPRSSDSSPCPPWPHMQLPLWACRDWVTALGT

SEQ ID NO: 986193 - protein, 69 aa, Homo sapiens
INIPDILTEPTGTNESLQTQVVNLFNTLEEVRELARRDNQDSAKLKSARKQELQAQVGLSPRAGGTGPA

SEQ ID NO: 986194 - protein, 74 aa, Homo sapiens
TGDAVDWRLKVQGRYRRQLNAVADTGLFSRDRDHMVNRPLPAFYNVLTCIIINCGIDSVTLYDYTIMYDTLCNV

SEQ ID NO: 986195 - protein, 114 aa, Homo sapiens
ALCVEENGQEQTMSECEAVAHELQRAKRSLAPAEGLVHADNPVGSWRPWSACLESSRQLGLSDNICSNWALDSFAFSSVYLPPQVPDICINTILGTPKSESNYSIASFLMSVRI

SEQ ID NO: 986196 - protein, 73 aa, Homo sapiens
RVMRLDRSGQVTVYGLIVRRRCQPTDVLEGLNLLITISGKRNKLRVYYLSWLRNKILHSDPYVKKKHGSTTVV

SEQ ID NO: 986197 - protein, 68 aa, Homo sapiens
RRRPDSSDERRTGTAETQLISDSSEDSSAAGRLNAVYKGIEVLTLAAAPLKTLHRNEMTLCLLQNFLG

SEQ ID NO: 986198 - protein, 123 aa, Homo sapiens
TGDAVGKRRSSLPRWDGGRAETLLTFQTGQPGRGAPHIPDDGRPGRDTPHFPNGVAAGQRLQSRHFGRPRQAAAPCPRAPRPSAPPAPHPISQHWCIRDYIYNTLCGIHSTHHCIIYEKKINQ

SEQ ID NO: 986199 - protein, 44 aa, Homo sapiens
TGDRLLLTVIIVALKRLTYSTAEYTPRLTSSGVHNASLTLFLIV

SEQ ID NO: 986200 - protein, 117 aa, Homo sapiens
TGDAVVCVPVCVRAHCVSVCRLLSLSHVSLSLSLSLCLSPFSLFRTPSLSVSVRLCVRAPWDTCALRAGGWVSRTSPFLHGSVSPRLCLGRVARWQTSSPGFQFGGLRRPAQRWQWA

SEQ ID NO: 986201 - protein, 109 aa, Homo sapiens
ETMGVRTETLLTAEMLWPALRGAPHLLDGMAGGAETLLTLQTGQPGRGAAHVPDDGQAGRDTPHFPDGVAAGQRLHSRHFEEAKAGGCEVEVVAAEIMPLHSSLGTIEH

SEQ ID NO: 986202 - protein, 34 aa, Homo sapiens
SSVDDGARGLMGSCGVSAGSPSGLFAAHIHLAAV

SEQ ID NO: 986203 - protein, 95 aa, Homo sapiens
SGLQIADKIEKIRTGNGLDGKTRGPAVHVLSNRSQEDFQLGPSSARNPGPGFRIGAEMSSIVLGHSDTVTAVKDQGLERRNITSEVQDMKCYLHR

SEQ ID NO: 986204 - protein, 75 aa, Homo sapiens
MTTNYLDVLHKDNELLTRASRGAMGETHLLHRLLLLLLTLCGQDTGAWTTSYVPCAQGPELWCQSLEQALQCRAL

SEQ ID NO: 986205 - protein, 99 aa, Homo sapiens
VPPPADMYYRGFFFVLCPLPRVRPSPCEKTSWGDLLPPASPLSGGQNSPAPAFRGESGPLKWIPPNPAFKGTQGACHFLSEEVCAPPRSCQWRSSLHNP

SEQ ID NO: 986206 - protein, 126 aa, Homo sapiens
KIGCDDDFGFSVRRSTSKNFSDQSSRWLNSAAWSEALMPVSLGNIHVCIPSFILHSEEGLLKTIVFCSVFSSLFSKFLGRVKFLCRLTFMPLAYLRLIQFSRMASVQMSSLAAGSELPRGEACFSS

SEQ ID NO: 986207 - protein, 136 aa, Homo sapiens
EERAVSMNTDCLPFDKRHETGMPFITTLFNIVLEVLARSIRQEKEIKGIQLRKEEIKLSLFADDMIVHLENPIVSAQNLLKLIDNFSKVSGYKINVQKSQAFLYTNNRQTESQIMSELPFTIASERIKYLGIQLYR

SEQ ID NO: 986208 - protein, 34 aa, Homo sapiens
MADRAEGIRQEDAWGLCVNRDEAGVRGRSCRASR

SEQ ID NO: 986209 - protein, 42 aa, Homo sapiens
MILQMIGCIMCAVCIGVVLSNRGAYRIGRDSVVGKNVRFTPD

SEQ ID NO: 986210 - protein, 30 aa, Homo sapiens
MGTAVLRNGARPSLSDRLTHVQGPRVRTRE

SEQ ID NO: 986211 - protein, 61 aa, Homo sapiens
MEKLADSTVPQGALVLVHGSCESVQVPDDQDFRSFRSECEAEVGWNLTYSRAGVCVWCAVL

SEQ ID NO: 986212 - protein, 120 aa, Homo sapiens
QCLGRLWHGESREYYSCMCQKQKFFWSFPGSGVAGSCAEMSDQSRLHSWRTRESSVRQSLRYSPLMYLSSMSLVQADYAGNILLDTLDLDSPSEVRSTLAEQTMVCESWVPVLLGDPARV

SEQ ID NO: 986213 - protein, 69 aa, Homo sapiens
LISLEWQAFVMPLRGPHCLEHLAAPYTVPLGGCTAALLPVAVTDGAGWDSSMCVMAIPSAQLTKKLAIL

SEQ ID NO: 986214 - protein, 54 aa, Homo sapiens
IELGTMETRLRVCALRYSRAAAHLRAGGKILTFDQLALDSPKGCGTVLLSGPRK

SEQ ID NO: 986215 - protein, 39 aa, Homo sapiens
MCPRPRSNDIARCCSPLPVSVAGRKLWRRPVGSLDDPAA

SEQ ID NO: 986216 - protein, 71 aa, Homo sapiens
LQDPRQASLVPHNGHRIVHERCYAKRLSIRQVSGSCIRLINVLTAITLLTGKKHPITTYHRILCELLLDLH

SEQ ID NO: 986217 - protein, 41 aa, Homo sapiens
MTCPRRLLTRCDICLDASDMSVVNNYNASRVTLDGCFLIEF

SEQ ID NO: 986218 - protein, 41 aa, Homo sapiens
AGSSDLTSVTAADTAVYCARDSYYYDTDAYKRTLTTGARQS

SEQ ID NO: 986219 - protein, 39 aa, Homo sapiens
MLARLGLELLTSGDLPALASHSAGIPGVRRHSQPVAVCF

SEQ ID NO: 986220 - protein, 85 aa, Homo sapiens
MRLANGPDVQVKKFNEARVNGGSNYDSLKVAKCLVIYISDAHAWMNEITTVPTLIYIESTDNGRGLAGIIGGRRTCLSLSLVWHG

SEQ ID NO: 986221 - protein, 139 aa, Homo sapiens
VSLIPDRSSYSCADICPPSHYVPALPSRTQETPPAQMYGFLNRYHEWEAHNTKASSRSWNKVYSVINNQEMGFYKECKDCCIWNSLPQRGPCELERSCLQKWPLHYQKKKHVYKLRLHDGHEYLYQAKDDEAMNTWIQA

SEQ ID NO: 986222 - protein, 118 aa, Homo sapiens
PANYSHNTNPGDTYGPDGKGFLNRKHEWEAHNKKASSRSWHNVYSDQNNQRNGLLRKMQRLLLTGIPYHSEVPVSLNDAVCEVTLNFKKKKHVYKIRLNDGHEYLFQTKDDKAMTHGS

SEQ ID NO: 986223 - protein, 33 aa, Homo sapiens
GLTVQPRCGCTQGSDPHYLPAHSQNSHQRTLAH

SEQ ID NO: 986224 - protein, 35 aa, Homo sapiens
MGMVALPVIAALREAEAGESPEPRSVQDQPGHHME

SEQ ID NO: 986225 - protein, 71 aa, Homo sapiens
PRFAEQYGGLSSLQTPPPRFNRFSFLSLSSSRITGTHHHAQLILVLLVETGFGHVGQAGLELLTPTSTSLR

SEQ ID NO: 986226 - protein, 62 aa, Homo sapiens
YSSLAKLLVLSSLLYSWCFPSEDLLGVHQYSQSLLGQLFYLAASSQPSCPNIYFYKVSLLAH

SEQ ID NO: 986227 - protein, 50 aa, Homo sapiens
LIASPELKRCGMARACHQAVKILMYAFNLLFWNFLLLLLVYLLEATVAYA

SEQ ID NO: 986228 - protein, 141 aa, Homo sapiens
DLEIPKVDSDAHSMQQAVRSGAVPWPHIHQPNPAHSAPMVLCLCGHPLMAPVENPPDPGSPLLPRKVAVLTLALRPVSSQAKHGSKLTGALKEWPGSGPLCSEVHSPWLSVENLLGPRNLGCEYLLGVRLCFLKLHGPRRR

SEQ ID NO: 986229 - protein, 43 aa, Homo sapiens
IAQIQLDHGSITFQGQPTKPRATGGHGRGVALNHSPSHHARTV

SEQ ID NO: 986230 - protein, 31 aa, Homo sapiens
MDSGIQVKVQSSWLWGQCEEWKIEYVGYRSR

SEQ ID NO: 986231 - protein, 91 aa, Homo sapiens
GANATWNAIAENPPVLPLSSTVVESCVDYSLMVYVDIPVSYEIYSLICHLSSVPFLYIHLVAEPHRVPHVTCTPDLLKLAQFITFLTHPEG

SEQ ID NO: 986232 - protein, 57 aa, Homo sapiens
DGDVTRHTQDGSDDLLTPLRVELTALFYGLSLFSVLFFLRVLNWIHRTVRHQGVVSL

SEQ ID NO: 986233 - protein, 101 aa, Homo sapiens
LGLINIQEESTLHHVWRFQGGAKKMKKSYAMAKKNMHYRKKIKLAVLKNSKVHDNGKMGGLHGKCLLDECGAGGFMASHLDRHYGGKCGLMASTNQTSNRV

SEQ ID NO: 986234 - protein, 71 aa, Homo sapiens
GTLDGLPLGGTATVYVWTHDVYCGQRDRLRVEHATVYGGTVCWYVHACNFQPPCEDLTVGRLGSTLKRLTA

SEQ ID NO: 986235 - protein, 43 aa, Homo sapiens
CCGYSRRLPYGGPAPWGTYGRCRTLGRLTAEYRTPPDRTFLDR

SEQ ID NO: 986236 - protein, 97 aa, Homo sapiens
TLDDPPRWKRDVRWSTWNTGQRAELLAPVGQGEAWQIEYVGYSVTGRVLGLKMPPDLSLGLDDQHWDDDEQNGHEDAQNQGPDVQALGGGGIGLGPG

SEQ ID NO: 986237 - protein, 57 aa, Homo sapiens
MALRIEVANLDGAHRKVLLWQNLEKPRAIALHPMEGTIYWTDWGNTPRMEASSMDGS

SEQ ID NO: 986238 - protein, 52 aa, Homo sapiens
VISFFSVDHARTSLENIPENVGPRCVNALLVPMCPSSVVANKNRPAAATTHV

SEQ ID NO: 986239 - protein, 74 aa, Homo sapiens
MKLADPDLGLQPSELYENNSLLFMATLVYGSPEQTNDTLPLWESHDHGHGMNRPRCSVILEGPNPGAGPDHPGK

SEQ ID NO: 986240 - protein, 72 aa, Homo sapiens
GLLISVMKVVEKEVEVAVSISSALQSLTTMPLTMRGKSANEKADSAGVRPGAEAYLLSVFGIWCLVMQREWR

SEQ ID NO: 986241 - protein, 35 aa, Homo sapiens
TNQAPPQLGCWCWSASAHEDSNDQKQFVEGQNRQG

SEQ ID NO: 986242 - protein, 151 aa, Homo sapiens
RHLTSVRLTVTNTSQPVMTNTSMDNDGPTAKDTSDGHTYRMTQNRVTPGRPTDDGRCQTARRTRGNWDSDKKYPPTWQCFTVRKRERRRAEDYYRCKITPSARKPLSNRVRLVAVEHRHTSGLPYWPYLTADNFRKGDGAPASILQLNNIL

SEQ ID NO: 986243 - protein, 125 aa, Homo sapiens
GSNTSAGSTSWTPWNGLRKVDFWHSDPCTMIKGTSGHLWPPFMTPKSSRAFSSPEACRSMKLLYKASGVFDGIPHYRFVAPKSLLANGSISPPNDGFGPCLESGNSELSAPAGSVPPGFSPILTS

SEQ ID NO: 986244 - protein, 66 aa, Homo sapiens
QRVLHPGQRCVILPRLSEISPRQQGTDFHTELISHGKVSAIDTPHFGVLRKTTGHGTETEHGVFSI

SEQ ID NO: 986245 - protein, 98 aa, Homo sapiens
IRDLVITYGRYLAPFRYKMGWVSGRGGACRSLSYYSGGGAKLEHRSSKASRANLVRPDLSETYNPTPTPHQTQGLVLPGPLPETNDDQTDDNVPFAFS

SEQ ID NO: 986246 - protein, 40 aa, Homo sapiens
MTPPTVLDSYAPTDPTLHVPLLPHTVLTHVRTPTTYPITT

SEQ ID NO: 986247 - protein, 69 aa, Homo sapiens
KDIERLKQRIRREQKASISSLDGSTRLKPSLAMLVISVMGFLCSEQPDLDLNPGVSVTVPADGGHSNME

SEQ ID NO: 986248 - protein, 178 aa, Homo sapiens
YVGARALLRGHNQYAHELAKITSALNRGPELLDRWWTPVAQITQRKWEAAREAEQLRAYLEGLCLEWLRRHLENGKETLQRADPPKTHMTQHPISDHEGHPEVLGPWASSLLEITLTWQGNGEDQDPWTRSSVETRPAGDGPFQEVGGLWWCLLEMEQRYTCCVRHEVLPKPLTLRWE

SEQ ID NO: 986249 - protein, 63 aa, Homo sapiens
KCSQSVHPSLSAVTSYVVKFSSMGIIDLNSLLFQAKSCRPDSEEELLFSHILIFHLAYSCMHV

SEQ ID NO: 986250 - protein, 67 aa, Homo sapiens
VALVLTQRRSCMFFSAYARPAPVGICLLDVPCAAWFPTKILGDSCVHAHLISVDPRGLMPVNRTSCV

SEQ ID NO: 986251 - protein, 170 aa, Homo sapiens
PRGSRGQRDDHKGQTSLYLPRDGDDSLLPSRITLLLRVLPGYFLVRAFQLVDGHNGRNVLSNSSIMSNPLLGLVIGVLVTVLVQEIQHLNVHRCQNGVLFIAHCAGCHPHYHWGPPLDRQITNTMVALMQVGARREYRRAFCSEPPVHDFFTWLSVEVLLPVEVATHYLE

SEQ ID NO: 986252 - protein, 61 aa, Homo sapiens
PPGSRISQAGLGAGSQVLLDLSPAVLPSRLQARLFWAAVLLVFSLAILPAVVHRLLSKSSP

SEQ ID NO: 986253 - protein, 74 aa, Homo sapiens
VDSTTDSPYCSRLVTDDELRSGPTSDWYVVITSHSLTDGEDSPLASGAWKRRTTIPRQTVYRMSCRKLAQLYNG

SEQ ID NO: 986254 - protein, 34 aa, Homo sapiens
QETHLLLASEVVSAMADTSRSCLAWDTTVDMPNA

SEQ ID NO: 986255 - protein, 41 aa, Homo sapiens
TPRGSIYRHFLVGEACCFPIMRFLLHGGSASPGITFRAFSP

SEQ ID NO: 986256 - protein, 52 aa, Homo sapiens
MTVLEGMMMCPHDSGSRTCWQDVNNGELCSPQDWAVAGVDTCPPTLANAESL

SEQ ID NO: 986257 - protein, 41 aa, Homo sapiens
MDIVILIIFSWPLARSCLSFLTFISILFLTISFFFHLGVPS

SEQ ID NO: 986258 - protein, 43 aa, Homo sapiens
VVYYLAWALVMTLESLRAVLDCGRMSWRGLWYLLLPSVRRASA

SEQ ID NO: 986259 - protein, 111 aa, Homo sapiens
WGGISSSPLLPPLSPVHVVGGQQAWRVVLCFLDTLSVVVAPMGRVLWSHLEPQRLGNSSRAAHVRSRSRLAAGVSRLRPCTTKPLEGAYGLFGGAGGYIVYLQRLIVHHVS

SEQ ID NO: 986260 - protein, 60 aa, Homo sapiens
LSTTPPTVDPRRWFLWDARTYVTTTLGNGVDDYLRVVVSTFGTPHYVTVLLGTRGTRRLD

SEQ ID NO: 986261 - protein, 74 aa, Homo sapiens
RIPVDSDVQIIWTLVLTSLTHGRRGFGGCPRGRRSCRTGHLLLPQLGHLPTGVYQKVVPQIPVKSVGPHVAGVL

SEQ ID NO: 986262 - protein, 45 aa, Homo sapiens
IYCSSESYGHCSAQHYSITASGRSMKYRLQQAQKGTPMKPEHTSH

SEQ ID NO: 986263 - protein, 40 aa, Homo sapiens
LDVDIDEMMSLDGGAKCNDQYPYKKRRRGRARWLTPVIPA

SEQ ID NO: 986264 - protein, 54 aa, Homo sapiens
SYCEELDGRTANDFSVRWVVVYLHPQHGRANDWTKDCDDDTDDRTNRSEMTVTR

SEQ ID NO: 986265 - protein, 38 aa, Homo sapiens
LSVYVTQSANTQFDYVSGKLSLHRKECTQFHGHNSHSC

SEQ ID NO: 986266 - protein, 51 aa, Homo sapiens
VDLAGIPQAMHGMAVFPVSLHAAGASGGGSTSTPTHQGTFPSPGPGVTAAS

SEQ ID NO: 986267 - protein, 95 aa, Homo sapiens
RTHPSSKSKEHRALNTQNPREQKASISTLDCSTRLKPSLAMLVISVIGLLCREQLDLTEPLVFQYQFQPLAVFKHGVTFHWVPYVTHGSCMAKKG

SEQ ID NO: 986268 - protein, 99 aa, Homo sapiens
KCRVVSIVVNAAGSASTSRLYCGPSHQCFGGGRLIRVKPDIGSLRSESGACSCIGLVPSDAVGHHQQRVLAFSIVCIRAADHWGGSIVARELWFSGISL

SEQ ID NO: 986269 - protein, 62 aa, Homo sapiens
SGSSAFRAGTGSSISRVLGPSDSDWDRNHQLSGASSWPTTGLGTGPFHKCWSQVFRINLFPP

SEQ ID NO: 986270 - protein, 113 aa, Homo sapiens
MAERWEEHQHSASPAKDEYYSSNFPALNMEAVVEAAPQCQKMVNQFLSKGGTLCHVRNCAHACNPNTIVTAEDGTIKRSGADDHPVTPLDKHPTHTHIQPISPGSVDSCLYSP

SEQ ID NO: 986271 - protein, 56 aa, Homo sapiens
TIFWERPPDLTGNDLDFLSGRHLTGPGTTRDFLSGTTPDWTWNDSRLFSGQTLDFT

SEQ ID NO: 986272 - protein, 70 aa, Homo sapiens
YPPVYLPVNPRLASVRARSSHSTSAPWLPLARVRLLLRDGAGVWDARPRGGRADLQNPHAPMASPLVRLT

SEQ ID NO: 986273 - protein, 69 aa, Homo sapiens
YSEGRGVLSLWMLRKGGDRKRGDVTCGFLRKCRRQDEGWCDLWILEEEAGDRKRGGFDPVDYLRNALVV

SEQ ID NO: 986274 - protein, 39 aa, Homo sapiens
AREQIPRYTHHFLLGNAEPFEKRNLASVFKWFSIPNQKV

SEQ ID NO: 986275 - protein, 108 aa, Homo sapiens
VLCCYHAFVSEFATRGPVSPSAKQVDSRFCCLQQWLPSGKQWVMVGDGACGKTCLLIVFSKDPVSHEVYVPTGFENSVADIEVDGKPVRVGFVGHSLGRTDYDSPEAP

SEQ ID NO: 986276 - protein, 51 aa, Homo sapiens
DAEVALEIPQPFVHLTTAGLWWDGVTHLLASTCISFPAGPGSPASDFKSLV

SEQ ID NO: 986277 - protein, 136 aa, Homo sapiens
ATQLSGRRRACETGFYFYFYFFSPFYFLTTTRTGTEARAEADATAEVLVTLGVCVDDGGCCAQRPASLPSNAYNPRPQPIDRRRRQCEHSHLATPPRTVYNKTRKHDMACLKRQVCPVLGPTFSWASNGPAMLLPT

SEQ ID NO: 986278 - protein, 51 aa, Homo sapiens
RLTGEDRGGFGMFKLSFIIFTFVQHHGRSHVCICSVACSIQADSASTVSSV

SEQ ID NO: 986279 - protein, 55 aa, Homo sapiens
LRRSTSRRTPPNDGTDATTYDTDWTWTVNTVYSLTDDVLVPFTYLCWCDTSTTLF

SEQ ID NO: 986280 - protein, 106 aa, Homo sapiens
MVQPNQEGLSQVLEMKGAVAHHQKGGREGHLMTSLQAQRGLTSSRAALHTIRKEYLRVQDKRTPKTGPGKQREDPKPGPKKPKEKGGALSAVGSHQLCKGGYPGGS

SEQ ID NO: 986281 - protein, 46 aa, Homo sapiens
ALRELHCSVTPITNFAGQQSQDTVESLAWLTNLEELQVAIGSSEPL

SEQ ID NO: 986282 - protein, 48 aa, Homo sapiens
LYDGLRHALATVWCTTATRLPPGGPDDRGALKHWVTGGDTDRHASSGQ

SEQ ID NO: 986283 - protein, 34 aa, Homo sapiens
LDGSPLTTPKRSRTVVTAPAFHRSLYFVPDTHST

SEQ ID NO: 986284 - protein, 91 aa, Homo sapiens
MTTQEDKVITEMAAQIREVEQSRQEVVRSVLEVGFPRRIQTTSGKCQTQKRVFSTKKLERDDQPSSFQLTAALNLGPATSSRAGLDGAGPS

SEQ ID NO: 986285 - protein, 90 aa, Homo sapiens
PSLNLRSSRTEQDYHGNNTSSVSVLYTDRQPHTVSPIILIIIITQSLIRRLITTLWSNTAAQLHVVLTNGGSAMVEGQVLHSEYWCHLII

SEQ ID NO: 986286 - protein, 34 aa, Homo sapiens
LSVSSASHVPGMSLAALTHTIPHGLLYKSKPEEL

SEQ ID NO: 986287 - protein, 45 aa, Homo sapiens
MHTCPQRISSAPGQVRQVVVHFSRPFSTGTISITGPSTFPSPGPA

SEQ ID NO: 986288 - protein, 111 aa, Homo sapiens
SLPVEGKNSFANYCFQEFCEIMKNAYCSGETFQSCIYISELGISEAFLRPQDKEATQMGNEGLPSFTCVVDLVFTSFALGPPLTAGTLPTTVLAAAAYPAPTCVINATYLY

SEQ ID NO: 986289 - protein, 42 aa, Homo sapiens
QTEELMVWVITAPADGADGAAPFFTWHKSKKTDMLAFVKEIL

SEQ ID NO: 986290 - protein, 109 aa, Homo sapiens
STGSVASSFHAFNSSEMRAMTRVGKTVSAIERWKKSREVSPVSRKRSVVFAVILGISGCLDISQRMKGIVVRKTTFQRMKGIVVRKTTFQRMKGIVGRKTTFPGLGTHY

SEQ ID NO: 986291 - protein, 73 aa, Homo sapiens
RTDDVCYLGGLALTQKWAGSHSMRYFYTSVSRPGRVGSPCFIACGLLWTTLQFCAVRQLTPLSQSDGDRVAPV

SEQ ID NO: 986292 - protein, 67 aa, Homo sapiens
LTTIPLGGRDVAILKAGNMVTISNAKQLLTCKNTAFPVPSASLDEMSPSYVNFLKSSKQFKFSFPLR

SEQ ID NO: 986293 - protein, 35 aa, Homo sapiens
VFAFSASSEKQGFLFCPLTSGLAELALGGKILLLC

SEQ ID NO: 986294 - protein, 100 aa, Homo sapiens
KQLEVLLDYYTTIRYTYFEVVCRSENFGQNGEGNSTPYEQHNSNHCTYYSYLCVSPWPSIALAVNQNLLEASFSSSLKPFPRTQFYPKKRMIRGLGAETI

SEQ ID NO: 986295 - protein, 105 aa, Homo sapiens
NKEAMLYIYVEEYSKLDHSFIVSQPTFYLLKNDNMHSTIGEVVGEVVTLEITSCISFLGSNVPSIIAQIYITSVLGWNRCISSNYEHSKYILKSRISQRGQINSH

SEQ ID NO: 986296 - protein, 43 aa, Homo sapiens
GLSLSKGSVTGMSYHAGSTLGNEMPSTPSQELEGTGIFRVSKG

SEQ ID NO: 986297 - protein, 59 aa, Homo sapiens
MSRISELQPMSQATMSILEVAVIQRDIQHQPPGRGQDHLCCPGAPRIQKLIGRVEHVVL

SEQ ID NO: 986298 - protein, 53 aa, Homo sapiens
DKVGFSGGGKSNFNYNLEAATVAHAGNPSTMGGRSALIIYGQKFETNLGNIME

SEQ ID NO: 986299 - protein, 109 aa, Homo sapiens
SVTDSCPPVTDSVPPAPTLSACEARAPASPHSLPTAFFFLKQGFALSPRLKYKSAIIAHCSLDLLGSRNSPTSASLGAGTTGTPRPANFLYFWKRQGLTMLPRRGSSHL

SEQ ID NO: 986300 - protein, 128 aa, Homo sapiens
PKTVSKKNKAGSITLPDFKLYYKATVTKTAWYWYKNRHIDQWKRLENPDIKPHPYNHLIFNEVDNNKQWGMDSLFNKCYNWLAICRRLKMDPYLSPYTKINSIWIKELNLKPKSIKTLEENLGNTILT

SEQ ID NO: 986301 - protein, 38 aa, Homo sapiens
EEEMMEWTSYTVAVKSSDILGAGTDASVFIIIFGEDAL

SEQ ID NO: 986302 - protein, 94 aa, Homo sapiens
VQQMMQEPEDAENPSEQSVVYPPNDHTSSPTRVFNQAELAGITEIEFRIWIGTKIIKIQEDSKTQSRKNKNHNKAIQELKYKISGIKKNLMDLT

SEQ ID NO: 986303 - protein, 137 aa, Homo sapiens
MGILCSRAIQSLKWPEKTLIDLYAQVVLEWIELRELGAARSLLRQTDPMIMFNQTQPERYIHLENLLARSYFDPREAYPDVRHHEPSRAAIAQALAGEVSVVPPSRLMALLGQALTLQQHQGWLPPGMTIALFRGQA

SEQ ID NO: 986304 - protein, 135 aa, Homo sapiens
AQFLVNHVLGFFPKNRLTGILLTQPLVSLWLRMVQTKDECDEYRHRDGDREQDGNTEGMNEEGRRGKGQKVGRRRKKETRRERKRERERACARERERERERERESSDAWMLLCVAKRTPGYRYSTATIMTTENHK

SEQ ID NO: 986305 - protein, 32 aa, Homo sapiens
MVRKSKKEVDHIKQLLWIPASLCCSLGETINM

SEQ ID NO: 986306 - protein, 42 aa, Homo sapiens
SSARTDMQRTQRESCKDTGIQYVSTKEKKKTETRRDRDGDPE

SEQ ID NO: 986307 - protein, 40 aa, Homo sapiens
YVSIVIMLCMAEASRNDLFCYIKPGSLHNDTLCLTFKDNA

SEQ ID NO: 986308 - protein, 180 aa, Homo sapiens
QDPVCLDLLRQVDPSHSATQGHFIYIKGRPDHRFLKQLHKMLVYVMPCGDLQTQRQLASSGNNIQDKEWAKTFMTYETPKATGTKRPNGANGTLLKLKRFCAAKETIIRVHRHPTEWEKIGQSIHVTKGLTIQRSIKNLNLQEKNNPIKKRAKDMNRHFSKEDIYAANKHEEIADHHWSL

SEQ ID NO: 986309 - protein, 92 aa, Homo sapiens
DAWHSRATLLASLRLHNLMANQPAAYLSLSKIDKLILMDKNHYGELSIQTDKSRPGAGAHTCNPSIWGGRGGRIMRQEIETTLANTVNPSLY

SEQ ID NO: 986310 - protein, 43 aa, Homo sapiens
SFSRGQLVEAVVSCSSCLVHRLHLLRLELQQLGLRWERSPSHA

SEQ ID NO: 986311 - protein, 53 aa, Homo sapiens
CLHTRKRAREQSRRKVARGKGYQFKTDGKNGLAGVKALRWFHQVDLLGIFSRQ

SEQ ID NO: 986312 - protein, 33 aa, Homo sapiens
TVYESSRYQMMQKPRVKGNRDPERQLRRKHDRR

SEQ ID NO: 986313 - protein, 70 aa, Homo sapiens
KQGIFRSVGRQASMAAGYTFMPHQGISHKARGQAHGVLVQGELQHMQCAGGHSSPISRPSDISSSHWRPQ

SEQ ID NO: 986314 - protein, 85 aa, Homo sapiens
SLATASATTPGNFGTVVEMGFRHVGQAGLKFLTSGDPPASATQSAGVIGVSHCAWSTSYFYRWFPMGGNLPKCGWCFLWNGITPE

SEQ ID NO: 986315 - protein, 99 aa, Homo sapiens
SLDVAGIRHTPPMPGYIFCDFFGEMGFPPVGPAQSSNSCTSGNPFGLGSPSCGITGVQRRAWAMVSISKVPTAIWTREGSGSTAGTLGGDPGLAHRPGK

SEQ ID NO: 986316 - protein, 79 aa, Homo sapiens
SYIYEVSCVPVRGDFGSAVSLEACEPPGFFEKRKPDFTKFQSRSAIRIGRHGTSSPVGVLRRFAVRCQCRLSARLIHRA

SEQ ID NO: 986317 - protein, 43 aa, Homo sapiens
GYGDGSLTACYDTSLNTHATYVGRTTFDTSLTTTDLLTCDLVT

SEQ ID NO: 986318 - protein, 159 aa, Homo sapiens
PQGSNIREFKKPFNEQSLSYRSASVFLASLIRQPRLAVSGSGVTFLAFQRIFKPVQTCVIALVLADRVCYPSIFHLAVSMGQTSGVLPTRCTPDFLRVTSFIPLTPWSWTSAWIAGLCHDRQQCGDLKRSACVPGLNKRVPGRGTRAISVGISNVPNRH

SEQ ID NO: 986319 - protein, 80 aa, Homo sapiens
MWFLQVGQAGGNSGPHVIRPPQRRPMLLASCKHEPLRDDHLESTVSHYGNGPSTLATRDRTRQDMHQDPSQETSGLHEGY

SEQ ID NO: 986320 - protein, 79 aa, Homo sapiens
VGGRNLRVNLREQRSPTFFSDVTGVETASSDPVPGGANSARAPFRLRSVSTDKGFWFQKFLNFSLAVIRSGCNFRDIST

SEQ ID NO: 986321 - protein, 173 aa, Homo sapiens
VDLRTRTAYLGEFKSLSAPEHWGGVAGGPSWEIPHWAGPKDLHARENSNHCQPENTGGIGWRPQLKGPSLGGTLRTRCQGEFRYLSAQEHRWGWLEATVERSPTGQDLKTSMPGRIQISVSPKTLAGVAGCRGPSLGQTPRHPYQGEFKSLSAQEHRRGWLEARLGGHSLGRT

SEQ ID NO: 986322 - protein, 69 aa, Homo sapiens
GGLTCQNGKQPLYVIWNQKRAGMAKTILSKKNKAGVITLLDFKIYYKAIVTRTAWYGCKNKGIDQWNRT

SEQ ID NO: 986323 - protein, 95 aa, Homo sapiens
MGYNWTGVKRCCDYVYQIMRVKDEDWWYVESQAGVELDAGLCPGAASQQLPSVFSPSGRMRCTKKSGPGQGPVLYVSRVTTSLGQGPESRAREQG

SEQ ID NO: 986324 - protein, 74 aa, Homo sapiens
ECENYNLVHDVNHNMLQNVNTTSAEGTTDQVDENCNSADGNHNQAEGTTTRQREPQQARVSQHRKVVKAIHPPE

SEQ ID NO: 986325 - protein, 75 aa, Homo sapiens
CTLIGGVYESDDQTRNVSRAHPADRPDHRLHEVGADQARYSTLLDNTLAENRRLTHYKSFWKNLRPWARDVRVPD

SEQ ID NO: 986326 - protein, 54 aa, Homo sapiens
MLPAPGPQAGGREIPASVARSVRLDTARPTNRTSTTDTIPTSVSNSAKDIRAPR

SEQ ID NO: 986327 - protein, 41 aa, Homo sapiens
MVLALHSFIDIYTGLFTVGNKLLVSLDLLLCNPDIISRLGE

SEQ ID NO: 986328 - protein, 137 aa, Homo sapiens
GSAGIHSRILACIATRQYRIAAMEAHTERLKANDSLKLSQEYESIAPGEQFTWAHSSLEVTKPKKRYAKVIAYDHSRVILQPLEGIMGSDYIAAKYVDGYRRQHASLATQGPLPEPFGDYWRLVCAPRSANIVMRTR

SEQ ID NO: 986329 - protein, 52 aa, Homo sapiens
MTAQDGWWGLVGHGSPFSGLAGDWSRRGMPCRMGRRDGRGPHSTLQQFDAAV

SEQ ID NO: 986330 - protein, 57 aa, Homo sapiens
MLSCWGHACVPGAGAYRVPMCCVWLGGPLVVVLLFPAVLDAHGLLGRLRVCGPPWAW

SEQ ID NO: 986331 - protein, 153 aa, Homo sapiens
VAVVCFRCVWISGVCVCMVHVCVGVQRVSMRLCCVRGCAVCVYALTWQQTGQWHLLQWGIGHSCPHRPSASPSHLSPSMITNPQVSSSFCSHCLRDMARSRGLSRRMSEVQGVQTDQVEAQHFSSQSRATQFPAGHAQCPSGQCPSQACPPFS

SEQ ID NO: 986332 - protein, 32 aa, Homo sapiens
VRPGQAQCHMHSSRKHLQCDNASWAMLVPPAL

SEQ ID NO: 986333 - protein, 87 aa, Homo sapiens
QRSRTDFTLTSSYGTTPRFLVTVLLTTGGLTLWTELYETSRHRRTRTKASVFLTADSPPAPDNCARVDTSHCWSVKPGHDTTDTETY

SEQ ID NO: 986334 - protein, 100 aa, Homo sapiens
MKRDTSDASRNVVSATEEGIFNLIDSNGLTFKQPHVVTVWASTALEPDESKPKTTSWVPNRRPQGENHPPQLIQPHQKAPGTGQENKAKTHPATMKDHSV

SEQ ID NO: 986335 - protein, 41 aa, Homo sapiens
GRFLSASRLTRETVSEQRRMLRGKPAVIPGIVRYELERIMS

SEQ ID NO: 986336 - protein, 42 aa, Homo sapiens
TCHSDKPSAILIIIIISCEMDSYDACESVYYTGTVCEGVPTL

SEQ ID NO: 986337 - protein, 55 aa, Homo sapiens
AGFKQFSCLSLPSSWDYRRVPPHHGLIFPYILGGGQGFHRGGGWSSISMTVMYPA

SEQ ID NO: 986338 - protein, 45 aa, Homo sapiens
MAEFNQCSDLPSSGNARLNVAKCLNVSMRNFQIIKPVHGRVTELA

SEQ ID NO: 986339 - protein, 39 aa, Homo sapiens
PLWTGSFYLLTDLFCFDTRHGFSTLTDNTYLHYLPGVLR

SEQ ID NO: 986340 - protein, 72 aa, Homo sapiens
GSTKTKDSDFKRHYVQHERAEDTKLGKFSIIYRVTISLGWLYNRGVAIFKGPKCSTVTRVYDWRKTVSAQEN

SEQ ID NO: 986341 - protein, 140 aa, Homo sapiens
MHWGHRRVPGLRILDRKATGGQWLQSFAGWPWFDTDNKKGMGVLWGHREDLQLSMIGLKFTRAFKEIGYTFFLYYSYLSLSLFLSPFCLGRWLGETQWKDVRSWPPFATIGLCASLLFTQLAFILIYYVVVDQFPVVHMG

SEQ ID NO: 986342 - protein, 39 aa, Homo sapiens
DCTFSGGQVLAAHLFVLWALAPAELKNATMASRLSRSPG

SEQ ID NO: 986343 - protein, 67 aa, Homo sapiens
EGNRGRGRQFSIHRESWLETPSEGNNNSQKRSLAPGQRPKGWATMDRVTEPWYSEEGAGREVRRPGG

SEQ ID NO: 986344 - protein, 172 aa, Homo sapiens
SGLRRLSCGFCGAWVLSGGALDSVSCGFCGTWVLSGHLRRLSCRFCGTWVLSGRLRRLSSGFCGTWVLSVCLRRLSCGFCGAWVLSGHLRRLSSGFCGTSLLSGRLRRLSSGFCGTWVLSGHLRRLSSGFCGTWVLSGGTLDSCLQGSVVPGFCLGALDGCLCGFCGTWVLS

SEQ ID NO: 986345 - protein, 38 aa, Homo sapiens
MPSLSVAPPAVPCSMGCLAIFILSALQQLVLLLQLHVP

SEQ ID NO: 986346 - protein, 47 aa, Homo sapiens
MKHTLEEQECKAKKLRHFEEFEDTWLPYLTPKDEFHQPWQLKYSKLI

SEQ ID NO: 986347 - protein, 149 aa, Homo sapiens
TSSGGGSDGRHSDIPNATSLKTFRPPTGEGFRAWRTWIGTALPAGLPISSPTCSPLHSISSPGPGHQPWTQGAHSPLESIPSGITRPCSVAALPCLNSCSSGGADSDSSSCRPGLPSFVQVIGHPPRDHRASSEQALVQAGSYSRDSEG

SEQ ID NO: 986348 - protein, 103 aa, Homo sapiens
WSLLSEEVMWAGHRAHIWDLSTLGGKLGGSSEVRSSRPAWQHGEALSLLKIQKLARHGGAHLWSQLLGRLRRENRLNPVRRRLQWARMAPLHSSLGKNSETPS

SEQ ID NO: 986349 - protein, 37 aa, Homo sapiens
DRTLSVSLHVHTRHAVDMHTHFDSIQGDTHSGKESRM

SEQ ID NO: 986350 - protein, 165 aa, Homo sapiens
TQRMGIATSHPGLTYHNPWLTGYVDVGLIPAGAREIQHPTHKLGSQANTCAALIEHPKNSSSMVAAPSSEADYHVAGNTFTYARRGNWENLTSPGPTKEPVWIQVPASRGPGGGSRGGVPRPSTLHGRSRPGGVSPGSVTEPGSEPGPPAAASTSVSPSLKWPNL

SEQ ID NO: 986351 - protein, 36 aa, Homo sapiens
AGPAQESTLAGNMVKPISLKYDKLDGRSGSAVVPAT

SEQ ID NO: 986352 - protein, 51 aa, Homo sapiens
IAFDMAVREYCAWRKWRVVDNDEQFIEAAVQLAADDAQHAQTLGSMRPRDE

SEQ ID NO: 986353 - protein, 117 aa, Homo sapiens
FSFVIQLMECWEKKVERICEQPRVVGQLRCNGARCTMRTQFPEIRKQRELQERMQSRVGQRGRGLSMSAARSEHEVSEIIDGLSEQENRGGQQMRQRGLLIPAQMLVRLLTTQRITV

SEQ ID NO: 986354 - protein, 132 aa, Homo sapiens
HRRGVELERLMWRRPAGTVISGARGSMRLGERDLLLIRGGDLRHIGGGGNIPLGGMNLHGGWPRPGGQHGGGSDLLAINLSSIHVLQRLLGFIWILKLYVRIAFGQMGMHPFHGHVNHFNFPIGGKYLHDVI

SEQ ID NO: 986355 - protein, 97 aa, Homo sapiens
RSTVMAIWQQPLDALPPQTRGARRPSYSQYTFYYPIHSQHCKKVQKSDSGPQTPQQDLINLAFKVYNNREELQLLASAVRETPDTSPAQKNFKTPKP

SEQ ID NO: 986356 - protein, 105 aa, Homo sapiens
RSPLHTLHKMYMSNLVILFSIMKINVSICDFIFSVQETFQMQMPGQPPAERQQGQQRSSLEKGHIDPGLAGNPCQRGCGGACAGAAGRRGSGDPFPFLPPVPAQL

SEQ ID NO: 986357 - protein, 68 aa, Homo sapiens
DVGRLDSNLVYQTLPLNKRDTDTTMTCYYQLCQGPETYRRLTDHTATTTENTDQHWFPNSWRLLTYPR

SEQ ID NO: 986358 - protein, 39 aa, Homo sapiens
DLSDWQSVAVEGSPFSGSGMSGGERAGGQREGALIALAE

SEQ ID NO: 986359 - protein, 52 aa, Homo sapiens
QLAVPNKNSRSKPSERHWTMTLSTSNLKSYTSYLVSDLYLVPLPHALRVRVR

SEQ ID NO: 986360 - protein, 77 aa, Homo sapiens
EIMERCQPGMSGARAHMGQVHADARRPAAADAHCSCPPRSRCHTPPWVTVRQASLNQLGHSLLDSLEEAMGTAGVRT

SEQ ID NO: 986361 - protein, 40 aa, Homo sapiens
VRSGVGRLNHSTRIMAVAGAEQFKACLISLGLRRGESDRA

SEQ ID NO: 986362 - protein, 81 aa, Homo sapiens
AKQTWSLDPNFGNSIWSASMNSGCRACTVDVSVVVKGHAFKAHRRWLVASSSYFRDLFQQQPQRLVGSYRRLQQPQSFQQI

SEQ ID NO: 986363 - protein, 40 aa, Homo sapiens
LNTDFNVDEMASIGRDASRTFIAGRGEVTVWVSKGQADFL

SEQ ID NO: 986364 - protein, 89 aa, Homo sapiens
MMTVTSETQIFNVDEMAFYWKQMPSRTFIAEEEKSMSGVKGQADSCVRAHAASKFKLKPMLIYHPRALKNHAKPTLPVLYKWNNKAWMV

SEQ ID NO: 986365 - protein, 112 aa, Homo sapiens
PCTVEQSDDDMGDHQPLANAHDVLARSRSRANVLNKVEYAQQRWKLQVQEQRKSVLDRHVVLSYWGMESKVTRKKQADNGKERTGLGGVSFKYLVDSTKGGGKIQNGKQKLA

SEQ ID NO: 986366 - protein, 133 aa, Homo sapiens
SSYWRNRFKYARTGDEVKKIGMQRFIKIEGKVRTDITYPAGFRDVISMDKRGENFGLIYDTKGRLAVHRITPEEAKYKWCKVRKILVGTKGIPHRVTHEARTIRYPNPLIRVNDTIQIDLETKITDFIKFDTG

SEQ ID NO: 986367 - protein, 98 aa, Homo sapiens
KGIQATSSPGCGGPSENVRKLSRADLTDYLSTHFQGPFIGAGSSLDHGVYHQQLVSTSPQKHLRLDSHWPFCTMTLVPTSYSIAVFTVAVETRPPVMM

SEQ ID NO: 986368 - protein, 49 aa, Homo sapiens
LHMFLLHIFIHVVSSGYDGERGMGTERCMGTERCMGTERCMGTELCMGT

SEQ ID NO: 986369 - protein, 146 aa, Homo sapiens
VASSAGGSLAAQGQVKFLDPQTPGTGLSPTSPGMAVSPLHSQFSPKSHLYGPSGLPPPTGSSAWGQTSSLHTQMETGSHQGHRRPPGPSSPGMLGQHSWLTSAGIGFLGSFFRERLLPKALGQHLRVFPSFLRWAPISTRPPQPPK

SEQ ID NO: 986370 - protein, 60 aa, Homo sapiens
PCTVMVRNPPVTVPGLNGNSETSQDGQTGRYAGSSSDGNWGPGEETDWPAWHTPADSTSD

SEQ ID NO: 986371 - protein, 83 aa, Homo sapiens
PHTSREFTRHRDSSPHNKELSSKAQDSSPHNKELSNKAQDSSPHNKELSNKAQDTSPHNKELSNKAQDSSPHNRELSNGAWGP

SEQ ID NO: 986372 - protein, 166 aa, Homo sapiens
KQKGSRGLAMWSRLTGPQVTHLSLPSSCINGHKPGLRALYLLILRLLNGLNSQASHPICPRAIPEFGGTQGLNHQSTQVGSYKKPCEWLWLGPINSVQRRLTDYPGDEWPDVPTSVVPGDRGHLTCSPGTTGQARVSVTSQPDSVGHPRGRGLPGNRLAGVPERIP

SEQ ID NO: 986373 - protein, 114 aa, Homo sapiens
WVDSEDPQMHAENPTNLLEKSNLKTIIVKFTKVEMKEKILTAAREKGRVTHKGKPIRLTADLTAETIQARREWGPIFAIRKEKNFQPRITYPAKLSFVSEGEIKSFTDKQMGYR

SEQ ID NO: 986374 - protein, 141 aa, Homo sapiens
PLFLETGSRCVTQAGVQWCDHSLLFWAQAILRLSFLSSRTTGTHHYAWLNFFFFFFFGGRVGPQGVPQAAAANLIPFRACIFPTGVIAQGCHPFFDGRWKILVPISRDGVHDSSGGGSREGKCRVINKAYLRVIREMAKKF

SEQ ID NO: 986375 - protein, 76 aa, Homo sapiens
PDDAETMPYRCTPAGDNELSKTNKQTKRIFDRCSQMKVAKNFGDCNIGIKKKCTGLMKSYNVHKYQGKQQLTEWTE

SEQ ID NO: 986376 - protein, 99 aa, Homo sapiens
MNDRVNKIAEDLKLENIFEYKQLVKLNTFFFLGFFRGFNGIYNGLAGSVCCSDVRGASLYSSLYVSQSYAVKVSTTGKQFFSPLGEYVVISYKQKEAHQ

SEQ ID NO: 986377 - protein, 134 aa, Homo sapiens
EGRVHPPARVSTTVIAEQCAGYEDADRQIGYTPNNQTSTPTGMVKQLKSTVSVVQLTKGFKYVSNLLISLKSCSGTVLFQKTLISLVHTCTFIQKLPKVIRTLNAALNNKENGIRFTSRNTASPQPCKLTLLTQ

SEQ ID NO: 986378 - protein, 106 aa, Homo sapiens
MTFDTRVTSIYLFFFFGKGVHSGWPRWECKGRIWAQGNLGLRGPSDSLASASRVAGITGTHHHPGLIFFGILRKDGGSPCVGPGVSGSRDLRIHPLGPRKVLGLRG

SEQ ID NO: 986379 - protein, 76 aa, Homo sapiens
GLTERQWYAQGQKHASMPEAYNPLPLKDTSQGLITTSKASHAHRRTREIVHSIRKLDRGQITTDMLVTKKSIFPHA

SEQ ID NO: 986380 - protein, 137 aa, Homo sapiens
VGSRCWPTALPLELLEPLLSRPPRPPGVERPISAILRKRTDSRSGSRPVPVCPSLHSSVSPVLPVPIHRLTVHLTHGWAVATPSRRDRHTWEGSSGPRLYREVFAAPSTRLVAEAKLVIASTCYYVHRPSAMPLPRF

SEQ ID NO: 986381 - protein, 31 aa, Homo sapiens
MQSIWEVIGHRPDDNEPCYQRQSSVATRVTS

SEQ ID NO: 986382 - protein, 39 aa, Homo sapiens
KFSSRDDEGPDMGSSKRSNEETDDYGKNSKWPLCLQSVL

SEQ ID NO: 986383 - protein, 76 aa, Homo sapiens
DVWRDISWEWCRVDSQITPVPIAASSSLDAQYSSFVDIVNMDKQIKSIDAGPVDACTLAFSPDSQYSGLRNSCGDS

SEQ ID NO: 986384 - protein, 44 aa, Homo sapiens
GPRWVDGHYSQTYWNLLHPPGFVWGSPAPSLEEVSLDRGQESET

SEQ ID NO: 986385 - protein, 71 aa, Homo sapiens
GKRYIGGHADNERVRLECAKTKQQSRQSRDNRTGFPRARYRARTTNYNSTRSRFYSGFNSRPRGSRRSPYA

SEQ ID NO: 986386 - protein, 74 aa, Homo sapiens
PHRQHRRQNEKQTRQGFTDFSGVSQWVQDKPLVMGNDSSGATYSVYIEMHPRLQVPTRLETPSPDVLAPAPSPT

SEQ ID NO: 986387 - protein, 156 aa, Homo sapiens
AVVWVAGHTDMIGVIVHGCWRTGLIEGPLITSNPTGFSNRYIPQVIKLETPGTNSFFKRWEFHLERDIHKFRVVQESIYQAAGITPFGHDLRADLMQAGGDVLGRCLTAKHVALEHLGQLITSYVGKVPSTVPPDAPHADADDGLGVQQCLALWLH

SEQ ID NO: 986388 - protein, 68 aa, Homo sapiens
CDSVPSLSPQDYPDALITNYYLWPAVHLANFYLVPLRYRLVVVQCVAVIWNSYLPGENIGSKTDSIHR

SEQ ID NO: 986389 - protein, 45 aa, Homo sapiens
QSFDEQQVVRLMGLLITEQARLEGYEASHRSLELHAGARSCSGEQ

SEQ ID NO: 986390 - protein, 80 aa, Homo sapiens
KEIIKSDGGKGEQNKPPVIHELSASPTQDHSYNNIGGSSPSYCSRTYLGFPVPPGQRGLCLRRHPCCVCTSCIVAPAYTQ

SEQ ID NO: 986391 - protein, 72 aa, Homo sapiens
IDTYHTIPFYDEHLGGSNTCTAIDEHCYQTSRHSCSGTIMTHGSLQLLGSSNPPASASQVAGIRGYAQPVPS

SEQ ID NO: 986392 - protein, 86 aa, Homo sapiens
MMSCCIAVLLLLVRGNVSALTQYIVCIESVSHCYKEVPKIASFIKERDIIDSQFLMAGEQLGTLRIMVAQGTQRGLTTVVGSQSGQ

SEQ ID NO: 986393 - protein, 95 aa, Homo sapiens
MKPMPLSEGKSLLLLEGHAAVAHPGSGPRGYPGSEKEIGGFSEEPEQQAVRLESSWLDFAPPAAVWTFVEHSGILGDFLLNMAVACPGMFGYSRE

SEQ ID NO: 986394 - protein, 52 aa, Homo sapiens
MYLRLVGSPLLQDQLCTKNKGPLLHNPEQPTQGSEALPAMVQSFALQHLDTF

SEQ ID NO: 986395 - protein, 52 aa, Homo sapiens
MRILMYTDITVLVAFKEPQQHADIRYTYVIEHFMGLADGDNRALLGYSSGAG

SEQ ID NO: 986396 - protein, 33 aa, Homo sapiens
SGPTAGVSQSTTLMEPPYGYERSGTPTQYNLPV

SEQ ID NO: 986397 - protein, 61 aa, Homo sapiens
QAQELCTCTGILYVPNKSYLHMRSMNERRAVMVTNTRAHRCSSFFPFLFFFGYVSPNNHQG

SEQ ID NO: 986398 - protein, 85 aa, Homo sapiens
HRVSVTSGYACGNMHVCRWGREAQWPHERRGGEVAHACRLGVRAGEALQKPRQNINAVTHLFSSKVTGRVSGAFLHKMQLSGDGL

SEQ ID NO: 986399 - protein, 104 aa, Homo sapiens
DRARWEVMPIIPAPWEAMRVDQLRPGAGDGLTGACEEATKQAWYEQHGCLFHLSAGGLSPKKESAKGGGLSLVLTGLGIGGGVWSNVLRAGVDLTKYILKGGEN

SEQ ID NO: 986400 - protein, 106 aa, Homo sapiens
CLPNHRRLKIAEELPKEPQGIIACCNPVPPFGRQRINERHLLIQQAREMPLLKSEVAAGVKKSAPLPSAERLENVLLGPNDCSHALRDGYPIIQTSGSVPVQKQAS

SEQ ID NO: 986401 - protein, 146 aa, Homo sapiens
PTPHNECPGTFWTEKDGSLVKSLILKPKSLELQPKVRTYAPVFCSNVAFSKTTHGPAPNPHPVPIKTPELCQQREKQLDIGDYGWMSERSSLTSEGQFDDVALERILARTAGLQGNITFLPCPFFISSFALRATFTRNKIPCIYRL

SEQ ID NO: 986402 - protein, 107 aa, Homo sapiens
SASHVTALWPTLVHCSHCSSPFIELLIVLFLLLPGTRATVMPPPVSCHPDTVSVYFPNPMLPLLAYTTLPTFNHSISTHTLPLFLSPPDCGLATPYCPWHTNLQDSS

SEQ ID NO: 986403 - protein, 38 aa, Homo sapiens
VYTPRLLFLAIPEPPDFNAAWIRKPLTEHTKRLWLLHG

SEQ ID NO: 986404 - protein, 82 aa, Homo sapiens
MTASRTWIHRSVIVRAFFYRLLIVENFFFFLLLEPQNVLDLEAMALYHWEQYILEDVHLPILDFNVRRGYLSVTLIYIASVS

SEQ ID NO: 986405 - protein, 44 aa, Homo sapiens
VLILKPSTQSIHGLGRSGPVLRQSLWSHRLLYSYPWVLPSGPGY

SEQ ID NO: 986406 - protein, 125 aa, Homo sapiens
RKATSSVGRVEGLQRWSVRQRGDEVGTPQPSRTNLSSSGTSISSPVHRLIHRVLHHQQSMCLSQCMICNPRSPMTPNIPDPNPEHDDDPGTPGTAVVDQQHSVEFDSPDSGLPSSRHSSVASGIQ

SEQ ID NO: 986407 - protein, 33 aa, Homo sapiens
MCPSARLSYSNPMLPRGSTKADPPFYSGLSIMT

SEQ ID NO: 986408 - protein, 45 aa, Homo sapiens
CPASLWSSSLACRRNSTLRRRSRWGLLPVELPSSFFSPAPYGVPD

SEQ ID NO: 986409 - protein, 142 aa, Homo sapiens
RRSSEIETLAIFICIIWGHLLAFREQTSQFASSVAGWVLRKLLTEPLYPTLPSTSTSLFLLLTLALCLQIRLPSEYVLSILSCDLSYEELCLPCFPFTSPWVCVSLCAQRHDLVVKQGICGTGLLMAGLLAMAGGRSWVGSL

SEQ ID NO: 986410 - protein, 55 aa, Homo sapiens
GWLKSFPHTRFSLRIPGLESSVNPLRGCLTRITIYDDQAYPFSQFLPFTLTSSSL

SEQ ID NO: 986411 - protein, 39 aa, Homo sapiens
SCHDRWSGAPTPKRGTLAPASCRYRCCSLARPAHPACFL

SEQ ID NO: 986412 - protein, 64 aa, Homo sapiens
RSPRWPGLTHRSLNWLAHFGEMASKVRLEYTVTTEPGAGHSAGIVSEKARVPQARIRLSSIHGC

SEQ ID NO: 986413 - protein, 109 aa, Homo sapiens
IPRWVDDPHRSFTNHVTFLSCSTIFHNFPTAPIIKIHDSSFWLAYLGAALAPPSIPLTVSLLLPPLRPTLVNPSSFLYSDGPIALAISSTQNAPPLALQWVGSSLPSQF

SEQ ID NO: 986414 - protein, 102 aa, Homo sapiens
PPARSEHRRGGKVVLFLLSTEHSRELELGIPGWVVTLAVWPARDAPCMSHRCCAKLLRTCTRVSEIRRMLPGLHTGQHEQHVTSRGPQPFAGCCSEAGNTLD

SEQ ID NO: 986415 - protein, 133 aa, Homo sapiens
RKLNTSKQNRHVHALIYENTLQETPRMMLGEGGVELQLENFLQSTGLKTERRTLSWVCYHHSSLDGSWQRDMLVPLDWKDEGLSGIFSVSLYIYGMPHSIGQFPLVFRSLLVSLSILVVGLASSAFGAQSNGL

SEQ ID NO: 986416 - protein, 43 aa, Homo sapiens
MEVTDEQGCIPICAKGYAYVEYENPDETREGTEAHGMEDKMMA

SEQ ID NO: 986417 - protein, 50 aa, Homo sapiens
MQIPQLGDYEISPRLVVGETSEPAGRVNWWRDSPGRLRWKESRTKDICSL

SEQ ID NO: 986418 - protein, 47 aa, Homo sapiens
IRLSCGMKDSSSVSAFQSVKSAEACWTESRCLVQLGERIQILVLSRT

SEQ ID NO: 986419 - protein, 43 aa, Homo sapiens
MGPTGVEERQPPDIRAAMRTHAHRALEVPVSCLGASRRGDRLG

SEQ ID NO: 986420 - protein, 62 aa, Homo sapiens
ASPDTQAMDNRITHHVVLASRHQQGSSTSLTWRTYMARDIDRFHNHDLTRTNAAITSIIWQQ

SEQ ID NO: 986421 - protein, 78 aa, Homo sapiens
ARTAEVSPSAPPALAYTPASVAASAGPGGHHTKTLCQGISAQHWQGVALLGVAGNSVDGLLMLLAVGRDLLHARFVVS

SEQ ID NO: 986422 - protein, 31 aa, Homo sapiens
MARRACFPFAFCRDCQFPEASPAMLPVQPAG

SEQ ID NO: 986423 - protein, 37 aa, Homo sapiens
LELQDPAHKRLLLDTLQLSTDSGGTTKLVNSEAPRAA

SEQ ID NO: 986424 - protein, 36 aa, Homo sapiens
MLFLRKAKIKSEIVESCIIEDVELLNRLVLVLTFGL

SEQ ID NO: 986425 - protein, 95 aa, Homo sapiens
SSSRFEFARYCLRPVLNHNLFFPLMVVTQALVRTAHVQMQLPGRWHAHAGPCAGLQWAAWCLTCWRELLPVAAPAPTSHLLPDEYFREKRLSLSP

SEQ ID NO: 986426 - protein, 34 aa, Homo sapiens
SLDLEALVSVWKAVNEGRRLRGTPGRRHQPLTAP

SEQ ID NO: 986427 - protein, 87 aa, Homo sapiens
PGRRGPGGRRQRGYRVGLSKTRTVCAIHARRVTIMPKDIQWVSRIRGERAYGIFLGGRSKDLFRATAVFIKSSCTRSPSDVRLPCAA

SEQ ID NO: 986428 - protein, 120 aa, Homo sapiens
DLHWCGGLSTMGVDYVTTYWLQHVVVSSSCNSAGGGGNQVHVHQAVRVQACSGQASKAAGKSQFHIHALFWVAGACMAGRQHLVLVQHCFQSTSAGGSVQSYRYSGITSQGSRRHPSSAV

SEQ ID NO: 986429 - protein, 40 aa, Homo sapiens
TCSGDLGSVTYGRYGDYGLTSGPNDTTTDRTRLPYWRGWV

SEQ ID NO: 986430 - protein, 50 aa, Homo sapiens
PHARIMRRHPRCCLHPSKASFAVLAADALAKVFDDAHLALPCAATLAWGV

SEQ ID NO: 986431 - protein, 74 aa, Homo sapiens
MWTEAHSTLHAPVRAKKASLPIGDPMWALGVAALGVLGNPWPGSLVLVSWKAVDEGLEGTGQPVPGLSSGGSLA

SEQ ID NO: 986432 - protein, 43 aa, Homo sapiens
MSHRKYYRYPDIGSLRLTSLRKRSQQAIVGKVTSYTLKDRPIP

SEQ ID NO: 986433 - protein, 135 aa, Homo sapiens
GHEAQLLFRSAAVGPSIYNISSSLSLLLHDPQTRISAPPGFSGAQNLKLEPEVLPGSSDCMTLDLEHSGPLRVFSCEDPRSRTSGPLQVCSWMTLKLRIYQLLSRAASCETLKLEHQFLPVVFSCMTLKLEHQLL

SEQ ID NO: 986434 - protein, 110 aa, Homo sapiens
EDHRKQLQQKSTNYALTLHQLIAAFKEAGLLFSSSQKSVALEQFFKEREQTRFHNGTNLQLQASFAGHILEISALLVMGTELARERYEVRKGGRKGKRRGEEQYDEWKTQ

SEQ ID NO: 986435 - protein, 59 aa, Homo sapiens
MEQSSRMDGNANWNHELLEALDCYSTTNLVQLTSPCAMPLQDVYKNWWYWVLFPVWPDV

SEQ ID NO: 986436 - protein, 42 aa, Homo sapiens
SDSRGSRRRQEPQEVEDLVDQVGLEELRVDVDGVCPAGKGGG

SEQ ID NO: 986437 - protein, 57 aa, Homo sapiens
RNTELRCGRFRFRRGPRSGARARERNPIHTVYVFSRPEWTALVVRKDSPIRSLADLK

SEQ ID NO: 986438 - protein, 67 aa, Homo sapiens
LEDPHSPTWMTVSSKLGMVCHLCIRIHGFNGMSEVWRNAPMQAFERSSFLSTTGGPLMSRMCPVMDV

SEQ ID NO: 986439 - protein, 56 aa, Homo sapiens
KSLQLILFPRVQRLLWGKRLWQVPITVPCRVTGRCGSVLVRLFPDIQEHWHRLLPP

SEQ ID NO: 986440 - protein, 38 aa, Homo sapiens
VTIASSASTLNLPTEPSKSPGQFNWWGPKSEQRLSDTR

SEQ ID NO: 986441 - protein, 66 aa, Homo sapiens
RDNHYGAVRPYDSLNYSRSLEIEMKIDTEVQMHSVMRIVKGYNNCCLGYHRKAIVDPARRNSRQYA

SEQ ID NO: 986442 - protein, 47 aa, Homo sapiens
WKYGLAAQSISKTEGMWKRENLICPARYPQEVSRTLINITVSSRNVE

SEQ ID NO: 986443 - protein, 52 aa, Homo sapiens
YGPQVNWQRERGQIQDTELVETDQQEIEPSRSGQLWWCLVEKRQYEYSIPCT

SEQ ID NO: 986444 - protein, 98 aa, Homo sapiens
MESQERIKAERKRMRNRICCLQVPKEEAGENRPAEGKSEKPVKAQNSELASTANMLREQVAQLKQKVMNHVNSGVPTHCYTQQLQTILKRDRRGLSEL

SEQ ID NO: 986445 - protein, 46 aa, Homo sapiens
RCAFPYWARKEERHGCGKPVRGQEEKEDYKLLRCSVNKLLELSDHR

SEQ ID NO: 986446 - protein, 156 aa, Homo sapiens
PYLLLLQPTIDGRHTCAVTFAAALPSQPYTVTVGKPVTLSACRVVGRGLQPKGVRVKETADFKVYTNGLLAVGELKVTVKGPKGEERVKQKDLGDGVYGFEYYPMVPGTYIVTITWGGQEHRAQSLRSEGGARVVALRRYVAWGPGLLRGLLTGTE

SEQ ID NO: 986447 - protein, 34 aa, Homo sapiens
RDEAKKKVEQPVIEEQLCKGSISVEEVYALTRYP

SEQ ID NO: 986448 - protein, 89 aa, Homo sapiens
SYQQPDSRTQQVQQQAADFQPGGPGSDPVAGGFGGPTLVDTLAVENAVGREVKAAQGLGVVAYAVALWKMSRTLLFPGRETVPYSRSQW

SEQ ID NO: 986449 - protein, 46 aa, Homo sapiens
GSMLNEYLEVSTAAHVSTELVQGRHAPKVVNTRRPGSSVYDYCGGQ

SEQ ID NO: 986450 - protein, 40 aa, Homo sapiens
GEEGALEAESVGVDEGEVPFSALYRPRSSWTTNWMHISRK

SEQ ID NO: 986451 - protein, 79 aa, Homo sapiens
DLIAYTSSTYKRYRKYKRSSKYKRGATYKAVEEVYALRKYQALRKYQAFRTYKALRKYTAYRSINALRKYNALRKYKAL

SEQ ID NO: 986452 - protein, 58 aa, Homo sapiens
APAKRYLEVSTVLTCRRNYVQWRHAPALLNTVDQAPSKRYLEVSMVLTVSTEPCTREV

SEQ ID NO: 986453 - protein, 152 aa, Homo sapiens
MHKLRTDFTFRLILPHTELFPKDVGKWSAYEQLTHDSSCDSENALARPEAQDPAQPCPFGSPKKAWKHCCKEQRGLLTSPLGSLKSGTLGGVESQTSVCCWESRGGIVTSSKWPSSPLSESLIMTSDSTSQQADTSEQEAVEAYTDMGMLST

SEQ ID NO: 986454 - protein, 86 aa, Homo sapiens
TFIAYTSQLFILLTAYTSQRYYTILTSLYILLKRLYYVVNRLILLNVFILLNALYFLLALQFLDALYFLNSKYFLNSSSFVRSLST

SEQ ID NO: 986455 - protein, 58 aa, Homo sapiens
APAKRYYGGQHWCSRVDGTCTWEACTCSGEYTYDHGSMLKLNYGWSALVLTVSERNYV

SEQ ID NO: 986456 - protein, 48 aa, Homo sapiens
MSDQAPALTDIWMVSTVLTVSDLNLYSGGMHLQGEYTSTMAPVFNDIL

SEQ ID NO: 986457 - protein, 51 aa, Homo sapiens
SCTVIVNWPSTNPAEGLQSHQCRTQLSWKEKKEAPELTNGGANSKAELAYR

SEQ ID NO: 986458 - protein, 43 aa, Homo sapiens
MQCNIESVDGGSQITTMTLHAEEGGQTRTGTMSCDLTANMRTI

SEQ ID NO: 986459 - protein, 112 aa, Homo sapiens
MRQLFKPDKPIGIQMEEVRSLTSSSFAKKLWYMKYCEKYEFSPRKNCLIVLMVKNTPTTARHALMSLHHCWVLNAGGHFIDENGSRLPAIPRSAKSGKSETITADVNHNLKD

SEQ ID NO: 986460 - protein, 79 aa, Homo sapiens
MTSEVQHTLGDGASAEGARDKGICWKWPVTVAAVEVQNFHGGAYRQQGPHLSVTNKKKGTRDVIAALTEEGTWARSAAM

SEQ ID NO: 986461 - protein, 85 aa, Homo sapiens
IESVEEGDKHHLTLLQKEEDKLEPAPEQNLMPNENIPESAAELVQLGFISFCRPEPVDFSARRDLEQVQFCQDQYPQLSRCRRCR

SEQ ID NO: 986462 - protein, 49 aa, Homo sapiens
RGVDPLSMSLVAKQGLWRIRCREDFTIRAAWGPKPAKTSVCDLSAAVSH

SEQ ID NO: 986463 - protein, 43 aa, Homo sapiens
NWVNIKDAKVPVGPGLAHCSESLRNFSRSTSGSCGESGAVGAA

SEQ ID NO: 986464 - protein, 32 aa, Homo sapiens
MHSCISQWRTKHNFMHIYMHYIGKMSIILKVN

SEQ ID NO: 986465 - protein, 106 aa, Homo sapiens
EYKLYKYDYNSGEELQACKFALLFTVPHLVLMENSMPVVQKMEHGDYVKRVEEKRMVFGNVCFLKKIAESLQSQRFVFQKTTEEGLEEIASENSDCIFPSAPDVKP

SEQ ID NO: 986466 - protein, 62 aa, Homo sapiens
IWCSPGRQAQWASVHSTQWADVAAGAGVDGVAVHGNGGAGAINAGHIGGVSASDLCCVMCSS

SEQ ID NO: 986467 - protein, 140 aa, Homo sapiens
MTGSLSRLLRTGLTRGPLSHLPRQVSTGTFPGIDLDFWTTHLRRWNPLGRTSQVRVVSESHLPSSGHYAVSVMILEQIIMQAGGDVLGRCLTAKHVALEHLGQLITSYVGKVPSTVPPDAPHADADDGLGVQQCLALWLH

SEQ ID NO: 986468 - protein, 46 aa, Homo sapiens
MSCTHNVSERASHGGASREENQAWPEGTSSAIPEELAHDRSTSCNM

SEQ ID NO: 986469 - protein, 49 aa, Homo sapiens
TGKQCDLPDFRYHFELYAVEGVERGSEEVPAELELHCCQCFTTSFLSSS

SEQ ID NO: 986470 - protein, 83 aa, Homo sapiens
YVMVVGSYDEGVRVEHELGMRTDCHWRSPAHPAAPPALVGCAQRLATDWGAAYHRWCHCTPVQPFSLLNASTTCARDSRVHWT

SEQ ID NO: 986471 - protein, 31 aa, Homo sapiens
MPLYSSLGVRVRPCLKKQTNKGTEKLTNLPV

SEQ ID NO: 986472 - protein, 103 aa, Homo sapiens
FLKRCWGELSVVLGQALFLLGLAGQLHVLPPRERDADRLPVQLVPVQVSHVQLGLVAVRHLHQGVLLLIEQDLHALHVTVDAEKNKEALGCDSLWVEVADQQY

SEQ ID NO: 986473 - protein, 94 aa, Homo sapiens
LHQLTGIVEGEGIKCAVLIEVLLSAQLAREPLNTMGATYGHAYSNICDVVDNLPLQQFWTLLSSPEEKIGNLDTLCGIENHKGAVSHLVKIKLN

SEQ ID NO: 986474 - protein, 40 aa, Homo sapiens
SPVQICENQFSSCSRTWTKSDNFLNQIADIGPEMKKKFAD

SEQ ID NO: 986475 - protein, 88 aa, Homo sapiens
PYGGTVFHQEADIAEQEKTTPTEPHVGNEPWLSESYVEGKCMTLNRSSCGTQGERKIPETNRWSRVLGGGGGDSVLSKSITPGVQPAG

SEQ ID NO: 986476 - protein, 120 aa, Homo sapiens
EVKQSPGGSFEAKKRQSCSRRGLEGAAVVFAPGAHDIEDHPLVVLDLAHLCDSDMTYTRPREKWFCFGFRVDEFLWAAGLSLCAQLSRPSPTRNYLLAFSGFRCLSRFPGLQFERGYRAL

SEQ ID NO: 986477 - protein, 79 aa, Homo sapiens
YSERATSRMELERRSSGLEFNEARQKYAGSNAISSDMFFGRDVNAEYEARSRLLHLSGGSAFSSSDFFDDLFGALCVAI

SEQ ID NO: 986478 - protein, 109 aa, Homo sapiens
MRTIPGDRNDRAKGSAGSCSCRGGSESQSTESFTEHEHTLGASAQFRVSVFQRKQYMICHIQLPEEKKPIKDSYTPHISHTHTHTHTHTQRSNVFKLQPLRVMAPWGLP

SEQ ID NO: 986479 - protein, 43 aa, Homo sapiens
KNSQDVARYCGAHSTDGRRCWGSSAVAATPAGVLPHYTQNAPN

SEQ ID NO: 986480 - protein, 57 aa, Homo sapiens
FVRYPKSPKIDGTRTPRDEMENEAQHNELKRRRMNKINNCIVSFRKSFQSVTQNAPN

SEQ ID NO: 986481 - protein, 37 aa, Homo sapiens
PVPDEAENPSSTSCCSKILIPYFNLYLQFLNISMQNL

SEQ ID NO: 986482 - protein, 72 aa, Homo sapiens
IRMKLSSVSSPEAVPLTAALEQVLALPKNSDHSLMLIYSAVICTDLSQPAVEEGAIDFLNEDGQDLQAMPQD

SEQ ID NO: 986483 - protein, 44 aa, Homo sapiens
CGFLPLCLLLASHCRTMAALAAQRVTLHSLEAPQEPALKSEFSQ

SEQ ID NO: 986484 - protein, 42 aa, Homo sapiens
MDVSQQAPGQSGMGAENGGYTNGMSSFSKMDLEQVPPTQNAP

SEQ ID NO: 986485 - protein, 44 aa, Homo sapiens
TTSTETSPCHNFRHCFGVAQMMYSMVWLCSAPGKSSHKAGYRDT

SEQ ID NO: 986486 - protein, 41 aa, Homo sapiens
ASRACLRKRHGNPCAITTTNGAINELLNTPMLITFCDGYLS

SEQ ID NO: 986487 - protein, 58 aa, Homo sapiens
LEDPIKRVLRGVCASGLHDEPKYSDGKLRERMQLLDGRINLSAVYPGRTTNVHAECAS

SEQ ID NO: 986488 - protein, 48 aa, Homo sapiens
TLSDDNLIEGGGTKFVCIPVARNITVIFHPLLRFIQEIEHALGLGPAK

SEQ ID NO: 986489 - protein, 63 aa, Homo sapiens
VLEDPPTGRLYWFWGRSGAYDKDGRGPMTGSSGGDRGGFKRFGGHRDYGPRTGADSESDNSGN

SEQ ID NO: 986490 - protein, 36 aa, Homo sapiens
LEDPNALEQGGLSVLDDSAVELMPAPTDLLGCAHPE

SEQ ID NO: 986491 - protein, 58 aa, Homo sapiens
ANAVLYSRQGGGLEPSVVAGRLPSDPRVHPPRRSRVHGLRQRPPTVSTRFRSQWTRRR

SEQ ID NO: 986492 - protein, 33 aa, Homo sapiens
VLWGGPLTLALECVTSRPWLVVSVASSSSRCSF

SEQ ID NO: 986493 - protein, 79 aa, Homo sapiens
RGSPAAHCNTKSQAVKYSSGSIALKLLICFKANDIEKAVQWLDTNVVDLLMKHIYKGFESPSDNSSAMLLQWHEKPLAA

SEQ ID NO: 986494 - protein, 43 aa, Homo sapiens
DLCDLVNKTTLPAWNGHWRGKLTKGSLYLQGEAHTYALRTPAP

SEQ ID NO: 986495 - protein, 57 aa, Homo sapiens
SRDPGGYGLQKYTILEVSSGCFSSASGLLPRLLALGFSSLSSFFSSSSYSTGTQYLQ

SEQ ID NO: 986496 - protein, 150 aa, Homo sapiens
RLSDVKIIRKVSSTAFTRATLRTLTLPSLRYIHQVGSSPADNSGSLWGPDIWRSMDGLIVHRSSGSTVGIFLLPRLTRMSPNGRAENCCTICNPIGSTLMELGWEEWPPLGRMPCKTVIPTDIHQRAPVIWGSPDYLLEFLNVCEKHSVQ

SEQ ID NO: 986497 - protein, 76 aa, Homo sapiens
CDSDVLNLTLSESPRYGMLGHRQQIENQQQILVAKMNSRLHISKSIRERRQQTVYFSEMNKLHEIEKNDVECPRRT

SEQ ID NO: 986498 - protein, 72 aa, Homo sapiens
TDAKCTLMDADGSEDEEGFGYPDTILILPSIGRYDDRWRERLGCISSKGKQVVGIGEDLMRPPQNSSFIQHL

SEQ ID NO: 986499 - protein, 181 aa, Homo sapiens
MTLRIPLGERREKISVTKLGRKLSAPTQNSPPSVSDILDLLSSNVVEIAENLSAKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDW

SEQ ID NO: 986500 - protein, 49 aa, Homo sapiens
FENPRRGGWASTCVRSRTLFPLGVVLTDTCALWDVCSEARSRSCLLKGR

SEQ ID NO: 986501 - protein, 79 aa, Homo sapiens
MEPSDTIENVRQDQDKEGVPPDSQRLIFAGKAAGEMAVLFLSYNTPRTDVEPCAPGSCGLRGGMQIFVKDPCEPVEAPS

SEQ ID NO: 986502 - protein, 122 aa, Homo sapiens
VLSRRPRPMEDEAKDEKAEPQVGYYNHVGPLPQADPEVGTVAHQTNILNKMPPGPWGPRPVQLGPQMRMLSDLYDRVSVTASEVQQAESEVSDIESRIAALRAAGLTVKPSGKPRRKSNLPI

SEQ ID NO: 986503 - protein, 43 aa, Homo sapiens
CQISENHTNGLLETPDANLTLGHCLPTLTHCSQGPLTWVLCIL

SEQ ID NO: 986504 - protein, 33 aa, Homo sapiens
MVRLVFRPYTQVGRPICTSGPLRTSTRVSSGFA

SEQ ID NO: 986505 - protein, 53 aa, Homo sapiens
EIEAGSVLEPLWHTARVRQCTGESSAGLTDLPSEAACEGFMRAEKKNHAELRL

SEQ ID NO: 986506 - protein, 44 aa, Homo sapiens
MLLKFYKKARCAVAHTSNLSALGGRGGGIARAQEFKTSLGTHYG

SEQ ID NO: 986507 - protein, 33 aa, Homo sapiens
SHRELPLTTIAEKNSVFPPGSAFPPGPVTHRDL

SEQ ID NO: 986508 - protein, 51 aa, Homo sapiens
QLSSEQLTHVDSERRAAVVDVETGSQRQSGIDVATDDESPGTGSLQASPKA

SEQ ID NO: 986509 - protein, 35 aa, Homo sapiens
MKRRLGGVALDQGSHHSLRPVSSPQRQGSHVQQQQ

SEQ ID NO: 986510 - protein, 43 aa, Homo sapiens
ATPHSRPEQLSNELAQSADGQKTESALEQFEWQNKELGSKLQE

SEQ ID NO: 986511 - protein, 72 aa, Homo sapiens
VAVAGVETGGAVMTALIAQLHHPHQADAIFTTYSDNNPGLLIQVYEGERAMRKDNNLLGRFELKVHPSDPQG

SEQ ID NO: 986512 - protein, 121 aa, Homo sapiens
MIVPLCSILVDRRKTLSQKRHGNVQKNVQAFHERAGSTTKILPLGQVRWIIPVIPALWKAEAAGSPEVLEFKTSPKHGETPSLQNIKTYAGHDWRVPVIPDTQGAEAENRLNPRQPRLGYR

SEQ ID NO: 986513 - protein, 77 aa, Homo sapiens
STLEIPLWPPGLGGNFALSMTEKELDLCPGPTGLKDLEAHLVQLEPQALNVSKDLLVSLVNLVKLVLQVLVVQRQDK

SEQ ID NO: 986514 - protein, 116 aa, Homo sapiens
ALCTRALDPVMGVVYERVWCGTRTTVHVIQPKIMHDRGECRPGPRGVEEAPAGQKLSRIFQYGIHEAYVWPSPLYHLMTQARTGAKQALPARSEGTAGGPGAVPGKRIPNSSPLAS

SEQ ID NO: 986515 - protein, 37 aa, Homo sapiens
MKSAGVGTGVVGDGGLTQSGPRPQLLAKTKALGLEVI

SEQ ID NO: 986516 - protein, 166 aa, Homo sapiens
VRGRPERVQSFCEPGAFLIKCAPWACESIYRMRGVASDSGVCILPVDRWMKRKLQTDGSAVYDEGLARTQSHVEMSAHAGVWERLTGSSLITSYDLYSPRLLRDFLPLLRVVPPFQTEPMFILHVLIDVSCLPYHVARATEAHQNLRNVTGAHRLPLPPSGAHPYW

SEQ ID NO: 986517 - protein, 90 aa, Homo sapiens
TEVYVTTVFENYCGDIDGGRQMLVELALWDTVGQEDYERLWPLSYPDSEVILMCYSGDRPDSLENITLEVGPELKHFCPNVPKSVLGLGY

SEQ ID NO: 986518 - protein, 106 aa, Homo sapiens
TRTATLPLVSWSTLDLGGVVLLCDGIGHGIIGPMNSVFQLGELALLALSWASFFFLEDDDPRALASSLASFLMVDGNTWSILPWNTCPSTSEEAFTACSGNMKVMN

SEQ ID NO: 986519 - protein, 46 aa, Homo sapiens
MSMGHASLLYEIPVYYTLSCLCTYPCLDRVQGWIPDSSLLWNEQSL

SEQ ID NO: 986520 - protein, 105 aa, Homo sapiens
LSRIPNALIASCLSLPSACDCRRVPPRVTVFRIFLVETGFRCVGPAGLQLLTASDPPASASRGAGMADGVLLTQCSILPRLECSGVISASYNLHLPAACLSLPNS

SEQ ID NO: 986521 - protein, 99 aa, Homo sapiens
ISKNPKDKRLVWFSQSMTHGFQLEYGGQGSYPADVAIQLTFLRLMSTEAFQIMTYHCKNSEAYMDQHTGNLKKALLLQGSNEIEIRADGNSRFTYRGTV

SEQ ID NO: 986522 - protein, 86 aa, Homo sapiens
LHLSYGNENHQPPRSYVKALKHPSLGNENIQSATSASQSPREERTQLWFAPLPPGQYKITQTLAPLPGSGHHLTKPGRASGSYSTH

SEQ ID NO: 986523 - protein, 79 aa, Homo sapiens
VELETAECDRLPNQAQLHHPQRVPKIEVTFDINAKDILKVTATDKSTGKAKKITISNDKGRLTQEEIERMVQEANQSKA

SEQ ID NO: 986524 - protein, 66 aa, Homo sapiens
AARVLALFETEFCSIPRLVCNGMISAHCNLHLPGSSDSPASATGTRLHSANSASLAPYAEHLPSRK

SEQ ID NO: 986525 - protein, 99 aa, Homo sapiens
MIPQLVSWQRCKEKGIHTLLVGMEVSTAIIENSIEVLQNTKIRNIGWAWWLRPIIPALWEAKVGGSRGQEKETILANDDETPSVLKTQKLAGRGSARLE

SEQ ID NO: 986526 - protein, 43 aa, Homo sapiens
TNQRRQQRFQWILTHHATQTGNSEYHQSKIFGRPERQRPTRQQ

SEQ ID NO: 986527 - protein, 58 aa, Homo sapiens
LALEQGEVPPKRPQEEEEILFQEAFQIERAVFKRNRKEGGGDSSWLLHPTEGRAVSQG

SEQ ID NO: 986528 - protein, 47 aa, Homo sapiens
GSTQNQKIRYHKEVLLSVKAAMAKALMGRTFCCSSTRPLVPTTKEAE

SEQ ID NO: 986529 - protein, 58 aa, Homo sapiens
PELLWMELGEEEVEEESINRGRGAEETSTMEEDRVPVTVFDEEEPRPQLHPKQASKAV

SEQ ID NO: 986530 - protein, 41 aa, Homo sapiens
MDVQILCVLGILVLLKIGCCFLLWMADTEEVAGCRSGPFPG

SEQ ID NO: 986531 - protein, 75 aa, Homo sapiens
GTPATASDGAGGHYPKLTQVQKTKHSVFSLISRRKILSYIDTKKGATDTGASLKVAVGRKVRTENYLSGTMLISD

SEQ ID NO: 986532 - protein, 92 aa, Homo sapiens
PLQIDPTDAAVKTADLDPETTLVIIASKTFTTLETLTNARCVPAWLLDGLVAAGAIADTEQAGRDPVAKHFVAVLTALDKGEEFGIHPMNPF

SEQ ID NO: 986533 - protein, 154 aa, Homo sapiens
ATAYDGEKVKHKRSGAEAVLIENGASISGTTTRDFTQLNELQCRFPRPLEGLGFPCNQFGHHENCHNEEILNSLKFVRPGGGYQTTFTLVQKCEVNGQNEHPVFAYLKDKLPYPYDDPFSLMTDPKLIIWSPVRRSDVAWNFEKFLIGPEGEPF

SEQ ID NO: 986534 - protein, 101 aa, Homo sapiens
TVLDAFESGATPSCDAFWEAFNPQPLSKVCSRVGTSSLAFTKEKIAIGVLTFHVLRGLLGVFSPNHFNFFLDSCFCMPSPSFFPCQFPGDRYQLFLNGFPA

SEQ ID NO: 986535 - protein, 85 aa, Homo sapiens
GEKYLESVVYLDDEARNFSDGFSAGSGENRFKAECKMLARATGKWGGYDGVEKLVGATGVAEGDEDPSGASVAAFDPELRYGLCC

SEQ ID NO: 986536 - protein, 72 aa, Homo sapiens
RAFDQIRMAAISESNINLCGSHWGVSIGENGPSQMALKKLALFRSVPTSTVFYPSDGVATKKAVELAPNTKG

SEQ ID NO: 986537 - protein, 103 aa, Homo sapiens
TPQLVGCLRRGATPSWDAFWEAINPQPSFIVCSRGGTSSLSFSKEKNAIVVLTSHELRGLLGVFSPNHYNYFFGYSLLHASPVLFSLPVPWGQLPAFLNGFPA

SEQ ID NO: 986538 - protein, 112 aa, Homo sapiens
MAPGMADSASPELRHTMWPFFSSSIPRRKALVVQNWPNVVMCWDLLKALLSLAIKLFPWTTAALFTTMVMLPTFFRTALSVWYTSSRLPTSQMKKWRSLPICRISSHPKKLP

SEQ ID NO: 986539 - protein, 105 aa, Homo sapiens
VGTPGTGLDAFQRGATPSWDALWEAFNPQPLSKVCRPGGTPPLAFTKEKIGIVGLTSDVLRGLLGVFSPNHFNLFLDSHSCMPPPSFFPCQFLVTVTSFPEWIPG

SEQ ID NO: 986540 - protein, 88 aa, Homo sapiens
YVSDLCSQHGHNAEGLENAMRPWRVKLQGSQVVLQSHPTAVIQHSFHSGQVGLHQQLLRMGGSFFKTLTMGWKGRIKICLFALGRVLT

SEQ ID NO: 986541 - protein, 36 aa, Homo sapiens
CEKFRHCGLANQINQCRARCSLYNFFGKSGLPLRAD

SEQ ID NO: 986542 - protein, 79 aa, Homo sapiens
PGTADVGIDDLVGEQAQDGLPRGVGPVVQPPGKDLEEDIFINRHPQGLGDQNAMLVQLGALYQAVLHALPRALNGEFPG

SEQ ID NO: 986543 - protein, 89 aa, Homo sapiens
MEVQIQTYRCKPVIRIRPDSGPPVFQEHLVGGSQGQGPSPLVTWILTTVVFTLAGVHTVIRTVLWCWYHERVRSHQGHVKMRGGAKTCF

SEQ ID NO: 986544 - protein, 89 aa, Homo sapiens
MATAAALRPAVHVFFGPVAGDGNPPHQESCKQRRKSGETLGPPQRYAYVMPKTRYSWLRIVPPAVASDANFKRRQKNRERGNCCAKARY

SEQ ID NO: 986545 - protein, 41 aa, Homo sapiens
ARYPVKTSVVDFPGGPVVKNLLAKAWDSGLTPGLGRFCMLQ

SEQ ID NO: 986546 - protein, 39 aa, Homo sapiens
TWISSTFQGLTDINWLAYKGSIPIVTLWFLFTFGVNIAK

SEQ ID NO: 986547 - protein, 142 aa, Homo sapiens
MPRKRTILNNPVMLGALALTTEITPCGGEDILADHVASYGVNYCQANGSSGPYTHEFDGDEEFYVDLHRKETVWQLPLFLRFTKFDPQFALTNIPVLKHNLNIVIKSSNSTGATNEDPEVPMFSKFPVTLGQPNTLIWFGTT

SEQ ID NO: 986548 - protein, 56 aa, Homo sapiens
GICLQPRICQHALLPQTAAREPFRKHSICSWHVPVLHRTLPVKVMVQFSIGQGTTG

SEQ ID NO: 986549 - protein, 128 aa, Homo sapiens
YRRSSNLTLILHQARTSNHTSSNTRHAHPPGITITNHPTPIINFIQTPDTLIHQASNLNLHPTPDTLIHQASNLNFITTPDTLIHQHKNLLILYDAIGTLDRLCRPPPQTAGIHPEADAPTDPEVRLG

SEQ ID NO: 986550 - protein, 37 aa, Homo sapiens
LGPPDDESDDYHADDHHEAVTAHVAVLDFADDLGTSR

SEQ ID NO: 986551 - protein, 40 aa, Homo sapiens
QFTASGAVHLSLQRQGSLQRQGLFTSVYSVREGRVLKGEV

SEQ ID NO: 986552 - protein, 44 aa, Homo sapiens
VITAFMDTGLLLGFAELLLALPAGEGLCHMHPFADLFCLCYPSM

SEQ ID NO: 986553 - protein, 38 aa, Homo sapiens
RALVNTCCNPAHGGTRVLDLHRLQSQLLAAVGEAIIAM

SEQ ID NO: 986554 - protein, 38 aa, Homo sapiens
NALIASYALIACNALIASYALIASYALIASYALIAYNA

SEQ ID NO: 986555 - protein, 62 aa, Homo sapiens
NALIASYALMPPNALIASYCADSLLNALKSSNVLRLRARATTLVTFDIFYQAFCAEDATHIE

SEQ ID NO: 986556 - protein, 60 aa, Homo sapiens
IVCGCASATGGKAEDAGARVGVAGYSADSMSEFSCHDTEPAFLVKQDAEAVLREDKSVDH

SEQ ID NO: 986557 - protein, 85 aa, Homo sapiens
NALQSPGKEHSFDITEMIREKNPDGSLSAAEMPLFKLYMDMTACFLAAGIFCVSILCRNTYSVFTIHWLMEPLAFTKSISLLSHS

SEQ ID NO: 986558 - protein, 37 aa, Homo sapiens
QLVPHQPVSSVMEDFDETRMHNGSELWIILCAIYELG

SEQ ID NO: 986559 - protein, 37 aa, Homo sapiens
MTSPYALGLKDADRCCTHTSSCRSTFSKWICWTRTAT

SEQ ID NO: 986560 - protein, 83 aa, Homo sapiens
NALTHSFVPELKQHLVCGENSTLTIDSSHASPVHKFKQHPAFQVTVSWASKQTHSPVPNVKHLTASEENGACTNLRSHTLDLS

SEQ ID NO: 986561 - protein, 64 aa, Homo sapiens
HTTCQENDNSHLYSVVHAASETCSLFFSISSSTCTLLEDSPQNARLTRPTPTVQINCCAQSSMS

SEQ ID NO: 986562 - protein, 67 aa, Homo sapiens
TARGALYAFDLPRPPGEKLTMQNLNDRLVSYLDKGRALEAANGELEEKIRDWNQKQAPDASRDYSHY

SEQ ID NO: 986563 - protein, 43 aa, Homo sapiens
LARYPTLDSLGLDSLSVIDIGVGIEEHSGRRVDQEQIDWFTSI

SEQ ID NO: 986564 - protein, 106 aa, Homo sapiens
QVPQMLAWVSGCCSRLSGAHLGVQGAVPGCQMLIWAYGCCSRLSNARLGVQGAVPGCQMLISAYGCCSMLSDARLGVCVLFQVVRCSAGGAGCCSRLSDAHLEVRM

SEQ ID NO: 986565 - protein, 100 aa, Homo sapiens
HRRQSEEGATRLGKMTHVLPSNLLTLFAPRDPIPYLPPLEKLPHEKHHTQPYCGIAPYISEIEDPRDARTPTCAETREERMLSTRRYKIERRQQDVETEL

SEQ ID NO: 986566 - protein, 74 aa, Homo sapiens
GAQSDPIEASQSLMAKFKQEREDNKYFLDTLVMEPAFIIQHFAGKVKDDIKDFRERNTDYMRPDIEDLLRSSDS

SEQ ID NO: 986567 - protein, 69 aa, Homo sapiens
RAGGLLPSLQTCPCTGPPLSVTHSAPDPFRGGLRYITPASSGGDGPLPRLAPCHCTGAGGTDVTSEPSS

SEQ ID NO: 986568 - protein, 116 aa, Homo sapiens
AGPRNCLGCSSFRNSQGSMMGTDQAVILTHICMGRAFQPSEGTHERQLAGQEAPGVPLIHNHHLVRNVDKVDALLHGLGVLGLTASTNHNLLRVCCWADRARTILGNATGTPRMLS

SEQ ID NO: 986569 - protein, 85 aa, Homo sapiens
QTAEGGNLLLQPRLQIQHDVAYVVLLLDLAPKLGQRLVHAANNTLYLLQMHAESHLCLRLHALQEANMLRRDCRCIYKPCMERRS

SEQ ID NO: 986570 - protein, 79 aa, Homo sapiens
MDLVHAIEALPGSGHLTALDQDLLLVKATSAATLSCLGESLNLLQHECAPGGPAQPEARSLGKHAVMARVQVTFHRAAE

SEQ ID NO: 986571 - protein, 56 aa, Homo sapiens
GSAPSGVQLSFGDRVVHVARFTSSHPATSERILLGVRLPVITATSLDYCSNQLVKS

SEQ ID NO: 986572 - protein, 47 aa, Homo sapiens
HRLLLSRAEAAEQYQQCAVMHVLVTDDVLSAVPAVLEPALPSTSSLS

SEQ ID NO: 986573 - protein, 53 aa, Homo sapiens
RVSPAPGQRRKRLAHLALEQRDAGRIDVGIGAADVHHGRDPQHPADARIDDAA

SEQ ID NO: 986574 - protein, 62 aa, Homo sapiens
PTERSMQQAGLTREYGSVCDCLVRVTDELTLMNSVSIIDYNPLSFERSRTGKDPTRTMSKNG

SEQ ID NO: 986575 - protein, 48 aa, Homo sapiens
TYRTWDMDDTKDARPGPQTSGQIEDTIYGGQGRWNTGEMDDMRDRGQG

SEQ ID NO: 986576 - protein, 85 aa, Homo sapiens
MSAAGGPRTLNSLRLYRGDPWMGGLWRPEATWPHLLLMATRRGQIWPELQLPGCFSGTSRQAAQALGLIYNPVMLLLTTPSQPAP

SEQ ID NO: 986577 - protein, 113 aa, Homo sapiens
RARYPGPSLLNQEKTEAVEAVERRLEFIDKEVKLPPSNLISVTELICGFRSDDSERIKKQITDLQDKQDGARTEMFALQQQSQQAQTVQAAQWVRRAVYDVKSETRELSHEAG

SEQ ID NO: 986578 - protein, 170 aa, Homo sapiens
PVNTVRGGQGTFFTLPELESLEPLMDGAGHPEGKTLEEGPADLKFDFQAQSPKELTLRKGDIVYIHEEVDKNWLQGKHLWRLGIFLVNYMKVLPAHDILNPIKPPTYQGLQFVEAVAQNTFMGDLQVELSFRREQHICLIRKVDKNWYEGRITGTGHQGVFPASYVQASR

SEQ ID NO: 986579 - protein, 148 aa, Homo sapiens
PWQLLRMLHLVAEALGGLPLLLEGLCYLGLLLFGLLLQATQYLILLLDGGIECGDSQVHIGHLGSQPGPITLGGLLQLFLGLAEVGDGALQVSDQARQLLLFFFEVAPLNMQLVFLLASISLQHLYPGLELCVVCGKSGCLLLQGFQL

SEQ ID NO: 986580 - protein, 69 aa, Homo sapiens
SVPQLLLRMQEHVNRVLWYLKVCIPSPFFIGKDAFGGMMDHAGKTESVWRQNLVSPDMGQFLGDNLPQA

SEQ ID NO: 986581 - protein, 36 aa, Homo sapiens
TSSSVPRTITTSLLTAAGVKAENFHSQVEILVKVLD

SEQ ID NO: 986582 - protein, 136 aa, Homo sapiens
TNPAGRLNRPSYGRGYGGKCEKTACLSGYKARKIYKSLILYNKWDLEACVDAALLATQMDRVNAIPLTYQQLDVLKHKLDELYPQGYPEYVIQHLGYLFLKMSPEDIRKWNVTSLETLKALLEVNKGHEMSPQVAT

SEQ ID NO: 986583 - protein, 72 aa, Homo sapiens
LARYPIQLLILHQNLPQLLVGLGGAKQHPIRHNHRCPTSWFEYSEKQRQKQQLRLFSFDDLQQILGCVLIVQ

SEQ ID NO: 986584 - protein, 87 aa, Homo sapiens
QDHIYSTFGPGTTLEKKRTGGGPFGFIFPPFEEQLKSGTAFGGCLLNNFYSKEAKLPWKGDNALQSGNFQESVTEPDSKDRPYSLSS

SEQ ID NO: 986585 - protein, 49 aa, Homo sapiens
VSAYRDQDEPWRCPATDPLDPYTLIQEHLTADIIVTGGHLGVAGLPWMG

SEQ ID NO: 986586 - protein, 89 aa, Homo sapiens
SKDLAELHIPLKEPGLYSINPINLTTFSSTYIPPFPANPDEGYELTTSSHEKTLGQGVTHEVAPNGLLLLPRKTTIALIKLRGLRRIHQ

SEQ ID NO: 986587 - protein, 78 aa, Homo sapiens
RGQSLFGAALPADGPLCKALQGLALRASAQAFFAGCTTIARKASRRGRLERIHRGYKNLVSHSHQASCGDEEGLALRK

SEQ ID NO: 986588 - protein, 91 aa, Homo sapiens
EGPGGLELEVQERNHNHSVPWVLLLAYLWVQVRNQTYCPQGIVDICCQPMEMIHTDSCAKMETVFDFKIWTKASLTSFLKGYTGFHIPLGR

SEQ ID NO: 986589 - protein, 37 aa, Homo sapiens
SLQRGSLQRQGINQWPVATLLPSLRDTKRHWLMEEDA

SEQ ID NO: 986590 - protein, 92 aa, Homo sapiens
NAYSFGYLREEPLYKSYDIISHCQPKAYHINPSSLYLFCRNAAGSLSLFYNNGTRPCGCHEISATGPTCEPFGGQWPCHAHVIGRDWSRWAT

SEQ ID NO: 986591 - protein, 41 aa, Homo sapiens
MFQGQVHHLLDVPALIFIGVYAVYNHPLIHEVAELAHDAAN

SEQ ID NO: 986592 - protein, 76 aa, Homo sapiens
MASLALPSSGVTVVRTLSTAGAPSAGRRMSFAPALGVARIVKCPCASINRSSSSRGGKLFLMRLMPAFLKEYRRVE

SEQ ID NO: 986593 - protein, 88 aa, Homo sapiens
VCRQGTTIFQLFFGKDQPLLVRRDALLVSDLCLDILNGVTRVHFEGDGLTSHDLYYNLHPTYETEHQVQGPLFLDVVDKLGAPIQNNG

SEQ ID NO: 986594 - protein, 73 aa, Homo sapiens
PDDVPVTLPDSTGTSLSSESILTPGGEFINSREEAKRVLSPAGSLDLTMDNPSSTKRVTAEEASKADEKIELV

SEQ ID NO: 986595 - protein, 101 aa, Homo sapiens
LPASIIGTFRYIAINARITACVRQYRIKFSMRLGHRFFFHNRIEIAAVRTNARFASDRVIYVWLVDEIALMTRYDGNTVFIIIDRCSFSVFTALKTTNDHK

SEQ ID NO: 986596 - protein, 114 aa, Homo sapiens
LLKRASSGWESRLHPGNWSPAQCGTGSRLRNTTEENCRSSEEEGSTPGWGREVRGADSKNDWQTLPEGSGGGGLDDEVGKCGGSPSPVAGGPKCSQVQARLARRLVANTEPGLV

SEQ ID NO: 986597 - protein, 81 aa, Homo sapiens
NTCFWDISGVMAHQLKAGRTRTGKTVSMIGDAVEGARRNWRVFVIDPKRIEYLGLREWPNIEMVATTVPDQVALIHWLWSL

SEQ ID NO: 986598 - protein, 71 aa, Homo sapiens
ANTGALRPTKTAGWTILGVLQDWISLREYPGAHQDADYQIILLLFVLFTSSAKKTTGFLVPGKPDPPSWSF

SEQ ID NO: 986599 - protein, 47 aa, Homo sapiens
ARYPAVQQGEALLAAVLPGDGGGLVVVKSLAVTDLFVDINERYTREE

SEQ ID NO: 986600 - protein, 37 aa, Homo sapiens
WIDMGLRQEEGDILCSSDKTAMNLAPLLPLLSTGSGL

SEQ ID NO: 986601 - protein, 60 aa, Homo sapiens
GRSEAPRVQYGCGTPEYLAPERADSDTSYTRAVYWWRTGVCCSTRCCVGESPFPGVRLAR

SEQ ID NO: 986602 - protein, 34 aa, Homo sapiens
MARTREAELAVSRDHATAFQPGEQNKTLSQKQTN

SEQ ID NO: 986603 - protein, 90 aa, Homo sapiens
PDFSRPLPDANAKQARKPGPKLESRFENLDVKRTDKMKVLIIDDEEDFRVVAASCLGLLGGVDVAEASSGKVGLEMALAEKPDVILLDLC

SEQ ID NO: 986604 - protein, 67 aa, Homo sapiens
SPGHHGCGREKDTVKKLQEQLGKGRGRQQLNRRAPLSEFPLLEQEVIVPLTKMPYTFLTNEPNNLHI

SEQ ID NO: 986605 - protein, 79 aa, Homo sapiens
VASTDVTIWPRYRNPFWSHRLHILSWVYPVWLVSQSGTCRAVPCRHRLNKEMTVGFSFLVLMSSSSDFSRSPPLQSLLG

SEQ ID NO: 986606 - protein, 85 aa, Homo sapiens
HLTAPLDFDSDIDPVGIATKQVNRTDRRHVLTTDQRPAIAESIRILSQYFLEMSLYPIFLQARINTQFLGDIKHLRSQQDLEMVA

SEQ ID NO: 986607 - protein, 34 aa, Homo sapiens
MGSESNSFTTTSVTPEGTSDSEVWEATVVTHIRT

SEQ ID NO: 986608 - protein, 99 aa, Homo sapiens
VNVTVQALGGDVLHDHVEDNDGACAADAGAAVHDDGPCVGKLSCRWLIWSRKLGTPQGSVGTQWSGQLRYWECQISRVRSPLPSGETCKVRSLVSVVSC

SEQ ID NO: 986609 - protein, 75 aa, Homo sapiens
CSVPLLSMAMRYEGWEVRTAGTGNAAVREAKDFQPDAVGLDMMLPDFDGLQVLRRMRDHDESVPVLFLTAKDAVE

SEQ ID NO: 986610 - protein, 44 aa, Homo sapiens
LSSAPGPATRAGVEPAPMLADGAAPGPLHSVAGTTHLLGAVSTV

SEQ ID NO: 986611 - protein, 134 aa, Homo sapiens
VRRRMMMHSGRKGADIMYTGTVHCCRKIFIDEGGKAFLNGAWSNVLRGMGGAFLLVLYDELKKVIYGPRTAPHTHTHQGNQENHVESSTVRTINLREIPVVFFPAASCLEMAGEGSRKGAHCDPTIGSRFRVLI

SEQ ID NO: 986612 - protein, 50 aa, Homo sapiens
MNLLETVVREADSGLNCFPEVCRDARHVLSSHDAQTAILFPSPQSVLGPG

SEQ ID NO: 986613 - protein, 40 aa, Homo sapiens
TYSYEIISSRDEQWLLLMEVNASHRTIMFIKLVTESAHPD

SEQ ID NO: 986614 - protein, 141 aa, Homo sapiens
SVPVSIPLCDPPALFEAGVMLPEHPAHDNMDEDDNVSMGGPESPDSMDPVEPIPTMTVQTTLVPNEEETFALEPIDLTVQETKAKRRFNVYVTKSQPDLSGKKMAKALCHLNVPVTVVLDSAVGYIMEKANLVIICAEGVV

SEQ ID NO: 986615 - protein, 68 aa, Homo sapiens
RLPRVRSDVEQRLPIAAFTDVQCRLQEQLAPVIAMEEVSESLSHSKTDRLGTEDPEKLFVLLMFLACN

SEQ ID NO: 986616 - protein, 109 aa, Homo sapiens
AKQMYLLEMNIWPGMCTLLNGVHRVQLGWPFNRSSMGSFNEARKHSFLARASRTRFRAEMFLCGRMGLRRAQPSTNPSLSSSCRMARSGNCSLTLTVCPAFRKPPPAIF

SEQ ID NO: 986617 - protein, 132 aa, Homo sapiens
MLAPVNVLGSTIGPPNTLKTNIPLMLTSQKVLPPLNAMFLNQTWVLDTILLTGTILLKRPFRFHGPPWFTDRAFIINLIVILNLHCTQSLGDRILHTGEVAPPWKAHFLQRNGSPPLPEPPTVPRSGIDKGS

SEQ ID NO: 986618 - protein, 74 aa, Homo sapiens
MGHILGPGDLGLQSLLRFGSLGTGTGTQREDDRSLHHNINMRTTETELVLCVQHKGVEVEDTTLFQQQDYHIRT

SEQ ID NO: 986619 - protein, 45 aa, Homo sapiens
PPSSYRCEMKPDDGQRFTIDVLTASTLCGKGESEPAIRNCVYCTV

SEQ ID NO: 986620 - protein, 34 aa, Homo sapiens
LAPQVGACVDSTDLVAGIERVRDADEATMKRWHE

SEQ ID NO: 986621 - protein, 134 aa, Homo sapiens
SIGYAGHVYCMTSAGPVPGHSEGMGRSHGMVQGMVQGRSRERPAPSGAKAQPAQGKAGQWHHWAMTGQGQRQERAEQAVPMVGARAGMGQSSGQDMSKARSVPEQEQDHDHWQGQCHDRTRVRTRGRARARARA

SEQ ID NO: 986622 - protein, 35 aa, Homo sapiens
ELGTQVGACVDSTDLAVGIERVRDANYATMKRWHE

SEQ ID NO: 986623 - protein, 106 aa, Homo sapiens
LGTHGFLAKTAQLVVVIAESTAESPKTTPPDGRPHHRVHVWASIPRTRSTQRHSIQERPTPNPFSVTTIRTLPALMKAATTTTTTMTATMPPVARLVHAPIATISE

SEQ ID NO: 986624 - protein, 43 aa, Homo sapiens
IPHVLTSSGLMDYCSHQDPELKRTVIQSPLVPLQTVLVIASLE

SEQ ID NO: 986625 - protein, 54 aa, Homo sapiens
SSPPLQAQGRDLVVFEPQFAQHRRIGALARHLPGTVVLTDSAAPGPAGSRRLRG

SEQ ID NO: 986626 - protein, 43 aa, Homo sapiens
PPVCAMLGLRGEEPPKREAVSDPEYVFLLRRNDQPRAIAAMII

SEQ ID NO: 986627 - protein, 113 aa, Homo sapiens
SSVGLFPRSAGWLHFFLPVYPGAGFDRYCPVFLAFGEPLAEVGVKAIVIHPSGTEELTVNWTGIGYLRNYPLTGHLYTTPTVHTHRCRRAYEDGCTSITSLSQMSVRRSNHSL

SEQ ID NO: 986628 - protein, 116 aa, Homo sapiens
PLSGHLSPAHRIPTEEVSKRASAASVTALGVRLNCTCLSTFASGARSRSNSGRVLRLKLVFWAACIIVQAFLNISLIGTTDFLESPDEVNGSTRALRMPTALGRISRLILDLVAYG

SEQ ID NO: 986629 - protein, 41 aa, Homo sapiens
LVVFKPQLAQHRRIGALARHLRRTVVLTESAAPGPAGSRRL

SEQ ID NO: 986630 - protein, 38 aa, Homo sapiens
PLGREEGRRARRHRLVGGDDEALVGVEGGGIDSKGTSP

SEQ ID NO: 986631 - protein, 76 aa, Homo sapiens
FAEKDDGRMTTRLTSCGTGPPASLSRNYCSSYAVHVTVELDSQGTLGGSRSITMHVSLRGPGDHEGVLGLRGEEED

SEQ ID NO: 986632 - protein, 63 aa, Homo sapiens
SSSAPPRRGWQDDVRMQCGGRVAEIRGPHEVELAGGVSSRNVMSVGRLPSGSSVALTSFSQPS

SEQ ID NO: 986633 - protein, 108 aa, Homo sapiens
IRSHHSWRRSALLRCVPGHRAVQHLVPEETGDKPRGSGQCMELCGNDSVYAYRSSVYRKPGVAEAKIQYRSSGLGSCELAQGGCKEVVELEEGGLGGVLVIRVGKGLD

SEQ ID NO: 986634 - protein, 34 aa, Homo sapiens
DPDFLHFVGSVTDDAGFLVRDNEVVNTDGNREMV

SEQ ID NO: 986635 - protein, 53 aa, Homo sapiens
RARYPIVAINKDEDAPIFQVADIGLVGDLFKVVPTDRQAVTELAGVGKGVESD

SEQ ID NO: 986636 - protein, 67 aa, Homo sapiens
MLPGPKGADIIFTATAHCWRKIFRDEGGKAFFKGAWSNVLRRMGGALYLDLNKELKKVIYGPGSSTL

SEQ ID NO: 986637 - protein, 85 aa, Homo sapiens
VWFLLRPGLEYNGTVPESRLTAAFNSLAQVILPPQPPSSWDYRCGPPCLAFFFLERDRVLPCCPGWSQTQEFETSLGNMGKPYLY

SEQ ID NO: 986638 - protein, 62 aa, Homo sapiens
RARHPLGTCQFRGVKFVCCPLAEKSDNVDSADAEEDDSHVWWGGPDTNYANGSEDKVLKVAE

SEQ ID NO: 986639 - protein, 99 aa, Homo sapiens
PRKAGWDSNNSLDLSTFVHSLNWNQASPFSHIQGVLPVESTSLEALESRLVDFSCISYNRMTVMHYFIYDKLQSLTSLRKDRKQSINFCLERHLFARYL

SEQ ID NO: 986640 - protein, 47 aa, Homo sapiens
ARYPLSIIHPSVIHSPIHPYSFIVLKNELYKSETTGVLEEHIDGWMD

SEQ ID NO: 986641 - protein, 55 aa, Homo sapiens
MVTDEGLGGPHCSASGKYAGEVQPQAQSSQFDPAKAGDTANWRTPLTPHSPPSGF

SEQ ID NO: 986642 - protein, 138 aa, Homo sapiens
MMVLSSSINGQCAPLGWSCSSRTCSLLWAVSSPSATCGIWGTGGRLEGPEVTHAYNSTGNFTVKGGLAAMRCRRSDALAQCDCDTRRVRGLIVNASCPVVPLNGSMSFSTRLEAGRDVRYSWVLCDRCTPISGGPAIS

SEQ ID NO: 986643 - protein, 46 aa, Homo sapiens
SSPPNNRREALRAYARACVDCIHSAARGFDTGAVTLAMIEGSALGG

SEQ ID NO: 986644 - protein, 40 aa, Homo sapiens
QLGPFLRASACRLAILLLLLPVELCACGNLLFHLHHLELC

SEQ ID NO: 986645 - protein, 165 aa, Homo sapiens
DSRTSAATVAAAEAQRIGLAHVSRDVFLDDVRTPEAITTQLQQGVALAHKQGSAVLIGHPYPQTLQVLEREIPRLKGQGIELIPLRQMIAERGNQAMPAHGGHGLYHNLLTPASAYSSERDDVLHLLIGERAPVNTLTLPGQLDGFGTTVETLLPGFQVRPSELM

SEQ ID NO: 986646 - protein, 124 aa, Homo sapiens
QIPAVLPSGRARLVVTCLAERGQLNAWAHIDPVGVSELRLALGVLYLVSLRSCRPGADHMLPRALIPESADVGAKVVVETERSPHGLQGPKFPRETSRRWEKSPIRAVDGATALSEIPGGHSNG

SEQ ID NO: 986647 - protein, 33 aa, Homo sapiens
WTLRTSLFSSVFSGLVFTMLLLKPEEDSEKVQV

SEQ ID NO: 986648 - protein, 53 aa, Homo sapiens
MVSIGLLRGVSSPHAHGGPQHQYSRGHHNCSESLELQDPSSGLRVTMQDLGPV

SEQ ID NO: 986649 - protein, 49 aa, Homo sapiens
MDFWRTTAIYSQLSLSGCTAPFTCTSLLLEPPEGPGMPEGPGMPEGPGM

SEQ ID NO: 986650 - protein, 45 aa, Homo sapiens
GVEGATHRRGLTVGNTHMPLDAVLKTSDWVSGRLGVVVDCYIMRH

SEQ ID NO: 986651 - protein, 103 aa, Homo sapiens
VQAHPLLIAQHPEIACFLWRQKKAHLTGRSMVNGGTVAEKLDWARERLEQQVPLNEVFGPDDDYPTVSAVYHGQGYKGVTSRWHTKGSCPRKNQPRLRKGARI

SEQ ID NO: 986652 - protein, 41 aa, Homo sapiens
LSDVVMWTSRTHEDYIEFASLDGSNSPRCAEPGHPAHPYWP

SEQ ID NO: 986653 - protein, 61 aa, Homo sapiens
LAAHPGGIGSCGTKPCCCANVGRVVCWPANAPSQRLLAINCAFHSGSRFHSGRHGLSGLVV

SEQ ID NO: 986654 - protein, 45 aa, Homo sapiens
FSADSSPSMAGTPSVGSAFWSRCITWSSVMLPLLGGILHGPTDES

SEQ ID NO: 986655 - protein, 41 aa, Homo sapiens
MLSGGHRGRVGTSLAVAASVGRVVLLASNAPSHDACDRCDF

SEQ ID NO: 986656 - protein, 104 aa, Homo sapiens
VTYSPMDVSIAKSVHIGEHCGLVIAPPMSDHVSLVSTVCLALLQCYLEKLVLRAPRQCSYTSCIDRYVFPRTGMSRHAQVTGQLCTLVASDQVELMKLSMTGIS

SEQ ID NO: 986657 - protein, 37 aa, Homo sapiens
MAPVQAGFIWRREACEILTQAQVHPMVTCTLMTLVVS

SEQ ID NO: 986658 - protein, 109 aa, Homo sapiens
MSRHHKGYTVIATPYTTPRNEDGILEMIYPNDGWGLQQVLSVSHDKRIAGQGLEDVLYEMVKDSRILPRTNSIPELHCPALRRGYTITDLAANQHTASQPYNTQALDGT

SEQ ID NO: 986659 - protein, 157 aa, Homo sapiens
HETYYRILLGTITLITDLCERSPAVLRHFRKVVPQLVHILRTLVTMGYSIEHIISGVRDPFLLSRYFVCLRILGRNHQESSETMNDLLALVARITDTSRYCRDMRSCSETVLTIMDVRSAARLRVLAFDILGRFLLHRDSNIWYLALTSLLPQAPSV

SEQ ID NO: 986660 - protein, 117 aa, Homo sapiens
MQTFHVQNVIFFFVVVEMESRFVAQAGVQWHDLDSLQPPPPTFKRFSYFSLPSSSDYKCVPPCPANFCIFSRHGVSPYWPGWSRTLDLVISPPWPLKVLRIIGMSHRTDPLKFLNRY

SEQ ID NO: 986661 - protein, 49 aa, Homo sapiens
MRAHDILSSPCAIIKLGYLLSLPHDTLRSRPPISATDLPCAHPQTVRLG

SEQ ID NO: 986662 - protein, 36 aa, Homo sapiens
MISLRTDRDTTVLPQPGSGLKVRPLGPRSFLCAKAV

SEQ ID NO: 986663 - protein, 33 aa, Homo sapiens
HLTAPPAPLSTFIPCLREGDGQAVRRPIVMCPL

SEQ ID NO: 986664 - protein, 59 aa, Homo sapiens
MHIVKTFIGKVLPGCRYPLVYSISSPPTIPIPWHATCTKINPAITPCRATIWLRQHNEP

SEQ ID NO: 986665 - protein, 45 aa, Homo sapiens
SNAVHGRQATVVGDVCGLAGHGEIVPRRGITSQRQALGRRLAGGG

SEQ ID NO: 986666 - protein, 32 aa, Homo sapiens
MGGLSAELLMQLGEVVYGGARFRPLRHAGVRQ

SEQ ID NO: 986667 - protein, 43 aa, Homo sapiens
HAEQVREVVVQPWAVGVVPAGRHSSVIHVTGDEPTLHFHLYGQ

SEQ ID NO: 986668 - protein, 46 aa, Homo sapiens
NKVERDWNPIAEDRYISLGNGPSCPHVSSRRRPPHVDYSHRAAVVP

SEQ ID NO: 986669 - protein, 60 aa, Homo sapiens
REPLTLDDAENLRERLTLRKPLTPPALNPWLRFRWREGRDSVNLDHTFMRVTELDDEAFG

SEQ ID NO: 986670 - protein, 79 aa, Homo sapiens
LHSHTYILRRGHLLSITPNTPDPRILLMATALPVCSGSCAVCPGPLALSLHLNLVFRVKVPPVLWTGRGPPSEWGASDR

SEQ ID NO: 986671 - protein, 79 aa, Homo sapiens
MLCYEASQALTDATCRLFAPAGRIMELLMYSHDNITCGITSVAFSRSARLLLAGYHDFYCYIWDAMKGDRAGVLAGHHN

SEQ ID NO: 986672 - protein, 55 aa, Homo sapiens
LNTATAHNMSRVDMGHTQLLIGYQKHSLELCNTCAAHIPCMTRYHPKKESASYST

SEQ ID NO: 986673 - protein, 41 aa, Homo sapiens
TLSLWGARHFYFYASHNHSAGHHLFHELFLQNPPLDPHRES

SEQ ID NO: 986674 - protein, 35 aa, Homo sapiens
LGLVGARRLHWSIKNIKLSGSEHKVERADAVERAD

SEQ ID NO: 986675 - protein, 74 aa, Homo sapiens
SIERHHCPSESTSVTTILPSHRASPLSFRAIERHQCPTEPSSVTSVPSEPSSVTTVHSEPSSVTRWSFRAIERH

SEQ ID NO: 986676 - protein, 38 aa, Homo sapiens
MYATPPPEAGLGGWGMHSSEQDSQNGWGHRGGHLNEGH

SEQ ID NO: 986677 - protein, 72 aa, Homo sapiens
MTAHGPGLRRQLCISSPMCPSWSSALRRHAQMHQLASVEEPGSETEACGTGPFTVPPPEGWPAISHIPAPRE

SEQ ID NO: 986678 - protein, 95 aa, Homo sapiens
RQSDAHMGVWVLFQAVRCSPGGVGADPSCHVQHLGVQAAVPGCQMLTCGCGCCYMLSDARHVVRVLLKAVRCSSGGVGGAPGCRMLTCVCSVMGS

SEQ ID NO: 986679 - protein, 81 aa, Homo sapiens
FYTDPPGLLRSECNGTISVTATSASRFHAILLSQPPVQLVLQVAHQHIWLIFVFLVEMGFRHSCPQVIHLPRTPKVLGLQA

SEQ ID NO: 986680 - protein, 38 aa, Homo sapiens
MATKSKLEFSIYPRAPGFHSMYFMPLQRPSLTTHYHRV

SEQ ID NO: 986681 - protein, 70 aa, Homo sapiens
GTGEMNRDDRDHVEGLCGAFRHTWTGCFTIPICWGAAWGSWISRFSDARLPASGLGRLYAFDSSGVAITF

SEQ ID NO: 986682 - protein, 112 aa, Homo sapiens
WLLMSGCDCNILAGITGMCHHARLIFVFLVETGFHRVGRDGLATLDLRQSACLGLPKCSDYRHHAWPKRLVFSRNGTRRVRHPFLFFSYLRQSSGSVAWAVVYCRDHGSLRP

SEQ ID NO: 986683 - protein, 100 aa, Homo sapiens
LSLLRSGHHIKIWQKLKHEDVSKAGDKYTVLTLFAHDRVQFHNLVTVTLNSWAHAILLPQPPKWLKLQACYIMVAGWLLQLLTLHQNMAEAKAGRPEQAR

SEQ ID NO: 986684 - protein, 49 aa, Homo sapiens
LVEKGQIRPTMTRHIEGLTTQHVREATAAVESGTMIGKVVITLCSFDNI

SEQ ID NO: 986685 - protein, 58 aa, Homo sapiens
RARHPLSALIASLGCDDPDFSVGRRPGGGRSSAVLALISEERNDIVLTRRPLSLRHHA

SEQ ID NO: 986686 - protein, 43 aa, Homo sapiens
IKHKMLFTDYQKSEQQRNPRVLTDDKLIPVIGFLCFKYIDGES

SEQ ID NO: 986687 - protein, 94 aa, Homo sapiens
HRVYARLKPSSLQCAQEPIVCMHHDEAVLPVVFPEPIVCMQTEAVLPVVFPEPIVCMQTEAVLPVVFPEPIVCMHHDEAVLPVVFPEPIVCMHD

SEQ ID NO: 986688 - protein, 35 aa, Homo sapiens
QIIMRSGIDGMTTAASRHYKPWLCPVARHPEGPGM

SEQ ID NO: 986689 - protein, 48 aa, Homo sapiens
CFVGLREKDDIHEGTNACCSRRRGWRCRQLCHMPQMLSDGNPLVEHWF

SEQ ID NO: 986690 - protein, 55 aa, Homo sapiens
RIRLIDLAQIADHRVLRVDISYYYPELPMEADEGLMSRENSHAQSYPENLLQNVP

SEQ ID NO: 986691 - protein, 53 aa, Homo sapiens
YGTLAYLDLLAYLDLLAYLDLLAYLELLAYLELLAYLELLAYRGASGMRGASG

SEQ ID NO: 986692 - protein, 95 aa, Homo sapiens
AYWTPGISDLLAYLDLLAYLDLLAYLDLLAYLDLLENQKVLYEEKINLFKRIFSRCIWERLGDIIGEMSNPSIAHHTEFSLWINEGPGMPEGPGL

SEQ ID NO: 986693 - protein, 134 aa, Homo sapiens
NEDADFVLSVQTLLSGGHHQECAAHTDSIVREPKNKTSVAWKGTPSRLPCRLGWAAFILLLLSGHVLLIGPYYRVLIGPFYRVLIGPFYKTLASHRALIGAFLQSTDWCILQSPCSDRKVLQVPTRPRRSRYAG

SEQ ID NO: 986694 - protein, 57 aa, Homo sapiens
REHLTFRETLPVRQIITMRQPFSYDSRYIYIGRDTLQAQYQVLSETEAEHLSNDHAG

SEQ ID NO: 986695 - protein, 31 aa, Homo sapiens
MPRASTDVLVRVLIGVHVTVSSQCFPSRSIA

SEQ ID NO: 986696 - protein, 103 aa, Homo sapiens
TLQDPPVLLRSQHGRRGLGELLLNRVQFHLYAEHDCVSVIWMLVILEAHVGFPGGLLTYDLLNLSYCQCYGISITREERRVSGERGDTLVTYPEMAGWHALPP

SEQ ID NO: 986697 - protein, 49 aa, Homo sapiens
IPPVSRHNSFRKEELDFYKNSVLLSDFHVLICKTTQRISVPKPYSTSVL

SEQ ID NO: 986698 - protein, 105 aa, Homo sapiens
GPPGCRSPGFSGLSQGSRLAVFAAAVSPEGSPVINLLPAHYCDCLYYLFLYGLLYYGLSVSYWLLGQRLLSVPSLTDLSKRLAYKMAAGLQPSHAREGMQDGSYL

SEQ ID NO: 986699 - protein, 114 aa, Homo sapiens
NKTRSVQITPAPSRTTSPADITILTETAPPAVGRHNFDTAKRFAKRLAERFLTAGRTDPAHDVRVAVVQYSGTGQQRPERASLQFLQNYTALASAVDAMDFINDATDVNDALGY

SEQ ID NO: 986700 - protein, 126 aa, Homo sapiens
DPPVLSGLLACSLTFFLSFRRSLALLPRLLECSGTISAHRNLCLPGSSDSPASASQLAETTGMHHHAKLIFVFLVEMGFHHIGQAGLKLLASTDPPPSASQGVGIIGVSHCAWPQFLNFFPTKVLP

SEQ ID NO: 986701 - protein, 66 aa, Homo sapiens
GWFELRPRVVRLLRLQGAIAGVSTGLASIILVTMTNKTAENQRSDPSSNTSISLHKETSGLHEYLC

SEQ ID NO: 986702 - protein, 86 aa, Homo sapiens
AYKVQQQYMGKHIKLSISPSHVRAKDEIPENRDTIKKGLKYREAQQHCPSDVMQYISVQLQASLGLSHMCSTAMQAGATFPREKLP

SEQ ID NO: 986703 - protein, 121 aa, Homo sapiens
SSHETAGVFSSEASSCENSYRVTEAPSSIFLSGHMQTMGLGGQPQQDLRKDGHRPTHQATDNGARGANLSKTSGRTDKVYTPGHRQWGSGANLSTDLRKDGHRSTHQATDNGARGANLSKT

SEQ ID NO: 986704 - protein, 118 aa, Homo sapiens
IPLCQVYGSSHVSPCLLLIDDICHLNSVTVLVSHGSHRHCLRSVPACQAPYYTMNSSKGPGSHAFYYCSQPQHPVRSLNWGQAQCAHACNPHTLGGQGVQERHGQQGETPSLQDLSEP

SEQ ID NO: 986705 - protein, 138 aa, Homo sapiens
QDAESSDPSILGPRNLSLLLSLLKAHACRPRSTSAPEWLLTPTGSTAHKFCPLSPHLATIEQDVITQQALAESSWQLQTLKSSCGHRFELKHSQVIVSPDILIANYPHDQDCSLLVATLLWRHSQAMSRTSLLLAGAQ

SEQ ID NO: 986706 - protein, 97 aa, Homo sapiens
EATALPQPPTSTPHFDLWHLGAFYSPVTVLEGKREGRTSGSQESKTQSQHLNNDCGPLCFRPTVRAGKQRPGNAPGPELGKARLTVLRIGDSEASSP

SEQ ID NO: 986707 - protein, 124 aa, Homo sapiens
PHCGTMDLTFFTSFSLVLFQDQLVLMAVRGPTFPGNVVTGTGVLDPVHSPRINPHEVSGSLHEAVHRNIGCIEIIQDWSPGTRQVVHAVPITDSADGLPVVLVHREPLAVAWANVDVDGAEVVI

SEQ ID NO: 986708 - protein, 98 aa, Homo sapiens
MIIRIAFLGLFTSMFDFSLVNCCPGSIYSYSWENLRPSLALRRSMLSASARAYENPSTWSRIPGVWYLSLRISTGSEEWASKESFSPIDCSSLEDGEW

SEQ ID NO: 986709 - protein, 72 aa, Homo sapiens
MPLLVEPEGLEKETTFNSLLCPSGGEASEELSLKLPPNVVEESARASVSVLGDILGSAMQNTQNLLQMPYGC

SEQ ID NO: 986710 - protein, 38 aa, Homo sapiens
LDPITADPAIRIDHVNPAGVYFFTHALATYHHVHIVYL

SEQ ID NO: 986711 - protein, 90 aa, Homo sapiens
DSTGSPNLYSLREYRKKLRPLRSYAAWNCEDDHGVLLLDVTDILITICARLGLTNHDQYSLVRELIDETMEDITRTLSQDKTLLRTEYRL

SEQ ID NO: 986712 - protein, 88 aa, Homo sapiens
TSVLFLYLITILIVLGIIGFFFFHRGHFFLLSYFYYFEFTPICIVCVCSAPPNIRVILLRISRIHIVTLFSQGATHKLYPSELVNSAG

SEQ ID NO: 986713 - protein, 66 aa, Homo sapiens
AERASPEPQEWVPIIQQDIQSQRKVKPQPPQRERHPGILGLLSLPGSQQGKASDWDQCCSSSLLTP

SEQ ID NO: 986714 - protein, 106 aa, Homo sapiens
MSLCGVAPCGAGPPPALPPKQRQLEPPAGKDGHPRDPSAVSGVPWEGTLSLMGMIQLCQQEERYGQVVSVHHYHREEFESSLERGTILFQLHTIPISNRHETLQHF

SEQ ID NO: 986715 - protein, 133 aa, Homo sapiens
PVVSSPAVPVRSPICSGSETICVARVCCFAGVRSLRGSLVILVERVEKLESSYSSSGLPATMRGGRQSHNCCSAPPVGYHNTCLIPLHQPPHPPHTPPHTTPPPIDLHTHHTHIYTHHTHLHTQLHSYTYTDT

SEQ ID NO: 986716 - protein, 47 aa, Homo sapiens
CQRTSTSFGLNACVPVHVSCHQLCTVTSSSDVRRAAVWTSVPGMCFL

SEQ ID NO: 986717 - protein, 58 aa, Homo sapiens
FGGASVAFAPPDVPAHFQHQEPYGASSLSTELPVVWSPWLFFTVSLGSPWKLPHLRGA

SEQ ID NO: 986718 - protein, 69 aa, Homo sapiens
PIGARHPAVDHNPSFATATTMRRLDANRQFFLDIGSGLFRTATQCDELFDNGLGAGVVLSYRCIQGVDV

SEQ ID NO: 986719 - protein, 85 aa, Homo sapiens
NLYSLREYRKKQRPLKIRMLYGTVKTIIVYDSNTVTDMLMTICARFGITNHDEYSLVRELIDQKKEDITGTLRPDKTLLRNEYRL

SEQ ID NO: 986720 - protein, 51 aa, Homo sapiens
ARYPFQPLVAASFLGIRSWFCRRVTAAQEADPIDSVKSYPCVVDTDAGRCC

SEQ ID NO: 986721 - protein, 30 aa, Homo sapiens
MDQTLSLWGESVPRCAGAERKCMVNTHRVV

SEQ ID NO: 986722 - protein, 117 aa, Homo sapiens
DPGSIPFRGHTQVEITNLHLPALEVHVGLLSLTVHRKVVADTILQFQVDNGINMLAVQGLQGDVHPAVPQRAKLATPRLNVEGRLILRPFLEGDWALLNAPCGWDLADVPDLPRGMD

SEQ ID NO: 986723 - protein, 47 aa, Homo sapiens
RSGLRRAVVCPGSRSTPPALALWREESIETTVIVDKRSAAFYALGAA

SEQ ID NO: 986724 - protein, 32 aa, Homo sapiens
RELLGSLKTPLVRPYFVPFDLLGFFCRHTVYP

SEQ ID NO: 986725 - protein, 50 aa, Homo sapiens
ARYPGKASNSGTKNHPAMTAGTDSSHPTCRDGHRNHAHIGGRNNLALIVI

SEQ ID NO: 986726 - protein, 37 aa, Homo sapiens
SQLGTLLIISGVNAFSFKPYTCPKIPNKDGFGKAAIK

SEQ ID NO: 986727 - protein, 88 aa, Homo sapiens
VSDEVLQQLELGVGEVKVLVPDTRCVPVLVDGERSCHELVSDLDRKQQRSRVSASDGVAESHRKSSIPQSGLMTERVSEPTNSRTGTR

SEQ ID NO: 986728 - protein, 101 aa, Homo sapiens
EKFLSYRLAFFNADQNQAGKLQTRIDRGIGSLTRLVQIFFIDILPLFSSAIVALGLMYYANFYVGLVATSIIPIYFWLTFQQAKKLGGWRRNLRDGREKKS

SEQ ID NO: 986729 - protein, 36 aa, Homo sapiens
FLEKYKALRKYKALRVMESIQEAHRASHTADSEEGQ

SEQ ID NO: 986730 - protein, 71 aa, Homo sapiens
IRLGTLFLRVLRCFTSPRYHPHPYTFRAGPPDTTPDIPGFPIRTPPDHSSLTNSPGLIAGHNVLHRLLVPR

SEQ ID NO: 986731 - protein, 59 aa, Homo sapiens
LRIPLTPTRLTESSRPRKLRTCAEESRGPGVGLGKRHLSVTRRYARDGKAVLMSLRWRL

SEQ ID NO: 986732 - protein, 48 aa, Homo sapiens
WLPVSQDIALHAAQCFISIYSFAGAAMTDLPQTEGGLSQQQIPPSHSS

SEQ ID NO: 986733 - protein, 103 aa, Homo sapiens
MRDSDPDRNWVLPFQTVGSLLVQGMSNNVVREPQGFCLMLYPAVAELVSKLQDKALFPLLLFSSRRKESLLEVQAALPVVVGGVSLELQAALPVVLGGVSPGA

SEQ ID NO: 986734 - protein, 58 aa, Homo sapiens
LTRIPSQPAAGETGSSDATVVSVYVLLIEMSGGLHGAPITLRDWLRGFSNAGARQAIF

SEQ ID NO: 986735 - protein, 77 aa, Homo sapiens
FELGTQSSALDVRVRHLGRRLLTLVTAELVLQLALCQESGHLGLLDGREILGLVHRLTVHEKGLIGVQTLLDLLLKA

SEQ ID NO: 986736 - protein, 63 aa, Homo sapiens
SRALYPPRHWEIAGVPAVDWTYFPDADPAFPADVTARICQLAGTDGILGNCHASGTQVIDDFG

SEQ ID NO: 986737 - protein, 51 aa, Homo sapiens
VSRVSPSELLRHVVCLTDPLRTRKYDRLDLIRRSLIVCLQSLPTSQDRRQD

SEQ ID NO: 986738 - protein, 68 aa, Homo sapiens
GLDRSFTLYVHLNADELEALSDVLRLRLLDLFTWEVSSRPDLYHVFVNLVRQCTITIAPLAIEVMAIG

SEQ ID NO: 986739 - protein, 95 aa, Homo sapiens
RANGSRELVMKAAVNGVGADGHGTVEKHRLLWQAAFLIEAAKVIDKVLGAADGEGGDQHVAAFLVSLLQNVGQLLQGFVTGAMITVAVGRLHQQY

SEQ ID NO: 986740 - protein, 88 aa, Homo sapiens
DRGRVAWEQRYLWGHCPRRDFTWNKSWQAAACPVRLVPCRRFAGECAGSVASKSLLLSTVLRVRSSAYRGGQSLLGRNGYLSSNLRNP

SEQ ID NO: 986741 - protein, 137 aa, Homo sapiens
APKRAGPLVARRPQLNSPVRRLSRCGFIRPKPWKSPGAKWVADQVACVRRAGALLGDAHTEGQAAVWVAGTQVEVVGPAVAASEAFHLGLALALTSSITLAADAALGVTVAAYGPWHLAVSLAWLALAGVGIVTWGA

SEQ ID NO: 986742 - protein, 47 aa, Homo sapiens
RVRLGVACPLLLLAALRLGAGDVILFFAVLAFLFLFLFLLLLTSVLA

SEQ ID NO: 986743 - protein, 60 aa, Homo sapiens
SVTEDRISTPRVYAPRCTGTSKVWYTQDILLCQLTRDNASIRPIQYQTAALMNTICETAP

SEQ ID NO: 986744 - protein, 89 aa, Homo sapiens
MGIPGPVRGTATGEVSVPELWSIVVSLGKDFLIIRVYLILNFFTLLYRPNYKVSEKVLSSVAYIPGLKTSESFIFHIRTGPGDALESHL

SEQ ID NO: 986745 - protein, 40 aa, Homo sapiens
YRSRAVTYNFLSQYTHTSIIFHTKYFLSIKEYSIDKYSLN

SEQ ID NO: 986746 - protein, 45 aa, Homo sapiens
MVACCPVLLLGCSPYSALVLSSSCSPSSSFLFLFLFLLLLTSVLA

SEQ ID NO: 986747 - protein, 129 aa, Homo sapiens
MATRQRLHVSLGFPKSAADWPGAGPGSGATGSVRRGRISASSHGQVGWRPEMRLDEVLPELMGSLALSELLFRGEGPPRACSRMDQYQDEDEEALEGGDDAEKVEDDKLEGARSKGEEDQGPGQGQDPG

SEQ ID NO: 986748 - protein, 56 aa, Homo sapiens
RLQARCREIPSGRQVFLGPTGAKGLRGIPGFAGADGGPGPRGLPGPPGPTGAKGLR

SEQ ID NO: 986749 - protein, 31 aa, Homo sapiens
MGFLDVGQADLDLLTKVIRPPGPPKVLGLQA

SEQ ID NO: 986750 - protein, 56 aa, Homo sapiens
MSGTRYQRTPEVCGVLESLLETTPGWGCHPLPSASIFTPHPPCLRWEAELGGRVGR

SEQ ID NO: 986751 - protein, 48 aa, Homo sapiens
MDVVGEQTDCWFGCGHQGVTHRVLDQAREEALAPQLTISTGPDIRTGP

SEQ ID NO: 986752 - protein, 78 aa, Homo sapiens
LTDAFCRPLSLRGRSCAIQAPCPWKTLVPSHSEGDALNCSFGLSPSPGSWKFLQKSSLNLSLSKASLLQVHIRRTLRP

SEQ ID NO: 986753 - protein, 56 aa, Homo sapiens
AQCRDHGKLQGVPFDIHSDRGDCPEAAKDWLLLRLTPAGDMRHSRAVRCMARNEGS

SEQ ID NO: 986754 - protein, 46 aa, Homo sapiens
VGNGRTGGEVLPLDVVGGAGILAVLRQILVEELQLLDDDTGDHRVC

SEQ ID NO: 986755 - protein, 59 aa, Homo sapiens
REPLTLREPLTLRKPLTLREPLTLREPFNPSPLTDFPSMHTTSVVDGLYCARVKGYPRY

SEQ ID NO: 986756 - protein, 33 aa, Homo sapiens
TGYLGAQLMVSYSLLVSEYLLDRFKNKSYKFDL

SEQ ID NO: 986757 - protein, 58 aa, Homo sapiens
MRGALKPDYCPFIFCPGRMTSRNHLVQKGLLELEETVECKGLKGLIGANLEAKQVLST

SEQ ID NO: 986758 - protein, 111 aa, Homo sapiens
TVYKASASQLIMHQTNTIPSHLGRTLGLYGKDQQEAPLQDMENDGEQDLRCKYISLIYTNYEAHKDDYVKALPVLLKPFETLRAQNQCGKTFIVGDQISFADYNLLDLLLT

SEQ ID NO: 986759 - protein, 82 aa, Homo sapiens
WGEARDWRTFGRYLLSSRTRSIISAPEGDVRLLRHASARSYTYAVACHTAGRFVPDRYVALPPLVLKDLVCLSAIRSCCLTP

SEQ ID NO: 986760 - protein, 52 aa, Homo sapiens
MCHALVLTVSTELVHGRHAPESGELHCLTMAPVLTDILDGHALVLTVSDGYL

SEQ ID NO: 986761 - protein, 37 aa, Homo sapiens
MSPPVGPFFGGIAVQRGAHAVEPQPGSLLRFFHGGDV

SEQ ID NO: 986762 - protein, 33 aa, Homo sapiens
YLASLLVIVLLDVPWQIWSHLKKLRMSKEDVRQ

SEQ ID NO: 986763 - protein, 39 aa, Homo sapiens
SQAPSVLSRTHHKDCITVAQSTVNDADIRDNTTIRVIDR

SEQ ID NO: 986764 - protein, 39 aa, Homo sapiens
MPPAKTSTPEDFIRMTNVSLTMNQTQLLCPEMPDATTVR

SEQ ID NO: 986765 - protein, 39 aa, Homo sapiens
RPPSPRFLWLAPVALHEAAYPVHIGPDLTLMDEEAGNVN

SEQ ID NO: 986766 - protein, 67 aa, Homo sapiens
EDGTTKVTRALEATTEHIRQELAAFCSPEPPAKTSTPEDFIRTTNVILTMNQTQGLCPEIPDATTVC

SEQ ID NO: 986767 - protein, 61 aa, Homo sapiens
LVTSYALATTHLPRWWRDWSAGQQLSCSLQTGNVHDTVSAFTSGAADLLICFHQVAQPLPL

SEQ ID NO: 986768 - protein, 49 aa, Homo sapiens
TTGSGTTNGDDGLQSAGTLAGMFILAREHSNNTKQASNPGTTCKLADTL

SEQ ID NO: 986769 - protein, 52 aa, Homo sapiens
MSDPRILTKVRKRLSFSGSDRPLAHSAFIAVHHQLHLRLQFGAQSQAVIDDH

SEQ ID NO: 986770 - protein, 88 aa, Homo sapiens
HGPFEHLLVIIQQPRGMAITCGIAQSNTPGSESRCFMHWLSVHSGTARSSQYSPGLAKIPELLNISAPLLRPEPSSSLLVFQIVTDDV

SEQ ID NO: 986771 - protein, 77 aa, Homo sapiens
PGWSVPVLSHCTILEELTFFLASQLMLKLSVMNRDDLSRDRPLGAEMVYVADDPAHHARCRRVRRGRGSLPLVCAAA

SEQ ID NO: 986772 - protein, 42 aa, Homo sapiens
ASGSSSSSDQAQQIPAAMYHLHPRSIHLKADRQEPQAADCGS

SEQ ID NO: 986773 - protein, 48 aa, Homo sapiens
TRRLPGLYHRPHIRDIRRSNEAGQGAHPGLPVPCTLGLLLCKQLRVTR

SEQ ID NO: 986774 - protein, 127 aa, Homo sapiens
REENNPRLVSLTGGLRTLPALDVTIRRREAAGGVLGAPASPGLLPLSSFWNWIASHSDCEENYRRSCVPHSPPEESQLMACHYRRLRGLPAGPWSPFFSAPLGLLLFLDWMGSHSDCEEPSPGLVSL

SEQ ID NO: 986775 - protein, 41 aa, Homo sapiens
ESHQDICCCGLSSVTATSPSCRPRRAGRRSAAGNIVHVLAH

SEQ ID NO: 986776 - protein, 42 aa, Homo sapiens
MMESHGHPSAVAPTGGSSQRISVLLCTVWNTGLLLLQAPAVA

SEQ ID NO: 986777 - protein, 92 aa, Homo sapiens
LAATRSMLVTANGVALAGLLPVCSIRYLSRGSFCDPCCQRTSTCFGLKPRAMHVSGSRSCKVISFDGGCTRCPTCHNVFADFVMMPARWGLQ

SEQ ID NO: 986778 - protein, 138 aa, Homo sapiens
VRLHSFVSLSSSPDSYLDLDFYCGWKGDVAAASSLDSSLLHYYYPGSSSPKGGHYNYTDLYLVRDLCHIYILEYSYTPSDFFSHAPQPGHLATLTAPPTSDLASAGGLVGHPSVTHKLMNHVNINAIPSVHYVYYQVG

SEQ ID NO: 986779 - protein, 56 aa, Homo sapiens
MSTPNWALKPLNRPNVMTYMSVFEPISRLFEDVICRRKFAFTGTSLSIVNAKIVAR

SEQ ID NO: 986780 - protein, 33 aa, Homo sapiens
PYTGPVFHEQVIILPLHGSGTAAVNHLSGTESR

SEQ ID NO: 986781 - protein, 104 aa, Homo sapiens
FQARCCGLAGRSYAAAGYFGAGVPMAPLSDWPWRHWARLQPQATALLLGEQPLSWLALQGQVDELAADFQHQGVEPGCGVALCGKNSYPLLLAYLALLQCGVRL

SEQ ID NO: 986782 - protein, 92 aa, Homo sapiens
RASSKLTTEHSGPWRVTIRATNHYLNREFSLERFVYSDLIKCKVVCADRATAYYTDTRRSTVKNSNCKRSRGSCTSRTNAAGLDERISIAVI

SEQ ID NO: 986783 - protein, 121 aa, Homo sapiens
MCDFTCSAAYPAVSTPLTPPSQNPANTFRPEVHLLPPPSDELALTELLTLTCLARGFSPKDVLVRWLSGSQELPLEMYLTCGSRLVPSQGHHHLRCEPACCACSSEDHRRGILYSIPVACK

SEQ ID NO: 986784 - protein, 58 aa, Homo sapiens
RHRNSITISRVSTLRKTDVRVVTHSSAGTASKSASLPFYPASFVLRFKQPVIPSQYAE

SEQ ID NO: 986785 - protein, 92 aa, Homo sapiens
EIRNGARRTITRVYLPGYVLVRWTSLTLVGYLRHTPSVTGFVGQSTTPIPLTFDEVIKMLTPSVLARVSRENADKAPSPKAKPKVEVADYEV

SEQ ID NO: 986786 - protein, 57 aa, Homo sapiens
MPKPVFPIRLALKLQDPTEPSAFLKSPRGILTGSSNFTAKLNLFFFLLLLHIKPAPF

SEQ ID NO: 986787 - protein, 52 aa, Homo sapiens
VGLWVFLVSSVIAYPAMYLFQIIHQHIGRISQCKDYPSVISGYLGKNWGFFI

SEQ ID NO: 986788 - protein, 91 aa, Homo sapiens
LSSPQHPLSFQQPQLTPPSSAHPTILSRHPSILSSVQHPQLTPPVLSVTPASSASFQQPRAQATILSSTPPSSAHPSILSSLQQPQLRTIV

SEQ ID NO: 986789 - protein, 93 aa, Homo sapiens
TRYAENPCNTCESSADPASVHPSRLRFWVPAQVEGEDVLVQQLLVHQVVEEGQHVVDGDAGVGHALDAIELVLAMKVMPGCLVGLPKDLPLHF

SEQ ID NO: 986790 - protein, 103 aa, Homo sapiens
PCLLEIKKRFVPGRSVPMRRNLNDRQHPLKAGCVWLLLGGAHGVGQEGALLQMMSLVGAGGTLALPLLGAFESVAFGVSWAPPSPSGPILPSALRPRVLSGVP

SEQ ID NO: 986791 - protein, 90 aa, Homo sapiens
ISSDRVSTDCMSWQLLDSEDYSFMAVDQEETVLSGTMYQDEEPHPVLEAELRLDLNSVHCRMLPDTGFASISWSFLSPLSGNTITAARTF

SEQ ID NO: 986792 - protein, 57 aa, Homo sapiens
GPVSTDVARTCILHLSTYFQCVTLSGNSLAWVQIAAIDYCDAHAVSSQGTCFPGKAQ

SEQ ID NO: 986793 - protein, 82 aa, Homo sapiens
MITSGVLDGDKTVTVEFKHDDRFNEESGALLHCALLYTSCAGQRRAGLGRKCFIRFGIEDGEEWVESTKRIDMARDWLISLF

SEQ ID NO: 986794 - protein, 68 aa, Homo sapiens
SSGIFTLRLPMPLPFARGTDRGQWLPQAPWAASLCALCRVQHIGVECLRFSRLPPVQLLMDLPFLGLE

SEQ ID NO: 986795 - protein, 69 aa, Homo sapiens
GASTDVRAIYGCAVPVRMCGPLRYVLGGRQGRVMDRRPRVTWLMLESLVVSPRSARVEVGPVMLIATGS

SEQ ID NO: 986796 - protein, 50 aa, Homo sapiens
PVPEHACLPAGRRVFTTALHASLSKILTLVRAELTSKYRYSWNLVDAYTP

SEQ ID NO: 986797 - protein, 88 aa, Homo sapiens
KKQHTRWTLSMRLLLEVTYEAIVDRCESGIREMLRRGLLLLTWNRQCFLFLVLVEPGAGTTYPPRLCPLTGQRAQGGVGHGVGRSFPT

SEQ ID NO: 986798 - protein, 34 aa, Homo sapiens
MRQSLFVGTFIGLFFDLMKLFEVGGSPANTRYLF

SEQ ID NO: 986799 - protein, 50 aa, Homo sapiens
TVLEVDGYAEERGVKADWDNSSRSEEGGSISDHSREEDATEEEAAEEDGE

SEQ ID NO: 986800 - protein, 38 aa, Homo sapiens
LFSRRDGVSPVLDQAVLELLTLNVIRLRWALRKAACEI

SEQ ID NO: 986801 - protein, 59 aa, Homo sapiens
KRDHKQPPGDLSKPGDLSKPGDLSKPGDLSQPGELIKTGDPDAKPGYLIKPGRTEQAGC

SEQ ID NO: 986802 - protein, 35 aa, Homo sapiens
ARPPHLDVAPEIDDHQVQGVKLLQTRDVVVTNLDA

SEQ ID NO: 986803 - protein, 70 aa, Homo sapiens
MVAGSSPAGCAIWRSGNLSKQCNMVGVAQLVEHRIVAPGVVGSIPIVHPIFQSARPKAWRFCFKLQTTRT

SEQ ID NO: 986804 - protein, 103 aa, Homo sapiens
MKREFTLSPRLEYSGMISCSLQPPSPKLKRFSYVRLLSAGTTGVRYHAQQFFVFFIQTGFRHVAQAGLKLLSSSDLPALSSKVVGLPAFNPLSSTESDLSELG

SEQ ID NO: 986805 - protein, 40 aa, Homo sapiens
PLKWHMANVIIYCWLFIYRQHAVLLLHPQWMKTCGIMLQP

SEQ ID NO: 986806 - protein, 58 aa, Homo sapiens
MSLVDSSHDAKMLWVQQCSDQVMARKTSLYLQCHDKPSEIVEDKAYYIADNGRSQVIT

SEQ ID NO: 986807 - protein, 87 aa, Homo sapiens
RACCADLDAEGAVGCRPLCGWADNECSVSRVRSLVTVVLPIFPLPSLYLAQRAPAEHCTVSWTTKREPSPRENLVPSSTVDHPYTAF

SEQ ID NO: 986808 - protein, 160 aa, Homo sapiens
HTYFAFLYMLLTVYSMRRHTCTMRYMEDDPVNRTLFIKGISKYAESYKTMMHFEEAYPNCTVLEARPCYNAARLMFLDAERKKADRWKLYFTNLQSKENVPTMINPKPCGHLCCCVERGCEQVEAIEYYTKLEQKLKEDYKREKEKVNEKPLGMAFVTFH

SEQ ID NO: 986809 - protein, 59 aa, Homo sapiens
ARYPFVKLNGTRGYRHDATPFCEIYQSCNCMGVSQSETLFTVKLAPSCSTLERHGRFWG

SEQ ID NO: 986810 - protein, 36 aa, Homo sapiens
MGIGGVQDLLIRGLRGDLCTKSPHHSTAKCHENGYQ

SEQ ID NO: 986811 - protein, 55 aa, Homo sapiens
RSSVGSEAVHNIGFLEDQPLLQGDVFASQHAWGVLRRELPLDFSCRLLGLLWTRM

SEQ ID NO: 986812 - protein, 46 aa, Homo sapiens
MSATASDVGNCFGCRQLLRMRQLLRMRQLLRSRNCFRCRNCFRCRN

SEQ ID NO: 986813 - protein, 117 aa, Homo sapiens
MSAGSGYNGPGDTGSYLEVKGEDVQYTAQVSDWGNRVGPVTEIGKPTERGVMGLEAYPKVWQVLKTQPGEPRFQCSLWDLYSHRESVDALSVGGVGSGDWPVSTKREREDNIQAPGL

SEQ ID NO: 986814 - protein, 115 aa, Homo sapiens
YRFPTLSLWGVLSHGIVWLLEVSSFYERTAMDVLSGVSSYPADCCKSLWCSGRMGDTRCCFSFILSPHSISTSQVSSGSGASSFSGSSSDSSDHSLFLFQPRDLHRGLGSTPGAE

SEQ ID NO: 986815 - protein, 84 aa, Homo sapiens
LLLYRSSSTGGSDVNLTIDSTGTDTTYSDSEKDRITIYRDNNTITLYMNMIRVRDPDTDVYYCGKGDGTGAIDYWGQVVLVTVC

SEQ ID NO: 986816 - protein, 66 aa, Homo sapiens
YNSSSYPVPITVCWSQRKVYALVGSCLMPKSGTSRGEAPVTPAAMLNQHVLCAEAACEAREGHQLV

SEQ ID NO: 986817 - protein, 111 aa, Homo sapiens
RIPDALRGEPETENHEADECMTSFYDIVQHCPLMPYVPGHHLVIFKGYTLELLTSDDPPSSASQSAGIIGVSHRTPAPLLFRIKCERLCVAEVVWSLLISPTFPPPSPTER

SEQ ID NO: 986818 - protein, 67 aa, Homo sapiens
LTTGEGQAGQEDRAAHRKPSTEWTDADYWFMKNRTSLIGQRSERQGFTNFFTEVHKQVSDIFIGGER

SEQ ID NO: 986819 - protein, 63 aa, Homo sapiens
MKVSPYALSALFSICLCASRSFNVLPGILSLTVLFRVQGRRECSCSLCAVYFVFPQRIAPASP

SEQ ID NO: 986820 - protein, 75 aa, Homo sapiens
PCLMMKTMVLLERVLLLYMFSGGDAAALERQVYMERYQCHMHGLVPIKTCPFEACTPLLISLSTLIYNGALRECL

SEQ ID NO: 986821 - protein, 122 aa, Homo sapiens
FPDALSVGEAGSSWPAHPAPPSHGHPPESVPTRLMTTAERGSGRTWDAWETWDAWGSGVWSPAPGPSVLPRAERPSLLLLGVLPPCPYVPAVEGRPSCGCPVGLQGHASRTQQLSPLPHRES

SEQ ID NO: 986822 - protein, 176 aa, Homo sapiens
CTVRRGQEDSDRAKSTKTACGGLIIQPTPSNLIPHVLPLCFPGPLQRYFQAHLLMVLMEAHQLLLQVLNLGLQVSLAQSEIIQDPAQAIDVGLHQLPHGQLCLVPAQGQGQQPRVKQNAELREGLKLAGTFQPSVKLMESCPRAYEDRSSPAPAPRVNSLGPEVIGSQFGIINVHN

SEQ ID NO: 986823 - protein, 140 aa, Homo sapiens
VPMHMLNTCKDIYQLGDGGAKFLMSAKCQPCQYALVKDGSLGPAVVTVFCTGTQPTNDTNILKTHFAAAVCFWRWGLTLSPRLECNGTVIAHCSLKLLGSSNPPTSASRVAGTTDACHHNWPIKKIFVFVETVVSIRCPS

SEQ ID NO: 986824 - protein, 74 aa, Homo sapiens
GWLDEEQQKSNASQFPHYSSPVPESLISLLMRVKSNAYVLNEIAQEYESRKIQTSCRKLIANAQASREKGPEPH

SEQ ID NO: 986825 - protein, 65 aa, Homo sapiens
VSSAPWDQAGSEGKPVPKALGTTLSEAELMVNPQCKRCLQACEEVWAAWGVSTQPSMSSTLAGRG

SEQ ID NO: 986826 - protein, 72 aa, Homo sapiens
RGRWELTKLSSPIGSCSSSEEQAARMGHCSSFEDSCEMPCSCSFYSVCGSGPWFPSWSCGGFPGLGSTLVFA

SEQ ID NO: 986827 - protein, 67 aa, Homo sapiens
MRSERTKKATPEVAHRAGAEAADCHLRCQQQEERFDAIEATVHKVHHEEAVVRRDVATYSEQLFYTS

SEQ ID NO: 986828 - protein, 36 aa, Homo sapiens
YTHGEPTHGGTYTHRGTYTHRGTYTQGNLHTQGNLH

SEQ ID NO: 986829 - protein, 73 aa, Homo sapiens
LQGQRERRQTLRARSGHRDPSGQQLFIKHLLRALGQILETQAEHDPSLCLELLVGWEAPLNQIISTHGKECGT

SEQ ID NO: 986830 - protein, 68 aa, Homo sapiens
SVALATTARAENQDSRLQVYNVPAHELRARVLDVEQIAHSYLRGHHPTGLDGRHRQPVDDTRIDTAIA

SEQ ID NO: 986831 - protein, 58 aa, Homo sapiens
RDPPEPLTLNDPACLPFECRVVTGPGQFKLSGVQQLCGGIWNRGGGGSAQFHHGAMTM

SEQ ID NO: 986832 - protein, 35 aa, Homo sapiens
RARYRCFRCPRSSVGMSVAGGISGTVAAVLTLPFD

SEQ ID NO: 986833 - protein, 75 aa, Homo sapiens
EIAPLHSCLGDRARLHLLGDGHDLPQAQLQGYLILPVRQQQLYRPLVLTVLDEDVAAVQERRICRLIQVLCYRDK

SEQ ID NO: 986834 - protein, 30 aa, Homo sapiens
MVALLSAVSSPGSEEDHSGGSAVSSGKGSR

SEQ ID NO: 986835 - protein, 56 aa, Homo sapiens
IEGTHPFRAVCDGEIELMVIADTRSGWVYGPPEIYVNHAVTWDDLRVCSDAVCITV

SEQ ID NO: 986836 - protein, 67 aa, Homo sapiens
ISRIPPPALNLTAATPHTGSSESEVRLMEDADYAMLPCRGRATPAQIVTHTIHNSKHRRRTVLLVLL

SEQ ID NO: 986837 - protein, 126 aa, Homo sapiens
YVVDAYCNYGVMIAMYHWRDEGSPSVSYKLITATGCPEQQGGSCLHIENEGASCLSCEISKGYPQRRGLIFTFTKVTMLNLFTKSSPFFFVTPSIFFLVEDFLKLSLPEHFTMSPDCQGTLAKRRA

SEQ ID NO: 986838 - protein, 72 aa, Homo sapiens
IPQFSCGRTGSLHILHAGSWEPCVKELSPPLPSLCWIPPEPRESYLAASSPLDVTLAPQCLSIPNHAAGDSS

SEQ ID NO: 986839 - protein, 66 aa, Homo sapiens
MSILESTASGRSTRQRAANATKYDDDVTKLLLKGCPFPGGPALGATFPIGFPLKEFCQLPHFPRSQ

SEQ ID NO: 986840 - protein, 64 aa, Homo sapiens
GTEKSEQEEEKEDLERVGYCLLEQPEAKLTVAERVHAGRIIHKLFVTSQRAAAMTPPEEELKRM

SEQ ID NO: 986841 - protein, 50 aa, Homo sapiens
MVPIQTELFIPAFLEYMARIQVEKVSVGQSTCASVPTVLHFFLALVLDLR

SEQ ID NO: 986842 - protein, 161 aa, Homo sapiens
MAMASDLRQNHGTNTLQRVAILSELCTDETKGQKLERVPTMRSQMGKWVETLSTWSSLDYRPQVISVLLGGKLCGPVMGPPCGGCWAVRGLILPEALPPWRLAQCAGYHPVALFWPALSPRLQGQNLEAERRTSQIAPGFPGASPVPLCHLEPGPASPWVP

SEQ ID NO: 986843 - protein, 33 aa, Homo sapiens
KEQCVEMYTDGQWNDRNCLYSRLSISSSSYACR

SEQ ID NO: 986844 - protein, 63 aa, Homo sapiens
PYYSENLSVPREQSTGAHFCPSAGGRIKDVPEPQDPMAGPSMMGWAQGIVRRDQASSVWDRCR

SEQ ID NO: 986845 - protein, 92 aa, Homo sapiens
DCVDGENKTDMFQTVDLFEGRDMAAEQRTLMALGSLTVTKNDGHYRGDPNWDMKKAHEHTREFTESQLQEVKACHWPSDGQQLRHFQAGMTG

SEQ ID NO: 986846 - protein, 36 aa, Homo sapiens
MPDNLLTTLDDTCDLLDPLVQETNKQPPQTVNPIGH

SEQ ID NO: 986847 - protein, 74 aa, Homo sapiens
VRSLNTQPIPRFPIPIPERQAFPSLSSLQKIRGLREKNYSRARCVTPCNPSTLEEAMIADHLRSRVRELAVDNI

SEQ ID NO: 986848 - protein, 69 aa, Homo sapiens
QRQRVMEVDSEEDVGLSHKDRAEAESSGRGNHPSGYQGGTSHLLKKCYCECQERRFGEMVFSIDFLRIF

SEQ ID NO: 986849 - protein, 114 aa, Homo sapiens
LKGGRRQKKMKEEEEERRRTDEEEREGGRNEEEEEEEEEEGGGDGQEKREEEEEEEEEEESKEKREDVAVAVAAMVVMVVVVAVAVAAVVAVMAVVAVAAKAVGLSFPIGSMSL

SEQ ID NO: 986850 - protein, 84 aa, Homo sapiens
IHALSRKVNYIHVLSVYSAWVSTFTSPQSAAIQLRSMIFLRIQGHGRYNSKFSLPPLGISSASQSRKLHAQALSSRASALLCPG

SEQ ID NO: 986851 - protein, 50 aa, Homo sapiens
SKLAGGGRRPVCQCSPKPPPGYLARHTAPPLVSQPHLLTSVQMRSSGPSW

SEQ ID NO: 986852 - protein, 33 aa, Homo sapiens
NDGPQLLPLGLCVAVRATPRLYMSGNTQVSMLV

SEQ ID NO: 986853 - protein, 53 aa, Homo sapiens
MASLNDGPQLNDGPQLLRRLRQESCLNLGGGDCSELEIAPLHSSVGNRLRLCL

SEQ ID NO: 986854 - protein, 40 aa, Homo sapiens
MVLLTGSASELREQSRNHNLWPGMVAHACGPSTLEAEDHR

SEQ ID NO: 986855 - protein, 105 aa, Homo sapiens
MIGPQTTADNSRTWERTQVQYASWSTIPSKWQQTLQNRELTVKRQIESKSKNNINEKTPQKSPFKGQQHAGHGWLTPIIPASTLVGRGRRITCGLEFETRLASYG

SEQ ID NO: 986856 - protein, 89 aa, Homo sapiens
RGPPTMVSADPVFDVWRILKEDMEMKRLNLYQLCVIGQDVGQLLHNSKASNMINSDSDQLTQRWDALVQRRADTLRPRETRGGTTQGPR

SEQ ID NO: 986857 - protein, 80 aa, Homo sapiens
TSFLLVVASAAVLACEPHQAADNRTTQVRRCELLLDWVPPPFQRSSLSVCCPSNITHIAIQAFRVGVSLQVRSPNTSWLE

SEQ ID NO: 986858 - protein, 57 aa, Homo sapiens
ISPERHWMTLMHGSSSPGVSLRIKLMLSVMNCWKKTLCETGLDWDPPGADPDNPPHA

SEQ ID NO: 986859 - protein, 42 aa, Homo sapiens
RGSPRINPYRLGLALLNDIERRWDRGQFGKEWEECEDWNRKK

SEQ ID NO: 986860 - protein, 67 aa, Homo sapiens
LVRFHTVFIPKTEKKKRFNWTYSSTWLGEASESWWEMKGTSYMAVATENEEEAKVEAPDKPIRSRET

SEQ ID NO: 986861 - protein, 118 aa, Homo sapiens
RLVVGNFIAIPAFSAEIGSTPGSTLHGLCPATAPLPHGSRLDRGRLPAVSLHAVLDTSQGRWSTAYCTGGAPVTCHCPALHSCVLSLKDVAECFYRKSEYFPTSGEPTNGHYSSGSHG

SEQ ID NO: 986862 - protein, 44 aa, Homo sapiens
QTPGRFSSCCEACQVKKTELCPPTLGGSLNFLFLVCFTVDKREV

SEQ ID NO: 986863 - protein, 53 aa, Homo sapiens
LFYGENKLTVYARIYLPRNVFEIDTYEQLRELDGKSSHLDTDIISLISKEMGV

SEQ ID NO: 986864 - protein, 54 aa, Homo sapiens
ALWYEQWKESGHQLLRLGLHARRRPDSVLSPTRGPWEKAQRPSALMGKWAHHYG

SEQ ID NO: 986865 - protein, 50 aa, Homo sapiens
CPGYTDVVEEQTDCWFGCGHQGVTHSVMRSGQEEAQPPNNHPTGPTSVLA

SEQ ID NO: 986866 - protein, 155 aa, Homo sapiens
MCAQLEGSGMIWLTAASASRVQAVLLPQPPSSWDYRCEPPHLAKFLLLKKKKNGHMPVVQLLGRLEWEDRWSPGVGGGMELWSHHCTPRGDRVRPSLKKIETIKGNYTEIREHKSTITEMKTLLEGSPIDWGRQKGPYLGQPSERDGSIGAHIME

SEQ ID NO: 986867 - protein, 62 aa, Homo sapiens
LLGLLSLDLAARHMLRVSGSHNHVTRMFTEYLNVLRDKNHPEELRKILIDPKMVELAPDNDL

SEQ ID NO: 986868 - protein, 43 aa, Homo sapiens
MTNHVRTCLDKSSEGETMEYQYEPAIPLLGVYPREMKTYVTQE

SEQ ID NO: 986869 - protein, 101 aa, Homo sapiens
EVCGVTVLGWDVLMREQEVHDAGLTAQPGSVTRKRRWSMEVSAVSFQHFIFLSHSLQKKELEQTKVKYLNEKGHLTSLTARHVAGPRAQRYCVVNWALERS

SEQ ID NO: 986870 - protein, 38 aa, Homo sapiens
RSYKHTLVVPNNNLIYCCSQKDMFFTCDFLPCTLDCNC

SEQ ID NO: 986871 - protein, 69 aa, Homo sapiens
ELPIIQQSSFVVIYPIELTARPQTYSLLTPDRPALSTVSARVNPHRMSIVGLMDQQNVVYAYYRILFRL

SEQ ID NO: 986872 - protein, 51 aa, Homo sapiens
TRNIWEIMKPCCQIYNMEIASKINFLMYKNQENRGRNAEACGLDIQYENTP

SEQ ID NO: 986873 - protein, 185 aa, Homo sapiens
ADTISNTTQIHTEHDIYQTDINHTQPYITTQIYSTHRHRITTQHTDPHHAQTRTDTDTNHTHTRTSGHGCRAHTDDTSNKQDADTQHTQTHTYHHTDTHHTHTPTHHHKNTHHTETHTPITTDTCHTHTHTSPQIPHTDTQSPPITQIPHTHHTDTHHTHITTWMHTTHTSLHHHTDTQHTHTHT

SEQ ID NO: 986874 - protein, 117 aa, Homo sapiens
DGTSLQDVINLTFKGYNNRVEAAKKQHISELQSFASTVRQTPATSPAHKNSKRLNRSCQGFLQNLLPEELATSARNLATRPRNACSPGFLLSRVSHLCRTPLKTGLFNSPGSHFQSP

SEQ ID NO: 986875 - protein, 61 aa, Homo sapiens
ELGPTSHIYIFFESTPYPTLVVYHPYEASSQNAWDAGTYFLFYTLDRLPSPTHSTLFVEVA

SEQ ID NO: 986876 - protein, 74 aa, Homo sapiens
VQFIRVGLVNVLSILEEGDGRCVALQGPFQLMHSTLSLLLNPPSTLKLSVRGYRSFWGRNVPFLPLMGYTTNVF

SEQ ID NO: 986877 - protein, 122 aa, Homo sapiens
MLMGGSPGQQESAYYCSLLISCCLLCRGWSLGSEHAEHTRRTGLWVTSLPAVFPGQVRRTLFITGLPRDARKETVESHFRDAYPTCEVVDVQLCYNVAKLIYLCKEKKKTEKSLTYYTNPQV

SEQ ID NO: 986878 - protein, 140 aa, Homo sapiens
MRSTEYAHFFKSLAWYSLVSLSQLGRRAGLRPYHRRDYGVAFQGRPHLIMYMNMCDGRRMHECHQCQKAFTTSASLVTAQVDIHSGEKPYECSDCGKAFNEPSALRSHARTHLKEKPFDCSQCGNAFRILSDLNIHMRVH

SEQ ID NO: 986879 - protein, 69 aa, Homo sapiens
RYRDGTHYLNPNHWDLSAECTVPGHLCLTFLEESSYIFHMRLYYYIHPHQLVHTEFQLSSHFSHTTFAL

SEQ ID NO: 986880 - protein, 84 aa, Homo sapiens
RATDVGILLSLRIRFTQVRYDSLSPVTGLYRLDCGAVSETQLGFAAMSSHLNRAIMFQKHMIKPSNTAIQGKLSSFHTLVNRYR

SEQ ID NO: 986881 - protein, 57 aa, Homo sapiens
MLVLSPGSLISLEGHDVSDTLAVTVRVQRDSFLRDILGGSRGSSRWYLSVRILEVMV

SEQ ID NO: 986882 - protein, 102 aa, Homo sapiens
SFNLNSDPEEPDGWRAGPVGCSDSAHYIPTLSFVPVTVPAYWQIHMERVKVCPGLTLCAKGCCCHPSDTGTSLITGPIEEIRALLAAIGGIHLLAVEYNLRV

SEQ ID NO: 986883 - protein, 63 aa, Homo sapiens
RGLPRRVYSQLHYLNHHHRDPLTQYSQLHYLNHHHRDPITQYSQLHFFNHHHQDHIPQYNLPV

SEQ ID NO: 986884 - protein, 72 aa, Homo sapiens
LYSIVEVYSTGSLYSTGRLYSTGRLYSTVQVVLHRAGCTPLPSSSWLVGGDLACPRPDFTLIELLWYSPQQF

SEQ ID NO: 986885 - protein, 32 aa, Homo sapiens
MALCAPLTGSVDRAVVSLGADTDAIRREDQSS

SEQ ID NO: 986886 - protein, 128 aa, Homo sapiens
REDNDRQVYSHQVIHVPEKGHDLIPFYGYIVFHGIYVPHFRSPAGNRQEFEVDSMSLLLYCNEHIAACVFIIEQFIFLGVYTQNGITGPNDSSAFSSLRNGHTVFHNELIYTPTDSVKPFLFQYNLPV

SEQ ID NO: 986887 - protein, 49 aa, Homo sapiens
QVLQHRQPLSYWMCFTSASSSLQVSFVANLGLGNIKQKEFWEAQFQLRY

SEQ ID NO: 986888 - protein, 73 aa, Homo sapiens
MRKELPVGLPSKQMPPSFLYERAEPSEPIKPLFFINYPASGMSLQQCENGLIAPQRSPNSSHFPGTTVGVIIQ

SEQ ID NO: 986889 - protein, 35 aa, Homo sapiens
CERGSYCEGGFLLRRRLLTAKAVLTAKAVLTAKRF

SEQ ID NO: 986890 - protein, 87 aa, Homo sapiens
SDGYLQTVPSICCYPGSKVASTFSAAPHSWYQFTVLVCFHTADKDISKTRQFTKERGLLDLQFHVDGGGLTIMVEGKKEQRQCSLTL

SEQ ID NO: 986891 - protein, 53 aa, Homo sapiens
IAVRLINAVTASTPLTIQRRSSQQVTLLSVKPRTPPWQNTEEGNLLAGAALDA

SEQ ID NO: 986892 - protein, 37 aa, Homo sapiens
VGTDCINAASDCINAACWKLKCEGDKSAGHQGAALDG

SEQ ID NO: 986893 - protein, 126 aa, Homo sapiens
TGRLYWFPLCSALARGRGKADSNGGGIPASVASRQAIQLTDLGLYTPTRRNTDADTRLAFGTHTGHVLKKAGQPVRGPGIKGGEWGKGTHPSEGEEEGLGCGRSREMATRTQSSLVPEIPQYNLPV

SEQ ID NO: 986894 - protein, 55 aa, Homo sapiens
FTVLVYVTGTHTSVCSTCVGGFIDLCIYLFRNGLALSPRLEYSGVITVHCSLYLP

SEQ ID NO: 986895 - protein, 40 aa, Homo sapiens
VGPTYQCRLTCISAADHPTPPTASNAAKRDGGGIRIAPLE

SEQ ID NO: 986896 - protein, 98 aa, Homo sapiens
VSAMRRLTLVRRITRVMTVVHPVQFSPGKPGIQNSKIEPPKKQQRERDAAIVPSSPRCTGKSTSGAISTTKQDTVETFYFDTWWISFPKTWLGGHRRA

SEQ ID NO: 986897 - protein, 95 aa, Homo sapiens
DYGGSPWLHVIIAFPTSYKVVITLWIVNLRVCVLKTIFWSEMDMMDPLMYSRKPGGPTAVDRKVLRSICMHTKKRVCSFRGNKIGLKDVITLRRH

SEQ ID NO: 986898 - protein, 37 aa, Homo sapiens
AVKDGDYKRETLVDGDIVVMIGGRTGRDGIQGASGSS

SEQ ID NO: 986899 - protein, 102 aa, Homo sapiens
ACFQPERTTVLIVVHVAEIHMHLVALGFAVCAQRVVTEIYPLRGCTPAAASAAHTPVGVSIPVLRSARFWIAGNLWGQRAAISPRSPSPGLSDRSRLVRAGK

SEQ ID NO: 986900 - protein, 113 aa, Homo sapiens
TTIYDPRLTTAEGWEGDKDKKLQIGCSAYCSGDGSTKISQITTKELTHVTKKPNTTCTPVTYGKIKEEDAALPSLHTLVILRKMKTKKKEAKFDILKFNRTRRLRIQPQNSSR

SEQ ID NO: 986901 - protein, 79 aa, Homo sapiens
DQKGPEGQLQAAQAASACQGRPDKKAELETAGGVCVRLEEHGAWPHPLGNNQGPHPPPEQGPLFEEDTEGRGPRPLSSH

SEQ ID NO: 986902 - protein, 70 aa, Homo sapiens
WVIMTHARTMGAAIPETEQTGPASEDMDIGLINLFHGKQTISLVDVFLTSQQFCSASDFVSSTMSPRVEP

SEQ ID NO: 986903 - protein, 75 aa, Homo sapiens
VRHAGLSHDAGISHDAGMARPLSLHVAAPHGLSRSVADFLDGGSGLSNVQKQNLPGLPKAYTWNWPSMTSAPSIH

SEQ ID NO: 986904 - protein, 82 aa, Homo sapiens
DISKVIQCAYDISQGMPSSWITSTPAEKKQWPLSPHPHLHPRTSLDIGAGPLQTLIPTPTEPLAQVPLVHDTLPGSQVALVT

SEQ ID NO: 986905 - protein, 99 aa, Homo sapiens
WLGPFAELAVVVTCMEDKNSCPKLLNFQTSSTSSAEANKKPSAQQRGKEPMDIPGTLSPCPQPPHRKHVVRTADVNSVLQTPSFRQILGNGLRARSSQA

SEQ ID NO: 986906 - protein, 57 aa, Homo sapiens
KKRASAVYSPPPLMNIAVVVGYLENVIMEYEFQILTEKFLDKCYLEFEDTEENKLTY

SEQ ID NO: 986907 - protein, 53 aa, Homo sapiens
MDTCTQKFWMLAERSITTQCYSHCTSMACGNISMTSHLFKIQKAGGLSYTIRV

SEQ ID NO: 986908 - protein, 110 aa, Homo sapiens
MDKHSVSWMRTTCSSRLVYRSCVVQKLSFLSIPLTGDNTGKQALWECATVEQHSRSVVFHLTPCPAYVHKVKHGGSSCLYDLSTVIFLCSPCSCVLARSLCWMCTVAFLG

SEQ ID NO: 986909 - protein, 62 aa, Homo sapiens
RAPVRAQVSVPTRETQESFRTISLLSPHSSPWVSFCLIHSRRLSSVYRQLLIFISSPDLSKP

SEQ ID NO: 986910 - protein, 92 aa, Homo sapiens
RAGPHPTVSRCANTSGDLVIHFMEEIDKEISEMKLSVNASSLTYPKEMKLKCEQIFIYKYVNCEVISSHGKLETFQISNNGGMCLMTYCTTI

SEQ ID NO: 986911 - protein, 33 aa, Homo sapiens
VATRTAHCFGVIPCFLSYHVILEFGKMAQLLGS

SEQ ID NO: 986912 - protein, 40 aa, Homo sapiens
MLGTGGGQGNKQLIEVCQQVNCGAEQVLPGLVKTMQDIMG

SEQ ID NO: 986913 - protein, 33 aa, Homo sapiens
MPQTPARSPGAAGGFVAVTELIRSNDIVLIGFA

SEQ ID NO: 986914 - protein, 104 aa, Homo sapiens
VYSPEISRPFGHSRISREVRYLTDAAVRTLVRAETSAEFFASPQRYVLGASADQMEAMDRWRAVTGRVLALSPNDEGENPVVGQFTQMSMEPHLSMYRQLAQNF

SEQ ID NO: 986915 - protein, 55 aa, Homo sapiens
CVLGMKALGEIDNFSVIEQMVGTTNEHQPDSETVDIYQQLVSIFINISRSLTDTY

SEQ ID NO: 986916 - protein, 110 aa, Homo sapiens
RIRVVVWVEVETLRGTAVEESWKAPCCALGGCQCLLDGDEEEDCEITHTGTAVTAADIAAKTVFHLPGTVSADTTGADTIGADMIGADAVAQTVSVQPRLVQPQLAKPRL

SEQ ID NO: 986917 - protein, 32 aa, Homo sapiens
KEGRKEGTKEGRKEGKGKGRKEREEDDEEEED

SEQ ID NO: 986918 - protein, 46 aa, Homo sapiens
GSALANDNTSMGVRRALTAGATLPTPENKAAVWEKIFAVDGDVASN

SEQ ID NO: 986919 - protein, 64 aa, Homo sapiens
MSECTEEADDGPDKGKDAEAAEATAYGALKAENNEGGSGRATTAKSSGTRQDSDSSATCSANQV

SEQ ID NO: 986920 - protein, 79 aa, Homo sapiens
KIVKNILEADEEALQAAYDALAVADPFSFGPDTYIPKLAPRLASQYDSKDPGVLVALITMNFLTLQPGEAIYIPADGIH

SEQ ID NO: 986921 - protein, 60 aa, Homo sapiens
LTRYEAREDAADCDRREQQACGDRATTDDDGADRGEEHHGLAEGHRDEVDDEAHADVGRA

SEQ ID NO: 986922 - protein, 78 aa, Homo sapiens
TIAVQQAVGTPARILRRSFLMQMIVTILPAQTMSLVVGVLAGWAINAAIGSTDAKQSFDPTIAVLPVAMWVVSVLAIM

SEQ ID NO: 986923 - protein, 34 aa, Homo sapiens
MPLPLAGSSCARASTRPITFASRRSQSSSVAPAM

SEQ ID NO: 986924 - protein, 36 aa, Homo sapiens
MRRSSRTPASSGVEHSRALTPVAIRTISSMRRRVSD

SEQ ID NO: 986925 - protein, 74 aa, Homo sapiens
LGTAADAALRADENPAPRPAPLHRPGNAQNRLIRLRLLAFPSHDFGVMGNQRPDHIARHFVAHTGPVKETRRRR

SEQ ID NO: 986926 - protein, 41 aa, Homo sapiens
MSEREIMPLYSSLETERGLRSQTNYKNLSLRNKCMGDPLAV

SEQ ID NO: 986927 - protein, 116 aa, Homo sapiens
MNANWQDSSFSIKISKLLPAHIHFLPASTACTHIPLFSNTKPLGSDPAPSFLHDSGAPAILLPTPASPSSPFSKHLSTISTLTSFRIFHLTIKNRPSMVAHTCCPSTLGGQCGQIA

SEQ ID NO: 986928 - protein, 123 aa, Homo sapiens
QDAIKVYCNMETGETSVYAHSVQMWTRRTGSISKNPKEQMRHVWFGVEHDTMCISSIEYGETGLLTLPLCAYQLTFLRLMSTEDSQNIIYHCKGNRVAYMDQQTGNLTEGPVPPGLRRDRDQC

SEQ ID NO: 986929 - protein, 52 aa, Homo sapiens
MKMEAELVPSEVLMHQAIQTIEFCLGCVSNTGSYLRLWALSLAHAQLSGYSV

SEQ ID NO: 986930 - protein, 72 aa, Homo sapiens
RHRQLGVGQAQGPQAQVEAVLETLPRQNSMVLMAWCMSTFGGDVGSASFFDHPWPPCLFLISSSPVQRECCS

SEQ ID NO: 986931 - protein, 68 aa, Homo sapiens
NRESVYHGKVDVQGYWYDATWLLSDEKMLSMSGRKRKSKSTMRYFLMPCQNDYQLKRPVVASIGKDVD

SEQ ID NO: 986932 - protein, 37 aa, Homo sapiens
MDRGVTGTVAVDGTYGWSVGPWFIDVALAAVGPTDNH

SEQ ID NO: 986933 - protein, 66 aa, Homo sapiens
AAAGCWAGRTWLAKSGPTIAGLLGATYLAALGASHGLAKKTGAWPAVITVTAATCTACHFLCDTKA

SEQ ID NO: 986934 - protein, 47 aa, Homo sapiens
LIGQVDTKPYLGAVTRPLAKMAARGLVGLAERSADAVVAATPTVGER

SEQ ID NO: 986935 - protein, 52 aa, Homo sapiens
DPRELQTGKPVRSCCWINQVSNEKAGSSALACERDRDGIWEDTELSVEAQGG

SEQ ID NO: 986936 - protein, 127 aa, Homo sapiens
VFTTAVHASLFEIRRHVSTALPPNIVKLEPAGLLWMILYPTMLACLLVDEYYTTAAHALDKMRRHLSTALDLLKIADLEPGRRVFTTAVQASLCKFRRHVSTALTSKYIYSWSLGDSIGYSTTPACM

SEQ ID NO: 986937 - protein, 53 aa, Homo sapiens
RTKGEGPPKGEGPTKGEGPTKGKGPTKGDGHNKGDGPTKGEGTPKGDGPQKGE

SEQ ID NO: 986938 - protein, 72 aa, Homo sapiens
IDPPTGAITAGGPTSLFPDALNPQLYLTAWYGKPTVETGVPSNIYTLDTTGLTQVTNGKDKARFVLSPGQRY

SEQ ID NO: 986939 - protein, 39 aa, Homo sapiens
IDLTTKNLGCPWREHVGLYTENGNQESLETVSMHHALSQ

SEQ ID NO: 986940 - protein, 42 aa, Homo sapiens
TENEELFWALRGAAESFGVVTNFYLRTQAAPEILTYFQFQWG

SEQ ID NO: 986941 - protein, 35 aa, Homo sapiens
FYDVGVVHSPKRDGLTKLVRIEGANLDRIKRSNIK

SEQ ID NO: 986942 - protein, 49 aa, Homo sapiens
SASAGFTGATVCAKTVSPAPTARASASARVSCAANRSPVSARRSTRTSK

SEQ ID NO: 986943 - protein, 106 aa, Homo sapiens
DHRPQLHAFGQRLQGDLDLHSAGVGRHGGRHFANFALGLDAGVIQQADGDRRIRRRLHQQRLIDVEHRIALAVLGQAENRHGGLHHLAHFRLARSNHTGRVGDQGG

SEQ ID NO: 986944 - protein, 37 aa, Homo sapiens
RGFRAYATALTAVYRLYQWIPPPPCGKRRSVNAVRQG

SEQ ID NO: 986945 - protein, 173 aa, Homo sapiens
SVRRRRRCCSDGVFDVGLMRSGSSSFNIQKPMPEFRYLHVVVKFCIFISKLEVFVFGCTGPSLTEYHYYFHVVGYSETERIVVCMCRVRRKKERNETGSCRSPIKADVYTSETAPPAFSVLAVKPGPIVMFVLFTSNWTWGLGLRQLVSTPPALGPCLRLQPERCGPDPGAVA

SEQ ID NO: 986946 - protein, 33 aa, Homo sapiens
QNESGSVDTSGERVTGLVGDRPAGGQLGCVERI

SEQ ID NO: 986947 - protein, 110 aa, Homo sapiens
LLAGCLRAKDLADLLASIWYFRGSLVHVITHHVTPWTQLHIAVDNHPCQLLLDQPRVVNFLPKLGTISGMIYRLSNDASHGTCRVRRHAKPSIVEDVHGKLEGTMRVSVE

SEQ ID NO: 986948 - protein, 125 aa, Homo sapiens
RFDETLISISMTRSICGQIKSRVSGTLELGAKANGIHQCLLSQTLANEVDDEILKELFSQFGKTLGVHASKHPSGKSKGFGFVSYDNTEDAHKAVESRMNWKRYTWYNHICEAVHTTKVQRLAEL

SEQ ID NO: 986949 - protein, 97 aa, Homo sapiens
GEVIATAVVQGPAVRKKAKEALVVASGYACDAHCFQGHPRLEVPVSIGGSLETSSFPHPSNAEGCGAPTGLSVVYGTTGTDHSGTGCQWPVVNGQEP

SEQ ID NO: 986950 - protein, 97 aa, Homo sapiens
TFDDTHLIDRNIFRVMYGGWYNSRAQLIVHLLQPLYKTFGHYTDVKATLMLQKRYNEAAIRSLTQGLDNVHKQRVAQVLNDPKNIDKQQEPLESPSN

SEQ ID NO: 986951 - protein, 35 aa, Homo sapiens
SCDDYIALSKELDVPVRMRVGTRLWLGDANAYRVT

SEQ ID NO: 986952 - protein, 104 aa, Homo sapiens
MTASRSHTYSLVGQIEEYSERIHVVIINNVVATEETGDEAERGERKGLGDVTHCLITSFCDYKIPPNETCIIFMIENTRKSYLFRLSGVIKCDRMSSFIVWSQL

SEQ ID NO: 986953 - protein, 65 aa, Homo sapiens
MLYGTVACTEVGPPIGLLNKTSPSKVASLRRTPARPPEAFLSRAFNGIPPATIILYFEHYMGLPM

SEQ ID NO: 986954 - protein, 49 aa, Homo sapiens
SIVYINTNNSRLTVIDLAPCDVVCPTPGIRLRLQPCLLPVNSLHPYMAH

SEQ ID NO: 986955 - protein, 63 aa, Homo sapiens
PDRPLQRPLVNTSPLQRYKPSAATYALRSSNPRAMTLSGTSAAALTRDRCSAHPALQRAAKTA

SEQ ID NO: 986956 - protein, 130 aa, Homo sapiens
TTQYAKANAHTDRSGPRRTCSASLQPMSDGWALTPSTDIMSCDMGPDGTPPPRVSLATRYYGKDYISLNVWYLRSFAPAADTVAQITLRFFYATGNAEDFRTYLEGECLELLRKYLEIGKDTLQRADPPK

SEQ ID NO: 986957 - protein, 39 aa, Homo sapiens
GSRFHHPYHQQVAAMLDGMTSPFILSVHSFTPRLASDPA

SEQ ID NO: 986958 - protein, 64 aa, Homo sapiens
VSHWVTVLTAKRFFMTEGDSCCVVAVRRYSEIRDEGELPPGSGAVGREMTKEEELQLRKEKKQQ

SEQ ID NO: 986959 - protein, 48 aa, Homo sapiens
MYITRGSLYVLPSTALTQLTRVIISRFCLVYRARSSLSHGSSRIVLAV

SEQ ID NO: 986960 - protein, 85 aa, Homo sapiens
DYGGSSSASEGLPMGPWVGTTGRTLDTLQSHRGDAQVVLEQQLFPLEGVQVKVTPEASLKAVSVHVRVASEPKNKSLRAGRCNDS

SEQ ID NO: 986961 - protein, 83 aa, Homo sapiens
TSISAVDYGSLANSLHLEDSFTWYNNKLTRVPGGLAEHKYIQVVYLHNNDISVVGSSDFCPPGHNTKKASYSVMILFINPVQY

SEQ ID NO: 986962 - protein, 63 aa, Homo sapiens
LCKRLSTCDVRQEGKTYSTKGALTARREGPPPQQQAPPPPPAVQAPGRNTCIFSSSSSTRRFA

SEQ ID NO: 986963 - protein, 37 aa, Homo sapiens
QVSGGQLGDDLMDRDAYLKLTPSDDHELTTLESVRPR

SEQ ID NO: 986964 - protein, 66 aa, Homo sapiens
VLHHTGEMWRALENAALPCNLAAAFYCNFNDTGNQAVRWKAIKKFYNRLPKFLRKPFAVAVVAPEE

SEQ ID NO: 986965 - protein, 60 aa, Homo sapiens
VADYGGRWLTTGEGGDYGGRWLTTGKVADYGGRWLTTGEGGWLRGKVADYGGRRLWHGVK

SEQ ID NO: 986966 - protein, 49 aa, Homo sapiens
NRHALRRQTHRDLLPTRGADPNASKQSDGRQTVPMTAACSIAGVESSGI

SEQ ID NO: 986967 - protein, 50 aa, Homo sapiens
ADAVVVLEIPITNYDIQTVPVFGRKAPSSWTLCPFEKFPSFFEHFLALFH

SEQ ID NO: 986968 - protein, 40 aa, Homo sapiens
RRNGHPIFNNAQGTDRGFGMPWLFPVLPEELSAAFLCYVE

SEQ ID NO: 986969 - protein, 37 aa, Homo sapiens
PDTRQHEGDGVGGVEGDGVGGVEGTGQGTVTSCRASR

SEQ ID NO: 986970 - protein, 63 aa, Homo sapiens
MIRKKQTKKGNRLVCDGLDACSTSERADALASIFIIQCPLPLHSSGAPCHSHDAVTAWSKQNL

SEQ ID NO: 986971 - protein, 89 aa, Homo sapiens
MAASVSGKEVVDSKGRMCTICYQGLAVSLLVVCVCQRDEETTEEHLGVLISLSLELIPISRDTVEKCCHYTDQDKETPISVQLESLRRT

SEQ ID NO: 986972 - protein, 129 aa, Homo sapiens
PTSPKGNSHILGVEIRCSAFTWHVTGLPGTGDTVWAAGSVGCFVVYRSPEASWTGEKLLAVTFCPIALQVTVRWLLGEKALEHACDDHVPILEGAVGLVGDAEETVTTVPWPQTSKASGVQPLLYPVVL

SEQ ID NO: 986973 - protein, 107 aa, Homo sapiens
DPGPMHSLSCAGSLVDMRGGCGRPSSSQYAYAMHRHDAVCLCRNEVRLLQVTKGRAGTTRCSQSHTRHLSHTLQAVRDTSEPVGTVTACSLSVVPPFLSVRRACLVR

SEQ ID NO: 986974 - protein, 42 aa, Homo sapiens
PDYRQLGVGQAQAPQAQEEAVLETAVPGSNSDRCEMVLGAMS

SEQ ID NO: 986975 - protein, 112 aa, Homo sapiens
TDISQITKTHHFQKTLPLILEFQYLTQCYELTWHDLYIILSATLSPVRRGPYLDPSSGACQYNSSPGSCPAYWCQAVPNQDPTRRSRYAGIPGPSTRHNHHCRLLMLCFPPL

SEQ ID NO: 986976 - protein, 123 aa, Homo sapiens
PVLVPTGVFSRDYYRCHVMVVTRRKTVGPGQGQVALVPRWPSVPGGRVHRLLRKGNYAERVGAGAPVYMAAVLEYLTAEILELAGNAARDNKKTRIIPRHLQLAIRNDEELNKLSGYSGGYRA

SEQ ID NO: 986977 - protein, 50 aa, Homo sapiens
SRSYWTFSERESRFTIRFFTLAASSPIFSSLIYIAFILVQVQVALCLKSQ

SEQ ID NO: 986978 - protein, 61 aa, Homo sapiens
MYQLSYRLEYKLHNIRDFSLIYHCNPRAQNKPAPHYVEYLFVEQFKKTQVTLQITHGVLIH

SEQ ID NO: 986979 - protein, 97 aa, Homo sapiens
GPSGNYSRKLNAQIILPTFIIACVFIRYRCCDTEDYEYMELASGAEVMEGLPEARIHGPEREMGDQRTADLQRAIAGHKEGTSVCYGLIRAWGLYTG

SEQ ID NO: 986980 - protein, 43 aa, Homo sapiens
MSLKIRCNTNLQGFPHHKKEVMLHVLAVDDVEKLKRIQRCCQN

SEQ ID NO: 986981 - protein, 82 aa, Homo sapiens
MPDRNWVRDCMESRAWWLTPVIPALWEAEAGGSQGQEFETSLVNMAKSHLYQKYNKLARHVWQAPAPPLRRLEAGEITEPGR

SEQ ID NO: 986982 - protein, 76 aa, Homo sapiens
GPAVVPLLPAQCLPMPRPQDTSAMCSVRGGLSNGSREECYCGHVFWDQVSTVTQHHVTQQADTWRSTVSALPWTMG

SEQ ID NO: 986983 - protein, 54 aa, Homo sapiens
GASMDPVGLLDSDGLTTRGVWFGFWPGFSLIIVVIGIDGASERASGTALAFVLL

SEQ ID NO: 986984 - protein, 67 aa, Homo sapiens
IRHCRALRGRFHPERMISHDTFRASAHSPSTRHLHPSADDNIKTPAPSVCGGRFHPQSDDNLKIPSE

SEQ ID NO: 986985 - protein, 50 aa, Homo sapiens
DPDALSVVVIGSASRFQVSELPVLPLVSCRRVLVDSWQSTHIGSRPHSIM

SEQ ID NO: 986986 - protein, 108 aa, Homo sapiens
MLEDIRMTGPVVTSYLSGFHTLGSYIIPCDTEYSEGPVVIGHLAPGTDREALIIYPPQVGCVLNLRFTGYGYSILILHGVGVVAGDEGFGWLCIDCDRRDCGPIEASV

SEQ ID NO: 986987 - protein, 79 aa, Homo sapiens
SALESHDNSTGTSLVRTPPWHRGECTPHLQAVRRWREQPRASQAWAATLLLIPGPSCTVFLPWSRSLLGLGSETRGNAS

SEQ ID NO: 986988 - protein, 83 aa, Homo sapiens
YSALFRGAPGCAGVCTQVGGQIPSMAELMNLIYRKPTLLPHGLQHGKRLSCCVSSHGSPLASFHGRSRSPTTVPGSLPAPSSS

SEQ ID NO: 986989 - protein, 38 aa, Homo sapiens
MCIPRGRVSLANVLSSRTCYPRFIEFLHFDRITRSRRG

SEQ ID NO: 986990 - protein, 71 aa, Homo sapiens
MMVILQPSGVSGCGMAAGEDRTLPGGALACGHTQGWVCACCWASSELCGPSLSIPARPCSSLSVLVHLTHL

SEQ ID NO: 986991 - protein, 74 aa, Homo sapiens
PRWSDDHALLEEQSKQQSNEHLAAMFASQANVVGPWIQTKMEEIWAHLLLSLNRDPGRTSSHLEAVCNAASVVL

SEQ ID NO: 986992 - protein, 42 aa, Homo sapiens
SRTCYPCTGTDSRLLVSASQDGKLIIWDSYTTNKVHAIPSAL

SEQ ID NO: 986993 - protein, 38 aa, Homo sapiens
WTLRIPSDVYRQTGLANRVLDGWLLALGDPLGRITRSR

SEQ ID NO: 986994 - protein, 114 aa, Homo sapiens
YKAMKEKTSEFIGKTSGTKPVAHIDHISADTLGSAEFAEEVNLNGSGKLLKIYRLCQSWKNSLQLLFEVLTNWCLQKLSAPFMMPYVSSLFSEERGLLLQEVMLQKIELALRIH

SEQ ID NO: 986995 - protein, 101 aa, Homo sapiens
FEIRASGPACRRRASVANAECICEREGHPAGATDGALGSPHPPVWHEPPQPVINWTVRYLLGISGPSFPPISGLKSPEVVFPALKPLCLGHLCVLPATVIR

SEQ ID NO: 986996 - protein, 47 aa, Homo sapiens
EYYWGGTELCPREPVWLGPRSGLNTVLASALWAPPRLLQPWKALCPS

SEQ ID NO: 986997 - protein, 34 aa, Homo sapiens
VKGGGEDGPLPTTVVSVSLELEATVTHKPRSAHK

SEQ ID NO: 986998 - protein, 119 aa, Homo sapiens
TALRNLVYPGSEWLCNSLMVLAMVGDAAAGSLTDVSMVELGVLESEDERLLYELVVALQLINLWLVVDDAPLILPQVVSWSSRVPCIFNGESPISSILAWIQGLDDIRLGSKLVEKPLI

SEQ ID NO: 986999 - protein, 35 aa, Homo sapiens
RGMKFFSSSADDSSFLLYIDQKEKARVITEEGEEF

SEQ ID NO: 987000 - protein, 55 aa, Homo sapiens
VDRCVWVERGLPGPLVSVVDLVAVVSLAQIVLLVPRSPAGERGSPGPAGPKGSPG

SEQ ID NO: 987001 - protein, 82 aa, Homo sapiens
MTGFRLRQADENKERKNENEEQNLREIRDYIKRPNLTTDWGYLENDVGDMEPQLEKHTSVISSTENFPKPSQDRPQPRFNRT

SEQ ID NO: 987002 - protein, 104 aa, Homo sapiens
MGQMDSLRAEDAAVFYCAVCSNFSCAIFDYWGQGTQVTVSSASPTSPKVFPLSLCSTQPDRNVVIACLVQGFFPQEPLSVTWSESGQGVTARNFPPSQDASGGL

SEQ ID NO: 987003 - protein, 85 aa, Homo sapiens
MSKSCAYLVRHFYFLQKGYTHRQFGHESTPNKGDRVIYNLTHLPYCCFRFPLAGTGPHILYWSRLISNLELLKEAKVEGNKGRRK

SEQ ID NO: 987004 - protein, 41 aa, Homo sapiens
VDVLHAEGNKRWAVWTLQMMVSDGLACTNAHYVVLWCFSCI

SEQ ID NO: 987005 - protein, 79 aa, Homo sapiens
EEGSVVGSYLPLVVSAGAETHATVLKAQFPSVAVEEVGVITLDNLPQFCGPEHETVISMGIADPRRPPSRLIISHQGCL

SEQ ID NO: 987006 - protein, 67 aa, Homo sapiens
SRTYYHDKELTFANTKSSPPAQRPLKEEEDDGAPLVCDLCLSVCAGLTDTHESYSEKGTHEKQRFRQ

SEQ ID NO: 987007 - protein, 47 aa, Homo sapiens
MGDANITTQVPQIQKEIMRVIGTQFTQTEGAPALVPPLLPQGPSDPL

SEQ ID NO: 987008 - protein, 39 aa, Homo sapiens
DRHLHSRDHAVWNIKTISTMKVMQFQAMKRKASSPVHPS

SEQ ID NO: 987009 - protein, 41 aa, Homo sapiens
MPITHILASIGPQSRRSQSMQQPPKPFSQQHTTPTPWRDED

SEQ ID NO: 987010 - protein, 35 aa, Homo sapiens
IIKCLCQGPKLPTYKVLPLTGSKTSASEQASGKDE

SEQ ID NO: 987011 - protein, 101 aa, Homo sapiens
AVLSRHSLQQCRRMVDAALATCSPEEARTVVLELADPSVEVLVSCYMILNPLKPPQRGLYACSAGEDNGAMTKTAVVTGASSGISAVTVPRFNGRWLTVIC

SEQ ID NO: 987012 - protein, 104 aa, Homo sapiens
SGAVAGSRTPIDEARRQNRRIATVVSWVPEATSARSRVSMLVLPPVPMMSRDVSFRPPMCSGSSEDVAAFLSQLTIVSSTFVTSVSSVIIRLVPPSRLDDSSHR

SEQ ID NO: 987013 - protein, 33 aa, Homo sapiens
ETPAACCMLWVTITTVKRSLSSLTRSSMARVEI

SEQ ID NO: 987014 - protein, 56 aa, Homo sapiens
MTADASQIGGREVNFRGSRCGRGAGVRVEHTNHGEGNGLRTVSGGVVDDDLRSDPG

SEQ ID NO: 987015 - protein, 39 aa, Homo sapiens
MSGRGAAGGARGRGGKFKKYTRGGKHNLQSLSLAATGST

SEQ ID NO: 987016 - protein, 97 aa, Homo sapiens
CYLRYVIDPYQLAEFEAYAKVWIPLVEKFGGQHHGYFLPSEGANNIALAMFTFPSLAAYEDYRERSKTDAECIAAFKLAEDNRCILSYERSFFRPVF

SEQ ID NO: 987017 - protein, 97 aa, Homo sapiens
MPRQTDDLECPKPQDIYVPGRMNESNRTYFEASKDSVTSGALVGGQKLPAPPACLPSSALASPIPVLLSLPVSPPHTHTVALCLVLSVPEPPGSDAL

SEQ ID NO: 987018 - protein, 66 aa, Homo sapiens
SRSGGGDIVDAAVKATEPRKAETPPCWCSAHTAKSLALCLILSLEGILPHCVPSLVGNVFGPKDNE

SEQ ID NO: 987019 - protein, 102 aa, Homo sapiens
AGRSGSARDSRVTSPLFHELALSSRLQPWMSTGRARGSNHFPVKTSQKQATTTTTTPFLRFSSRVNVFRKKRIPIIPPHSVCISASRSLLGPLLCPRCSVSH

SEQ ID NO: 987020 - protein, 64 aa, Homo sapiens
IATANQPAIDKEWNDCDEPLLGRGDCMTAEGHWEAALADRTAKQATKDDEDGKEVVPPGYTVVD

SEQ ID NO: 987021 - protein, 42 aa, Homo sapiens
MTQACMHACMLSVFTNAVHASLYKFRQTREHRADLQISLSWS

SEQ ID NO: 987022 - protein, 103 aa, Homo sapiens
MVSNLGAQVDRGESSDLEVQTDGAASASQVAGITGACHHTQLILVFWVEMGFHHVVQAGLQLLTLSDLPTLGSQSAGFTGLATAPGQLNIFLDYGRQVGYSRE

SEQ ID NO: 987023 - protein, 34 aa, Homo sapiens
MYPTWFTFIKTKASLGETLATDIHVKMSSEFRTP

SEQ ID NO: 987024 - protein, 33 aa, Homo sapiens
EWTHPHSMTAGGKEETFLYSPPITVLPTHSCTP

SEQ ID NO: 987025 - protein, 143 aa, Homo sapiens
EQDEEDQEAEEYACVQEADCEDLRGAVWGWPYLLTVSMTVAVTDPNVPGIGVRAFVCPTGDPTRWASDGLYTSRPGAIGLCSGRVRRGWARSTDARSRCYTKMQFSSVPFTSIVSQSRSRMEPSRGWVLPVWHWSCPQMASLE

SEQ ID NO: 987026 - protein, 67 aa, Homo sapiens
MRELPRPALGKFKANSISSLAVQPAGGHRKVVLKLLIKLLTSGYEERGDKTNQGISELNGQFSGMGK

SEQ ID NO: 987027 - protein, 84 aa, Homo sapiens
MITLLTQVDRHGGAVQEPLRQFGERLQTARKARMKDKVGKLTVKMTGVMVVTLLPVLLILTAGPGFLGVIRMLARMKEDIDDLD

SEQ ID NO: 987028 - protein, 37 aa, Homo sapiens
DDVEVMFDPVATDHRWQRQGYLTVESQHPVGKRAYRM

SEQ ID NO: 987029 - protein, 69 aa, Homo sapiens
VAGWNYGFSEEGNLTPDKLHERGIGSYLLSESCRQKGSEKARGVMQPWDAVRTDLSNLAKLTGNEPTGK

SEQ ID NO: 987030 - protein, 45 aa, Homo sapiens
TRRAYDLYAARKAGLRCEAADFLSEYATEDMDLAWNRFDGGVHAG

SEQ ID NO: 987031 - protein, 64 aa, Homo sapiens
IVLGPSLIFWNNSQKWKYKAEGLVWWLKPVIPALWETEVADGLSPGVWDNMVKPHLYKQYNLPV

SEQ ID NO: 987032 - protein, 36 aa, Homo sapiens
PGTLSLTLPGDNNASSKGYGGADALLPDKTVGEGRA

SEQ ID NO: 987033 - protein, 55 aa, Homo sapiens
EEECQRSRYCSTTGRQEIGGTPSAAVDHGHEANSSDHLSELAQQTGELGYQRGLL

SEQ ID NO: 987034 - protein, 51 aa, Homo sapiens
MAQQAIGTAIKNAKAKSGEIVMMDVTNGEVLAMASMPTFDSNKPGKAKESQ

SEQ ID NO: 987035 - protein, 41 aa, Homo sapiens
PIIDIMRCPGNDMSLVHAALRCAGAPTSRCFRRGSESPMPR

SEQ ID NO: 987036 - protein, 34 aa, Homo sapiens
WLQPAGAETFLRLLREGNDNHDGYAAAGRYSVGW

SEQ ID NO: 987037 - protein, 136 aa, Homo sapiens
ITGAPLYQAAQDSAARIPGGRSLGAARPHSLGPGFGSAGYARYGRFGDLSAFSEGGRSVPCLLLVLRDNGLSFLLLELPICHLIHIVAFLRQREVGFHLQHHRFRHIISLYFLPHLQPLLPLFLIRDNHHQYNLPV

SEQ ID NO: 987038 - protein, 42 aa, Homo sapiens
VWRTRGLLKLMLVGILLAIVNQTTGVNTVMYYAPKVLEYAGM

SEQ ID NO: 987039 - protein, 157 aa, Homo sapiens
DVGQLGNRHHLHTAELAGSTMRTGTYRHPPSLTGTYHAPTLIHQYLPVSTLAHQYLLHPPSLTCNYLHPTSLSCAYLKLPSLTCTYLCPPSLTYTYLHPPSLTYTYPHPPSLTCAYLHPPSLTCTYLHPPSLNSTYLCPPLLTSTYLHPPSLTCTYL

SEQ ID NO: 987040 - protein, 40 aa, Homo sapiens
YNHILDRDERLWLEERIEAGQPKPSRAEQKYILQKLNAAE

SEQ ID NO: 987041 - protein, 103 aa, Homo sapiens
GVLGIDELVHVFLFFETRSARSPRLECRISIIVHCSLELLVSRDPGTCHHTWLIFKFFVESGSHCVAQVGLKLLASSDPPSSTSQNPGITSVSHLAQLVQPAG

SEQ ID NO: 987042 - protein, 59 aa, Homo sapiens
SISVPGAKLDRLVLPETSHPARILRGPVHHEQPADPAGTQCLAGKSVTSHGQPTSHGQP

SEQ ID NO: 987043 - protein, 74 aa, Homo sapiens
MIVSFVSYDRMQEENKPINGLLERHSYGRSIKAERSWLHDMKSPYFATLVMVDSLAQEFETRLGDHDITSPCSD

SEQ ID NO: 987044 - protein, 54 aa, Homo sapiens
EERGDVGYAAPREDAACGQSVDLGERRSCRQALGRSSREAELALEWACVTRWRG

SEQ ID NO: 987045 - protein, 39 aa, Homo sapiens
TVSWLMALIGVCLQELHCMGPTALPHKQLWSRLLRPLAV

SEQ ID NO: 987046 - protein, 40 aa, Homo sapiens
HCSITLWNDCERVTQLLSARLQVSSAYLPVSPIYFYNTGW

SEQ ID NO: 987047 - protein, 64 aa, Homo sapiens
QQRGLTWLVTTPDLLICLLGSQSAGITGVSHCSRLTFFIFLKRLNLTVDRGLSPTPDLVDPPAS

SEQ ID NO: 987048 - protein, 49 aa, Homo sapiens
VDPETLCRRLQTDEFQLHTNVNDGTEFGGSIYQRVNKKLGDRYSIYAWH

SEQ ID NO: 987049 - protein, 51 aa, Homo sapiens
TPPPTPPDLNQDFSGFQLLVDAALTLVAKIAIQASEFVRVQIVAGESFIKL

SEQ ID NO: 987050 - protein, 101 aa, Homo sapiens
NVTTHCQSCALENAEDGEQRRGPRGDHLVAYVPCLNDCGPYGQCLLLRRHSYLYASCSCKAGWRGWSCTDNSTAQTVAQQRAATLLLTLSNLMFLAPIAVS

SEQ ID NO: 987051 - protein, 53 aa, Homo sapiens
DTDSKYYKGSLSYLNVTRQGLLAGPPETRWRWPAELTLMQKEELDESHCGHEA

SEQ ID NO: 987052 - protein, 40 aa, Homo sapiens
KADVHKLASQPSLPQDQPAEHIHLVQVDLPVETCGMTFRI

SEQ ID NO: 987053 - protein, 47 aa, Homo sapiens
YRSAFDQRMDPEYSVLLGKDLVVGHYKQSGKAAGESGDIRPLEGLVL

SEQ ID NO: 987054 - protein, 37 aa, Homo sapiens
MIRIHQFQLFYCCVEHRNKDTPDFRLFYFCDRNTDDK

SEQ ID NO: 987055 - protein, 61 aa, Homo sapiens
PTSPTVAAPAYSRALSLATQQRGLGDPGTLRDRWLRVPVMSTTIAPWRADWSMTNGWLWCE

SEQ ID NO: 987056 - protein, 105 aa, Homo sapiens
VGPAYWALGMTCRVKLSYATRRSPSELLPPPMLPVGPSHKLSNIYYCTRDGRRESVPPSIIMSSHKALVSGKPAQSSVVSATEKKAVIPAPPIKRWELSSDQSYL

SEQ ID NO: 987057 - protein, 126 aa, Homo sapiens
VGTCVLGDVSQLPLFFFKKLQNPVSSPTNTEQFWFLQVIGWSNSIFSFIICIFLPFSSFPSFFLLFILILIYICFLKSNFLFPLMDSLFVVPHAPCTSSSAVIFFHSSLLFSQPLLHSSMLSLILL

SEQ ID NO: 987058 - protein, 49 aa, Homo sapiens
MIVKLDYVRIVRSYVVPDIHGTSVNEASYDGHYSSYGWVLVEVSYYLIT

SEQ ID NO: 987059 - protein, 160 aa, Homo sapiens
ESQISSLALSRDVPAISPVCPSTHLYSSVPVPPIVYFMFLFTHLPMCLSHPSLFHVPFYPSLFHVPIHPSLSHVPIQTIVSMCLVHPFLHVPIHRSLSHVAVFPSLRGARPPIPSSMCPSIHLYSMWASHPSLFHVPIHPSLFHVPVQPSLFHVPVHPSL

SEQ ID NO: 987060 - protein, 81 aa, Homo sapiens
GYPPALLPVVQAEFMNSSFNKAVTAEAPGDGHNVRIPQTDGRGLAEKAHLCTEARVGGGGGAVFAKMKAFPFYCPQGGDPG

SEQ ID NO: 987061 - protein, 120 aa, Homo sapiens
WAYVLACETRDASDRSKKIHILEIYPSSILSKVDVNGKAQLCCTFRDFMRIRLWRSGSSILRHVLHRIIVLLYIRSGPFHAVHRQTKYLRWTDAEESPLLGEIDTKDRVRPILAGKKRDS

SEQ ID NO: 987062 - protein, 72 aa, Homo sapiens
MSGYEEKLQSNPLQHLLEDYVQVTKEAADDKSVAKAAQEFFQRLALGDVQALSLWQKYRDQSIEEYTSGLQA

SEQ ID NO: 987063 - protein, 33 aa, Homo sapiens
RTAYWAYWHDLQWKLQLRYQEISKRTQPPPKLP

SEQ ID NO: 987064 - protein, 81 aa, Homo sapiens
GYKTDEYQLHTNVNDGTEWGGSIYQKGNKKYGDRVSSLAWTARRQITRRFENSSHSIRMDPRRRASAKREHTPRLIRFTDT

SEQ ID NO: 987065 - protein, 82 aa, Homo sapiens
VTGRMVRGKHDHGSMRANGNSMGLTVFLMSFFLCTKDISRRNMFLWQLFDSAINLPGDNDRKVFYYLLGGSGKWDEGYDVQG

SEQ ID NO: 987066 - protein, 70 aa, Homo sapiens
LLESLEERCVQSHARGPTMTVTGRVALVDLGRVDHGLGCELLCLAPEAGRVERNILGGCVLMHRGSDCCR

SEQ ID NO: 987067 - protein, 96 aa, Homo sapiens
TVDQSCMKGTHGRSGGGSKPSWEELSLSKSVLSAGHDITGCSHGTHVAITVSHTWGQTQHLDGNAVDSLSAHQRAPYAPHADMLHQPEAVAFLLAS

SEQ ID NO: 987068 - protein, 67 aa, Homo sapiens
AGRVSGLAGRELVGVHRTDPQWENGAYETLVMLETVPRSGEVYTWQVEHPSVTSALTVQWRARSDSA

SEQ ID NO: 987069 - protein, 38 aa, Homo sapiens
FVLTPGGSGSALELVISSGPAADFFPTPDDVVVGFRTP

SEQ ID NO: 987070 - protein, 150 aa, Homo sapiens
HQEVLPRTPNLHLQVRTGNWMLLQAAAPASLPTSSPAAPIATFSLLPVGGAPTVFSFGSSSLKSSATVTGEPPSYSSGSDSSKAGPGPGPSIFSLVPPSKASLAAIPEASPVVPSDASFSFGSSGLKPTLESRPVPSVFAPNITMNCVFP

SEQ ID NO: 987071 - protein, 57 aa, Homo sapiens
VDQSSQQTHVVAADKMEKHVPLESVPPEQTPSHSLPLCCDNIGARGDGVFQTGPTRS

SEQ ID NO: 987072 - protein, 46 aa, Homo sapiens
AQVYRPELDETCLFNTWGAGYKINNLYDGTFVLDEHFRPLWGAFRS

SEQ ID NO: 987073 - protein, 53 aa, Homo sapiens
PTAYKSVSEWQEGGDGDTYHDVSFMTLTHSLPHHYQAMQRAACSSPQVTRRSG

SEQ ID NO: 987074 - protein, 45 aa, Homo sapiens
AYASSTVMRKLLNASLPDYDCHTSRPSTPKLIIGIDTAIETTTRH

SEQ ID NO: 987075 - protein, 46 aa, Homo sapiens
YSSNDDAPGFKNTPTNAPATLEYTASYNANQKYDDKNKWNLGTKVV

SEQ ID NO: 987076 - protein, 78 aa, Homo sapiens
MHHGCELGMHVFPGAPRRGYWEGTFVRRLTQGQLLFLSMFFNRCLYLPFQDLSSNAGPSSRFLLPLACGTHIVGVNEG

SEQ ID NO: 987077 - protein, 151 aa, Homo sapiens
MCSRRRSSCSSSNNASHARDANTIAKVGGSNGVVASIGRGVIPQSSGKLPDFLCGNKIRVCRRVGAPNVMRTDRHVSQAIPDPHRHRIPRSILIAHTGERMSVQLSEGQTFGPRAINVTRTTLVRYAGASGDFNPIHYSDRAAREARMDGV

SEQ ID NO: 987078 - protein, 42 aa, Homo sapiens
SRGRTTNHIRNNEDSRIFSLEKTTRRLQNKMISEESSRGPHK

SEQ ID NO: 987079 - protein, 37 aa, Homo sapiens
LHPGVNHLAEHVGGMLNLLTSTQLRVRTIGLKYRKLN

SEQ ID NO: 987080 - protein, 61 aa, Homo sapiens
QRYIWQQSGSTSEQGDTDRFAVELFIDVTLLGLEKRSQNGFLSGDIIAFTWGGGDDDLDGL

SEQ ID NO: 987081 - protein, 56 aa, Homo sapiens
ICVMEFREDLLELISRQHALVDERARRERSKVHPSFMLGTPPQHERYTFQVHANTT

SEQ ID NO: 987082 - protein, 121 aa, Homo sapiens
ILWLVVGRVQCRSRIEGMIGHTDSVRLPWNHKEVTSAVTSAGMSIHASDSVEGAQREIQLWFQSSELVSWADGGQHSSIHPSLRLKLPLPPHPPRRTNYLRQQEPKPTSKPACPKPLTTHP

SEQ ID NO: 987083 - protein, 77 aa, Homo sapiens
WYCPSSRFSGGLQRKMSACCASPSGSVIDSSAVPQPAHSGVPEEFAQDVISTIGQRFELRFKQYLRNPPKLVTPHDR

SEQ ID NO: 987084 - protein, 48 aa, Homo sapiens
MSTSAVAVGVKPEWVQQKVCQALAGYLREGFVCSGELAKPPAQQLPKR

SEQ ID NO: 987085 - protein, 49 aa, Homo sapiens
MNERGGSQDAIEVEQHGMELLIEGGRVHNPHAIHHVGKGHLDSISRRLL

SEQ ID NO: 987086 - protein, 33 aa, Homo sapiens
VPSRSTSGPGVRTSKPSHGGVIRSRFSASEKNA

SEQ ID NO: 987087 - protein, 128 aa, Homo sapiens
VYLLLLYLALALPCLSALPCLSALPCLSVYLVSLLYLVSSLDQLHITTKISSGTIEILVIVAADQTLVTKCGANEANAVEHSQNFPLFSFVLVIQQVFDNGSIYNPEVLDITEETLHSRFRRGCPAMF

SEQ ID NO: 987088 - protein, 48 aa, Homo sapiens
NQRFYHSREWKSVRDRVILRDEGLDMGHPDYPINGRIYIHHMNPMQPI

SEQ ID NO: 987089 - protein, 49 aa, Homo sapiens
YSDVGSDIIVRISDFLQVRQVTTLGSTLHCLPSMSAQYFVNGVNNRAED

SEQ ID NO: 987090 - protein, 103 aa, Homo sapiens
MELAVIPRLPWKLSVGGSVRRTYPRPMSHRSGTEVASHPVLPGNYSGDSFFIFYFLEMGSHSVAQAGVQWRDLAHCKLCLPGSRHCPASAFQVAGTTGVRQNA

SEQ ID NO: 987091 - protein, 33 aa, Homo sapiens
KDQEGVVVGTNRRRHLRVHQAYVGQHLLHDDAG

SEQ ID NO: 987092 - protein, 105 aa, Homo sapiens
TAGKLQVDGHVALDTSSRVHSAVAELTRYLWRQLQAAAICILGLLIFRSIRSRLTLTTGTSRTIASMRKFKALISIARRSVMMIIAIGSIYRARVIITSGRRPMA

SEQ ID NO: 987093 - protein, 42 aa, Homo sapiens
MLIVIMDESLQSHYGESSMAISYVITCPRQSSKNILGLPNSD

SEQ ID NO: 987094 - protein, 36 aa, Homo sapiens
DEYITPAQKKSNYYGTWQKIVEILILVEVHGIGNSD

SEQ ID NO: 987095 - protein, 78 aa, Homo sapiens
MNGQQARHNLYQKVMALYGISSMLTPKALSLWNYLRKDLRLVTDLETKKSFDPQHQGSAIQIIEEPIQAHYMKDYSSR

SEQ ID NO: 987096 - protein, 60 aa, Homo sapiens
YVRLLMIGHPGWARPDQLCRFTDNEFHYLSTSTTIGVDFKMKTKQVDGIKVVDNRSRDTS

SEQ ID NO: 987097 - protein, 70 aa, Homo sapiens
MIPKGALAVAVAQVCRVVPLVADGICQCLAELLLRQILLDTLLGRMLPQLVCRLVLRCSMDNSAGPREWL

SEQ ID NO: 987098 - protein, 40 aa, Homo sapiens
MEVSHILARVICTQRTHTSHVLARVIARRNSPRTSSHASS

SEQ ID NO: 987099 - protein, 43 aa, Homo sapiens
RSRQLVQDDDMLYWHKHGDGLERPPSPWRYGSLLDTDMLMSEL

SEQ ID NO: 987100 - protein, 43 aa, Homo sapiens
MAEATRRCVERQNSQHFAICRSVSELADGCKSVGLKDRKQMRV

SEQ ID NO: 987101 - protein, 64 aa, Homo sapiens
KTNCWRTCDTCGIDCLAADDLLITKWRHRGHADRPAVCAARPGDTIIVESPVYFGLLQAIEHLG

SEQ ID NO: 987102 - protein, 47 aa, Homo sapiens
MALAPACRSTPCCYNAFIQEQSLGYHYNAVNDLLDYVSNREVFAYEN

SEQ ID NO: 987103 - protein, 38 aa, Homo sapiens
RQCVSDVLLCVDSLRLSAVRRVCAGPRAVCSQFHSSRR

SEQ ID NO: 987104 - protein, 63 aa, Homo sapiens
NAPGRNRTVRCRPNCMAAVQCDRNLLKHSQASAYSCSDSRMSTPYLRTKREIIQFLTAGSRQS

SEQ ID NO: 987105 - protein, 39 aa, Homo sapiens
DIIDLYTRDMSGDLRGPENLRSTEVAEMLNTIGAQTFRS

SEQ ID NO: 987106 - protein, 89 aa, Homo sapiens
PCCAGPRVRHQHGDVPTPSVILPAVRSGSSSSTRCVFYLPLALLQVSLAARFAAPWAGPAWRAAGALGHVVAFVVFALCLVQARRRWQR

SEQ ID NO: 987107 - protein, 58 aa, Homo sapiens
LPVLRHRPTAVFQRAGFGELIAAKNALRAEVYNRYSWVLSRSETAATLYPEMMQQSDR

SEQ ID NO: 987108 - protein, 51 aa, Homo sapiens
GTDFHAVSQGAVSVTAVAVSDLTRTSHACRYGRQMDGGMGGAVVRAWVLEP

SEQ ID NO: 987109 - protein, 51 aa, Homo sapiens
ITHRRQVRSLSASEAKTVALWVADNQLTLLQLDPHPPTLAWHSGTAAMAGE

SEQ ID NO: 987110 - protein, 52 aa, Homo sapiens
SDVPGYSRTPDLAHMEEKKEGNWHGQASGYSEALWGAGSATCTISPFSQNPR

SEQ ID NO: 987111 - protein, 44 aa, Homo sapiens
LEDPLFAPRFQELYQSLLSWPLAWPIVFRVVQMRKVTVRAPLMK

SEQ ID NO: 987112 - protein, 53 aa, Homo sapiens
PVIAEPGLSGTVLVEYRIERSRMQLPLMATQITKDKEMPRLRRVGLSSFDWAE

SEQ ID NO: 987113 - protein, 32 aa, Homo sapiens
MSTLVSPLPVLSRPYAMAAAVGSLMIRSTTAQ

SEQ ID NO: 987114 - protein, 64 aa, Homo sapiens
AARSTPGPLPYHMAKTPSTLRSARTPACWVPMTAVAAMSSLMLGRNEIWLASSAFCAFHIAMST

SEQ ID NO: 987115 - protein, 43 aa, Homo sapiens
LWSDLSDPGMANHARSCEMNRWSAPARPAGRQQISTCALTETS

SEQ ID NO: 987116 - protein, 38 aa, Homo sapiens
GCSEDPRLVGVARAASSSARQARQRGMQGRTFGGGLGD

SEQ ID NO: 987117 - protein, 102 aa, Homo sapiens
MDSRFVTQADVAVASLRLIEGFALPGPRNSLCLIFPSSVEPQAPDTSGHFFFLGILRKKGPPRCKPGLLYSSNLVIRPLQPHKVLQYRELDTEKKPKRVPEL

SEQ ID NO: 987118 - protein, 42 aa, Homo sapiens
SPEYIAFWDKLKRGEYDAGRYRRIHKDGGDVWLQASYNPILD

SEQ ID NO: 987119 - protein, 44 aa, Homo sapiens
SRYPVVFSQLACSQNQVLHSPADVALLQRKSKEVGHVLDAISDY

SEQ ID NO: 987120 - protein, 75 aa, Homo sapiens
ESSTVAVAVRWQLLPQQPQLQQLPLRECQWRVLQHVMWDGPWPPVACLHTLVVNAGGPMGSPRWLYTALLHDSPK

SEQ ID NO: 987121 - protein, 33 aa, Homo sapiens
SEYSRACLSHSPSSDHKLILSSCAAVNFISATY

SEQ ID NO: 987122 - protein, 45 aa, Homo sapiens
PSPKTPGKGGEAASGCRRRACPFTDHAALLLVQAGLGGRQLVIAA

SEQ ID NO: 987123 - protein, 53 aa, Homo sapiens
LQRGRTAWRRREGVVGKLLRRISAARLAGGRVAVGRTDAEQLPGLFLGTEDGR

SEQ ID NO: 987124 - protein, 38 aa, Homo sapiens
AARADYCASRPPLAQNMKIKVFNSPQKDLVKDFKSAID

SEQ ID NO: 987125 - protein, 45 aa, Homo sapiens
SWSSYRVLMFPMEASAPFAGLVTGTRSALLPARRIGRAFLWNSRP

SEQ ID NO: 987126 - protein, 42 aa, Homo sapiens
PRGDLLLHRLGVGDDEAVAFIMSEGLTLTAAIEKPVICWTVF

SEQ ID NO: 987127 - protein, 53 aa, Homo sapiens
GPRQRAFLYCNGLRHTAGGSDGAGCWHLRNRKAGNLLNAQPAVGQVLRGALKA

SEQ ID NO: 987128 - protein, 37 aa, Homo sapiens
MMYQWVANWRVDYKLAASCHVVQLAHSPVSVAYPYLY

SEQ ID NO: 987129 - protein, 58 aa, Homo sapiens
QVGASSQQHADGGHTHGNWGEGAVLSDQDAVDVAEYFTHMPRPDFPPKEKDWPDGKKP

SEQ ID NO: 987130 - protein, 72 aa, Homo sapiens
AAVGPLVATFTDLGHFDFVGADVRHGNVFGRSGGRGSCCCCRFFFRFRRRCSFRCACRFEDHDQFAGFGFIA

SEQ ID NO: 987131 - protein, 30 aa, Homo sapiens
MARDLVEEGVGVALGVVVDVLQLGIDPAVA

SEQ ID NO: 987132 - protein, 135 aa, Homo sapiens
KLCVLWRSFMSADLLSLVVDRRLSLRRRWLGASRMHLCVPSLGALTCVGRKRLDGLRVLELHPDCARAVVRRSRQHHQAIGRRVAADPLDLAHLAAHGLYARDEVVLDVTFTHGGPAEPEWGSTPWRYRSASTWP

SEQ ID NO: 987133 - protein, 34 aa, Homo sapiens
NRAGPGCDGRYFVFGVHVCQHRHAQLALDLGQDL

SEQ ID NO: 987134 - protein, 80 aa, Homo sapiens
RAAAAKCRRRCSCVPFRRPSRAFIHKNLRILRFIAERLPQLFRHHGSDLAVGFNVIAHAVGLAAVPLGVQQRQRRRLRYI

SEQ ID NO: 987135 - protein, 36 aa, Homo sapiens
SVTAWLKSQIDGSAHLQLMCSPLPKAYGLLLQMYLM

SEQ ID NO: 987136 - protein, 40 aa, Homo sapiens
TITGLLRVKNTLQHTDHDIHRGFEAITTQPILPTNDGAEF

SEQ ID NO: 987137 - protein, 57 aa, Homo sapiens
WVAHLLATVSLNEQVEHVRLIGWNVHALYKITVPFHLKELLCATYSYLVTVYDPFKL

SEQ ID NO: 987138 - protein, 47 aa, Homo sapiens
NTIWYTSSLIGVYRDVSFILNLVQFHTKTMTTSVVLRSSNGQAGSTR

SEQ ID NO: 987139 - protein, 38 aa, Homo sapiens
PCTGVCRARGDGATGSVVLGLVLVVLVGLLLGRLRVFG

SEQ ID NO: 987140 - protein, 58 aa, Homo sapiens
YLFVTGIPGASAPRTTRRGRSSEPVAFSEQEIEARVAHIRALMQDDQQEDAVTALHEL

SEQ ID NO: 987141 - protein, 50 aa, Homo sapiens
MSVLGVDDQATFTLVQKCEVNGQNEHPVFAYLKDKLPYPYDDPFSRTTAQ

SEQ ID NO: 987142 - protein, 140 aa, Homo sapiens
LPVTSFLWYSWYAHQAQVAEELAERGRILARALAETSEYNVISGNLTDLRLTINGLVQSDKSIYRIDVVDATGKRAVRVTSESAADAEPHYYEAPIRKQVVWINLFTDNGIPHVSASSDTRPPTLTTEVVGAVRVTMSPA

SEQ ID NO: 987143 - protein, 41 aa, Homo sapiens
ELVRYQAAAAAAAVGLLYHLVLFNLQKPLQFGNLAFQISNA

SEQ ID NO: 987144 - protein, 45 aa, Homo sapiens
AVRIGLWWLLTDGSMTLWTQHILLCTQSGSQQLVVVFEPWGPGTA

SEQ ID NO: 987145 - protein, 48 aa, Homo sapiens
EGGQIACASIVSEIVEMELDGGRADRCGFIVSDIVNVIYRTRSGSIGL

SEQ ID NO: 987146 - protein, 39 aa, Homo sapiens
YLTTRSEEPLQPRQPYRQWIENVRIKLDSIPAQAQGPGQ

SEQ ID NO: 987147 - protein, 44 aa, Homo sapiens
IELGPTFTRAPLGRGRLGQAGDEAAHVVAADGTGLVRRLARGRQ

SEQ ID NO: 987148 - protein, 62 aa, Homo sapiens
RRRGTPYSRRFGLIDGTADVLRAEQGLQLELSGQRRRAPSNGMLLEELEEIPEIGTRLRIGH

SEQ ID NO: 987149 - protein, 119 aa, Homo sapiens
DLRDQSARTRNVRRQRPEHLSQGPRGTFDPKQLLITLNENADLSTFLHESGHFFLEVMADLASQPNAPQQIVDDMATILKWFGIKGDEQVGGSDSGAPLAQQDAEAVSEAIYKEMAADD

SEQ ID NO: 987150 - protein, 30 aa, Homo sapiens
MSRSKRARSSASGLRRQQRIVADDAVVART

SEQ ID NO: 987151 - protein, 44 aa, Homo sapiens
VDRAVAAPVRPGGHSLPPGGGALGQLASIDPRGLDPRLAKTRIV

SEQ ID NO: 987152 - protein, 54 aa, Homo sapiens
QLGTRCMSRIKRQWQSGGGVSGFELLGPGTLVPVLKGIGIHRSRGMHISRTVIH

SEQ ID NO: 987153 - protein, 56 aa, Homo sapiens
LLLGDGATTCFVRFKVFAAADVKVVVANSAGVLRPPCVLNSDYSVTLNPNQDTSPG

SEQ ID NO: 987154 - protein, 65 aa, Homo sapiens
WFGTTTAARGGIDYQYFDDALALAHWCDVLVCAMPGGAGRGIMVNAAVLRELGPGGYLVNVGRGS

SEQ ID NO: 987155 - protein, 55 aa, Homo sapiens
RYLLVKARIASLLSADGAINTEDPKPQLAQAAIQGGECVARQIVHLELGEPLEKF

SEQ ID NO: 987156 - protein, 36 aa, Homo sapiens
SVPGASCAKQVRCSRRFWSMPGLTGQEAVACSACRI

SEQ ID NO: 987157 - protein, 47 aa, Homo sapiens
MAPSWNDRGLTRTMFFCKTDNLKAEQTTDEFDVNQRDTPNDLVEVRT

SEQ ID NO: 987158 - protein, 34 aa, Homo sapiens
ILFWAVCNGHVKMRGGDAPVYGSALNVPQQDGTQ

SEQ ID NO: 987159 - protein, 33 aa, Homo sapiens
CRYPGGVDSAADRLRREHGVAHGFMQAGGHNVG

SEQ ID NO: 987160 - protein, 60 aa, Homo sapiens
GLFGYTPDEIVRLSRRWRRCQRAAGGKRRLKLVCSVSYWSVLYRRRAVYSAAIRLFPQWK

SEQ ID NO: 987161 - protein, 78 aa, Homo sapiens
FLITIILVHMDVLITHLVERHDSCALRATGHLIRLMTKSRNSCDLRSKARTSQRKPLSIKANGTISRSVRPLEMEQYS

SEQ ID NO: 987162 - protein, 39 aa, Homo sapiens
SSVLFFMRGITPLLEHGLATSWPGSLKVDTQSGVALTAQ

SEQ ID NO: 987163 - protein, 56 aa, Homo sapiens
TRIQLDRRPIQHAGRAGDVLFDLLAGDAPAGQHFMAGGDHAVGDRQMAQQAGLLDQ

SEQ ID NO: 987164 - protein, 70 aa, Homo sapiens
GPPSRHDFALIGANVRRRFDGLRHGAIFTGGDAVAHFRQIDKHHIAQQFLRVFGDAYGVNAVYLLNEPTR

SEQ ID NO: 987165 - protein, 51 aa, Homo sapiens
MLGPSYAAAAIATWKRAALGDVLRDLAAIQEVLVLLRRHLRPPGAFIGLRQ

SEQ ID NO: 987166 - protein, 69 aa, Homo sapiens
MDVGFMRLADLLNGDILMPGDAGCAIRQALWCPSPTLSSVGFTSAHTALACGQRPPLFFSLAWTYLNET

SEQ ID NO: 987167 - protein, 98 aa, Homo sapiens
SAGYSLKSLGKTQPASIPCRDASYGYEGVVFHLAVRICLAVTVLFHSSILIVLEDHLLVHELRRIGQVRSSAIHVYSVIGTFKRAVPCCRSFLESTCR

SEQ ID NO: 987168 - protein, 35 aa, Homo sapiens
YHLQPEVLISQRNSAFSLPGGCRNVAIVEHLLDDQ

SEQ ID NO: 987169 - protein, 51 aa, Homo sapiens
ADDARNTRNEISEISGSSRGLQADIDNIKNQRCQVGWPLIGEAEERGELAL

SEQ ID NO: 987170 - protein, 36 aa, Homo sapiens
SSVPDSVVMAEAPPGVETDLIDVGFTDDVNKGGPGL

SEQ ID NO: 987171 - protein, 70 aa, Homo sapiens
PIDMKAKQAQMDQQLAAELSAAFQADSVPRSSVCCARTPGGESSLMSNPISLASCKAVKEGLSDQEHFQV

SEQ ID NO: 987172 - protein, 47 aa, Homo sapiens
LLGVIRSHVGAIRHQAAAHSVVRHSNSSAFHAAYHHASVPHGIKAVS

SEQ ID NO: 987173 - protein, 41 aa, Homo sapiens
LGPSTARRTVWGSSVPPVVMHGTLSGPAQPCAGGMTRGGDS

SEQ ID NO: 987174 - protein, 91 aa, Homo sapiens
RLHDITRVLCPTMKFTRKGYWQVQLDQSGGGQRELTRVQERAVSAICGHRALPIMDAARMDEVRELAERPYGAVTLDSGAEYIDPLVMKVS

SEQ ID NO: 987175 - protein, 100 aa, Homo sapiens
SRGDLVEKAGRLAHLSDYNIQKESPCTCVPSQSGMQIFVKTLTVRTSPFEVEPSDTIENVKAKIPDKEGIPPEQQRLIFAGKQLENGRTLSDYNIQKEST

SEQ ID NO: 987176 - protein, 100 aa, Homo sapiens
VTSRILSVGRALFKDHLSVTLWLLQRVSVLLGCASMEPWEDFTCTGAYPESKTPLATLSKSGNTFRPEVHLLGGAVGRKLALNQLVTLTCLATRLQPQGR

SEQ ID NO: 987177 - protein, 118 aa, Homo sapiens
VDEMSDISAAPTGPHLYKLLLQPTTNPHTSDRHEALLHGDVGKPSEPASEEGSESEGSESSGRSCRNERSIQEKLQVLMAEGLLPAVKVFLDWLRTNPDLIIVCAQSSQSLWNRLSVL

SEQ ID NO: 987178 - protein, 132 aa, Homo sapiens
TLEDLIDLTGLRSCNARHAVRSPAQVETAMRRSSGEPTWRPVREWLRDDLENGKETLQRRDAPKTHTHHAVSDHEATLRCQALSFYPAEITLTWQRDGEDPDPGHGARGDQACREWDLPRSGRPVVGTFLLG

SEQ ID NO: 987179 - protein, 34 aa, Homo sapiens
NLWGWLSPKAGEREDADRASPKGTDAELVHTHSM

SEQ ID NO: 987180 - protein, 68 aa, Homo sapiens
SDPAGRIHSTIRPGLIGERITSRVESQALTTDWLYYPNLVAGKTRLQLASPHRTNESRGQPTQLSAVH

SEQ ID NO: 987181 - protein, 127 aa, Homo sapiens
VIWTGVWLRGQVHFHYPIPLVSPDLSARANSTKFSLFAGGMLRVHLDIQVGEHANDYAEIAAKRHVDVRCRYDVRQLVEQVEQIQKEQNYQRWREERFRQTSESTNQRVLWWSILQTLILVAIGVWV

SEQ ID NO: 987182 - protein, 122 aa, Homo sapiens
NLDSDLTGHFLVHVFTLAYYEYSLNAVDYTTKIQSTTWYSIMYEWCTEIRIYHVRLVCYQVHTINSIFLIIFNHSHLGYVNHSSTWTLTALQQYNLPVEYNLPVEYNLPDEIQPAGEVHPAD

SEQ ID NO: 987183 - protein, 50 aa, Homo sapiens
QHIKYKIAGMWYFLYPCYSGAKVQSHLNQEDETAVRSHHCTPAWATAKLS

SEQ ID NO: 987184 - protein, 75 aa, Homo sapiens
KLVDLLLIHEVLNPCVLDAFPCSQHIVGRLNARAKLKGFLASAGNTFSSFIPTIKRRKDDYFKALPGQLKPFENL

SEQ ID NO: 987185 - protein, 119 aa, Homo sapiens
GPRQVVLVTETRKGLMCKRMPGRQAPQTVCLFYDKNYLDFAGWKNSKCHFLAIWNYCRVCIGVKRHCRSKIRHLGFRSGVSWRGFKFLRTQAKGARRRNGRWKVAHQCKQANPEYNLPV

SEQ ID NO: 987186 - protein, 73 aa, Homo sapiens
GSHSYLIGLAQALQEQKVAQAHAFQDVTLEPLSGKVRQSYWPLTKTMGPRAREAFESTMLQPRKQAQCLCFPH

SEQ ID NO: 987187 - protein, 83 aa, Homo sapiens
MTDQHLELCPKPKQETTTSKSTSGLTDKHGAPVDSDLSDEDQTPFSRYPTTTNNSLLDLDDLTVTGQRLVTVMNLKITGSDAL

SEQ ID NO: 987188 - protein, 68 aa, Homo sapiens
MAWAYSSLRGAHLLVMYGIVYNPPVLRDAHCIQPYLARRPKLQLSVYTTNEFPPWLLRNNIRPGKRMA

SEQ ID NO: 987189 - protein, 86 aa, Homo sapiens
QDLNSILTSTSQDVRHAWTPPAVHPRCPGDPSKSTHNYSAKDSILRRPGRMFTCRRPALGGLLNSPQPFPRFQASPQACHHAFFTF

SEQ ID NO: 987190 - protein, 76 aa, Homo sapiens
TLSGYCHIACPACAQLQSWGQDSHPQGPTGEALCRSWAMSHVTDIIALVMGTPYNSTVLRSIFIKWSTSGPPLIRG

SEQ ID NO: 987191 - protein, 37 aa, Homo sapiens
RGSLQHPNQRHRIPEQRHRIPRGCAWTADAQRQRCVY

SEQ ID NO: 987192 - protein, 69 aa, Homo sapiens
WAAEAATRKQRITDTESPYQELQGQRSDFYSDLNTQRPYYQGARIMTVRNIITVIQALPKPISQGGRGS

SEQ ID NO: 987193 - protein, 78 aa, Homo sapiens
MVVVVVAVVTVEAGGGGIIINNIMVAVVAAAAVVVCHTGVQRALGSHSPMVEIVHTPLYWPTLTMCASPVCSRRVLSH

SEQ ID NO: 987194 - protein, 154 aa, Homo sapiens
RISWQMLARGCGAIPGCQMLISAVWVLFHVIRCSPGGVCAVPGRLMLSWGCGLLSHVVGCSPGDCGVLPQSVILSAGFVVIASRLLDCSPGVVGAVRRLSVVPAVVVGAAPGPRILSWECGCCSMLSNSHLGVQGAVPGCQILTWRCGLCSTLR

SEQ ID NO: 987195 - protein, 87 aa, Homo sapiens
IELGPAEQLADLTLVFGTAPGCQMLAWGCGRCSRLSDVHLWLWVLLQTIRCSTGGVGAAPGCRMLTWVCRVLFQAVRDSPEGVGAAP

SEQ ID NO: 987196 - protein, 54 aa, Homo sapiens
HTSDALVMNYGGSLFCFGKDFDKVDSFLGLVQCRSVVVSCGFYVPKYHPVTRPI

SEQ ID NO: 987197 - protein, 54 aa, Homo sapiens
PACDVKALSQQNVSIDLATFMKLRTDAVLPLTVADCAETSWDPTLEGLEGGVSG

SEQ ID NO: 987198 - protein, 115 aa, Homo sapiens
SGSYCIPSQGYYSSISIRQLTAFCGMKLLEYCPSCVPRAGLLSRADAWGISTKSTCFQNPFIAQCSCYHTSHSRTEHSCSLPLSAGLVSLAGPSASRYRSHSYPRTYTTVHSWFQ

SEQ ID NO: 987199 - protein, 81 aa, Homo sapiens
MVHYVGLSVIILVLILCYVHVKQLGQIEVHVLVAKAEEPVANVGLSPGSLELYRYEMAMEMSNSFDSNSLSSQDCLAELFC

SEQ ID NO: 987200 - protein, 136 aa, Homo sapiens
ESRGSLLELRSPRLSCYIDWFTPAVVMLCVVKSGAVTTGVSETVFLPREDHLFRKFHYLPFLPSTEDVYDCRVEHWGLDEPLLKHWEFDAPSPLPETTENVVCALGLTVGLVGIIIGTIFIIKGLRKSNAAIPQGV

SEQ ID NO: 987201 - protein, 40 aa, Homo sapiens
FWDDADDSTGRGTTFYQEYETFYGEHRLLVQQAEILRLAK

SEQ ID NO: 987202 - protein, 167 aa, Homo sapiens
VLITALLVEPEGSRRKHNSTPYFVHQVMRLLEELSLKLPTNVVEASARASVSVLGDILGSAMQHTQNLLQMPYGCGEQNMVLFAPHIYVLDYLNETQQLHSRGQVRRPLAISTLDTKRQLHYKHYDGSYSTYGERYGRNQEKPWLTAFVLQTLAQARTYIFIDAAHI

SEQ ID NO: 987203 - protein, 92 aa, Homo sapiens
PPGALASSGADPVDLASFGEFLSCIIVGCDDSSMEASQLIISSAFATRPSLYFMSVWLLGVRVHDCYQFILMFTWPRYGQKDSLQAGFWVLL

SEQ ID NO: 987204 - protein, 108 aa, Homo sapiens
MGTAEALALILQRCRRAPEAERRRSPPESYTAETSVTGEDPNCVDTRAQGPGKGHFACLQGMACLRKLLPHCRFRSNNSFLTEEEGGRDIIPIRHSRKLGPTGAFGGR

SEQ ID NO: 987205 - protein, 44 aa, Homo sapiens
MSQTLLVIRRLSAVLKTQLMRRIIGVVFQCLDWKNPSVNGRRTS

SEQ ID NO: 987206 - protein, 33 aa, Homo sapiens
DAGPPLMPWWGEVACVGLLPFVEFPIIIERLGW

SEQ ID NO: 987207 - protein, 75 aa, Homo sapiens
LCLGCDADRAWMKIVSGRGNHLGSGGRPARPSCHGSCTCTVFTWSRVCGARWCPKQDFWKALELFVTERLVQVLI

SEQ ID NO: 987208 - protein, 68 aa, Homo sapiens
PWCPLVAFGPTQHPPATLGPTQHPPDEAFGPPSTRLMSLWVPRHPPASLGPARHPPASLAPTRHPPDE

SEQ ID NO: 987209 - protein, 37 aa, Homo sapiens
MSWSHHGYVDIGRRIVGDMRHAVCAFNLRGIADVDPT

SEQ ID NO: 987210 - protein, 149 aa, Homo sapiens
KPGRMSSWGCGVFGLGLVLAACAPVGPLSVYMLHSPCWDQPQCWAFWGMGQRVRCLVWLMYTPCIVEPSTDPAGLKVLGKLAGPEWLVEHTSGCGHGLELGVGAAGKAGICARIWTVVLLLLQPDLPCLLLLLQALDGQVPLHLQVPLL

SEQ ID NO: 987211 - protein, 39 aa, Homo sapiens
RYRFSPASDRSAACTMTRVNIITGLGPVLQIAEGCAQSG

SEQ ID NO: 987212 - protein, 57 aa, Homo sapiens
MWYGSEYGNKRLGAHAASNAGGVRCSGCVMAVPYSKDIHAVPAHFNAGGGQALPLYR

SEQ ID NO: 987213 - protein, 83 aa, Homo sapiens
IELGTSVMRAELAVRTAGLRAVSASIRRSMSPPGSSRPSCGERALPGLAGVVAVRLHQLRIAVPAGARDLDEHGRECSRDAVT

SEQ ID NO: 987214 - protein, 72 aa, Homo sapiens
MQIGLYSAIPYVAAAVFMLGFCAQLRRLRERRWHTLVPALLAGVALCIATAAPTQFALSLTAITLATGFMWA

SEQ ID NO: 987215 - protein, 53 aa, Homo sapiens
RCGWPSFGSCLQMVRHTSRGGDAVVAQADAGAAQHVLVAAAAQVFRQAGPQQH

SEQ ID NO: 987216 - protein, 60 aa, Homo sapiens
ELGTLIDLVLQRRERSSWRSRDTVEHLVADVSACSLLTASAILSLFWLVQVFALVHGVFD

SEQ ID NO: 987217 - protein, 54 aa, Homo sapiens
MSWYRMRVRQVAVAAVVLDQFDAADWRRLGDEPGDAGAVAEFDAGARAALGQRD

SEQ ID NO: 987218 - protein, 37 aa, Homo sapiens
RIELGTYTIAPPGISCRALLRYSSENDLFTAPALKTA

SEQ ID NO: 987219 - protein, 37 aa, Homo sapiens
MDSKLLDYYNHELVYLREMGAEFAEQYPEGSRCRLGM

SEQ ID NO: 987220 - protein, 73 aa, Homo sapiens
VSTCAHDVDRELVAVQACSRIGEYTSTRVHLNDIWRVEQGAQVIDGSCSKEACTASGEYTSTMEACMHDRGTA

SEQ ID NO: 987221 - protein, 37 aa, Homo sapiens
SWYLDVLALLEATSMEFEHIKCPHSKYGCTFIGNHGH

SEQ ID NO: 987222 - protein, 38 aa, Homo sapiens
IDVRKRREWRRVRLYHGPALQPARCAPMLPMLFVHAGV

SEQ ID NO: 987223 - protein, 68 aa, Homo sapiens
SRCMCAGPEGSAGGVDEQRARRCCDAACSSASQSSPSSVRATGTTLQPGQAQHLQQVGVGRLLDQHGI

SEQ ID NO: 987224 - protein, 56 aa, Homo sapiens
GPPTRRTDRGGRAAGFSAPKTSASWLGYNYRLFDPLPVHGGRWVRLAGAPAGRRGL

SEQ ID NO: 987225 - protein, 54 aa, Homo sapiens
PSQPAACRRGRFTFSAWVRADQPAGEQLVSPAAMAGNALLIGINQGVPFVEVNG

SEQ ID NO: 987226 - protein, 88 aa, Homo sapiens
MGSPGITPEVGATMHARDVSHCDAFFGQVAQIQRFPTDLSCSYLVLHSGVELLRSFLSPDVESMSYRGVHANWTKYVLADFALGTGSL

SEQ ID NO: 987227 - protein, 44 aa, Homo sapiens
AAMGVVGGEEQGVGSVDVVGQAFGLVGQPEHVAQFRQSRCCTDL

SEQ ID NO: 987228 - protein, 43 aa, Homo sapiens
TRAVIVELGAVDDARDDLAHVIRLARVGGDDAVQLGRVVARLA

SEQ ID NO: 987229 - protein, 61 aa, Homo sapiens
VLGPPRRSVFAESQPQAAAEKIGILLAGSVGAIRMTISPPRPILTFLLICFSLNIGAVLIS

SEQ ID NO: 987230 - protein, 46 aa, Homo sapiens
MRARYRPPGGIGSYYCTPRDTSSSRTFGQSDPAGDHTERVSCTIHV

SEQ ID NO: 987231 - protein, 92 aa, Homo sapiens
LEDDGKPMIKEAMEEAVVESMMVHRHISKTDGPHTHSPSMSGLHSTFLAMDTEEGVEVWVVNDAPFRYHGKCLRGATSERIQTCVRAAVCWL

SEQ ID NO: 987232 - protein, 81 aa, Homo sapiens
MTGSAVHGGSSLIAFAKPISFISLMSAFLRCRGTGGSVPCWFLMQALTVVCSSLYTSMDLCCSGNVDHTLGPEAPTCSPGG

SEQ ID NO: 987233 - protein, 103 aa, Homo sapiens
LIAGSPLRQRPSQLFTVHSADPPAPCSHSLIRFIAVLTNPQGDYDMSTGKFTCKVPGLYYFVYHALHTANLCVLLYRTGFEVVTFCGHTSNTNQVNSGGVLLT

SEQ ID NO: 987234 - protein, 71 aa, Homo sapiens
RLIQDPMESKAQDADRCAEKAGFHLKADEDLVSPSCCTLHMYLYSSPKCTITGDHFWSVPYPAGLALHNLR

SEQ ID NO: 987235 - protein, 93 aa, Homo sapiens
MVISRYLPGFSNHVNIIHVSVAVAVVGPWQVEDHLPEICIHLPLTQITLALQPACSAYTTEHSLDIMVGVCGTVHIWVLHRELSMLLSPSDVY

SEQ ID NO: 987236 - protein, 68 aa, Homo sapiens
ALLVISYRIPCQIMRQEQMMQNTVFLDCQGVFLGHASIWVLSETCIWSLLAVGARYTVNPARLPTLLS

SEQ ID NO: 987237 - protein, 41 aa, Homo sapiens
GRERPITLPFSVQAGDMHLFSNLDRDPSTDNHAPTTIIHEA

SEQ ID NO: 987238 - protein, 79 aa, Homo sapiens
GLSTLAVHVCSGEPRGHHATVSRRVHSIVFWVAVMACTVVMSPSTIPKLSLDDLGPRVVLKQLGGARECHCLMIFEAVV

SEQ ID NO: 987239 - protein, 52 aa, Homo sapiens
REGVIYISLYAGFIDLVSRVTAVSGAILINPGVSIALVTLTDILAKRLITSC

SEQ ID NO: 987240 - protein, 41 aa, Homo sapiens
VLPARLISNYVATAHAGSGALGPRRASAAVDALYHSAFPSL

SEQ ID NO: 987241 - protein, 40 aa, Homo sapiens
LSKLQAAAETPTSTFHPGKSTGTEPPAPVPYQNYYDREVT

SEQ ID NO: 987242 - protein, 54 aa, Homo sapiens
WLHTLQEVVAEALVGLAGNVGPYGSGDSAPLNEAMAVLQHHDASQRAPLCQSCS

SEQ ID NO: 987243 - protein, 38 aa, Homo sapiens
PFPPVRRDEKVERHEIDSPKESYGPWYSNPTRKAMNWI

SEQ ID NO: 987244 - protein, 34 aa, Homo sapiens
MLIHQVIQISDFTPSTTDTLRSNQSPTSQTPFHT

SEQ ID NO: 987245 - protein, 137 aa, Homo sapiens
SFPHKDTFRLELSVKMMLSTLWFSSHEQFYQIPSTFSESEEKESHFVMAQIPGQYPWDRGTCLVIINVLVCLCELNQEAVWMDVDVSHPQYIHPFGAPQRISHPLHLTSWRTFMKNPVLYCSIAVCLRFRCDVPSFS

SEQ ID NO: 987246 - protein, 104 aa, Homo sapiens
GDWPTVAYYYFSQLGTFPRSRRTLIDGASCMLDAICLLSPINIPEYTEPANVNNRYLRTIASMCKLKALDISIARMIVSCMIIATLASITIGARAYNYSQSRQS

SEQ ID NO: 987247 - protein, 76 aa, Homo sapiens
RFSVRVELNEVSVNGAGFPVVLIQTSRDEYRRHLRTMSNTTGGPPVRHMGGDWCFLDEKITEDNFCFNGFTNAGNI

SEQ ID NO: 987248 - protein, 109 aa, Homo sapiens
MLRVPVSIFIPAKINLLYLVVVVFTGISMVPIYLPVDTALFKGRDLESPCARLIREDIMDLPELFIECGGSSFCGCVLLSIVHLQVPVDEVTLSKTNHFHARKTEDYFP

SEQ ID NO: 987249 - protein, 74 aa, Homo sapiens
MALTVETTGQCGAPDDLIFATAHPSDLSPNAITVLQPQLEPCEAMARKCVLWSPWEAGGWVQLDYDPLPPDPSS

SEQ ID NO: 987250 - protein, 192 aa, Homo sapiens
TAVQLHPVGDSVEDPGLSKLGSMWMQILARTVGDVRRDWQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDE

SEQ ID NO: 987251 - protein, 131 aa, Homo sapiens
HRTMLCPQKCGRLHPPCRACYGSPYAAPALRMAPASPAPEVWAGHPPQMRMVTGDILTDITGHNVYEYMLFISDRLRMNRYGSITFGNAMKYTSASFGTKAPPMVRKIAVRRAAQVFYNNKGYHSMPTYLN

SEQ ID NO: 987252 - protein, 56 aa, Homo sapiens
MARPNISFNNGCFKRGPALLTDTMGVKQQFSTFGHELVRGAIADATTQEISTAMNG

SEQ ID NO: 987253 - protein, 37 aa, Homo sapiens
TTLKTKPESLVAEGKKAALIPKEFTLDKQTTEYTIDQ

SEQ ID NO: 987254 - protein, 41 aa, Homo sapiens
AIKGSPVKLTATGAKAFAGFYRAGEPMNPLSTNLTLSAEKV

SEQ ID NO: 987255 - protein, 59 aa, Homo sapiens
LFDQVDVRQRLGLEGPPMMQELGLEEAAIVSMRLGLGEVNLSKVQWPGGEGCGGEELVS

SEQ ID NO: 987256 - protein, 92 aa, Homo sapiens
MVAGWYAVRDKIKPDLLDNVVPSDEGMYTMQTHILYTGGTLGMVSTPDGLAPGADLTGWLTQLLSGTELAGAFETQSFEHLIDSANATPDDW

SEQ ID NO: 987257 - protein, 80 aa, Homo sapiens
SIRHVAEYLKLANSADKQQAARIKQVFEKKNQKSAQTILQLQKKLEHYHRKLREVEQNGIPRQPKDVFRDMHQGLKDVGA

SEQ ID NO: 987258 - protein, 89 aa, Homo sapiens
MPRLTTSSSSKKNRGVVEQARTLAEEELSACQKSLVLLPQFGRTKLIYLSHSGSWAGTRRVIKVLCEVHCWEPLEHRYKRSPEVFAGGK

SEQ ID NO: 987259 - protein, 36 aa, Homo sapiens
HLRPPSSWDYRHASPHLANFLVKTGLRYVAQTGPRI

SEQ ID NO: 987260 - protein, 99 aa, Homo sapiens
EDPFTKSAVYDRGIGQDSAEADYERWFWTDLSKRSLSFDKPQSLAEKDEFEHKRKELEQVCNPIISGLYQGAGGPGPGGFGAQGPKGGSGSGPTIEEVD

SEQ ID NO: 987261 - protein, 104 aa, Homo sapiens
MFPPIQKCFHVHLWETHDSHYFSPLTLKLVKIQKGGELSLVGPFPGLNMKSYAGFLTVNKTYNSNLFFWFFPAQIQHEDAPVVLWLQDGPGCSSMYGLFVEHGP

SEQ ID NO: 987262 - protein, 51 aa, Homo sapiens
SLPQAPKVLGLQCVSHHVWPYCSTLKDWCLFLGQLSSHQTVGAVDTLGEGW

SEQ ID NO: 987263 - protein, 37 aa, Homo sapiens
RYPVYGEGIITAAPSRREGVTAIASTSAESMPPDRPT

SEQ ID NO: 987264 - protein, 39 aa, Homo sapiens
PKSRELGRIGHVLHVEQHCIGVIGQDHIALDVERGGAAV

SEQ ID NO: 987265 - protein, 32 aa, Homo sapiens
MDDWQIDPIALHIVTPPGRRRPARVQALIEYL

SEQ ID NO: 987266 - protein, 43 aa, Homo sapiens
RYRCVSARLTLVSIRTSRHFGPKWLSISPRVVGVSSTVSCSQA

SEQ ID NO: 987267 - protein, 42 aa, Homo sapiens
DRANVNRSLAEGGAGCSGLSADLARPMPEMGEKVDFHLLLLT

SEQ ID NO: 987268 - protein, 40 aa, Homo sapiens
TITAGGYAVRGINPAIVINEDGGMIKHWRRNAALKAMPLI

SEQ ID NO: 987269 - protein, 37 aa, Homo sapiens
MRVAREVPIQSRFGYANGRRQFRCGNAADFHRWIQAL

SEQ ID NO: 987270 - protein, 94 aa, Homo sapiens
SQQRPKNSRFTDSLHYAPGKPTDTQCLALRAAVWDGPCGATVEKLLKALGAHPSHQCGLDVRQGVKGDYFRALRFNDCPAGFWICLGPGVPFFW

SEQ ID NO: 987271 - protein, 71 aa, Homo sapiens
RLVHGGGCSVDGLVSSSETLLGLHVSTLLQVQPCLLSAHGTVQQGTETHLFTGQNSRFEGTMKLRYASSSP

SEQ ID NO: 987272 - protein, 87 aa, Homo sapiens
MVPILNGNVSAANAKIILQCCTSCYETLYLRLATLSEMLGPAGAGSYQTLRYSPCRNTVLRVGYGRSPGLACATSSVPPAGTDVIKN

SEQ ID NO: 987273 - protein, 98 aa, Homo sapiens
AACSPTLEDPLCEHPSRAVNPPGDKALFLWNWTYLYRGCTRSVPTGGDVNISRLRLGTRAQAGPTLVERPRLGAKPGPLAEVKGGLKNDVELKRHSYR

SEQ ID NO: 987274 - protein, 113 aa, Homo sapiens
RRGIKRSEDSKVSKCTPMDPGLRPLRALSFQEKVSCFEGGQGMPGVGSVPFLSDLEKKGPTMGLGATLVLWFFAGLVLRGWEDRLLIFFPKRPPASRAFWRKPTNWRTGSLRK

SEQ ID NO: 987275 - protein, 36 aa, Homo sapiens
IPDQPQGCYYIITQKYLAVSTAVTEVSLRDNRFLAV

SEQ ID NO: 987276 - protein, 44 aa, Homo sapiens
SAMFVTCKNWETNPGTAWEIITTKPQIHDNSQRYHCRQITLFSI

SEQ ID NO: 987277 - protein, 67 aa, Homo sapiens
MSPSYVLYDHLFLYVTTKSFDAHYNNLSSSIEEHRGIHILTITRVYSNSSWKELTDITLWVRLIFHN

SEQ ID NO: 987278 - protein, 77 aa, Homo sapiens
MLAGRLYRYPRVSPVSQAGLKLLGSSATARLRPPDSAWDYSAEAIVIPLCDSITQLVSHLGGLQVSLDHGLPALLEF

SEQ ID NO: 987279 - protein, 118 aa, Homo sapiens
CLLVVSRRSPFAMFPPHLKTQLMYVHYINRLVEVTISVVTIVKMQKYAFDKIQHGFRMKNPQQTKNRGHFLVVKNMFNKYLLFTSLLYSETLEAFSLYQKQGNDVPSPNFFSSLQLTS

SEQ ID NO: 987280 - protein, 119 aa, Homo sapiens
FKDPQTVDRLGSVMIVKEMPSADSGPRQVASKQCHPWAEDLVEPIKKHEVPAKSDVYCEVCEFLVKEVTNLIDNNKTEKEILDAFDKMCSKLPKSLSEECQEVVDTYGSSILSILLEEV

SEQ ID NO: 987281 - protein, 109 aa, Homo sapiens
MSENTPGFSSSHSQGRSSTLTLRVHPGLIHQGMPPKYFSTSPPFAHLHCLCASAPAGGLQGFPISSAPARLGPRPSVHPPHLSHLAHHAPAPPSSFCFFPSLWAFAHAC

SEQ ID NO: 987282 - protein, 82 aa, Homo sapiens
YEIPLVSEDNDYWYGQAAGARVGDEYRFVLMNGGQVISRIDPYARHVTNSIGNGIITDPNSYDWEGDDFTAPPTNELVIYEM

SEQ ID NO: 987283 - protein, 32 aa, Homo sapiens
VKTLEQVLGVTLLVRTTRNLALTESGSQLYEE

SEQ ID NO: 987284 - protein, 46 aa, Homo sapiens
MHTLLDAERVGPAYTEDGMLLARRKTREALAAIAARIRPGMLEEDA

SEQ ID NO: 987285 - protein, 78 aa, Homo sapiens
QEDRVQRVNAIAIEQLRRLSGQQTRVFPGRRVPMGRRKHRQKRQNRIDGMARGRDGAATAARTRTRLTHCLGESPEDP

SEQ ID NO: 987286 - protein, 177 aa, Homo sapiens
AAGQTWVFYGCQGVQAFQVICTDQKVLGTCSDNLKHLILELLSATGGVREPQGFLVAGGVADRERSELLSDAERLPMAGGDLVKDRLPPAVRGVRDLERRRIASGERLPERLRGNSGVRDLKRRRIAGGVRDLKRRRVTGEVRERDLLRVTGDVRDRNLLRVTGDVLDLDLLDRRSQ

SEQ ID NO: 987287 - protein, 41 aa, Homo sapiens
QEVDTDEENQDEEETTNSRLAHIRTLASTLRVDRRTLDPNK

SEQ ID NO: 987288 - protein, 136 aa, Homo sapiens
DIHARYARSYVVGVHPGQRLTLRDLGDLLDLGRRHKASAVYLDGVDHNNDELRTIHIATRTSTTTAATTPAMIRLRFLRRRRRSSIATLMSETGIKPCPPEAHQNRANYSDISCAKGDDEVPRTYLFSEGLRKVLL

SEQ ID NO: 987289 - protein, 33 aa, Homo sapiens
TNCEIEGTGILLSSLLSELGSLFYYHRHPVRVF

SEQ ID NO: 987290 - protein, 121 aa, Homo sapiens
RLLEFSNHHLVWLSQARDVVATLESREVVYEVKMRQVPEFNSLPIPLFQIMLGIFYNVLTGMSLADVPFTEKDCENGPQNIYNLYEQVSYNCFIAAGLYLLLGGFSFCQVRLNKRKEYMVR

SEQ ID NO: 987291 - protein, 107 aa, Homo sapiens
MSIFIPQLSAGCACGMTAETQEDGEYVGRGRRPVPLSDSGLTQKETALESNGIQTYFNQRDPWSDGAVKKEDDSQVCGLGDGSVGGEYTRDRKGRDFWWDKTAGAPF

SEQ ID NO: 987292 - protein, 40 aa, Homo sapiens
MGQKVTQAQIEISVVEKEDVDLGTVCLKPVYTYYITYFWY

SEQ ID NO: 987293 - protein, 136 aa, Homo sapiens
LSAPDSWKLTAIRAEYVSLRWTLAVLSSYISLTGLEAIQRTPKIQVYSLHPGKNVKSNFLNCYVSGFHPSDIEVDLLKNGERIEKVEHSDLSFSKDWSFYLLYYTEFTPTEQDEYACRVNHVTLSQPKIVKWDRDM

SEQ ID NO: 987294 - protein, 56 aa, Homo sapiens
RFAPVQRRQVAVSPALIVPLSNGKRTSDDSAAMVVLPQPLGPSRSDEFVFADRQVD

SEQ ID NO: 987295 - protein, 65 aa, Homo sapiens
ASPSADAENRTQAPLETAGKAPPPLRRAPSAIRGRPSVGPGRALRVRGAIIVPFTSLIRPLAVLA

SEQ ID NO: 987296 - protein, 33 aa, Homo sapiens
MGRYLGHGGLSCLKELLIMCPAAIAGPTFLNPA

SEQ ID NO: 987297 - protein, 38 aa, Homo sapiens
QAQSPQSTLGLQCTHHHIWLIFWSRLDIRYVAQTGLEF

SEQ ID NO: 987298 - protein, 179 aa, Homo sapiens
MVYNEDQINRGISTLTVPHRYTASSPTETTWIKSGTTPNYNELRVAPDEHPVRQTEAPLNPKAGREKMTQIMLETFNTPNMYSSHTRLCYPCTPLAVPLDIVMDSGDGVTQHCDPSTRGMPSPMPSCVLDLAGRALTDYLMKILTERGYSYTSKEERDIVRDIKEKLCYVALDFEQEIP

SEQ ID NO: 987299 - protein, 40 aa, Homo sapiens
SRHDDTLEQWGERMGASARTLARCMKDETGMSFHNWRLQV

SEQ ID NO: 987300 - protein, 69 aa, Homo sapiens
MTEALLSHGESRPVCSIPLVLWMRTLGQDLGPIVEISMTVIREPDPCDFRGFVQIFSHRPYFNHLKMYQ

SEQ ID NO: 987301 - protein, 75 aa, Homo sapiens
VGSWYVYIFLGPEPKSVVQQYLDVVRIPVHAVHYWWPGLPPVPLGATTSTVYHPTRCVDNMTMGPSFAPCRSKWN

SEQ ID NO: 987302 - protein, 136 aa, Homo sapiens
MSILDISIMTGFALYRMLVLALSYLGYLVVLTAPYADPIPSELTTPSQQYFYLRFALPNGYFILSRLIRVQFQWSLQLKAPVHTVLFKMPLSSYKPLACTSSSTFIERRAGMGCLPSFWHCVVSLFPLGRSVYPVI

SEQ ID NO: 987303 - protein, 68 aa, Homo sapiens
VGTSSAEFMLPADSSIPSQLDRIDVVVASTLSITVISGQFLSVNAGVRSYVEVVLFGLPGDPKRRYRT

SEQ ID NO: 987304 - protein, 162 aa, Homo sapiens
ADSKDPHTVEQVALDAIKVLLQHGGLAETCVYPTQSPWWAKRNCYISENPEDKRHVWFGESIIQMVVPVRAMAAKAPSLPICALQMTFLRLYVTEGSQNISYHCNETVLCLDGQHTGNLVKALVLPGSIEIEIRSEGDSWFTYRRPCRWMHDSLRSLWSDSD

SEQ ID NO: 987305 - protein, 39 aa, Homo sapiens
LTDCPAASCAAERAGVVDDPVDAGGRIDAGASNVCIVER

SEQ ID NO: 987306 - protein, 51 aa, Homo sapiens
GKVGWVGGSQLGWRDVYRTADRANVEARIPGLGAPTSNGATLMMGRREVLV

SEQ ID NO: 987307 - protein, 66 aa, Homo sapiens
RLVPVCSQLLRPVIFVKLTCQCPGHACFARLSHGLLRAVLLAPPGPASGSRWALPLPERLPHSRFF

SEQ ID NO: 987308 - protein, 68 aa, Homo sapiens
QLVLRVLIRTQPGHRIGYPDLFWSVFTTINITGHAIEGVLLLAGAYLVLTLGTSWALNLWYARLRRKG

SEQ ID NO: 987309 - protein, 40 aa, Homo sapiens
PDVLSRRITTQISKDTGATLVVENRPGAAGNIGIALVKRA

SEQ ID NO: 987310 - protein, 76 aa, Homo sapiens
TVRFGSVSKQTIYQVVWRHPCRYNGALSKFNAGGLGAPVHQEDPQRVSPLPGFGSGAPSWELTAAVPMIDAPEPEG

SEQ ID NO: 987311 - protein, 53 aa, Homo sapiens
ELVPLIVNETDIALDARWIAWPGYCLERCAEPHLRAGRLRRVLDEWSPAGAPL

SEQ ID NO: 987312 - protein, 52 aa, Homo sapiens
RPLCPVRPTAVLKGLHGDVLAFRVDAAELGVLWSLCPVGPSAACHVRNNGTC

SEQ ID NO: 987313 - protein, 70 aa, Homo sapiens
EASLDIRRMEGQLDGHFGRVGALAAILELESIGHALADTRHASCPCGFLLDVPCSSGATAAARVGYTLRL

SEQ ID NO: 987314 - protein, 80 aa, Homo sapiens
WYQIPFHQTQGSGVPSSPPNGISPIMAQHVLWIWDWALCTLRRSSQVLNSPPAQLSCLPSCRGQQESHARGDLCDGNGGS

SEQ ID NO: 987315 - protein, 33 aa, Homo sapiens
MRIPGSGGTKRKAGHIDDGRTESVYGWFCIQSL

SEQ ID NO: 987316 - protein, 33 aa, Homo sapiens
VQNPFHQRGSLEGSGASSRGSILLVFGTEAMIK

SEQ ID NO: 987317 - protein, 38 aa, Homo sapiens
VRYVFCSALGIELLRVSREMAHDDNAELINDRTALAAG

SEQ ID NO: 987318 - protein, 38 aa, Homo sapiens
MRTLPEDEAPSDSCSFKQSRNIISIHRIDFIHLRSKLW

SEQ ID NO: 987319 - protein, 36 aa, Homo sapiens
SSVQSQNHGLISAESEMIFSGMERGIGISSRSRLCQ

SEQ ID NO: 987320 - protein, 66 aa, Homo sapiens
VVVGLFAGRDLAPDVTPAPCAFTSCISQLSDGLQIVALAMGLFGVADFLKNINQIGGDTKVTSTKV

SEQ ID NO: 987321 - protein, 58 aa, Homo sapiens
TGPHCRYLGIFRAEWADYYRLKRVAPKTLLAELQDQGEISPVRVEGLEGQFYVHGSLT

SEQ ID NO: 987322 - protein, 69 aa, Homo sapiens
VPVHSGSIRRPRELSTLSGCAAHAQRMATADIFQDPMSSLNPRKRVRDIIGEAPLANGIIARRDYDDYV

SEQ ID NO: 987323 - protein, 63 aa, Homo sapiens
NCRLGWRESGWSGDGNAMLASGVSSLQDTHTGANVESRYFWSRGTNDPMWATINDECSAGSVL

SEQ ID NO: 987324 - protein, 50 aa, Homo sapiens
MSWSQYRKGSQGALFLPLSGDQQAGAAGAATFQHLVRPLGVGQRKFLLVS

SEQ ID NO: 987325 - protein, 64 aa, Homo sapiens
AADAHFFIEMLGLMDVERRQAGRGVCVASAPLRTLRNLPISFSLLMSRRAVAGEMSNAAITSAT

SEQ ID NO: 987326 - protein, 96 aa, Homo sapiens
NFEDSNHDLLPQKPYDWKALFLVALAEVPVIAHACKAAGVNRVTAWRAREADPEFAKAWDDAMEEGVDRAEQEAFRRAVVGYEKPVWYKGVPVGTE

SEQ ID NO: 987327 - protein, 54 aa, Homo sapiens
MPRFTIIQPFSSSDQQIFGPALHAEHRPIAQRQDLLGNRPAQARVAHHRILNAV

SEQ ID NO: 987328 - protein, 55 aa, Homo sapiens
RENGKERKRRSELSKVNLRSTVPEVTERTEPRTSRLMGYHDRVYSHCTTVSVGIS

SEQ ID NO: 987329 - protein, 55 aa, Homo sapiens
GVREKEEEGDGEEEDGDEDEEGSTTRNPSQDVTVPCPVPSTPPSPSLSTPPSLST

SEQ ID NO: 987330 - protein, 103 aa, Homo sapiens
GPERMAWTAVKGHSVGALLYMIPMTQNYILRTLAWCPGDPIVAPMSSTHGVMNYVALFLEYYALTLPSPVTTISIFITTRSLLWWLPMHYLLFLMIFSLFHHD

SEQ ID NO: 987331 - protein, 82 aa, Homo sapiens
MTHVNNHAMDMLQDMLLYSIQWCNPWDSQRLPLCLPEILESVTLSLEPKEAGLSPTNEVINQLLHHVWCECALHRTTKSGTE

SEQ ID NO: 987332 - protein, 57 aa, Homo sapiens
MYGERNIRSLWAEPGGGLWYTHRPNQHLNISYTIGVAGPWLNFIFITLQMNAGKSTA

SEQ ID NO: 987333 - protein, 126 aa, Homo sapiens
ARLVAYFNIEFTRCHKRTGFSTSPESPYTHWKQTVFYKEDYLYREDGRVRSVGTIRHAAQRPQNNSGPVTSPITCDFTGPACAELVLAPPHYRDALEARALPPWTMPRVLSRSYGGFGSSPLSLVH

SEQ ID NO: 987334 - protein, 145 aa, Homo sapiens
ERERVRQPWGPPRCRTVYLSSWREEDGERVVTEITLRWFNGQAVHGNVPEVASATSCICGPFPRTSRGSSMGGDPGAGHPRGSILATIPERGTIGVPLITGMAASEALAPLPFTPNRDRCSWQDLSSKPPSLSCPILPRLPGSIM

SEQ ID NO: 987335 - protein, 47 aa, Homo sapiens
AFRRRYKKIGTGIARPPSSAAWRVEPDAGTKRALQSTLVPDALTTGA

SEQ ID NO: 987336 - protein, 66 aa, Homo sapiens
SERERQTGYFNSLCADTAYGPTWVINADSGARDESFNIIPTPQQMDPVFLLSSLLAVHKIPAGYTS

SEQ ID NO: 987337 - protein, 103 aa, Homo sapiens
MNDQNTNGVDHGAVYPSPCTARRHLKTTIPPAPPTLLKDYLESVYLRPYHDLHWSLSEECDGSFSGLYSASGYRVDMSPEYCPYFVVHHMPLATIRFRSLLKQ

SEQ ID NO: 987338 - protein, 113 aa, Homo sapiens
GAEDILSSPLVRKRRVVIVDPETGKEISMYQGYRKGLIDHQTYLELSQQECQWEENTIFFLDGVVKSMIIDRRFGRQYQIDDAIAKNLIDRLALDQYRAGTLFITEFADMLLG

SEQ ID NO: 987339 - protein, 39 aa, Homo sapiens
ESVITPPDVYLVWTNLGAFGNVFHSGIDDIGDPPAGETQ

SEQ ID NO: 987340 - protein, 67 aa, Homo sapiens
SRVIPRCGYKARLVQGACLVCTETVHSDALLALILKGRLQEALRRCAPDVSPGADVWGVPELNSVII

SEQ ID NO: 987341 - protein, 48 aa, Homo sapiens
MPHGAAAARVDVEVRAGGEAGAARGAEAEVARNERPRSRERIWCQEIS

SEQ ID NO: 987342 - protein, 42 aa, Homo sapiens
DSCCLSLEFPGTAQPAATVVTVIASPLPVRPEPPVRCPAGGQ

SEQ ID NO: 987343 - protein, 118 aa, Homo sapiens
LVVLSSVPLGAFLAGYGHSWPPDRDFPADFFSTGMQQMLLILMKALSFKKVSLLRCLCWGHNRIIAAAKYPSYIHKMVIWGANAYVTDEDSMIYEGIRDVSKWSERTRKPLEALYGYD

SEQ ID NO: 987344 - protein, 62 aa, Homo sapiens
DLEYPPGAVFSTGLLCCVIEDDADEALEIYSGPAVYLRTGGKGRQQQQKQQLPQTPPSCLKT

SEQ ID NO: 987345 - protein, 112 aa, Homo sapiens
QGIGIGWLLLRLRTLLDYGPYAAFSVCMRCVCILRKVISCVVSCNHLHPCHCHRTVSSPSGTHLPCDSPFEPHPHTLPVCPWQPQIPSLFSISSFVIWRMLCTWKRVVCNLL

SEQ ID NO: 987346 - protein, 52 aa, Homo sapiens
MLACVGSWLDREKCKQFVDAAHAPAADPVCPGGWDAHTTCQALGVCGTMSSP

SEQ ID NO: 987347 - protein, 46 aa, Homo sapiens
PRGVCPPGAGPIPPGEHLNPCEQHTLPPVLSDLNWMQHHNPSAEHL

SEQ ID NO: 987348 - protein, 50 aa, Homo sapiens
ARYRMRYGVLYTHSTIFIPSPGSCTFRAAFARIATARHSAPTAPAGSRFH

SEQ ID NO: 987349 - protein, 96 aa, Homo sapiens
TSGKPGKWEWLGIGLTWRTPWSGQLTVGAENVISRGKNPFSPRNESNDDGTVPYVRYNRISDPTARFFLQWLLTGAERRPLRMRDRDTRIALFGGS

SEQ ID NO: 987350 - protein, 50 aa, Homo sapiens
ARLACSAQLAAALCTGWEIICRRLRQHRLHLSALIAELSQYDGFRYVQLS

SEQ ID NO: 987351 - protein, 37 aa, Homo sapiens
MPVLDAPRGVLFFGFTAALLMRYNSTSSVLREIRSEM

SEQ ID NO: 987352 - protein, 111 aa, Homo sapiens
RTGFLLMWEEIDKNGKGKKRRGQTIIEGKNEGEEQKGKKIIYPPCPRLCRELLDQRGPEVLQDSLDRSYSTPSGCLDLDLIITYRSAFYVLEQQRVGLAVDMDEIEQYQEV

SEQ ID NO: 987353 - protein, 70 aa, Homo sapiens
AGPHRRTGLTAGCGQDLARSRRQQAGDGAASVVLPEPEPPTTATTSRGFDVQVDAIERALGAGAREQALV

SEQ ID NO: 987354 - protein, 67 aa, Homo sapiens
PCSSLTCIAIREAATSNLKKLVENFWEGVGPCYNHPSKVLAMSGFPNYLHRYYYAASVLNCACLRVC

SEQ ID NO: 987355 - protein, 86 aa, Homo sapiens
LRYLRIPAPLGAKEKCSSSQVDMCQRITLLWTRRQINREAFVQFARRVAERLWNRERKGEEEGVGERGVRSLHCVHAQGPVIELEA

SEQ ID NO: 987356 - protein, 151 aa, Homo sapiens
LEYPLQSSLMSRICISRSAVVVKLLPRSVRIFMRSHVRSRPCPGPDAGLACGEGIPLCRWAQCVTPVTGSPSRMPDGTDQRRTGYSSAWIATVHVLRVLRGLNDDLGHLSRRFGPSGFQGGPPVQQLRVCSREPTRTLTCTNGVGGQIFSH

SEQ ID NO: 987357 - protein, 175 aa, Homo sapiens
KDPRPPAGMMLECVEKNRDRIVSSKDLYGYTKNDWEAKSAQEILIFWFQKIVVDTSVTNTGQIIYGCRISLLAYGVYPNVCYHKEKRKILNTEGRNALIHKSSVNCPFSSQDMKYPSPFFVFGEKIRTRAISAKGMTIVHPLQLLLFASKKVQSDGQIVLVDDWIKYQYLMKLLL

SEQ ID NO: 987358 - protein, 108 aa, Homo sapiens
SSYRRLCWLASWIWIRHIWEILGVEWKHSGRCVQADSRTWPGTPLLVTWVHTALRPALLAGQMVWKSPPCTVIIVCLVVPCPLVLVLIITTTVTMMGSGGRHGTAAFS

SEQ ID NO: 987359 - protein, 80 aa, Homo sapiens
RSVSEKQLNELNIMTQHRAKLLTERELLLDWWTGSEEAEEGAESSQEPVAHTVSEPKVDIPRDSGCFEGSESGRDDSGAV

SEQ ID NO: 987360 - protein, 39 aa, Homo sapiens
MASTRVGLTEDKLENQETARAVSGENPWLENPGAQTGFP

SEQ ID NO: 987361 - protein, 68 aa, Homo sapiens
AYGTMGLRAPAQVVQPEITDSLDTSVTKQCMVLYEALLKGEWDLNIWTPAAEVQKKTYAFNCHRLKRK

SEQ ID NO: 987362 - protein, 127 aa, Homo sapiens
MRFLQLYHEDLLAGLGDVALLGLFGKVRLAFGSAEARLPARRLRSFCGACWAAVAPMCCAWSTRAAPVFISAQKGSTFLQRLEAQFQCVFGTERLLTATLDTGLEEVDPAEALPVLPGNADVYCGPQ

SEQ ID NO: 987363 - protein, 176 aa, Homo sapiens
FKVGLFRGRLRELWVLLEGEASREGPLHILLVPPVPPSCGGSLGGRRVSGRASQETEEQGCPPSCLRAHLRSKPHAQGSGAAVPSLVSFSGEGGILGSAGFGVKMSLPGRACPSHACAPFGIIYSISRPGLGLPTRGAGLGASAGICYRFCGGPGALEVPAYAHLDTCSAHKAATA

SEQ ID NO: 987364 - protein, 71 aa, Homo sapiens
TRLHWCCVKRLRWRESRWRLVGDTRVLGRDDVLGLDASGGVVSRDQTRYIPEVESTGLADGLHEGVRGESG

SEQ ID NO: 987365 - protein, 85 aa, Homo sapiens
VITGSYSSLCWFFWYTKAWRQVSLPKSGKLQESGRRVKKRGSRASQVGLERQLGGENSKSAARLQDAAGEVNEGGSRGTGAQNSV

SEQ ID NO: 987366 - protein, 56 aa, Homo sapiens
SAAPLHPTTEEDLSTESVASQARLGGLSGSDCLEMRETTAETIEGLVEELLKREGA

SEQ ID NO: 987367 - protein, 42 aa, Homo sapiens
RVAALHTLMLRRCTAHFSSALKASVFFIWGQLGESDTEEGAA

SEQ ID NO: 987368 - protein, 41 aa, Homo sapiens
LLLLFSATDRARQRSTDTFEERERQSHHQLDPLTQNITPIL

SEQ ID NO: 987369 - protein, 77 aa, Homo sapiens
TSCSSSVAGLQVPHHARHFLHFSRDGFTMFAGWSRSLDLVIIHLSFPKCCDYRHEPPTPAMPFLKIQVLPSPGGEGP

SEQ ID NO: 987370 - protein, 106 aa, Homo sapiens
MAGPGLDPDPTPSPNSAGGEDAGGRLVKVERSDTAHAVGEEGIAQGTTHEHVPRCSIGDHLRKGRCVMAGPGLDPDPTPESQLTLVVRTLAAALSKWNARTLRMPS

SEQ ID NO: 987371 - protein, 61 aa, Homo sapiens
LLLPLHCSPAPGEPLHRGYSMRCPNSSVSLLTPSCQVYHSDSTIFNSLSQTPSPGPFQTVP

SEQ ID NO: 987372 - protein, 91 aa, Homo sapiens
MPLLLSRSCLGLLGKRSWVTPPVQGLSASSTDKMQFHATKLLPSPLAPPEVRCCARLGVLQRHNTHPLHQSQRDNQDVALRPGAVAHACNP

SEQ ID NO: 987373 - protein, 43 aa, Homo sapiens
LSCVTECSLWITAQRQLSSCCAYLCCLLEVCVSTPADGAAICF

SEQ ID NO: 987374 - protein, 109 aa, Homo sapiens
SLLLLFKYTQIWCCSGTAGAHYIELLMNTVSTYQISSALLSSWLGAVVTPVIPALWQGREGWIARSGVRDRPGQHGEALSLLKVQKNWPGVLVHACNPSYSGGWGGRVA

SEQ ID NO: 987375 - protein, 37 aa, Homo sapiens
SPTYAWVQSDSAVPGSATEEARTFAENNGTALPGDLP

SEQ ID NO: 987376 - protein, 65 aa, Homo sapiens
SSSYPTLCVGGGPEGQALVTWEGHCAKDTNNKFRELKNPKPNWRKPMQWDHLTRPLCLLALVASV

SEQ ID NO: 987377 - protein, 34 aa, Homo sapiens
QDLCCSSSAPRVLELRACHYTRLTFVFFVETGLA

SEQ ID NO: 987378 - protein, 54 aa, Homo sapiens
MLSIDSRHCIEKHCENPCPILFRSNYRCMQPPVTYPLLLNRSRPSHVDPLRVVS

SEQ ID NO: 987379 - protein, 40 aa, Homo sapiens
VSRFVGRAVIIVAADESTISWGPHRTFGELGYGDHKPKSS

SEQ ID NO: 987380 - protein, 45 aa, Homo sapiens
LTGYWHLVGRHDFIYRAACVHVELDPLIGIGVITIERAYPLRLGS

SEQ ID NO: 987381 - protein, 56 aa, Homo sapiens
MLAHADDLGAAQRRRALGAAIADQHRVALARGQRVQRRQQVRHEAGAAQHGAVYEA

SEQ ID NO: 987382 - protein, 57 aa, Homo sapiens
PRARHWRRLTSHVDVASDLGSGGDGVQACALKLGVIVFGNNQRVISNHLRFVLEFVH

SEQ ID NO: 987383 - protein, 92 aa, Homo sapiens
LKGWTGSQLSARDREQQPTPDLKPTATQVGKRVSSQLLAPATGCAPRGPGRLQAESVGRAVLVPAMWMVCYPRGSRRNILRLPRSFESTCSG

SEQ ID NO: 987384 - protein, 57 aa, Homo sapiens
RRCPNLNRRTRTTPTLVRFPSRSPPQMRAADGDVAKVYIPARQRSVVRQVQTLGDPC

SEQ ID NO: 987385 - protein, 56 aa, Homo sapiens
SEDPGGRNWAGHVSSLHTLLQLLGAPGLQVTRLPWWMMSGYMCLGGRTPHDLFSSG

SEQ ID NO: 987386 - protein, 41 aa, Homo sapiens
RLFGRQDTGGWGRVHIVTPSRRYVWPEACLELWASCQPERG

SEQ ID NO: 987387 - protein, 39 aa, Homo sapiens
NPVNHLSRIKILPLSTILSYIISYSIRFTASELIHIRYL

SEQ ID NO: 987388 - protein, 67 aa, Homo sapiens
RREAVVNSHLSGSAQLCTEPVPHLDELLFIQAEADDFLAASFSFLWSRCIDKVWGARATDRRCRKSS

SEQ ID NO: 987389 - protein, 38 aa, Homo sapiens
GAGCQNAGWVDGFQESNRGSGEEVGAAAHVSDYGVLGP

SEQ ID NO: 987390 - protein, 72 aa, Homo sapiens
LTGSSAPSLFSNGDTDTFPREEKSMVCCLANNKNVGSRVGKAVAIGIFHVNHVQKIQGCLSSCWVIPNQFFP

SEQ ID NO: 987391 - protein, 57 aa, Homo sapiens
IWKSMRHDLIEEYHGAPPRALFILLSHCSSSSRGWSEDSGKSTTSSRQAEKTRSGLY

SEQ ID NO: 987392 - protein, 89 aa, Homo sapiens
ERERQSTNHLDLSKTYDNHVGTSEGSSPEPEPESSTMALDVTRQTTGLGPSAVFAEPRRQCHTDPQHDCQFQIQIPAPRFADPAGRAGP

SEQ ID NO: 987393 - protein, 35 aa, Homo sapiens
SSSSDQESHVIIIYTICSSTSVVSTTSAGPYLAQS

SEQ ID NO: 987394 - protein, 51 aa, Homo sapiens
MATQGGVSLFHDRHIDRNKQEARYGPPACNYLGPCLRRGKPGEERSVTDDV

SEQ ID NO: 987395 - protein, 152 aa, Homo sapiens
MSLSRPPHSAVGASAPAAPVPLPGVWLRLAVPPRALWLLAASALRAFRSVCRRPLALALLLPPSGIITRPGSAHVFCPGVAHCSVQASFITITASVFQQSLLAQSSLHPSAWGDFCTMELSRQSITVAVLSTQVIFHHTTLIVSSSSSSSCW

SEQ ID NO: 987396 - protein, 163 aa, Homo sapiens
LRGRASAFTAFRPPPPAVSLRPLGSSAPPLPPLSAPAVPLVLRRLPLAPPPPPSGPPPLSPARSPHPSSTFPHSVGAHPSPAWCTFCFTCIGQQPHHRTCIPPAASLITLGRPHAQFIPVVNFSAHSCFPPHQSQGIVQAPLFTVCHSSCNIHIRALLPFCSR

SEQ ID NO: 987397 - protein, 49 aa, Homo sapiens
GSEDAYDGKDYIALNEDCALGPVVDIVSQITQRKWETAMRRSSGEPIWR

SEQ ID NO: 987398 - protein, 36 aa, Homo sapiens
YASCDEHGYTHTHMHTQCRYTHTHMHVCACGCLYVC

SEQ ID NO: 987399 - protein, 58 aa, Homo sapiens
KCIAYEHACSLSYSQVLKQEDLLNLGGEVQRAMIVPLHSSLCDRVRPCLKKYKVFNQQ

SEQ ID NO: 987400 - protein, 138 aa, Homo sapiens
RCEHASIGSRLLSGSTIGPWLWLCAQPTDVVQVRFQAQARAGGGRRYQSTVNAYKTIAREEGFRWPLERDLPNVARNAIVNCAELVTYDLIKDALLKANLMTDDLPCHFTSAFGAGFCTTVIASPVDVVETRYMNSAL

SEQ ID NO: 987401 - protein, 70 aa, Homo sapiens
ADLQHEGPHEDEGDQTQQQQLEAGVSDVTQRQRALLEAGDQDKAHQDGAKERQGQHEVNWEQQSFLGRNY

SEQ ID NO: 987402 - protein, 33 aa, Homo sapiens
RAYDGERQHIARVCGLEKVTCKNGQGNCYKSNS

SEQ ID NO: 987403 - protein, 62 aa, Homo sapiens
FFIERHMGEDQVEMSRYTEARGLPRWTRLTTAEGAYDERVYGMFNIQTLEEAVQHGCCMMKY

SEQ ID NO: 987404 - protein, 49 aa, Homo sapiens
MRTVRAWACPCLRVNAGVGVCSACICVCMSVCMCVCVTLRVWAVLCSGK

SEQ ID NO: 987405 - protein, 37 aa, Homo sapiens
MVIVCRDSHSRMRAPLGCTVEWTDSGQYHVEWGVKAG

SEQ ID NO: 987406 - protein, 35 aa, Homo sapiens
QLETSGIILLLSCTIQCAVTSPRAVYTVNSQFSAS

SEQ ID NO: 987407 - protein, 71 aa, Homo sapiens
HQLAGAGMPLLRHGLWTALTLVLGRWCPTSPVASQGHQWLSWRVARCGQAPLGSDQAAGPESSTVYYLRDQ

SEQ ID NO: 987408 - protein, 99 aa, Homo sapiens
VNTLMTMKNIKIGGEESATSQEYLISLQEESRSSTSAVLESVTTHLTAQLRISYKAGRTPSYAKSITHRPLQTTWEVWSFYLVDKPAKETTQAQRQGET

SEQ ID NO: 987409 - protein, 115 aa, Homo sapiens
GSVRFLLKGGIQVCVPLPRQSLCVTNLLGGLAVRRACYGVLRFLVARGANGCEVVVSGTLRGQRAKSMKLVDGLMIHSGDPVTLPTLTLLCATCCSDRVCWALKVQIMLPWDPNR

SEQ ID NO: 987410 - protein, 54 aa, Homo sapiens
CSAVWNTLIARRILYICFPSVTFPPLWSAGSTGRGKPSEACSSFCSFQPKQEAI

SEQ ID NO: 987411 - protein, 72 aa, Homo sapiens
RAEEAVDEAAGQVTLSMPSKEHSMSRRRQEKPSDEQKRKAQVRRLEGGSSTDILLPSSWSLPGWMHMCVALG

SEQ ID NO: 987412 - protein, 141 aa, Homo sapiens
PLAYSIVGHSGQCYYLAHGHEFIVLVLTTSTGRGYVQCVHEACPKGRSEVATGGHPVMQVGFQAAASLMMVIGHHLSTVDNGITSNIGRGPFPEAPEPFLSGNGLVGIDGALVSPTTSSPGLSLESDLYHIRGLGHSHSQG

SEQ ID NO: 987413 - protein, 142 aa, Homo sapiens
WAGPGNILSSGFVCLLHVTCYAHLPAMHCVAGYGSAGCSWCTGPRSASCLGGKFLAVTPCPLSLQVTLSELLGEEALDQAGDDHVPIWLGAAEAQREDLGAGRGCWNTECTVRTRPSPLYCLSSILEEPSTERPGDCPMVTQ

SEQ ID NO: 987414 - protein, 46 aa, Homo sapiens
MSFPIIDYSDLLIILVSLIISIFEITPLTGINNLQLVYYVYPQDSD

SEQ ID NO: 987415 - protein, 120 aa, Homo sapiens
DRRVYRRVTAWDPTGRDEKCVALLQLKFFGIVPHGLPRKISLLFGPDSTHSYVQRQIVQRWRNQPKNLPTPGKHGTKTEVPPKSMWKSVKQPFTLIRQYFFTFGYFILCQWAVSWGLSWS

SEQ ID NO: 987416 - protein, 74 aa, Homo sapiens
MQEADMLFAEDDGCQRVEGVSQERPGRSYAFNMKKRRGEDEGLKGKDQPSAVHRSKVLGQRVNEVISSGWTPTP

SEQ ID NO: 987417 - protein, 58 aa, Homo sapiens
GPRLSSTSCSHFLQCTRGHPGALNGVDCAIFGSPYPMTMALSVLVTIEMCNALNSLSE

SEQ ID NO: 987418 - protein, 34 aa, Homo sapiens
SWYPTGGCTQGLLFSAKLADKRLPAPPGSTTCRW

SEQ ID NO: 987419 - protein, 79 aa, Homo sapiens
ARRSMLRTGAHEEEHGEDRGHAVQRGDRMPVSQIRTVSSSAHVGSPLAFSVAKHLQGEGQEDGADDTTLLGEKLQAGQV

SEQ ID NO: 987420 - protein, 46 aa, Homo sapiens
MACPEAIFAFMCLGWPSGFPEELETVFRLTCTTPVPASSSERQCPP

SEQ ID NO: 987421 - protein, 85 aa, Homo sapiens
LSFCGPRSSDCHPGGPGPVERRLGSIVTTSVDLTCVPIVRYLLQVSRLVLRLWGRQALRPPPLFKSTGLHTHTCTYSCMHMYTRS

SEQ ID NO: 987422 - protein, 111 aa, Homo sapiens
CVIRVFRVCTLRVGCAVLWEVRASRCSPGESPEQDEGVPGFHKIPVPRTSPPRVHLPLKPSEAKLAPAGRRSLTTVLCGPSGSHCPSPSPCAEARHLQPSCPQPQLPRPEA

SEQ ID NO: 987423 - protein, 43 aa, Homo sapiens
MFPPRGRYRRVEGAAVALKLWRGPEIGSPGLTKGADLGGSSNI

SEQ ID NO: 987424 - protein, 41 aa, Homo sapiens
CDPERIRFAFNSESEFGSEASSPYYFGPPAKNGVAAEVSPA

SEQ ID NO: 987425 - protein, 66 aa, Homo sapiens
GLRQQEEEEEEMTRREDGLALNYERKLKSAPEAGGEKYFSVGLDKCWQEPHLLKRACILKTSATIT

SEQ ID NO: 987426 - protein, 44 aa, Homo sapiens
RQDTGAHVFTYGCPRSPAIEAQHLLKRKPDIGDPARGWNGEESF

SEQ ID NO: 987427 - protein, 33 aa, Homo sapiens
FQHWDELKAFFGRGGQGWCTPWLLALGLPQCPG

SEQ ID NO: 987428 - protein, 51 aa, Homo sapiens
NWAGAWELWTPAQLSGPQAWQVTRLPWWMMSGYMCLEAAPRHDLLLRLRLP

SEQ ID NO: 987429 - protein, 61 aa, Homo sapiens
VLEDLWRQDTEETGDSAAVPVLVCGLEEPSWRVFPLLGLTEHEQGASPVGSPEEGCDVGAG

SEQ ID NO: 987430 - protein, 84 aa, Homo sapiens
MSIRVCSSLQRGQDWVSKMRRLEERWTYSETRLFAGGFLVSNFQFWPGLFQCGKAHGPPHWELFLGGLHPILERGGEEGGQQKG

SEQ ID NO: 987431 - protein, 39 aa, Homo sapiens
RREGVGGTATFSGRPSSGTGAWFPISMSCSFSRREADDF

SEQ ID NO: 987432 - protein, 42 aa, Homo sapiens
METPLDVWSRAASLVHADDEKREAALRGEPRMQTLPVASALS

SEQ ID NO: 987433 - protein, 181 aa, Homo sapiens
LGILTRGVRVVPGCQMLTWGCSVLFQAVRGSPGHVGAVPVCQMPTWVCGFCSRLSDAHLWVWVLLQTIRCAPGVVGAAPGCRMLALGLWVLLHAFRCSPWGCGLLLQRCQMLTMGYGCCPMLSDAHLGVVGTAPGCQMLALGLWALLQTLRCSPVVVGAAPDHQMLTWGVSVLLQVSNARV

SEQ ID NO: 987434 - protein, 44 aa, Homo sapiens
IQTDPLAYELGTFPELNAMSMGYGKENLKQNQTQPYTWVGHGVS

SEQ ID NO: 987435 - protein, 40 aa, Homo sapiens
AGKLWMRGLSMEPWHVAHTVYWDGVSVAGGNEEVLGVVAA

SEQ ID NO: 987436 - protein, 63 aa, Homo sapiens
RLPVLCGDGLLSGTERQKENSSPSYQIHTIERKRDEDINSYGGTLGTLRLRFNCEITGMYEIR

SEQ ID NO: 987437 - protein, 35 aa, Homo sapiens
GGHVSTSTGGELPNKGYTCAPYDIGQVVSALCSSH

SEQ ID NO: 987438 - protein, 148 aa, Homo sapiens
APGRSKYPMAIVPVCPMCLPLRGRFTSLQQQHEEPMETSIRMQRRKRSMPVAQEDTTCRQQQQQPDTSSKIRQSLKTMETSQAGSKDKKMDQPPHAMKAKVKNSTVDLPIENQLIMADRQRDAQLVTIATEGQMIMQDKPGARSGMLL

SEQ ID NO: 987439 - protein, 42 aa, Homo sapiens
SPFCLDSCVHPSAYLERGYQRRHVLCPYYRALSNLASRTQGQ

SEQ ID NO: 987440 - protein, 88 aa, Homo sapiens
IGKSDLATTHQAQRSIRDAISLTNIPNSFDNYSMLLEKLEIPNSKKDKENKNPGCTAVILHRIKTLGSMLSFVNKAAVFWAKRMRPNT

SEQ ID NO: 987441 - protein, 71 aa, Homo sapiens
MEVSTVAHVSTELVQCRHAPAVVNTRRPGSMLAIFGGRRGAHVSTEHEQEGMQRSGEYTSSWRHACVLGYW

SEQ ID NO: 987442 - protein, 41 aa, Homo sapiens
LGGDWTALLLVPVDFLGAFVGSFIARISRGRSVREFVIGVV

SEQ ID NO: 987443 - protein, 53 aa, Homo sapiens
LVSEAVSTDNGRHHRSLCSSGGINMAKTLYQKLYDAHVVHEAPNETPLLYIDR

SEQ ID NO: 987444 - protein, 51 aa, Homo sapiens
RYDKNYAIKRFRCISICASLSLLGKYTVRPRDRMDGLLPDATYKRKPTGIT

SEQ ID NO: 987445 - protein, 65 aa, Homo sapiens
EPDVRSHSWSLSPLQAESGVGLDDVTVNYLDEGDLREYSLLPEVGGQVAVGLIPGLPGEYANVVP

SEQ ID NO: 987446 - protein, 85 aa, Homo sapiens
MGQMAMGGAMGINNRGAMPPAPVPAGTPAPPGPATMMPDGTLGLTPPTTERFGQAATMEGIGAIGGTPPAFNRAAPGAEFAQTKS

SEQ ID NO: 987447 - protein, 40 aa, Homo sapiens
VSIVRICWPFGVVAHLFLLNCSHRPLVSSPPQWPKATNSL

SEQ ID NO: 987448 - protein, 67 aa, Homo sapiens
VEKKKEEEDDEEDEEDEEEEEDEEDEDEEEDDDDEEDGSSAVFVFLGLEMHLTPPGTQSHSYLREKN

SEQ ID NO: 987449 - protein, 93 aa, Homo sapiens
WNLTVTKYHNVNLQIQVTMTWIDEALHKSWDETINVHESDMGKWQIPATMSTGLEKNEKSMVREFPWMFGSHGNCISYYNLGQEYNEIVDITV

SEQ ID NO: 987450 - protein, 36 aa, Homo sapiens
MSHSLFLLLLILLTVRAFLLPELQYAFVFCTSCLYR

SEQ ID NO: 987451 - protein, 43 aa, Homo sapiens
EGKSKKKTKKQHKKHSKKKKKKSGSSHKSRVTSRNKSKNEFAE

SEQ ID NO: 987452 - protein, 50 aa, Homo sapiens
EYRSMRTEFGMQIRGSQRLDHPSMMVSLCLEDGRQAYIINNSIITTTKGE

SEQ ID NO: 987453 - protein, 65 aa, Homo sapiens
IPERQDEKVILEKREVNYEQEERVNSRSKSSKRLGVVANTLTTSTLGGRGRRITRAREYELMSYM

SEQ ID NO: 987454 - protein, 49 aa, Homo sapiens
AATCMQNDRQQTHMLYVMQDHFSRAASIIDELLQDRFFTREPRIPTTTC

SEQ ID NO: 987455 - protein, 114 aa, Homo sapiens
MGLSEYVRAPHQEESQPTWMQLGTIGLLETMIRLPQSMCHNPGSCRPPQSLEKSLLWSTEGKYRIRQQNRLKSWSSTCLQIPAFLACECSMTNSRKSAISIFHKNVMCYTYAAR

SEQ ID NO: 987456 - protein, 48 aa, Homo sapiens
MVRHLASYVHNLMHGDEDEEPESPRIQKYRRVSFKGSGLPPSVSLISC

SEQ ID NO: 987457 - protein, 50 aa, Homo sapiens
MAEVSKYVSGFLRIIYSLRVEWESAGRTHLKVDGCISQNWTGLLKRGTEA

SEQ ID NO: 987458 - protein, 45 aa, Homo sapiens
ACEDRGLVQVDDGRKMYLSQAVLVGEVTIGGVLYKICRKGIHGYR

SEQ ID NO: 987459 - protein, 36 aa, Homo sapiens
MCGLFESNGTKGMYSLFIKSSENQGYEVFQRNAKYR

SEQ ID NO: 987460 - protein, 102 aa, Homo sapiens
WEHPILHRRILGTIRHISCAKIEKPYIEEYWPYRNTEQTHVIHKGNVINTATYKEIPRKLGVVAHTYNPSYLADSGGSTEVQEFETSLTNMEKPSLYLKIQN

SEQ ID NO: 987461 - protein, 83 aa, Homo sapiens
MPHGNMHVSTIAAEDDLSTSFPPTRDTSSTTITTSQISSSFSLFIFTFLSAILSHRCSRSIEGKQHFACNVPLLVASGVVAPP

SEQ ID NO: 987462 - protein, 44 aa, Homo sapiens
QRRVAYIKEHKSGAVARLELRGRSGVTTTSTSGVQALLRPQPPK

SEQ ID NO: 987463 - protein, 85 aa, Homo sapiens
RSSLNTGYFWTRQFYATDLHIYPYTSTTASFYFYFFEMESRSVPQAGVQQHDLDSLQPPPPGFKGFLCLSPPKQLGLQVCTPTPG

SEQ ID NO: 987464 - protein, 51 aa, Homo sapiens
LPPLYKLQLQQLQIQQLQLQQSSSYNSVQFTTSLHVVFINVDLTLFHSSNC

SEQ ID NO: 987465 - protein, 40 aa, Homo sapiens
RSHSSQEILAAPFLPGAFSILSSSNTTLFIFLTTHLTRPL

SEQ ID NO: 987466 - protein, 71 aa, Homo sapiens
RVTGYGRRIYRDSNGTGGLKTGQPEAYVRRDFSWTNNISPASPFQTTIPRLAKDSQTHGGSHVPEELLDRP

SEQ ID NO: 987467 - protein, 76 aa, Homo sapiens
QLVVVSRADLSVKRTKRKANTVCTYYDKWELKQWVHMNTKMKTSRHWGTPKLGRDDIGYNGTGNTCRVVVLVRQIH

SEQ ID NO: 987468 - protein, 94 aa, Homo sapiens
INNYISNGSKTNSPIIITGSDAHITILALNVNGLNAPVKRHRLANWIKSQDPSVCCTQETHLMYKETHRLKRKGWRLIYQANGKKKKAGVAILV

SEQ ID NO: 987469 - protein, 90 aa, Homo sapiens
RKPYDITKRSMRDSTRASLIGWEEHLAVKHFSVKVSWNSGHCYYSSRAPFDLFGNKKEKNNIKLYVRRVFIMDSCDELIPEYLNFIRGVF

SEQ ID NO: 987470 - protein, 71 aa, Homo sapiens
DPLGETVAWADGYKHGPERAAYQCRRWSVCAAGGVWHLVITLAPQARLGFCTVKGEDVPLALGTLGGVELR

SEQ ID NO: 987471 - protein, 170 aa, Homo sapiens
MGHSSNYVEGVCMQEIVEGCTGALHILARDVHNRIVIRGLNTIPLFVQLLYSPIGNIPRVAAGVLCELAQDKEAAEAIGSLREPQVLCQSYFTLGMKGVATYAAAVWFRMSEDKPQDYKKGFQFELTSSLFRTEPMAWNETADLGLDIGAQGDPLYRQDDLAIVLSRWCI

SEQ ID NO: 987472 - protein, 47 aa, Homo sapiens
SVALPAVLRCPFLETDILEIYQWARAQRCSLVCTAPVSYTEGLATVF

SEQ ID NO: 987473 - protein, 67 aa, Homo sapiens
THRVRECLGTHRRENAAEHTVVAEEERREITQGGERQVNAQEKTPGERRKKVDSQVNAQGERRGNTQ

SEQ ID NO: 987474 - protein, 103 aa, Homo sapiens
CEPGFRGVILFTQPGGLVRCRGWHSEVFAWPCCLAVSSAYVVVGLNTDRSMCCPGGTPVAVGAEGPLGSAAGMVRGLTRGFVREGGSQCLRPPSVAGGTNSLR

SEQ ID NO: 987475 - protein, 40 aa, Homo sapiens
CHNDDAYLLWSVTRTDAWVIKKPLLVLVGPDKGKDDEVLL

SEQ ID NO: 987476 - protein, 115 aa, Homo sapiens
AILDRSYDPQTQVDHPAACLSTSSTSACLAPDIPPSGPATCKPRQGACHSLHSSSSLPSLQSKSLSQRQVRGRMKPLVRHWTLVGGPSLRWGLRAWMHMTPGKLQAAPYSTSTVV

SEQ ID NO: 987477 - protein, 56 aa, Homo sapiens
MRISFTLDRLEGRGLISLYELYAESSLPLTCLPVSLHYLDELLLCSPSLKDSQIHT

SEQ ID NO: 987478 - protein, 59 aa, Homo sapiens
MIPYSLASAVACCSIFLLPEHHAAGIVLGVALALSCTPAFRGAGIAGVSHCAWPHTQPT

SEQ ID NO: 987479 - protein, 58 aa, Homo sapiens
RASGLEFKSRISGRHPYDDSLSKGISTEYLWALGDVVIHFHKRFIFDLLAIFFLPMAA

SEQ ID NO: 987480 - protein, 49 aa, Homo sapiens
MTLDSIVMDPKKDVLIEFYAPWCGHCKAARCPCTTALAKQVQRANKGPW

SEQ ID NO: 987481 - protein, 54 aa, Homo sapiens
KVILMRIPVATSTNRNISPSVLLDRVHSSQLSPRTDTFHPVSSSYRLGTAARNS

SEQ ID NO: 987482 - protein, 47 aa, Homo sapiens
FVLRSERAVVSCSMCCPGVLAITLVLAVFVASLASLPLRGMLSEAMA

SEQ ID NO: 987483 - protein, 64 aa, Homo sapiens
DDTHTVGRSWRYPPGMGAGRWRYPQSGRSCDTQSGRAAIPNRGRANDPPTCEVGGSESNRNMVM

SEQ ID NO: 987484 - protein, 53 aa, Homo sapiens
WPCRERPSYQFMSFLFIIFIIFILLFLLLVIIFFLLLYLVMARPRFSSVLLLP

SEQ ID NO: 987485 - protein, 39 aa, Homo sapiens
SATSTKQKPPHMKYTYTRSTSKINHTQNTPHTFHVGYTR

SEQ ID NO: 987486 - protein, 75 aa, Homo sapiens
VLRGSRLGLVELGKCCCRYPQTVIQDAGRYPPRVAQDAGRYPQKWCRTLDTHQAMVLDAGRYPPYSGSWTLCDSP

SEQ ID NO: 987487 - protein, 101 aa, Homo sapiens
DPHSSHSIISSFNLIICTSLFYSHHAHLIIPSHSIIPFHHLISFHLISFQFHGLPLGAMETPKPQGIEVPIGTLPRIKALTGNQLVFHSFRSSNSPGNGYG

SEQ ID NO: 987488 - protein, 37 aa, Homo sapiens
MELPKTRPSLRSSISTSFHKFIPATFLSFPPGCKTTM

SEQ ID NO: 987489 - protein, 38 aa, Homo sapiens
MASAAMEVARLSEQSSLAGKVDRRWLIMPLREAVVEVY

SEQ ID NO: 987490 - protein, 36 aa, Homo sapiens
MDSQSISGFACRVVHHTFWVLTRVRVSTSPPYGGVA

SEQ ID NO: 987491 - protein, 30 aa, Homo sapiens
MRGSPEPGDQGLSELRFVSPRSVGDGIDTQ

SEQ ID NO: 987492 - protein, 121 aa, Homo sapiens
PLEYVTEMLRISCFFCSPSTKSLLREEIVDPLYGIAEVEIPNIQKQRKQLARLVLDWDSVRARWNQAHKSSGTNFQGLPSKIDTLKEEMDEAGNKVEQCKDQLAADMYNFMAKEGEYGKFF

SEQ ID NO: 987493 - protein, 48 aa, Homo sapiens
TEYSQRGHEVGEAAAEAQIMTFQKYGQGRFRPMKQTREQETPPELFLF

SEQ ID NO: 987494 - protein, 68 aa, Homo sapiens
MWPSDSTHRFIPKRTGNRYSNNPLYTNVHSSTIQSSQNVEGTQMSTKINGETNGGIHKQRDIIQPSLV

SEQ ID NO: 987495 - protein, 59 aa, Homo sapiens
LQQLLFTLGQGTWKAWRASRPPPVLVKKKIYWEHRHTYEFKYGLWLLTCYNSTAERGYP

SEQ ID NO: 987496 - protein, 81 aa, Homo sapiens
DGYRKYDVRRERTSLGANFDFKINDKNIIKAGAVYNWRDDWDNRYRLRFNKVTPIYDKTDESLITGYKADLRAQTKGGIDT

SEQ ID NO: 987497 - protein, 61 aa, Homo sapiens
HGNLHDNGGGCIDGGEQPWQVESGSRYARAINEPVGIHADGTRQLPICSSEIEQCPDRSLI

SEQ ID NO: 987498 - protein, 139 aa, Homo sapiens
RESLNEAAIQAILYLAVVAHPLDRSVRIGEHHIMKFAGCTWLAHDEVQLLELLHPATPGVHGTFPEKPRFSRKRAGVLDRYDGMIGHTRPETKQHVPCRLSLRISVNNLHGNGQCPRNRAEAVVGFSCPFQRFGNVGEV

SEQ ID NO: 987499 - protein, 64 aa, Homo sapiens
MSGRRLYTVLRVQEKEGTITSLLPAVTCTHSGEQDKVLLSYSLPSTKDTPKDQRHQARKSDKRG

SEQ ID NO: 987500 - protein, 35 aa, Homo sapiens
RGFALPRQWEEKESSCQVPGGRKLVERLGLEKLDL

SEQ ID NO: 987501 - protein, 66 aa, Homo sapiens
MLRISVELASAPRARVRAAARCLGSSEAAQDSSSVDLELPPLWEEHVPSELQERLIQTEGRPSQRA

SEQ ID NO: 987502 - protein, 35 aa, Homo sapiens
MLLLIEHLALRARNYEYLIRLFQEWEAHRNLSPAP

SEQ ID NO: 987503 - protein, 46 aa, Homo sapiens
MDPLWFLCWRVALVIGTLRFVFTHQLRSSTQHKTTSKDDTRQHKNH

SEQ ID NO: 987504 - protein, 60 aa, Homo sapiens
RVGLVLEAYMRLDEVLPELKASLALSEMLFRGEGPPCACSRMYQYQMKMRKPCKEVMMLK

SEQ ID NO: 987505 - protein, 65 aa, Homo sapiens
MIDGTCTGRHAAVLVNTRLTRLHVYDLGAVITVLTCLTELVYEGMHRTGEYTSICKHACILGSWT

SEQ ID NO: 987506 - protein, 110 aa, Homo sapiens
VLPLIAPLAHASHAERRLKRVSSEQDIDRTLINWKPQRKEEIVAEVNAVEGGRVSASAQLHQFLLGLWCQEANKGTLLGGLKPLQCLACLETHRLCHSDCALIVNGADEV

SEQ ID NO: 987507 - protein, 43 aa, Homo sapiens
MHECVVILLVACILPVVTPPGVVNARCAVSSFCRYSADRYELE

SEQ ID NO: 987508 - protein, 42 aa, Homo sapiens
EAVSPKYTVTPAEPCNSLLATTPILPHMHSGEAGNWALCCFT

SEQ ID NO: 987509 - protein, 94 aa, Homo sapiens
MSAEVPPFSVDCSVSLACTIDKLRTGSYRQIFQPEQVITSKEHAGDNYCRGHYTIGKEIIDLVEDRMRKLVSTTYKYAFNVGEKFQCNLSGVPD

SEQ ID NO: 987510 - protein, 107 aa, Homo sapiens
AAGHLRIPFGVRPTNQVVYLRCTGGEVGALLPWPQDRPLGLSQKKVGDDIGQGTGDWKGLRITVKLTIQNRQAQIEVVLSCLCPNHQSPQGNTKETERNRKKLNTCG

SEQ ID NO: 987511 - protein, 55 aa, Homo sapiens
GQALKPGQALKPVETGFRHVGQASLELLTSSGPPASDFQSAGIAGVSNHTRPKIV

SEQ ID NO: 987512 - protein, 45 aa, Homo sapiens
IRYTATVAGTLSAREHSGQAVTAVFRSPPGTGRVRGDVWAPAALG

SEQ ID NO: 987513 - protein, 88 aa, Homo sapiens
LEDPYHFCCVRRARTVCSTIQTMSLVRVAHSATSCERWCPLAVRTGWRSRRRGKQRLVLRFVVGVVADKTLAGCQVDLLGHQLLLVES

SEQ ID NO: 987514 - protein, 37 aa, Homo sapiens
SDSLGATRLCPSEIIGECVRLTLAALVEPRIRKALVS

SEQ ID NO: 987515 - protein, 33 aa, Homo sapiens
HLQQRCRYTVTPGLDRAARTWRPGTSVFFLNSP

SEQ ID NO: 987516 - protein, 50 aa, Homo sapiens
LRILHTATADPFTDSEDRAARVAVLTHTSRLARSEACAPRSWCGTSSNRI

SEQ ID NO: 987517 - protein, 35 aa, Homo sapiens
RPSRAVHLNYSQKGVIDVFLQLGKDTQVCMGHDEL

SEQ ID NO: 987518 - protein, 32 aa, Homo sapiens
LAAQCIVMDLETGHPHGAIYEGYASPTPSASG

SEQ ID NO: 987519 - protein, 71 aa, Homo sapiens
AAVEAAEKVGTVSETVGASYREVSCVDSQEGRSAEPGPGRAVRLRRMPCWLERRIRKRVRKKKGEQKGPAR

SEQ ID NO: 987520 - protein, 38 aa, Homo sapiens
LVMKDNGRSCPPVMRFARGDAGVLDAEDCQTLTKTICA

SEQ ID NO: 987521 - protein, 32 aa, Homo sapiens
MGSHVAGCSTLTHDLPLTSKVLDDSVSTVPAR

SEQ ID NO: 987522 - protein, 43 aa, Homo sapiens
RSAQADRQHIDSQTRVTEEDAGRISIQSTVKDDEESKCTRAGG

SEQ ID NO: 987523 - protein, 42 aa, Homo sapiens
YHKGKLPPNLGNGADLPNYRWSQTLSELDLAVPFLCELPAES

SEQ ID NO: 987524 - protein, 74 aa, Homo sapiens
TGLLRVAVSACEAGESLEPGEAEERWAEIAPLHSSLGGESGIPSQKETKKTQKKTCRWSTVFKVLSTDTYNPVA

SEQ ID NO: 987525 - protein, 66 aa, Homo sapiens
RRPSKKRLETYYKVTEPCHLPSIRNCGYCCAHGQLLMGSGGHVSSPRVCTHHGGPKVATLDAVYRL

SEQ ID NO: 987526 - protein, 169 aa, Homo sapiens
GQALKLRVARRGVPGRGLLRLAEFLSVQLGAEKNWGGPADWASLAKSPSRLTVDSQLLGLSGMASKAPGGRQALAPGGLSQPPRGPGPPLQMDSHSKKKGLSHFTAVPGEPLGDETQGQQPLQLEEDQRAWQRLEQLILGQLEELKQQLEQQEEELGRLRLGVGATDSE

SEQ ID NO: 987527 - protein, 42 aa, Homo sapiens
MKLSSPFSISPSLAVDHIHNRRNSTHFFDPGGGDPFYNNNYS

SEQ ID NO: 987528 - protein, 35 aa, Homo sapiens
PGSQQAGLNRECDGVVCARVGVCDGCAECWRYCVY

SEQ ID NO: 987529 - protein, 91 aa, Homo sapiens
MRQEGLLAPPTVAHTGEFRPVLECEDGGGQLQAGRVSRQAILLPLPQGEPPSRSQGTGCRAPELHPAAVVAGTQEELALEGCAWQAVESNE

SEQ ID NO: 987530 - protein, 129 aa, Homo sapiens
MEGQTSGWTSMAGAKKQQLGLVLGRSQGMTEGGDCKTDEKILGSTLYSSGKARGDPLTKQISDNQYCFKNWVLGDGIVMAYDNVLQKLLEEYGSDDTRNVKETTEYLKTSWINLKQSIADRQNALEASV

SEQ ID NO: 987531 - protein, 77 aa, Homo sapiens
APLDEIVVNWCNGTFGKVVECLDHARVKSQVALKIIRYVGMYREVVRLEINVLYINQGEGQSKTMFLCVLMSDWFNF

SEQ ID NO: 987532 - protein, 40 aa, Homo sapiens
TNRNNGFEKNIVLASLYLITALRLYNLYADFDLCIEVNCI

SEQ ID NO: 987533 - protein, 127 aa, Homo sapiens
MTGSNSHITILALNVNGLNAPVKRHRLANWIKSQDPSVCCTQETHLMYKDTHRLKIKGWRKIYQANGKKKKAGVAILVSDKTDFKLTKIKRDKEGHYIMVKGSIQQEELTMLNIYAPNTGAPRFVKQ

SEQ ID NO: 987534 - protein, 81 aa, Homo sapiens
RSRTGYVSFHCHGHFSPNSTKNWNISTDSNAKERPKNNVTNIELKEEWKREGFMLVRGSKGQYVFEDYHLIKAHWLYDKPP

SEQ ID NO: 987535 - protein, 57 aa, Homo sapiens
RFRAGTEASHPCKQLMDFCNVVAAETGRVIYVSDSVTPVLNQPQSEWYGSTLYAQVH

SEQ ID NO: 987536 - protein, 39 aa, Homo sapiens
YRAYLAAQWCTPGFQPLKRLRHENCVNLGGGGCRAAETM

SEQ ID NO: 987537 - protein, 51 aa, Homo sapiens
GLGRPLHETCPCVGVLWTVTTPPGWDSDSATSRQDQPCSPQLTYRLTWYRR

SEQ ID NO: 987538 - protein, 34 aa, Homo sapiens
HLHEEEMRGLLIVGMFYHMPMLHIDYRITNIKQE

SEQ ID NO: 987539 - protein, 41 aa, Homo sapiens
SVSTNRRIKEVQENLAECGGACLESQLLERLKQENHWNLFV

SEQ ID NO: 987540 - protein, 103 aa, Homo sapiens
KLTRESDGVFHAATDVNIKMTTFSEKCCLDVPFSVPAVEGNDSILIWFPFNPLVVRVRWYLDVTSDWMFTGKLLKWSFGAKMNSFPSSKKFPSWSLSFISTAL

SEQ ID NO: 987541 - protein, 35 aa, Homo sapiens
ASGEPGTHIKRIASGSSEEAAYSNPSLALVHPPSH

SEQ ID NO: 987542 - protein, 70 aa, Homo sapiens
MEPTMVSNRKYVPAFRRSGWLPHRVMIAQVRIRVVTKNMCNMISSVAVNVIIKEICREISIERKSFFRDS

SEQ ID NO: 987543 - protein, 89 aa, Homo sapiens
AYLQCGDCDERPWSRTLPAPRCSRILRKPMSVEMNVNVLDFVALSAHVCILCAQEQGTRCRYEDYVEGLRVFDKEGNGTVMGAEIRHVL

SEQ ID NO: 987544 - protein, 139 aa, Homo sapiens
TAGLSVSHCIRPLCPLLIRGFRTVQSNCNWCPDSSPSIEAEVPLLLASHRGPLIPAHLLELAGMRTRGPHQCHMIDRLLAVAGACIEGKPRYPHQNAVSRKDHMGLHSPHKSSSFSILHRPYTLYPVARSRSRISTGVM

SEQ ID NO: 987545 - protein, 60 aa, Homo sapiens
MEVGVAGPLGAPVYQGRKQEAVNSITQLPSEDGKSCVGKTDRKHNNAEDEELEHYRSHES

SEQ ID NO: 987546 - protein, 62 aa, Homo sapiens
KYVDSMRDTPVDTFWNIILGGLVLDVQVKQKARKDLCYIPSVLAIYYHLEDLTTPIHVCISY

SEQ ID NO: 987547 - protein, 132 aa, Homo sapiens
LELSPPNVDSAMASSCVVLQGSLDLWASQDSANICINHLVHSTIVVLLREAALRLVPYNSSYFRKALSVQMQKRPTCPPGASFKMFSLLTLSRVIPGMFLKALLNTIFLIIYNARAPALDTATVSHACVHFF

SEQ ID NO: 987548 - protein, 40 aa, Homo sapiens
PVDLSELIEQNRRAAAEGSDDDPITAAADQSPLLQERDLI

SEQ ID NO: 987549 - protein, 97 aa, Homo sapiens
MRSPTNVNLSDIRRIGQRNQRNLCQQLQHHLVNANVVSRHTSHGYNKIPADDHNLIGVTAELVDTLYAKVRGKMLSPVSLPSVCVRLFSNQIRQSRA

SEQ ID NO: 987550 - protein, 30 aa, Homo sapiens
MPYSKASAPGGLPVLCFPPGTMRSPPGYPR

SEQ ID NO: 987551 - protein, 98 aa, Homo sapiens
CGLMRRRTFASCCATIYPILSGYNSPSLVLCCLLCQLLEGCTVARIALAREVEAAEVVIMPLRSSLGDQIKTLVSNNNNNKDQDLCQIDTLSCASLMG

SEQ ID NO: 987552 - protein, 57 aa, Homo sapiens
SGPVLPHKQFTLGLTPAVYSTCFDKSLMRCIHYYGTIQSGSIALKILCATPVCGGST

SEQ ID NO: 987553 - protein, 34 aa, Homo sapiens
RGRQQQNAERRGYFLFYSLVGSFPYSSHYIYTHN

SEQ ID NO: 987554 - protein, 76 aa, Homo sapiens
MAFGRHGSATVPGRRVLRLVLVFSESRSFLLLPIPDFVALGVHDLPRSHRDRFDTGRGPDLDGRVGLSLEVEIPIR

SEQ ID NO: 987555 - protein, 54 aa, Homo sapiens
LGTILAVSYNVVLCRVCTMSSDEFGKYNASRVPPSGEQRDELLGLRAREQIISY

SEQ ID NO: 987556 - protein, 71 aa, Homo sapiens
YWHSSQVTIHVTQPSLSVKSFPVVQLPLSLGFQLALPAYWLLTAEDSYDSEAIQRNRFYFKINLDVKAGTR

SEQ ID NO: 987557 - protein, 76 aa, Homo sapiens
LNESWSVSTVLMCRRNLYTGWHAPDVVNTRRPGSSLTIFGESARCSRVDGTCPGRHAPAVGEYTSTCRHACMLVVL

SEQ ID NO: 987558 - protein, 44 aa, Homo sapiens
MAIIRKVRKQQVLERMWRNRNTFTLFVEVALGILYKSELAGNSS

SEQ ID NO: 987559 - protein, 30 aa, Homo sapiens
MYFAGTWMKLEAIILSKLTQEQKTKHRVYS

SEQ ID NO: 987560 - protein, 51 aa, Homo sapiens
VYPQTAYNQWTVTVIIKEICKEISIAEVEYFLVIVVHWISGVCLPVCGGST

SEQ ID NO: 987561 - protein, 63 aa, Homo sapiens
CEYTSVCTQQKDGLIATCTEADATWMLNRLPILHTCRPCVHSNCWFLCYIPCSGSDWDGNTNC

SEQ ID NO: 987562 - protein, 38 aa, Homo sapiens
TVLSQTECYHPPTECYLLYCQVQCGGCPLFVESVSAVS

SEQ ID NO: 987563 - protein, 37 aa, Homo sapiens
FEMLYRAVWYVSKEEISRFIEQLPPMSDYGLRNKKSW

SEQ ID NO: 987564 - protein, 59 aa, Homo sapiens
MSSTQKVYYSLYFTRCILLHHHKADIIHGKCLTHEETEARRWHVLLCVTMSNELSVEVA

SEQ ID NO: 987565 - protein, 104 aa, Homo sapiens
NCTGLVLVARGWAWPWACAGLAGSAQRQWRLAFFFAASAGGTALNRNNAAMAAASTRGEYGIKKLPWNTDRGACTIRARTASVKAQSAWWRWGFSQPRRRARSA

SEQ ID NO: 987566 - protein, 90 aa, Homo sapiens
MSASVHESGVLPPQTEWYLHKQSAISTNRVLAPQTVCGYLHTDSATSTPRVRTSTNRGLPPQTECYLYKQSAPPQTECYHPQTVVRSSTN

SEQ ID NO: 987567 - protein, 167 aa, Homo sapiens
YSRAVRRISRMEHSFRGGGGGSSVLEGSGAGRRGERPSGPRPSYPRGIRLKQHGAAWLSGLSEANASLAERDDAAKDCPADPVGPSPQDPSLEASGPSPKPAGVDISEAPQTSSPLPSADIDMKTMETAEKLARFVAQVGPEIEQFSIENSTDNPDLWFLHDQNSSA

SEQ ID NO: 987568 - protein, 71 aa, Homo sapiens
HRVTLCSLSSVVWDDIYRCREFSEIAEIMAFTLPPLLVRGDAAAIGESFETIPDRKIVRGSDGITSTIYQR

SEQ ID NO: 987569 - protein, 44 aa, Homo sapiens
SWYQSHGGLTFPEKPGLSLVSERDEKATMALEKSLVLAPSACPD

SEQ ID NO: 987570 - protein, 101 aa, Homo sapiens
TCYYQCGVSNSITLLQPPLPGFKGFSHLSLPSSWDHKHAPPHLANFFCRDTVSLWSGLELLTSSDPPAAASQSAGITGVSHCAHPEPYFFCSVSGNSENAS

SEQ ID NO: 987571 - protein, 102 aa, Homo sapiens
TRYLLIAQGETQETLFQSPSSSLIGDEMRFRQWLYATPLYFPVSTSLLINDRSVLITGLVRLCFGESNTAGLECSNRLAIGMIIDMESVPSSLAICPPLFPY

SEQ ID NO: 987572 - protein, 43 aa, Homo sapiens
YSRDAPAVIVWVRMKSAYISSKDRFSRIKVGSTNPVSNPFKFE

SEQ ID NO: 987573 - protein, 39 aa, Homo sapiens
MRTYYCMDTDTSYFPPGIACCRCLVSRCFRGHTQREMIH

SEQ ID NO: 987574 - protein, 62 aa, Homo sapiens
VRSYRMQEIKCVGLYYQMEKSFMSKNESRSCAMYCGCGYFNEKEIIRRLCEKIGAAEEKRLV

SEQ ID NO: 987575 - protein, 36 aa, Homo sapiens
MYIAATGAWTFPDWNLRILGLKCPELRCCWSEQCLR

SEQ ID NO: 987576 - protein, 54 aa, Homo sapiens
CSILEVVHVLLGKPDQLLPVVQHLNMVEAQGADDDDVAIIVVAAGGRSFGQAGI

SEQ ID NO: 987577 - protein, 68 aa, Homo sapiens
GYDVSGFGASREIDDGDSSSTQPRSQEGPEGVQVAAHAERDRWPESEPLGARCRLHRVHGAVVEPPVF

SEQ ID NO: 987578 - protein, 44 aa, Homo sapiens
NVCCAVISRYMLLNRESLPHLECRFIEVKKERVLIQMLLDLELS

SEQ ID NO: 987579 - protein, 72 aa, Homo sapiens
RRSLNSDKVIIGGGMCYTFLAAQDIKVQQSLLQEEQIDKCKELLEEFGSKLVLPVDLVAAASFAADADNKIV

SEQ ID NO: 987580 - protein, 71 aa, Homo sapiens
VSENPYSQQANNTMNSPFLVTPQWLAQHINDENLVVIDVRMSPVGLTPKKDMLAEFERGHIPGAVYFDIDE

SEQ ID NO: 987581 - protein, 94 aa, Homo sapiens
MTMVSQSIDNLSCVRPENVMKEAVQHGRVQAMLSMSSTCCPGRCGARARSHLQERRMCVSVAELIAAQDLDEKLSSSADMDRARCHLTGYFGAW

SEQ ID NO: 987582 - protein, 107 aa, Homo sapiens
VRLESRSFPRLRSEGFLGKLTYAKAPMWGREGFLGNCLFFSSFLRQGLAVSPRLKCNGVIIAHCSLDLQGSASQVAGSTGAHHHAWLVFKFLVEMGLAVLPRLVFNV

SEQ ID NO: 987583 - protein, 125 aa, Homo sapiens
YRQSLKGSQGDIPQKGLGHVRGLVGSTSIPLPFPLLLPYPFFLVSLAYRNKGSSKGRTFSSPILLFSVDPLTHFHSSLRVGPQLVLMCQCLITQVGNSDDGPKRARGPSGYRGPAENSKVSPGSA

SEQ ID NO: 987584 - protein, 98 aa, Homo sapiens
GEVSYSAILQGRVSTGSTIPQRGILIGIQQSFRSRFLGVAEQLHNEGFKLYATEASITIWFNAQQVYLTSQLAWASQYGQRSQTVVFHSETSMRAWQD

SEQ ID NO: 987585 - protein, 33 aa, Homo sapiens
SDIWRSALVLTCLTELVHGRHAPAVVNTRRPGS

SEQ ID NO: 987586 - protein, 71 aa, Homo sapiens
AYARMSRNTVVDLVLCTPGALARNLGCRLRQHQHDLFVWEHRVSSPLPSASSATILRAVKASSLTRLWFPM

SEQ ID NO: 987587 - protein, 38 aa, Homo sapiens
VLHLNDIWSVSTGAHVSTELCTVKACTCSGEYTSDHGS

SEQ ID NO: 987588 - protein, 86 aa, Homo sapiens
MIGSGGSLEVTRLHRVLEVSTVLTCRRNLYSEACTAVVNTRRPGSMLARLGGQRGAHVSKELVQGGMHRSGEYTSSWRHECMLGYW

SEQ ID NO: 987589 - protein, 87 aa, Homo sapiens
MLIVHECRSNAVVDWCSARHGALVESRRSVRSIQHDLFVWEHPVDSPVPRASSATILRAVKASSVDQALFPDDLGQALQVFLHLQGT

SEQ ID NO: 987590 - protein, 32 aa, Homo sapiens
SSGTAPLWEYGSWYKACKVDSPTVNTTLRSLG

SEQ ID NO: 987591 - protein, 47 aa, Homo sapiens
TAAAGRGGQRAAEPQLQTWLRAETAETVRRASELDNPFQDPAVIQHR

SEQ ID NO: 987592 - protein, 58 aa, Homo sapiens
LLIIGVWVEMSRFIAGMFIITSAILHKGFYDTTGYLRLQGGGYNFLQLEKAIRYLFID

SEQ ID NO: 987593 - protein, 67 aa, Homo sapiens
GAGAHHDLPRLDATVGPELSSSNLPGAYREITSMTEGSTGLVSAQGHRHIPMTQDIGDDLARRLAGI

SEQ ID NO: 987594 - protein, 56 aa, Homo sapiens
VDGAAYLSVFPIISSSVSGDFDRSFLCPVITLQATALTTLDHDFCARFADPAHEGI

SEQ ID NO: 987595 - protein, 96 aa, Homo sapiens
TAASSCDQEYNPAEHYGTYQKHIYEFLQLNKPESVSLALTKDIIDRMINYTFKKRTVRLKKFPWIGFDAWTKFETSLINYKAFWGARGLTGLKSET

SEQ ID NO: 987596 - protein, 74 aa, Homo sapiens
MRYRRAARADDEPKPVERGGTLSLSLFNEDYWDNNRRSQSVSLSYNNSWEAVSYGLNYTFNQNGYDSNGNRSSI

SEQ ID NO: 987597 - protein, 106 aa, Homo sapiens
TDKEVYKHKEDSSEELICVYYLVPSEGWVVEVQDIFQRLLLLIMIFFSAHLENIIPELRKPFLTEAPVEQDFSPFLTPDPPSAAADASPEPGSLSDSLDVQIFPAP

SEQ ID NO: 987598 - protein, 72 aa, Homo sapiens
MEVSTVLTCRRNLYSGGITGVGEYTSDQAPSIGYLEVSTVLTYRRNLSQGGMHRSGEYTSSCEAMIASARVL

SEQ ID NO: 987599 - protein, 56 aa, Homo sapiens
IPTSTFSAYPECPDVYSDYPDAYYHIKHPIICRLIHFLYSSQFKYLLIFSVSFVRR

SEQ ID NO: 987600 - protein, 72 aa, Homo sapiens
NNIMRLTQSATSDAGSALKKQRKVMMAGRGGGVCNPNYSGGWAYRCAPPHLANFLVSTFVEMRSRYVAQSGS

SEQ ID NO: 987601 - protein, 48 aa, Homo sapiens
VPLDVVRAACCRRQVRGWAATIRTARSIISTRLGKCITVTEPGRFCGA

SEQ ID NO: 987602 - protein, 39 aa, Homo sapiens
SRKTALLLVANCRTAAVGHTDKIGRLKELCEQYGIWLFV

SEQ ID NO: 987603 - protein, 71 aa, Homo sapiens
DTSTNSVGVHIIIVLRRRIIDATVSCVLYLSCQQNSNRGCKPVGIYQNDCAGQASRGLDDNGCYYEGYVVD

SEQ ID NO: 987604 - protein, 54 aa, Homo sapiens
MTHLDSMIYFYRKTKQRSQVLRSREGSEGFTLITSGPFWSPVGARIHFPSVCAW

SEQ ID NO: 987605 - protein, 72 aa, Homo sapiens
ADVDIKGPKTDMDGPEVDVHEAQRGTEEAQYDKAQVQRCRASKQRGAEVDVNLSTARCCCHQDPRWMWKSQM

SEQ ID NO: 987606 - protein, 53 aa, Homo sapiens
MWWVQYRNQYYVDIKSQVTFTETRRYRLSPILENREHTLEQVLMQSDLFVEVA

SEQ ID NO: 987607 - protein, 40 aa, Homo sapiens
RCIGDTFQRKVTVVITATSKKLQEDTLAYTTTIHVRNSDV

SEQ ID NO: 987608 - protein, 56 aa, Homo sapiens
EPTSRHWIAEKEALRSLLGVLPDLVVEILGVNKCRLSWGLVLESLQQRLYEQAFDR

SEQ ID NO: 987609 - protein, 44 aa, Homo sapiens
VLQLLLLLFDEVSLQQKDLFVEEKEIEELKSERDTLLARIERIE

SEQ ID NO: 987610 - protein, 122 aa, Homo sapiens
RYKLNCLDGASLKLTGVIVDDGHKSVAKVWLLSQRCLSTSLVCIRVAMWKTALHDVIVPAVGEHGVLNTHVQASQVHLVRLAVLQLDEPAQARQELRVPVGAMLIGQDGELAVALAFSRWVF

SEQ ID NO: 987611 - protein, 62 aa, Homo sapiens
IAVIHQREHFPHMYLSVAETQQKKKISGHISLMNIDVKILNTILANQKAYPPRSSQLHRWLF

SEQ ID NO: 987612 - protein, 58 aa, Homo sapiens
TGTKCYSTNSHIHTPHTSISHIHIMHHTHHIHTHPFPRTSISTHHTHSTGYTLFVEVA

SEQ ID NO: 987613 - protein, 166 aa, Homo sapiens
SSVPVLLHKAVYAEKWQCRAVPTPVINPYQLSYLLHVTFMVAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRIVPQYKYAAGVRNPQQHLNAHSTGLFVEVA

SEQ ID NO: 987614 - protein, 39 aa, Homo sapiens
RDGTLIAQDEVYVVNEKFGIRLTDIITPAERMRKLLRRI

SEQ ID NO: 987615 - protein, 33 aa, Homo sapiens
MSTCPQSCSFPGTYIELVMVGASNSFPVKALKT

SEQ ID NO: 987616 - protein, 78 aa, Homo sapiens
MGERSEPGCASIPAKHEQELAHLSKPWGRHLQMTWGGHSFSTGPPEGQADANSSPGTVGQRAECAVALLGAYGELGGL

SEQ ID NO: 987617 - protein, 38 aa, Homo sapiens
MDTLKTNLKRGTIVFQIPSLRRVVNRKIASVTEEKSAW

SEQ ID NO: 987618 - protein, 73 aa, Homo sapiens
VESSVYASCLVCSAVIIVATVKIRGVAYCIRYIPENALYVTLIAFASVMIWNATGAHCSEESQDESVEGRIRS

SEQ ID NO: 987619 - protein, 73 aa, Homo sapiens
YISSVTHDSCIFVRQIRTCLNLVSIAMMSCALQWCSPPTSSKLTIGFGADDDRIVETAVGLDRVIQKESESGL

SEQ ID NO: 987620 - protein, 38 aa, Homo sapiens
ELAPDLMSSGIPRQDCATFKWSPCPIIRDRHGFICTEP

SEQ ID NO: 987621 - protein, 83 aa, Homo sapiens
GGGGACCAKALEKGLRMGSCVLRWRIFTSGKLCVLISMRSINAFEVSGSGRPCNANICKARDQSRASFPFSLTMKRASGEGAP

SEQ ID NO: 987622 - protein, 63 aa, Homo sapiens
AGRRAEIGVKAIDQGRFSGFVNACCKSGALEVMVPQGRFGYQPQAERHGNYLAIAAGSGITPM

SEQ ID NO: 987623 - protein, 33 aa, Homo sapiens
EPGPPSTATTLFFMVLVLGRDLLLHSVGNARYI

SEQ ID NO: 987624 - protein, 33 aa, Homo sapiens
HSFFSFIRHPLFVNIFYSVPPLQSSIIIFFSFS

SEQ ID NO: 987625 - protein, 67 aa, Homo sapiens
ALWCDEARGVSSRGYDSCDIAEIVERRFEHQVTSYARARTAADAHAGESPLKSHTASNEGSRTIRIS

SEQ ID NO: 987626 - protein, 45 aa, Homo sapiens
LDRQALFLPWMECGLGLLGSMNSCGVDCVKRIPDSTAMWWSCCQS

SEQ ID NO: 987627 - protein, 59 aa, Homo sapiens
MIFLMVLGATLISFCMRSAMPGYIVVPRIGHVSIEVLPDVYITLHDAVVSGFMDASRLH

SEQ ID NO: 987628 - protein, 41 aa, Homo sapiens
DQLGTYSRIQDFCGRIMMSLKKRVLGYKTLALVVEYPMVCR

SEQ ID NO: 987629 - protein, 46 aa, Homo sapiens
APVQDVLGKSRARAQRRRRRCGEQDLQTALLQLRRWTRTDSRAVSD

SEQ ID NO: 987630 - protein, 45 aa, Homo sapiens
RKRVNWVVRIVSSGHFAEVYQLKELWAETMGLLDIELSHLQRDVV

SEQ ID NO: 987631 - protein, 35 aa, Homo sapiens
SARTGDILNIQANKRGMPLYWISPEAVKPAEEKSA

SEQ ID NO: 987632 - protein, 38 aa, Homo sapiens
HSDCTTLSFTDDGDLFTDLYLCVQTQLTTFVRLLHLLT

SEQ ID NO: 987633 - protein, 39 aa, Homo sapiens
PGTQQGADVTQEHSKKHGHTSLNTRQRNNLGRSSETGGK

SEQ ID NO: 987634 - protein, 68 aa, Homo sapiens
PVPGQLHFVRQIRTGLNLGPLQDVMRPPAALTTNKLEATIGFGADDDRIVETAVGLDRVSQKESEGSL

SEQ ID NO: 987635 - protein, 67 aa, Homo sapiens
SNLYTLARASFGLQNTKSWRTGTGTQAQLKVQVSASGGRTCCTNALRKLYSLEIRGQGFDWPPMVYT

SEQ ID NO: 987636 - protein, 71 aa, Homo sapiens
ARARNSNYGPRRVWAALWLRGHCCLAGGLRRWKLKLHTSSPSRRRLIWPEEALCALALVIPPEPAREGPYS

SEQ ID NO: 987637 - protein, 48 aa, Homo sapiens
MVRGQPGRLARHQVGGQRLCRLRIRHRATHQERQAVEVLGHQSLKAVW

SEQ ID NO: 987638 - protein, 34 aa, Homo sapiens
VVPGDVIWNLGTMRHFQMEPLPHFRAAMVHMHRA

SEQ ID NO: 987639 - protein, 78 aa, Homo sapiens
TTGVRNSLNGVMRIPCKNWLFLKSNNSTYVSQVVGVCHDDVKRTLPTFLHRQSCERRFCDGVSFYRRGKWEVKETVKP

SEQ ID NO: 987640 - protein, 34 aa, Homo sapiens
MTLFFSPLKKLDTGAHHQTQLILYISKDEFVRAW

SEQ ID NO: 987641 - protein, 38 aa, Homo sapiens
GPACTFSSPSSSSLFVNIFYSFLLFIIIIIFFSFSFFI

SEQ ID NO: 987642 - protein, 38 aa, Homo sapiens
MVMSYTVYRLLWIFFLFFFGTTLTAGRSSGGQESNLGP

SEQ ID NO: 987643 - protein, 81 aa, Homo sapiens
LGTFSHDSRSGKGSIIPIQIPISRHGQRPWLCHKMVYSLSFLWAECWFPPIYPAQLYPSLQLVNLTSPDFPGSNEGIRATL

SEQ ID NO: 987644 - protein, 104 aa, Homo sapiens
CEDDHISRTHSIIAVNLSSVGAASTADIIIHAYNLTLCYEQTVRDCMLWTKIRNDNLTDFASMGLTTNFSACNNPASATGTRNTAEMPHISHSFRASYVMKVFL

SEQ ID NO: 987645 - protein, 64 aa, Homo sapiens
MLGRNLIRLQHYYFIFNFVFCLFRATPVASGGSQARGLIGAVAASLHHSHSHARSRIASATYTT

SEQ ID NO: 987646 - protein, 59 aa, Homo sapiens
ELLLERLQEVGEGEAQGPGRFLSSLWERVPQNNFLKVIAAALLLPPSSPWLQGEELEPG

SEQ ID NO: 987647 - protein, 55 aa, Homo sapiens
QDYALEIAHCLLYSRRKSDGRRLSQSSTTAAFTGLFIVWVAWVGRDISVSRQVHL

SEQ ID NO: 987648 - protein, 66 aa, Homo sapiens
MVSRGELSVGRRKRMWGRPCLGCPVGSGATCEDVDAGGRWREEGVDAGGGRRRPWMQEERPLLPDR

SEQ ID NO: 987649 - protein, 47 aa, Homo sapiens
MILYYIVPHAEVVIFETCCGYGVTAWCENLHPLPRIFKGQRELTGRR

SEQ ID NO: 987650 - protein, 39 aa, Homo sapiens
PAIAASGVPLWRSGTNPTKNHEVAGSVPAFVQWVKDLVL

SEQ ID NO: 987651 - protein, 48 aa, Homo sapiens
EQDLIHDQASWCCKSSVYTTAVHASLYKYRRHVSTADSKYRKLELVDS

SEQ ID NO: 987652 - protein, 58 aa, Homo sapiens
MMEFCDHKKYRVVLALVEHVLGQDSILNQSNSIFGCIFYTLQLLLGCLRTRWASVLML

SEQ ID NO: 987653 - protein, 73 aa, Homo sapiens
LGRMSGSININWILGAAETTGKQWGACWSCMVWRYWKKGVQPTGSVSGERKRSEGCTWPLGSSGLPKGNGLKF

SEQ ID NO: 987654 - protein, 141 aa, Homo sapiens
LGLQARATALGLNINNLISGHNLSVAQPYSTDTLNETIKLLIFQTPIFLSLSKKVIVDFFDDTPTPMEYHHSAAFLLLPSMFKLLFLCARSTQPWIQPNALSAPHFYGASDLAIPLSVFVINQNILKGPYLLNILPPSDKN

SEQ ID NO: 987655 - protein, 55 aa, Homo sapiens
RLERLGMMLIFAGIHSNTLFVWSSVHVFRWYIYNEYGNQLTPVFTEIIIPKDRSY

SEQ ID NO: 987656 - protein, 44 aa, Homo sapiens
STLQASVTKEESEKEQPAWRQRSSCAPMLQGECRYRGDTVCISH

SEQ ID NO: 987657 - protein, 100 aa, Homo sapiens
LHDLMLGGELQAATQVSVQPNFQHDKFLGRLVQRGASPSNSAWLREQEGGVVQCASSVVAPATGLVALNPDPPPFLRETPSVRTRNQCWLKPGGAPLGLQ

SEQ ID NO: 987658 - protein, 38 aa, Homo sapiens
WRTRLYDRRKGRAERMTCVVPLQKYPQPKAEEEDRQVR

SEQ ID NO: 987659 - protein, 69 aa, Homo sapiens
AAALGMRSQRVGHPRLPSIYSVLGFPLAGTLSSKLTQVSQPTKISLRHVLIYGQTNQSTEKLSNLSKVT

SEQ ID NO: 987660 - protein, 39 aa, Homo sapiens
TEATVPGLVQPNFQQDKSWGAGSAGPRFNSSWLREKKAA

SEQ ID NO: 987661 - protein, 50 aa, Homo sapiens
QLGPICVIARKQNIAVDRAALTEANVSDYMQHVLDPEKSKVIRYELPAMN

SEQ ID NO: 987662 - protein, 47 aa, Homo sapiens
EDKTDKFLDSSKRREMQAMTCVSREVLPESRLKAQELREKLSEAARS

SEQ ID NO: 987663 - protein, 69 aa, Homo sapiens
MRKFHIKKDLEIKHSDEPKHNSAKELVTNQSLSERSSRGGARRKWGHRSVTGNHFKGNILDFCPTSEYG

SEQ ID NO: 987664 - protein, 56 aa, Homo sapiens
MSGWTEITDQNMTRVLREHRLWLLMVVGNAWFCVTVFSLSLSLFRAVPAPYGSFQA

SEQ ID NO: 987665 - protein, 41 aa, Homo sapiens
PGLSACVIWLVTCLVFVFNFIGLWLTYSVVVVSGYSTVIQL

SEQ ID NO: 987666 - protein, 78 aa, Homo sapiens
MTNNTVLDLKDLIFLENKSAKTQGSNALKATELLQQKNPHHGVKAIKSRPNENSPKAGREMLLQLLGHCTYSGRDRYY

SEQ ID NO: 987667 - protein, 83 aa, Homo sapiens
MRSDRNYEIQKTNLGSYFGQKQYFRKKEKEEAKEDRENDQSQRQEKNTKIQYTVPTMNIHELKEKVFTYLELIRQAENNTGEN

SEQ ID NO: 987668 - protein, 44 aa, Homo sapiens
GTNLQGRQHACGDFFGHPLHPIKRRIERQIIQNLSLAIGIHISL

SEQ ID NO: 987669 - protein, 77 aa, Homo sapiens
GAGLSGWCQQFLFSHCEQHQNKNHFTHLQVAELIQSYNKCMCMIWVVDEVLCFINVMDVPHKPTHVLSKHVCRSSFC

SEQ ID NO: 987670 - protein, 51 aa, Homo sapiens
MQSTALNWYQLHNAAGNPLHSIRIHCSMLHGFHFIQPGYIAPCCMQSTAFT

SEQ ID NO: 987671 - protein, 55 aa, Homo sapiens
GSLQVLLPFLAPYTLVTALSSEANTLSTNGIHLLEKNSSRKQITPMFEWPSSAVL

SEQ ID NO: 987672 - protein, 82 aa, Homo sapiens
SLGRYSGWVKILSVTSWTHTGYVRITICGCQIIPGIYVLTEVLAKLSLYTVFLTLAVAVSRDYFQRGRSAVCVCWVRPALYR

SEQ ID NO: 987673 - protein, 49 aa, Homo sapiens
VKRYPTPEEKEEDTSKGIEGQFSLIVNNPIPPGVGSSTDWKLTGSDRSY

SEQ ID NO: 987674 - protein, 47 aa, Homo sapiens
MAARTLWLGRIRVFSVKSPKASGGPDHCLGPEVCLPFPTHLKSCGLG

SEQ ID NO: 987675 - protein, 50 aa, Homo sapiens
MAVWYVDTKLKEDLLDVLDNWMKRILTSNLLMATILIRFLSKYPLLRLDL

SEQ ID NO: 987676 - protein, 72 aa, Homo sapiens
LGRVERSHTAGQEAQLKVLNTANYYSEYKSKPQLRITSHWSELVSSKGLHINAGGSGEKGTLLYYWQRCKLV

SEQ ID NO: 987677 - protein, 65 aa, Homo sapiens
RLERSPRNKCISTPCNKKDEGNKRSRSLSCSVKTFTSSKALVQKLPSTYTPGDKSPEYNTSTIQA

SEQ ID NO: 987678 - protein, 35 aa, Homo sapiens
MASRQCLVAGVLQQQGCAGRWYRLLLVSGPWEVVV

SEQ ID NO: 987679 - protein, 101 aa, Homo sapiens
ATVGVSDDTTRVSEGSNTKATGGSTNMIFDGSGDSAPHRFQHRLHLISTDIVTTGSDNFNTSVVVGTWCCCKGIQNLCHGWFWHYCHRPLFTRNLMDTSRV

SEQ ID NO: 987680 - protein, 108 aa, Homo sapiens
ERDLPKVLDHRDLLYEQLSKYLQVRNVMERLQEAKHSELYMQGDLGCNFFVDTVGPDTSRIYVALGYGFFLEVTLAEALKVIDRKSSFLTELSNKLTKDSIDIKAHIH

SEQ ID NO: 987681 - protein, 39 aa, Homo sapiens
EVQDPGKVFDEARTEAQQSKQQFVVKVGKESRSQCDVGL

SEQ ID NO: 987682 - protein, 70 aa, Homo sapiens
STSETHISYTEHSLNRVWGRVDLELTTASRTSQRQYAYWGVVLSGPAPYSHSRRQGLEVDSTPQRVLTRD

SEQ ID NO: 987683 - protein, 157 aa, Homo sapiens
ITLIAGDPCDSWYAAVVPAVPRTDQQQGGDEGDRIDGPEFVFERDIAKPGTHGRFSLIAETVLARCHYCAAIQNSAFDMGQMRRINRWQASRKSAGRTRCCAAPGLPLFRYRCKATSAQYFGQVSGFIATILRAWGAGCVEAGLGRIVSQHSKGLGE

SEQ ID NO: 987684 - protein, 101 aa, Homo sapiens
MATRINSIEKTLNDLMELKTMAGELHDACTSFSSRFDQVEERILVIEDQMNEMKREEKFREKRVKRNEQNLQFIWNYVKRPNLCLIGVPESDRENGAIRVS

SEQ ID NO: 987685 - protein, 83 aa, Homo sapiens
GDSKDPRGGQIVESGVKTCPGNTLRLYLYKKLKISRTWKHAPAVPATWEAKVGESPEPRRRRPQGAVTVPRYSLGDIVGTPTL

SEQ ID NO: 987686 - protein, 122 aa, Homo sapiens
PGRFPGFMRLNLGACCPRQTANRRGPPGRSARQQQGDQDRLHRQQRDFARMQQVLAHGIGVEQHFARQAEVVLHHLQQVQRQATAVDQQGAGAGDHGGEGVELFGARDLALFPGVLFTFLRG

SEQ ID NO: 987687 - protein, 67 aa, Homo sapiens
TLPVTTKEIKTCVTKKQDEPWMTAHGDKEIGGSSEQQKSHFSPVSQKKTRQTVEAEQRPVLCLVSAL

SEQ ID NO: 987688 - protein, 51 aa, Homo sapiens
ATVDFDKDKIIKWAHGGFMPNGIGGLIASFAGGDVAFGGIEIIGITAGKAK

SEQ ID NO: 987689 - protein, 78 aa, Homo sapiens
TVELSVVFKSPDICSISLAQRETVECNTFLPKLTGRLAVSAQTSAHAKGRGFLFLLSLHLRFPDKPEDSNFSTHDKST

SEQ ID NO: 987690 - protein, 36 aa, Homo sapiens
WCLAVLYLSHDRGVREQVLGRGVWCKLNLRIEEGHQ

SEQ ID NO: 987691 - protein, 102 aa, Homo sapiens
DEYFSKTETKLIIFSTEVCIPIFFFWIPGFAPGWITVAPPRLQSLDLLGSSNPPTSVSQVAGTIGMCPSYVWLPVFLILRDNDFGELSPLFTSSNQLQFYRG

SEQ ID NO: 987692 - protein, 47 aa, Homo sapiens
DLEDPSNLIASSLRQPGNMVRPVSTKMQNYLGMWHAPVVSANREAEV

SEQ ID NO: 987693 - protein, 66 aa, Homo sapiens
DPPREIHHVLEDRVGGQGEEFFMEVDIGVHAGFGIAGIQVFAHVHQGQAQLADFLAADRLGHQADD

SEQ ID NO: 987694 - protein, 40 aa, Homo sapiens
VIVISSDGLLAGLASSNKAVNQLFGISYSGYDTPQSWFPV

SEQ ID NO: 987695 - protein, 79 aa, Homo sapiens
SNNRVSEDLDLYRMSRSLGTPSSSCRSGLTAHTGLQQFGGVSLIVCSPFMSRILWMYRDSSRNTISLCLLSYHSQTRVE

SEQ ID NO: 987696 - protein, 76 aa, Homo sapiens
MQLPRWQLIGGFLGPMYVVVLTLATPHIGIAMTMIAILSGQVGKSVLIDHFGWFGTERKWVNGEALDRVGVDCGGS

SEQ ID NO: 987697 - protein, 68 aa, Homo sapiens
GFRRSDLMGDLRLDHIAAVDRREVGAGGPVLGLMLDINVEFTGLEGFKGHVAVAIELHFDLVVVIETL

SEQ ID NO: 987698 - protein, 80 aa, Homo sapiens
IEYNTKTQGFLVRSVERIVNMSWGEIHPPPKGTGRDHYLTAVTRVDNQLVEIIDVEKILAEVAPTSETISVGVVDAETPH

SEQ ID NO: 987699 - protein, 78 aa, Homo sapiens
DRDDTGRLLTESQAKARQVAMKEAVTQTDAERGKIVKKEAVTQTKAKAWELVAKTEAKREALTQNKAETHILAEKETE

SEQ ID NO: 987700 - protein, 33 aa, Homo sapiens
MGDAKGHRRKAGAAAPKRQRHVPGRKVMPRHSS

SEQ ID NO: 987701 - protein, 92 aa, Homo sapiens
LKRVNWDGVDFSAHFQGSPPAKSLCAECSRGLSAPSLSESAVGPVEACCLVILAAESKVRLSRPTYSELGSSQTLLMASPTLATPSTVLGTA

SEQ ID NO: 987702 - protein, 99 aa, Homo sapiens
RGSLYRLRRRGIQIFDVAVLRPFPTRAHFCFHGQIRLREQKNPPATTHPTELRLRVSVALYPPSADDHTSHRAQVEGLGSPCPRHPADDHTSHLAQSCE

SEQ ID NO: 987703 - protein, 48 aa, Homo sapiens
MIHMRVLLHALIKCEWTSNLAEAITLAERKYSDEKKRVDELQQQVKLY

SEQ ID NO: 987704 - protein, 59 aa, Homo sapiens
MRGSSFNGLGVHESMHHVEGSASSDLQDWQPVVHISLPSPELFSVQSHCVIDERTDVLS

SEQ ID NO: 987705 - protein, 91 aa, Homo sapiens
MGQMDVEVTRNAPRYWPKASRIKHTEGSENRVLILPGDKVELGKAIVDNLCRPGTYTASRWERTGTGVVQGSSKSTAYEAIQQLKKSTIEN

SEQ ID NO: 987706 - protein, 186 aa, Homo sapiens
GQMDNKIQAEVVSDGDEELIQSWSKGHSCYAKRLVAFCPCPRDLWNFELERDDLGYLAEEISKWQSVPEEAEHTNLKNLQTDDAVENKNPFSREKFKLAAEICIGNKKLTINHQDNGENVSRACQRPSQQALPSQAQKPRRKNGFMGQVQGPPAVCSLGTWCPASQTCQTWLKRAMYSQAWFNSEA

SEQ ID NO: 987707 - protein, 99 aa, Homo sapiens
TNPNRIEAVVLKHIEGGALYLEPERPLTMIKRMITARFVHPGQLVYNASLLGSAAQFVAYILRSSMLVICRSSFQGAHTVAGFLGNQHAQNMHGLTWGA

SEQ ID NO: 987708 - protein, 53 aa, Homo sapiens
GSDGQDVTSDNLLGDEVFQGRLGSRSHSCRNILDCSYTSHKGQGARSAPSIGE

SEQ ID NO: 987709 - protein, 76 aa, Homo sapiens
MKLRRLCAFAFVPTLFLTSINLHAEQLGQYGNTWNIQEQDAIDMIKGRLGEMEKRGELTKYWNDYRDTQLAGRLGL

SEQ ID NO: 987710 - protein, 159 aa, Homo sapiens
KDGSDGHEEARQYAIPSMESTLNQSAIDRRHLISDPHHRVRYTTTQEPAQVRSCTACSLRPRRHRAAGQCLSGMDHILNKQWGPTLLELQSVPGLSKPTALYRCGSRVLDTWNPQRANYVNTALVGQQLGHRYRKQIEQIAASEWSHTATNLVLKGPSR

SEQ ID NO: 987711 - protein, 39 aa, Homo sapiens
TGKMGQIGPWGNTEWYEGWGPPTVSSKPRVSDSHVMIFL

SEQ ID NO: 987712 - protein, 61 aa, Homo sapiens
MPCRVDVYSRYCGACLPVLSIRRHVSTVLSSKYVKLEPGRRVFTTAVHASLYKFRRHVSTV

SEQ ID NO: 987713 - protein, 100 aa, Homo sapiens
GSCTSTAQLLDYRFTAALFIANFLQEMESHSICPVLQCSRCNLGSHATYYLPGSSNSTASASESLGPTGIAPPNPANIVFLVETGLGHVSPGRSKTPDLR

SEQ ID NO: 987714 - protein, 130 aa, Homo sapiens
ITLLDGMESLQHGCSSLLLEGFILLIMRMSRQEELKFLHIALWSCSRKPRAASEAPEEEVSLPWVHLAYQRFRSRLQNFSRILTIYPQVLHSLMEARWNHELAGCEMVWPSSACPEQALWCFQLHSVNGE

SEQ ID NO: 987715 - protein, 119 aa, Homo sapiens
RSSVGCVLLTSEGRIFKGCNIENACYSVGIYVLNGPAIHKAVLQGYKDFRPIAIASYVTNWPVYMTKPDGYVYCHDGLGTADLLTLRPERPAEDPVTAREWPLPVTATLKNFIQMSHRP

SEQ ID NO: 987716 - protein, 45 aa, Homo sapiens
RSLWGKAVNGGLKLVVSQLCVYLGPRGSLSPGDLSTPDAVMGTLR

SEQ ID NO: 987717 - protein, 61 aa, Homo sapiens
IPTLSVGQGERGYKLVVTPWAVLLGGTTLRTQRFYMSSYWRILSTTCMLVHRATPYSVEVL

SEQ ID NO: 987718 - protein, 48 aa, Homo sapiens
LCDGPHGAPRRIYIQAHIDRDVLIVLVRDAKNLVPMDPNGLSDPHRES

SEQ ID NO: 987719 - protein, 37 aa, Homo sapiens
DALCGDLHESSQIMSRSDQVQTAGWHGGGLYPVVDVA

SEQ ID NO: 987720 - protein, 49 aa, Homo sapiens
SSLWGFWLWRAHSMSNLHSLPGLNRFETQHINMTFPSNAPTAMQVINNY

SEQ ID NO: 987721 - protein, 49 aa, Homo sapiens
YRPPFLGATLNSFIHVLMYYLLWFVVSPFHSVHTYQWKKYITQGQLLQF

SEQ ID NO: 987722 - protein, 121 aa, Homo sapiens
ASVLKYAESPWTAGTLYTYTENWRVFKALIAAQYSETQVRVALRTTPLSILGQTNRTPKYLRKFPAGKVPASEGDDGYCVYESNAIDYYSEQRGAAGTYSRGSSPGGAVCELMLIPDIVPH

SEQ ID NO: 987723 - protein, 63 aa, Homo sapiens
SPESNTVICSEYQYIDFYRFSYFIFLDQTHSMQKFWGQESTSVPQLEPESQNRQCCVTQGIGD

SEQ ID NO: 987724 - protein, 97 aa, Homo sapiens
MRSSTEQPERDFISDNKKRGQAQWLIPIMPALWEAKAGRSRGQEFQTNIVKTHLYDDYKTNYPGVVMHAYYPSYSGGYSRRITLAQECQRLGLAEDR

SEQ ID NO: 987725 - protein, 66 aa, Homo sapiens
IELAPIPNYASVTLKQKKYPTHSRILATKNNGNNDKAILQHFSFYKFTARIKVKKRELHSYSFYLV

SEQ ID NO: 987726 - protein, 47 aa, Homo sapiens
MPVTRIILPVPIRFDQPQLSIRVPTELCLIANASAQHDSYLLAMQQC

SEQ ID NO: 987727 - protein, 81 aa, Homo sapiens
VCICQWQISILNEPMQTNATTSAESRYRSICEWTHGGARLSRTPDMLNPHTAEKVGHVMAMAWTPPESNTRVLSCSREVRL

SEQ ID NO: 987728 - protein, 85 aa, Homo sapiens
ELQTRDTFNSIMKVTVDIRQDLYANTVLVGAAPPCIRALLDWMQKEITALAPSNMKIKIIAPPERKYSVWIGGSILASLSTYQQM

SEQ ID NO: 987729 - protein, 31 aa, Homo sapiens
MPLEYTLKRIYTQLSKTPKQTRYYNLATPFS

SEQ ID NO: 987730 - protein, 93 aa, Homo sapiens
MTSEICYHRGVDLSVLSALRKSSFASKRPCEPHQHSRKATLPQKRLTNNANPQEIFHGSDKANTARSRRVQLPQEKENNKQDEEAEKPLPVKP

SEQ ID NO: 987731 - protein, 80 aa, Homo sapiens
CYRAKLRTHAAMGIPSPSDWRNPKKKPATTADADRLYHVNPSFVDLLPWVDYLPAEKAMLLEDGVSRAAFFELTPMGTGD

SEQ ID NO: 987732 - protein, 80 aa, Homo sapiens
CLAEHFHTLFTTEPCIDALKQTLVQLAVMGKLVPQDPNDEPASELLKRIAEEKSRLVAKGKLTTAELIAKTSFFEEKPYA

SEQ ID NO: 987733 - protein, 58 aa, Homo sapiens
MLVGDSIGSRFSLHEQINVHTWQLCLVPRSSSTDGQDYKAVPVVDDLINHYVVVFSVD

SEQ ID NO: 987734 - protein, 40 aa, Homo sapiens
MLKENFKKGSSVARDLAVNTLRWEPQWSAVATAVRATAKA

SEQ ID NO: 987735 - protein, 45 aa, Homo sapiens
QALELLTIYAWEQGSGVPGFGHCRRFPDVLALVTLCRVLCIPCEV

SEQ ID NO: 987736 - protein, 34 aa, Homo sapiens
FFAFYMCSIFAATTHVTVDCELMSHFFREPVLKT

SEQ ID NO: 987737 - protein, 113 aa, Homo sapiens
MLRAICKRVLLLVTLKTAGLLGPVEGSVVTEKTLMRLKVVGFNTLNLNTGIDHFLKLFSAPKIMAMDSSMQGSPDYKDLPRDVVVLPRPCLSSCGSQAVNPKMSAPCSDHSSV

SEQ ID NO: 987738 - protein, 58 aa, Homo sapiens
HGLWSHLIVPDATRTIIERTFNPFSGMCVYSPSRERTSLLRLWEPVAALDAAATSVLA

SEQ ID NO: 987739 - protein, 37 aa, Homo sapiens
MTFTLKHVALSLTQAGCEISALSRTVDLVVAQVMAFD

SEQ ID NO: 987740 - protein, 43 aa, Homo sapiens
HYPKLHSFLQVDRVFTTAVHASLYKFRRDVSTVLPSKYRSAGA

SEQ ID NO: 987741 - protein, 79 aa, Homo sapiens
RERVPQKSIPALIQLTRLVERLPGGLTFSMWANYTVSPLAANISQNSYISSPHSLLLAVLLRTALRIPLECQFHGFLPP

SEQ ID NO: 987742 - protein, 132 aa, Homo sapiens
RLRVLYGQCDYCTGSCEPIRLQVPVEVVNMYQPLYLVATTSPPQLLACGPTVHQTCSENTYVKGLCFLFGSNLRQQPQKFPEALRGCPQEDSDIAFLIDGSGSIIPHGFRRMKEFVSTVMEQLKKSKTLFSL

SEQ ID NO: 987743 - protein, 66 aa, Homo sapiens
ILQVDLSIPITLLTGKTSKACVSARFLMQRHHYQIPWRCFSTQHKLMIVHQDSHPSSPGQSYCHDF

SEQ ID NO: 987744 - protein, 91 aa, Homo sapiens
MSSARYLITRVRSENLGLNVKLFAIDYIHAAELRLQYLTDFLFGIFTKLTDPFRHRFVNLAGNLFNFFRVNHVISFSQKEVLFLSVIADAV

SEQ ID NO: 987745 - protein, 144 aa, Homo sapiens
YEPNRSDRDDIVPELDEHGFHPGNQHNKPSWRQQLKSMQNQSVQAKQRRRATKARKAMSKLGLRQVTGVTRVTIRKSKTILLVITKPDVYKSPASDTYIVMGAAKIEDISQQAQLAAAEKFKVHGAAVSHHFKHTTQTPTVHEE

SEQ ID NO: 987746 - protein, 81 aa, Homo sapiens
TNPNRWISLSSFFLSPKELTPRFSKRDSSTTRPFMLPSDFIFSGCSSDSTVLFKCHLCHECKEQHLLLDPNVYVVWDVMFH

SEQ ID NO: 987747 - protein, 52 aa, Homo sapiens
DVYGLATAGICIDMVAWDRYDDRGSRDYDRCAMIPGYGMWQQEHYWHVGICR

SEQ ID NO: 987748 - protein, 135 aa, Homo sapiens
YNLIAARYLVKHILSYTSNSRRRLQRSYECFTYRLIDIVSNAVQLVLGFLFTFDVDLDIAPSLVTAFCSFDWGESTGAGCRLTYSRVRFAICSTSALLSFVFCSVAALGSKFFKLSKGSTRLMMKSSPGAIRVSG

SEQ ID NO: 987749 - protein, 69 aa, Homo sapiens
MRERACKQADDWLGIPQGDHPQIKIVDPNVDRALCHDLPDPKFPKAKLEARVFPCGPKLTPKKATMLRG

SEQ ID NO: 987750 - protein, 66 aa, Homo sapiens
YIFTILQALSHSIAPAAPGAHTASGIPVHSQAQHSQPAPGIPRHTQCFDAQLRHCRQHSAATASQF

SEQ ID NO: 987751 - protein, 34 aa, Homo sapiens
REEAGLWILLPEQWLPSWKKLVICWLMEPVELTC

SEQ ID NO: 987752 - protein, 113 aa, Homo sapiens
KDPLHLIALREWCSACVITQDVVQEHLVQRQNLVCNANSGGVGAGHIRVGTVVDVQQLNLGTFEHDVLATRDAGLGNSAVTSSISGLKPLRVFLALGQCLIKLDGWLFVVTHQ

SEQ ID NO: 987753 - protein, 78 aa, Homo sapiens
FSGLAEERIHLEVDGYLSEAKSHKRHYSASSHIRSEFISKELKKKQRWIHAITERIIEVQGMWEDTSKGYSITVIVRV

SEQ ID NO: 987754 - protein, 84 aa, Homo sapiens
AVINLIAKKIDSVLEERRVKKYVKKHTQFIGYPITFILEKDERRQLSDDEAAGREEVSTEEDDKDDDEKPKIEDVGTDEEDDSD

SEQ ID NO: 987755 - protein, 39 aa, Homo sapiens
ELGTDYAPNGGVGVACRQLMWLLSAILWASLWMDRMCSR

SEQ ID NO: 987756 - protein, 68 aa, Homo sapiens
GHCVVAGAYGVIAYQPLLSGKHMGECYYGAGKWGPGVPCDGCAGLWLHWRGAQAKDMTPVKPEPPTEI

SEQ ID NO: 987757 - protein, 40 aa, Homo sapiens
SVPLQALEHVVDTCLEVYKPVKQRWFLAIKPPREEFLNSR

SEQ ID NO: 987758 - protein, 45 aa, Homo sapiens
IADQALSSANSEVGTSCVLHHVQKLAGPVTPVETILQRCNLEEIS

SEQ ID NO: 987759 - protein, 43 aa, Homo sapiens
RESDLSKFWALEHTSCGQDVGACEMATCDGINAEMYEMARCRG

SEQ ID NO: 987760 - protein, 88 aa, Homo sapiens
MSGVMMSLDEITVCVSIACSDLGVSLTMPSTCFLACLEPWGTKPYAQTGQSLEADVLLVPLSCHDRPVDHPTHTHVSCMLPCLRVLPQ

SEQ ID NO: 987761 - protein, 185 aa, Homo sapiens
AYPNCFGAGTAVVVAVAGGRSGGGSSRREGVSLVALSVCFNRLEEPEVGLGSSELRQVVLGLRTKLALEGVKFHSQEPPGGIATTGVRETMVGCEWRPEDRGKKDEIQELAGARQVKRENISDSWQHFGGLGPGVGLGVENSVNLEEVQLGTGAQGRPVGFVNNNNGLGFLVKFLVGGFCVTFIF

SEQ ID NO: 987762 - protein, 173 aa, Homo sapiens
MCWNSCFEENETMGNERLSGKLKAEAYQKYVGCSQDVPCVLEDLPQIAAKIAAPLTNGRGDSRSSVETHSKVTLEVNLTCWTETCLPLVHSQLTGVDLSKDTLIKKATGVQVVEATLHAHSLSNRHTRPYLPDNRINPPEKTGTILPLVTYISQGTTSAVCTRPYYLAVFLSR

SEQ ID NO: 987763 - protein, 37 aa, Homo sapiens
RRQFQPRVPISSSISFYTGKTTPTKDTAAQAILPDKQ

SEQ ID NO: 987764 - protein, 76 aa, Homo sapiens
MPIVVYALSSAINMVSSRDAGVPPVLPNGWCENGPGRKTEQVYKLPLLISNVIVPVNTRTALQPEQPYVMTRLVSA

SEQ ID NO: 987765 - protein, 46 aa, Homo sapiens
LEDPRLRLTAGQLLLQVSRRVGLGSERPPVPVGQLQASPDHASLGL

SEQ ID NO: 987766 - protein, 34 aa, Homo sapiens
CLGSVMFAIALGGVAATFSGSLAELPSERLNPVV

SEQ ID NO: 987767 - protein, 74 aa, Homo sapiens
QYPSMLVMACRVDVYSATGVLSSLDKYRRHVSTVAELQISYKLEPGRRVFTTAVHASLYYFRRHVSTVLTSKYR

SEQ ID NO: 987768 - protein, 48 aa, Homo sapiens
MRLKERSHLHTIKAKTKQQVLMGKLQQVLQEIWLRPLVKVATLNNRFS

SEQ ID NO: 987769 - protein, 42 aa, Homo sapiens
GTGLSDVQRLGPGSGEASWCLGGTALTVELVSTPGPRFLRGG

SEQ ID NO: 987770 - protein, 53 aa, Homo sapiens
YGVSDAPMSLLHLQARFPTSGWRLQFYWADVEGLGSSDVVSVYHWTLGLHVHS

SEQ ID NO: 987771 - protein, 86 aa, Homo sapiens
MAGAGQSQAHCQCTSPPYKAPTTWPLLQPVHRCKPEPQPWLQPPAFLVRPLSYRSGSTAISVTATHPQQGKPWCRRLKVSPHPYWP

SEQ ID NO: 987772 - protein, 37 aa, Homo sapiens
SRAILDCLREDTSSTLSGSCITPCYRAVYQGAGRSIL

SEQ ID NO: 987773 - protein, 52 aa, Homo sapiens
CGTAPLRLIEATSMGECRGAWHWIRTWSAQVAERSYLRNDATISNGRNRRAV

SEQ ID NO: 987774 - protein, 37 aa, Homo sapiens
MSRIFRHESSQPLVAGDAGRESQTRRRRRVAEDQTVD

SEQ ID NO: 987775 - protein, 68 aa, Homo sapiens
MTKQGSSTPPQNFSSSPAIDPNQEEIPDLPDKEFRRLDIKLIREGPEKGEAQCKEIQKMIEEVTGDIF

SEQ ID NO: 987776 - protein, 44 aa, Homo sapiens
TDCAGVVFSLGALKASKGPQPVGVCALAALLGPVRRAAVRGYRA

SEQ ID NO: 987777 - protein, 36 aa, Homo sapiens
LEDLLGFDRYAFWLQLLMPINLRPYGVNENLESRDW

SEQ ID NO: 987778 - protein, 35 aa, Homo sapiens
LYVSIVIGIKQTNRSTIVLMTLPNPPLRETPKNDQ

SEQ ID NO: 987779 - protein, 194 aa, Homo sapiens
RSCSVLSILETLTCLWCLNFPFCRMNRFLIGKPLRTLILCPPVQGEHLSHGCPSAGFLGSWVLQDPARDFNNENSAKEKDLEKPFAAQLVPWAQLDKAMGTSELFSTHTQVAGTASFLQWGEAGGLGCPQVGRQSRASKQGRQEPGVCPGTADSSLRSLAIPVPWASQLAQGWSHKPYAHVLPSLMITQWGESP

SEQ ID NO: 987780 - protein, 87 aa, Homo sapiens
VHYSPEETLCALFPQEEIPCALFPQEEIPCALFPQEETPCALFPQEEIPCALFPQEETPCALFPQEETPLCIIPPRGEPMCIIPPRG

SEQ ID NO: 987781 - protein, 36 aa, Homo sapiens
MTFLLISLLVSFSGRAGCLEFSVKETQDSPLFLCLW

SEQ ID NO: 987782 - protein, 32 aa, Homo sapiens
MRFHHVGRASLELLTSSDLPASTPDIKMIVPR

SEQ ID NO: 987783 - protein, 55 aa, Homo sapiens
MAWRPEQAWPYLGEQVQGLVQVGVHARGGLVGDLDGVLQNALGDDVGRQTEWRVP

SEQ ID NO: 987784 - protein, 137 aa, Homo sapiens
SHYCILAHFTAADKDIPKTGQFTKERGLLYLQFHLVGEASQSWLKARKSKSHLTWMAAGKESACAEKLPFLKPSDLMRHIHYHKNSTGKTHPHDSIISHLGPPTTRGNYGSYKMRFEWGHRAKPYHSTPTPPKSHVL

SEQ ID NO: 987785 - protein, 79 aa, Homo sapiens
CPTYNALPVCISNHDCLELEIQNLLFTSRRNVLSRTSPSCPRSSTSQFAKEVPPKFFKHNNMASFVRQLNMYGFRKVVH

SEQ ID NO: 987786 - protein, 117 aa, Homo sapiens
EFPALWGQAVGMEWSKCEIQVNGVETPCPLGAGEEWKIEYVGYRSRAELLASMMPPDLSLGLDDQHWDDDEQNGHEDAQNQGPDVQALGGGGKAWAPVTSPTIFLSLDFTEYANAMK

SEQ ID NO: 987787 - protein, 57 aa, Homo sapiens
DSEDPEFGSLGGLADRLAVSLHEFSSIRVRPARGARFIAVGYVDDTQFVRFDSDAAS

SEQ ID NO: 987788 - protein, 76 aa, Homo sapiens
MVVSESGCTTVGGLETFDSLTDLVEHKKTGIEEASGAFVYLRQPYYATRVNAAYIENRVLELNKKPELAFFAGYQV

SEQ ID NO: 987789 - protein, 59 aa, Homo sapiens
DKDEKKKQDQVIEAKESFQRCLENHEKMTSTTRYKKAEQMFGEMEVWDAISERDRLGSV

SEQ ID NO: 987790 - protein, 42 aa, Homo sapiens
LEQFMSPGHALLLSCSSEPQLYRVLAALCCILCHLASNQAKQ

SEQ ID NO: 987791 - protein, 97 aa, Homo sapiens
RRQGRRTRLNKIRLDLLGCILRTVEALLSHSDETGGPYNIQVMNTLPLEQIAVKKPTKSHQNQVGHESDLWSSSCYTPEQHHDSFTNAMATSGSYPI

SEQ ID NO: 987792 - protein, 56 aa, Homo sapiens
QVISVPGDSESQVIQCPGDPVSQVIQCPQVIQCPQVNQCPQVIQCPQVIQCPQVIQ

SEQ ID NO: 987793 - protein, 60 aa, Homo sapiens
AVIYRIRRGRPERELQQRWNAQQRELSTRTSEDEETIVATKIILRATTSGSRVNSGVRSH

SEQ ID NO: 987794 - protein, 50 aa, Homo sapiens
TIEGDSTGQSKALRIPQHNLQTYWEAEAGGSQGQVFETQPWAFPIRWRLS

SEQ ID NO: 987795 - protein, 202 aa, Homo sapiens
SLADGAAAVQRHSSHPRQWAAGQRRSTLPRWLGSRAEALLTSQMWVAAGQRCSSLPRWGSSRAEALLMQGHFKKDCPMRNNAAPSPMSTMPRQSLDSTLPQRTKVLWARSPQPDDPTTGLRVPGASTSSLMARKLTSSWTLAWLSHCYLLSWTAVLKVCYHLRNPGTACNQVFLPTPQLSLGDFATDSKYAYLIPHCHTAIW

SEQ ID NO: 987796 - protein, 47 aa, Homo sapiens
VTVFLNQVEFRELVRINLQNFLKKENKNEKVLKHIMEELDTNADKQL

SEQ ID NO: 987797 - protein, 91 aa, Homo sapiens
MLITETGAGPDEANVQLAQRSRKLGEVRHHKVVICQIVAQGFKANLLRYFDLTDDASTDVVGEVGGVTDAKGIRTQDFDLHGLISVEFNHA

SEQ ID NO: 987798 - protein, 64 aa, Homo sapiens
MRETLGLYLIKYRNYAWVIGWQPCPANPQVYSVIAAGLEHIALIACGMVEHSRAVRLDVFAATF

SEQ ID NO: 987799 - protein, 43 aa, Homo sapiens
IFRSIRSRLTLTTGTSRTIASMRKFKALISIARRSVMDHWQIW

SEQ ID NO: 987800 - protein, 54 aa, Homo sapiens
ELTKHDDVWKVDVYSPLRCMLPVQVPSTREHVVTPNMLSCEPVSNSSRILQYPS

SEQ ID NO: 987801 - protein, 138 aa, Homo sapiens
HRGAAVVAISHRGSSHNRQMDQHNEWPLTFSASGKVYSVSTDKARTRLYPSYNRMRFWCNSWVANLQTDTGNIADTLQEARMQSFLCDIKHFRVVDAAIVEHLLDDQPKGEGGDVEHVQQRGFAGSHFVSSLDQLHIT

SEQ ID NO: 987802 - protein, 136 aa, Homo sapiens
EGRLHTGMAAPQRAWKHPSPQARVAHHGVWACFRFCQEDLELVCWEGHGKRLGWGPWGSWHRPCRRCTMGSSHGLQQAGAQGVVHPADQTCQAIHCEMGWVALRIKAGKPSRSQSIPWCQLSTIQGYVASKKLPSC

SEQ ID NO: 987803 - protein, 65 aa, Homo sapiens
LVSMLDQMWLFIGKWWMQDQGSRESTGAQVQVAGDTLPNSTERAITIAGIPQSIIECVKQICVVM

SEQ ID NO: 987804 - protein, 71 aa, Homo sapiens
RQGDSCNREFFRAFEAVNLTSYHHFEGQIISIESKFKLNFELSPQFFPGNDLLLNYILMHLKVKTQLGKSE

SEQ ID NO: 987805 - protein, 75 aa, Homo sapiens
QYPSMLEWLSRSDVYSATCVCMPPWYKYRRHVSNRADLQISYKLEPGRRVFTTEVHASLYKFRRHVSTVLTSKYR

SEQ ID NO: 987806 - protein, 168 aa, Homo sapiens
TTGRLLPDSRQWSDLVTSPSQPDDWSRSLDFSDSTKIPVKSIPSEQKAIQIQNATSNPPSFKVKNANNTPPLPFQNSTSDSQKVQIQDSTSNQEVISKQNFAYHSQKIKIQNISGHPKEISISHISSNSRKVPLSNLTSDTPPLSGPGHLQLFGAALDLERHCYHANV

SEQ ID NO: 987807 - protein, 97 aa, Homo sapiens
LQTRRTAVRGLVRRLCAGGSQADAAALCLEVAQRDAVRVALVYPGYTGATVDEELPSRFSQRGRCENGLLVCNPGYTGEDCGVRSCPRGCSQRGRCK

SEQ ID NO: 987808 - protein, 42 aa, Homo sapiens
STATFYLPTYGKSQQSGKEVKTDQMLTSDEEENKTEKDRMTV

SEQ ID NO: 987809 - protein, 49 aa, Homo sapiens
RGSPFTDLRRCKQEPVRTDTCRAMACASSLRLPRVLCQTKEGVRRVFET

SEQ ID NO: 987810 - protein, 72 aa, Homo sapiens
LDRTQAYYSGVISVTATFAYQVPAILLPLHPSSWDYSVHVITPGSFFVFLCRDGVSPVWAMDMSRISVTLMI

SEQ ID NO: 987811 - protein, 66 aa, Homo sapiens
RSKQCPGLQELGHGCAALVTNGRSPCQCSPQVIAYTKKELIEVCPEESLSKVSHVLDCLPRSGYIV

SEQ ID NO: 987812 - protein, 56 aa, Homo sapiens
YKEPKSHLCGSTSWDLPTYKLHNILERLMCETIDLSQEFEISLDDITKSHLYKDEV

SEQ ID NO: 987813 - protein, 74 aa, Homo sapiens
IQSVPRARAVGMQTLQTGNMSFCTFWITKQSIASWRMGIGQVAYRTASVIGTEAITTRRVSAVTEKGLARLKED

SEQ ID NO: 987814 - protein, 85 aa, Homo sapiens
MNRACRAPTVKRPMNLGSSTEQSFHIALRGVWRIRSVLLQPVGHSDDYGIIDVKYARVSTFIPTVNILCAHTINPRKPIDIIAQI

SEQ ID NO: 987815 - protein, 36 aa, Homo sapiens
HSSKGHWNGRSADVVSEIVLLVSCMSCWTVMRLVDY

SEQ ID NO: 987816 - protein, 88 aa, Homo sapiens
ITVPGHHVISYTCLSHRMVVRFTYTVLCCDHSQAGSLTWCSAAAFTVIVFIIIITPEIGVVVFQAIELSCTMGLISSLEELAKPRVLC

SEQ ID NO: 987817 - protein, 96 aa, Homo sapiens
MCARLAGWNWCGYHYWMATTACYWLLVFLTVDSGMTYDTCPAWLCLTFIHSVPWVNNVPCDTCYDGTSVFFNRGLDFSYFALWTLGTVWPLGHCLR

SEQ ID NO: 987818 - protein, 71 aa, Homo sapiens
VGVSCDAGIECKMQKRAVTRGWVDRAGVDLDCMRVPIHRGGDAYSIHAPVMGWIVVPLRHRPLWLPSYFNF

SEQ ID NO: 987819 - protein, 101 aa, Homo sapiens
MAIMTFLHTQRYLKDLKRQYYGDDTGFLFQPYLREKIASMFLIETRVNWASSQLSFSWISKNKRPGKDKQVFHRNEANTFSHDIIIDLVVHSSSPAFTDIS

SEQ ID NO: 987820 - protein, 73 aa, Homo sapiens
SARKQAYEQSGLCYTYGIGATDRDYNVYRWMKHYPRTSNIRYYMIHYSIRYQYTKCVTLKEYNQNQDSKQEPI

SEQ ID NO: 987821 - protein, 54 aa, Homo sapiens
GHSGFEQEDEEYGSYNSYRDREMHTMYQIAREMKQDYNTVGNARASNHESNMTL

SEQ ID NO: 987822 - protein, 67 aa, Homo sapiens
YRELGVNGRESVITMDGTGYGNRSESLAVIFKSCHIAYKQSYLGCGPTDTSIKFLGYIQFTLALREI

SEQ ID NO: 987823 - protein, 73 aa, Homo sapiens
MAVDRALHVLTPIGPQSSNTPVTKSTSSRILVSEYHYLLHGTKAASPSDWYQGLGLDTYKVEADPLEYNLPVA

SEQ ID NO: 987824 - protein, 40 aa, Homo sapiens
LIHSFDYSDTCNNFTENCQILLNCWGPSSFIDPNSQQGRE

SEQ ID NO: 987825 - protein, 50 aa, Homo sapiens
MEEDMLLFVNSRSKARHGGPPGGKEINKPWFLVIGRKILRSKRGNMRIHT

SEQ ID NO: 987826 - protein, 71 aa, Homo sapiens
VEASSSYNMVIREDTQTTAPAGGGVHLFKSIGNNRWLRTISGIQYPNKQDLLAENVLAWEIEDRRTHFPSN

SEQ ID NO: 987827 - protein, 67 aa, Homo sapiens
AGTLKIMVDPQEVCPSQPSLGARSLFLLSSYTAADGFSSIVCLLSSSPVGNSNTLIARTFHHSHHQH

SEQ ID NO: 987828 - protein, 86 aa, Homo sapiens
VVPPNTPVHCRVGTPVGIVGCSRTSEPLMKLAGSYMSIHMPVKGTCVMALSHHVLPPGHVLWCVGDFWATDEDPGPITFPNQMCWP

SEQ ID NO: 987829 - protein, 74 aa, Homo sapiens
VAMPVMPSPTHETTYKQKVRLILFLWVTSSYYSTPTSRISIRRTGCTYEPPPGFSTGNWFCTLGIESPEQPGAP

SEQ ID NO: 987830 - protein, 31 aa, Homo sapiens
MVLQLGEATHPPWSTSVAVEYNLPVEYNLPV

SEQ ID NO: 987831 - protein, 102 aa, Homo sapiens
YNLIALRAWTLRSQMYGNFNGFEQLAVCQVSTATEKTLKKIADWRSRAAKSEEMCGLVMGLFTRLSNCANRTILSDMYSYVWDIKSIMSMVTSSVQRLGYSG

SEQ ID NO: 987832 - protein, 70 aa, Homo sapiens
FNLIAEDSLVTGASSGEYTCGMDSLSIFGNIIPGHDSPVRAMTWSHNDMWMLTADHGGYVKYWQSNMNNV

SEQ ID NO: 987833 - protein, 56 aa, Homo sapiens
SYHQQCLLHTNCLAPLARSSMTTVGIVEGLMTTVHAITVNPTQAAHKERFKKVKGT

SEQ ID NO: 987834 - protein, 107 aa, Homo sapiens
RDTLRLLSHWLAHADWQPRDVGREAESGLCVEPCILSRRSLCFTYGVLSGVVAVTQCTHVIAACPQQLQRAQVAQACALFLVRSSCMYLCHSKFKQQHGLSICPLSN

SEQ ID NO: 987835 - protein, 140 aa, Homo sapiens
DTSVTSVNQNCTFLCDSGSRDVRVDLLGCRGAYSGPQTYSGCRWLPHHICRPLMSSGKHMVRALCVIFSSNRSYLSRKRMMAVSVNHLLVADALDYFMLSCMRFISSYSASTKSQALQATHKMMAVTPSQQWIHFFRSDR

SEQ ID NO: 987836 - protein, 90 aa, Homo sapiens
MVAGTQQVLDNIRYSLSHKGVDKTPGVGSRSCCSQHRTPLTEEGYHWALLLRRLVQSQIHLLDQLHITGVYSNRERNVTMCTRKQEYNLP

SEQ ID NO: 987837 - protein, 54 aa, Homo sapiens
MVLGPQGAHVHVHRIFHRVAARTEVGEKADGDKRTLLQRTTAQDGRFDGHGVNG

SEQ ID NO: 987838 - protein, 91 aa, Homo sapiens
IHFTRVKSSPGDQGHGVNGMPFTPGGEDASGLHEVLKRQNRPKLIKEGSRSLEDGDGISIDDKLPVLSLAGALEFAMNGIIWDHVTHVVEV

SEQ ID NO: 987839 - protein, 51 aa, Homo sapiens
IYSMASASDYMQVGGWAYECQMLGLHACFHSPPIPAWAIILDILITSLFLA

SEQ ID NO: 987840 - protein, 52 aa, Homo sapiens
SHQAWGAAELQTAAYCLNLKYEHPSKDTWTYEESFQMETATHEQKDTTTSVE

SEQ ID NO: 987841 - protein, 130 aa, Homo sapiens
HPVSSLRRLQSIDRAETDTALLFNSMQLLSTWATNLLCNAGRVELCTQLIQLNRILEVTQELEEHHGVDEPSSSLPHNVCLQVTLQQHTGSTNFTLSTLLYLYPPFKQATYFSLYFKQVVSQAIWQREAQ

SEQ ID NO: 987842 - protein, 71 aa, Homo sapiens
LEDPCHLLHGRNAMNWNGTDSNGMECHGMASNGMASNGMEIECNGMLWNGMECIGMECPLMEWIRVEWNRI

SEQ ID NO: 987843 - protein, 32 aa, Homo sapiens
TGSWAPKNTGSAELKAQPDDLLQIFSCIGPEV

SEQ ID NO: 987844 - protein, 48 aa, Homo sapiens
INLSEELLVVGDPKNEPTDQCISTTDRGFPRARYLRPDHQLQQLLARS

SEQ ID NO: 987845 - protein, 73 aa, Homo sapiens
QYPSMLACLRVDVYSATAVHASLGEYRRDVSAALSVQISVSLEPGRRVFTTAVHASLYKFCRHVSTVLTSTYR

SEQ ID NO: 987846 - protein, 141 aa, Homo sapiens
MVGMGQKDSYVGDEAQSKRGILTLEVTPIDARCIVTQLVTHGDKSWTTPSTSEPCVWLPELSTPVRADLRPLLNPKGQRATKMTQNMFETFHPKPMYVGYPLAIPVTASVPYPLASVMDSVDGVTHTVPIYEGYGPPQRES

SEQ ID NO: 987847 - protein, 99 aa, Homo sapiens
GDGGFFVACFVGMPPIFITRMRNSWKLTAPSGVDYPTSLRPEVCYRFFLTILSDTRVSSTFLQGLVPVDRHGNSPFIEGSDLCVDSQIHRSSQALSQAH

SEQ ID NO: 987848 - protein, 99 aa, Homo sapiens
DALSVGPDGRLLRGYDQDAYDGKDYIALNEDLSSDRGGHPRLTLHPSASGRRPCVCGAGQSLPGGPVRGSRSRRYLENGKETLQLRGYQGAVGSLPFSY

SEQ ID NO: 987849 - protein, 36 aa, Homo sapiens
QDSTLPRPEVLRITCSLYSAAHSCGKGALEVVQVSQ

SEQ ID NO: 987850 - protein, 79 aa, Homo sapiens
EDYDALLKENDSPDVRRDKTCIQETNRGICQQVWVNNGKILAPYLGNERLKLGRLDVCHVKNIEDEKAKQLLGCVQDTR

SEQ ID NO: 987851 - protein, 167 aa, Homo sapiens
PATDVENRRFQQWCPWNLPHIDSSMEATAYIILYDYRHGGRQGQIIYNWEGVQSTQDEVAASVILSAQLDEELGGTPVQSRVVQGQEPAQLMSLFGGKPMIIYKGGYSREGGQTDLMAVTASSRSALIALEAPGRVEVLPKAGALNSNDAFVLKTPSAAYLWVGTGA

SEQ ID NO: 987852 - protein, 44 aa, Homo sapiens
MVPALKFYEAVPKGQCIRADRHGALGLLSAVELAFSVNWGAELC

SEQ ID NO: 987853 - protein, 165 aa, Homo sapiens
STDVESPLFLSILKLNSENLLLSSFTSLFDMLTCFHIFPSWLLLINIPEREVAGSRKSRQETSSGKDPECIESRGSQVLENRAFFFAVVKRRDRRQRSWAQSQNSFQTSSASQGFPWGRVWEPCGSLESRAARCSRHWALTPLQAANEEVVATVSAIACSLRYHG

SEQ ID NO: 987854 - protein, 60 aa, Homo sapiens
LIACVPDLSDSRLIAYPVMVLLVVFSHSDGPSFRHSWVLSGVLMSPALAFFLLSEPIIYK

SEQ ID NO: 987855 - protein, 123 aa, Homo sapiens
MYAIRVRHMAVGASEGQRMLLPPPSPSLGSFDPWLSSQERTQMSQHLPQPLHAPVTSQHRIQKPPSSGTSSEFEVVTPEEQNSPESSSHANAMVLGPLPREDGNLMLHLQRLETTLSVCAEEP

SEQ ID NO: 987856 - protein, 45 aa, Homo sapiens
ISSVRLRSRRRRTVLVVIGVTFAPPGVGGSPRTPAPLPGQHFWSP

SEQ ID NO: 987857 - protein, 68 aa, Homo sapiens
DRQASSYNDIEEVSTVLTCRRNCTGRRCTAAGEYTSTQAPGKRVWEVSTELTCRRNLYRKACTAVVNT

SEQ ID NO: 987858 - protein, 75 aa, Homo sapiens
SSSVPITLLDGDPQTDLVTENQTGFTILNTIKNIHGRLGAVTHACNPSTLEAEAGESQGHEFETSRANMVKPCLY

SEQ ID NO: 987859 - protein, 175 aa, Homo sapiens
MAFLFFLEIEFHSGRPGGSARAPSRLTATSTSQVQAMVRPQPPEYREITGMCHQAKLRFGIFSRDEVFPCGSGGSRNSGPQVIRPLRPPKGLEITGISHGTQPKVGCSNLQMEIRGGHKIQVTKTWRIKQVAVKKRVKSHQNQEGHESDLGVSSRLHSLQHHDSLQMPGQRLGVN

SEQ ID NO: 987860 - protein, 212 aa, Homo sapiens
GSVPITLLDGITDKQRQIMSELPFTIASKRIKYLGIQLTRDVKDLFKENYKPLLNEIKEDTNKWKNIPCSWVGRINIMKMAILPKVIYRFNAIPIKLPMTFFTELEKTTLKFIWNQKRARIAKSILSQKNKAGGITLPDFKLYYKATVTKKAWYWHQNRDIDQWNRTEASEITPHIYNYLIFDKPEKNSMGKVPRLELIGISRSTVAAAGCR

SEQ ID NO: 987861 - protein, 84 aa, Homo sapiens
IESVPITLLMDIWPNALAYCKCSVDANLSGMSSPPTHDSQNQVAPVKAPPSALQKQNMSFNFSERLRRQASGAGREGVSQRLRV

SEQ ID NO: 987862 - protein, 197 aa, Homo sapiens
SSSSVPYAPRRRTLQRNRTWTEMEKIRVCVRKRPLGMREVRRGEINIITVEDKETLLVHEKKEAVDLTQYILQHVFYFDEVFGEACTNQDVYMKTTHPLIQHIFNGGNATCFAYGQTGAGKTYTMIGTHENPGLYALAAKDIFRQLEVSQPRKHLFVWISFYEIYCGQLYDLLNRRKRLFAREDSKHMVQIVGLELQ

SEQ ID NO: 987863 - protein, 67 aa, Homo sapiens
CISNSSLEHRTHDTYYVVSHFHYVLSIGAVFAIIVGLHSLISHYSHGYTPKPKRKPRSIHNATGQPS

SEQ ID NO: 987864 - protein, 63 aa, Homo sapiens
VVAGHAASGRTYRHSSRCGLVQPTSQTEEGGFTGPRRPHDSGKGTRVDAKADVDDGVDPLLTL

SEQ ID NO: 987865 - protein, 86 aa, Homo sapiens
IADSRGSQKGDVIPTAGSSRGSGDLAHLSLLSSGDYRRARALRVNFYIFYKRRGLSYYPGVVSKFRGLAAHPCFGPPKSAGRYSAV

SEQ ID NO: 987866 - protein, 51 aa, Homo sapiens
DRLLCTLMRVADAALCSSSCSITAPLAAHISFVNKAVVDYFFVELLLEAHY

SEQ ID NO: 987867 - protein, 133 aa, Homo sapiens
DIKQCQFCLPKMARLGSVVFHALLCACELGYLTLFKFEDYVEIVSSPRVLMIALPDKTAFGWVRSFWENACYPEGNFGGNQLLDGSISLSPLYPGLDDRFARQDRYGPPPEFPLASPCPGIVHHLSGPNTCAR

SEQ ID NO: 987868 - protein, 38 aa, Homo sapiens
RECSLLRLRRGLGLSAAWFAVGQLESLEWQEWRKGGPV

SEQ ID NO: 987869 - protein, 159 aa, Homo sapiens
IGYRSLVGGQYKWCKVRKILEGHKRESLIWCLMMPGTICYPDPLIKVNDTIQMDLRDWQITDFIKFDTGNLCMVTGGANLGRIGVITNRERHPGSFDVVHVKDANGNSFATRLSNIFVIGKGNKPWISLPRGKGIRLTIAEERDKRLAAKQSSGDMGPW

SEQ ID NO: 987870 - protein, 110 aa, Homo sapiens
MNREATEVYDGQTNRKMGTERKGQEKEEKVLNYSKVNIRSTIPRGTERTEPKNVPEIGYHEGCISTCTTAARNIQPTHIPTLKLYVIKAPDGLHCILCPLHVYKGLIYHD

SEQ ID NO: 987871 - protein, 34 aa, Homo sapiens
WQEGENIIFRCVDTIIRILELFIIFTIGFHYPFH

SEQ ID NO: 987872 - protein, 103 aa, Homo sapiens
ETHPPYVMKKEFSMSGGDLIDGYAMASFATLQALLKDASIQPPERLEHRLKHSREAAKVWLQGATGQPGDSSDREPARPPGDLARKWPNKRIRKEVTVHLKTL

SEQ ID NO: 987873 - protein, 49 aa, Homo sapiens
YSMLAHMKIGGMRSSGAAVQCIRPSVNTAFSVKPPSSFQTRLEPCPLAL

SEQ ID NO: 987874 - protein, 87 aa, Homo sapiens
VDRGSAPRMCWFAGCGVTGSAREKYLTWGIRRGAQAELTSTFGVTSILRVVAEDWKKGDTFSCMVGHEALPAGLSHRRLIDRLAGKP

SEQ ID NO: 987875 - protein, 42 aa, Homo sapiens
LVEVDLRQIHFAIIFIGVNLTFFPQATVNPQATVNPQATVNP

SEQ ID NO: 987876 - protein, 39 aa, Homo sapiens
QSKWHRKACEPKCVEGLPEWNFDGSSTLQSEGSNSDMYL

SEQ ID NO: 987877 - protein, 78 aa, Homo sapiens
GLTVACALTVAWLETYSPDKDRTWLAASCLDRGALHGLGCCTWQAVSASRFLALEKLFREEEVVETNERLELIPPPLP

SEQ ID NO: 987878 - protein, 63 aa, Homo sapiens
VLMLETECLSYIRTTRVSTSGSKSWSINTDGAVHFQEIPHSGDSDGSWEPIKNAINQCHRSTH

SEQ ID NO: 987879 - protein, 46 aa, Homo sapiens
GFRAGWLNTCTRRYSPLEVGFKTMPFRLGAMAAYGPAAPAQATVNP

SEQ ID NO: 987880 - protein, 49 aa, Homo sapiens
AVDLTRSSEECRYRSSDDSILGELEPPDTVEGLVVDLCRHMQLSYNMSA

SEQ ID NO: 987881 - protein, 63 aa, Homo sapiens
PVISSEENGEEETRVCRERKAVMTEHVHSGEMSDTKLSGTSGKAPYGLMCTCLEAPDPSSVGL

SEQ ID NO: 987882 - protein, 39 aa, Homo sapiens
MSRDRFSHWIESSKLLYQHSSSSLICQGSSLDLVYLSSN

SEQ ID NO: 987883 - protein, 62 aa, Homo sapiens
IPGTINKLHRLSFCSAKLDHPSYSSHIRFHRTSGTGSFSSVPETSHTRRTDLVTGLLLPMSS

SEQ ID NO: 987884 - protein, 40 aa, Homo sapiens
MRARNDGKWMLVHRTEVIKYTLDPVWKPFTVPLVSLCDGD

SEQ ID NO: 987885 - protein, 35 aa, Homo sapiens
MVQPTSHGTTHKPRYNPQATVNGEYLLRVRTGRRS

SEQ ID NO: 987886 - protein, 109 aa, Homo sapiens
SYRWFDRGLCHQKELGLFAIEQLSEEATVYHIMRLLRSEVEGPYCITTPRGIEGAQRRRGVPPRGTPGIRKTSVPVYDGAVPVEAVAEAVASSAEAAVTYGMGLNRPLS

SEQ ID NO: 987887 - protein, 38 aa, Homo sapiens
GPYFERGAVVVGGLGAEGARGKPRSVVLMPGLLVRFWD

SEQ ID NO: 987888 - protein, 48 aa, Homo sapiens
MRPLSRFSLKLSPTGCRDAASLSTCAFSYLNEPCACLDWPTSYLALIL

SEQ ID NO: 987889 - protein, 58 aa, Homo sapiens
MSAVVQTRLLSLRLPGSEYSCLSFSGAHHARLIFVFSVETGFHHVSQAGLEFLTSGDP

SEQ ID NO: 987890 - protein, 38 aa, Homo sapiens
ERLFILLTLPSACLPFSCIWSSSSNPATVPCLGGPSYQ

SEQ ID NO: 987891 - protein, 57 aa, Homo sapiens
MTVACGVTVACGLTVASGLTVACGETVACWLTVACGLTEACGLTEDLYVDRDLYVDR

SEQ ID NO: 987892 - protein, 104 aa, Homo sapiens
KRLGTPPKASVPPCPSSITNVCRPPLKSERVSRGCSEKSVAAAGYDAEKNNSRITLGLKSLVSKGTLVQTKGTGASGAFKLPQKAAFREAKPKVKKAGGTQPKT

SEQ ID NO: 987893 - protein, 51 aa, Homo sapiens
MTFYCRGCSAVVYGLLGTECLLVALLFLLPGLLITCHVARIPLPAGYREEI

SEQ ID NO: 987894 - protein, 34 aa, Homo sapiens
WCLEDPFRVGASAGGLKINDNLSTVSMFWNTLTP

SEQ ID NO: 987895 - protein, 48 aa, Homo sapiens
KGYPCRTSLQSSIFPGTFRGRLGYTGPEEPAIARSRKAPIQYSDNPID

SEQ ID NO: 987896 - protein, 53 aa, Homo sapiens
GEFPGPMSDQTVVNCVFTRYFSHEHPQPGEHSIMIILGIDPGLRTTGYGGDPL

SEQ ID NO: 987897 - protein, 37 aa, Homo sapiens
MTLSTWRHLTHKQHKRNQPTGRRLKQGTDQDRESGGT

SEQ ID NO: 987898 - protein, 84 aa, Homo sapiens
ILEDPFGVVIPRHYRGMLKKTTQEAERILLRTQTPFTPKNWFLAMLSVVHGNLRKDVKPENKQYTAMPDKTVAAHICTRQSTNP

SEQ ID NO: 987899 - protein, 42 aa, Homo sapiens
ATLLRGGAGIRSERGVLGLGMQSPQTGLGPATGDLRGIDFRA

SEQ ID NO: 987900 - protein, 173 aa, Homo sapiens
GEVQLSGKSLGSAPKPVEGRSALFAGNEWLVTHTSSIAESWETTQNSTLLTACDSYGKAQRSAVTAWCSMLGWLANECHPVNLMPENGLSFANVHLSLDVPGQPTGCPYIGCPGDDPGGTCYPLGLTLGLLFTGHKSRLRGRLLCDSLHLATSQKAVKSCLVCQASFCELYLT

SEQ ID NO: 987901 - protein, 87 aa, Homo sapiens
ATLHSDTFMYHVWSKSLLMYGCSPRNFFLLVRTWSRWLRSEAADLHSECNSSEGSASGVVRSSLVGYVVSLASGVKLQTFVVECHSS

SEQ ID NO: 987902 - protein, 55 aa, Homo sapiens
KPGQVGAPCSRALSGGDPSYQYVESGNDKNSNYFSMDSMEGKRSPKAGVTSMRAC

SEQ ID NO: 987903 - protein, 175 aa, Homo sapiens
MQEYGYRVRTRYENTSTYYRAPRCRYTHHPSYPESRYSVATYQCSKAIVKTRTQTTGVSKRPYNIDKIRTEIGNIDKEDMHNNSMLHKGKKPTDEYLDTMMNEAPGPINYTMYLTMYGEKFNGTDTYKMSSEMPLLALLKKQLGTIQEDYLRELADNHEGIAKPDKEVDELVTQP

SEQ ID NO: 987904 - protein, 32 aa, Homo sapiens
MSDNYTDVNGGEGASQGMTLSAHMALEVGNDE

SEQ ID NO: 987905 - protein, 31 aa, Homo sapiens
MDMILQIFHPRQGNMPPGSTHGQATVYPQAT

SEQ ID NO: 987906 - protein, 145 aa, Homo sapiens
GVFWWLGFVLLADADTSDSACMRLQSAVHSIQHGLGDEYKQVIRIHVGLPEELTHSVHLFGAGATDHKVISHHGAADEVYRANEGLKGLRVQPGNDWLSVVRAKPFLIQEVGHHAHEGIRFDLPTFLQLIQVQPELEALGNCPDV

SEQ ID NO: 987907 - protein, 30 aa, Homo sapiens
MDRSLVGCTVASRVDRGLVGYDRGLVGEDR

SEQ ID NO: 987908 - protein, 75 aa, Homo sapiens
PGCASDLLIPYGHVEIPLDSPVAGPAASGSPNPPLPSPPGTHHRISGSPQNPLIHSTNLRLCPRTHHFSGMPKPG

SEQ ID NO: 987909 - protein, 65 aa, Homo sapiens
GDLEIPQADLFHQVMMVWNFKYVGRYEMYARDLGGKLVKSNYSRSPSERVAGFRCHVLGVRKRPL

SEQ ID NO: 987910 - protein, 71 aa, Homo sapiens
STEAVIIADTPMCASPGPVTLTAEAPVLLDLEYVFPCVIQCSTNLVSVVFPRVERFMVQESTWGTRARYSV

SEQ ID NO: 987911 - protein, 80 aa, Homo sapiens
ARGSQKAELFPRYSVLLQSESDYFANSRKLFSSLIISSLHQVFWLFSMAVAFWSGSVLLSIFYILVGFCFPRLDMGVWDT

SEQ ID NO: 987912 - protein, 49 aa, Homo sapiens
MSSWAPNAPFFPPGRAALIHPRHVLTTAIPQFWESVTLPQSRHFMMEAT

SEQ ID NO: 987913 - protein, 136 aa, Homo sapiens
VDQVWSTVARSLFTATSPSRLQATLSQTSRIAGLQVRATTPFCIFSRDGVHHFGQAGLKLLNSTDLPGSASQSAGIAGISHCAQPKKFFIIFYFTRDGLHCVVQVGVQCLFTGAIPLLDQHRTDVSSALYRNLVDS

SEQ ID NO: 987914 - protein, 57 aa, Homo sapiens
MSSCNCLMMSREDPNGFQWLLFLEPDKVLKAFVLPYLECIDVAEVDLSLRIFIQTLE

SEQ ID NO: 987915 - protein, 47 aa, Homo sapiens
HSRSSRCQPALSVLELQVDLPVRHLPVPSCLRLHDWCTGANEQCCTA

SEQ ID NO: 987916 - protein, 56 aa, Homo sapiens
IWILHEILSTVEQKAAESRCAAQPGQARSRGASRCSTTLDLTVTVNCTSMAQDMTD

SEQ ID NO: 987917 - protein, 53 aa, Homo sapiens
MSNMVDNPMSTRNITIQTDVVARYLYITSYLAGCGGKTPLNPGDGGCSDPRSQ

SEQ ID NO: 987918 - protein, 57 aa, Homo sapiens
VCNYYCMDEERVGYGIQHKTSTAVLVHSLRSQPSGAGAESKGYRFIFLHDSSHKQRS

SEQ ID NO: 987919 - protein, 41 aa, Homo sapiens
RQIYIIRGPYGGHSLGGPMSSLVVRGPLDTGSSQASTSWDR

SEQ ID NO: 987920 - protein, 40 aa, Homo sapiens
MRNRVSCSVSDWSTTCRMVKFSSTLYIMYFSEDVLELVDQ

SEQ ID NO: 987921 - protein, 132 aa, Homo sapiens
PKDDKKTELQELNELYKPELLRRKISKGADPKSVICAFFKQGQCTKGDKCKFSHDLPLERKLGTTRSVYIDWGETDRTLKKTTYWTTWDEQKAGTEVVNKKHGEAEKKKPKTQIVCKHFLDTIENNKYNLPV

SEQ ID NO: 987922 - protein, 57 aa, Homo sapiens
VCGGPHSPPVTRMVDSEIPRRQEHYISLERIPRDHPYIQYNLPVDELIAVRKYNLPV

SEQ ID NO: 987923 - protein, 66 aa, Homo sapiens
GRLLNHVLSWLKQGQAGQSSTVVQPDLVEYKLGDGIQPAVCEYNLAVCEYNLAGGVQPCQVEYNQC

SEQ ID NO: 987924 - protein, 45 aa, Homo sapiens
SSAVSCGGILSRRVTSRPAMPVHRCCPQLPSSISVSAAHSSTTFR

SEQ ID NO: 987925 - protein, 38 aa, Homo sapiens
EYMLLGEVQLRVIVQLRGEVQLRVTVQLRLRYSLRVEV

SEQ ID NO: 987926 - protein, 110 aa, Homo sapiens
GEVQLITGGASASCSVPPVWSCSSLLVGFLVSLALGVRLQTFVVIVTALRGGTDPKSQQQQHLAGRTKELSFHSMKSCCCWLRWPAFIPLSGPTHILLIGPFYRELIGPI

SEQ ID NO: 987927 - protein, 36 aa, Homo sapiens
RDDENDSVTLKCHRSLLPCRTIFTTVVFHNVEPRSQ

SEQ ID NO: 987928 - protein, 111 aa, Homo sapiens
TSQLALPGDLCIDGELHAQSGRHASGVEPGATGLHLAGIMSRQHLDLEGAPGYLFISIQYCDAVGPFSAGHIIDGLGAISVVYHVHWLHQAFGPLHFDLQWGHTSLACVHL

SEQ ID NO: 987929 - protein, 53 aa, Homo sapiens
MGLLQEDLISESCFRTSSVRQLAGPEGSHCAEAGDVCYAGVQKDGVGMVEYLR

SEQ ID NO: 987930 - protein, 77 aa, Homo sapiens
RSSLRSGFYKKDENKLSSANAMKNVHKEEKKQEQKSESITKEKHKKERKRSIDRERNMSKSRERKQKLKQREATEPL

SEQ ID NO: 987931 - protein, 63 aa, Homo sapiens
VLVLLLARGVSAHPLCFLLLSLLLGSAAKPNTHSFLDARTRKAAGLTPTGLQAGPNKPLAAPQ

SEQ ID NO: 987932 - protein, 46 aa, Homo sapiens
PSERQDRSPSTHFKARSRIGQVWKQPLAGCPAVPLERPKVADSLPV

SEQ ID NO: 987933 - protein, 66 aa, Homo sapiens
MGLTLYQHLEAECNQVRILTAACDGTVSQLSELEAKELLNPGRQRVGSGARDRAIALQAYKFRITS

SEQ ID NO: 987934 - protein, 53 aa, Homo sapiens
VCGEASVKRGKGLLCVCLMKTRVQPMTGQCAPDLTDLDVDVDNPKKKRKKLLE

SEQ ID NO: 987935 - protein, 63 aa, Homo sapiens
CSGFFSFSLVVIRSWCLRLRLTCGARRYPIRRLKRKREFRHSGDKLPESAAAEEARGGGGCGE

SEQ ID NO: 987936 - protein, 91 aa, Homo sapiens
LSSVSHSITAASGPPFWCLDCVLVKGGHVGQCHLHMQVARSMRHTPAALPGFQSSSSSFPVLCGLCLCVAWCLIVSCSLRITGAGVLGGPI

SEQ ID NO: 987937 - protein, 62 aa, Homo sapiens
VSGSSVYVSSSAEQLHIVLFPSQPQHYHVCELEHVVCSLPCSHTRQQQCPLTTTVKESPLRQ

SEQ ID NO: 987938 - protein, 75 aa, Homo sapiens
WVTVACGLTVACGLTVACGLTVAVWVGQIENKAAARVSVGNPLQSPSTLWKLCSFLFAINLAIAHSLGPHCFYEL

SEQ ID NO: 987939 - protein, 70 aa, Homo sapiens
GTEAGHVPEKKLQGSGRPHEGHPTQYCPNRTDLLVLASTENTYLPSECDRTLSVHQNRSFWTTAKFPLTR

SEQ ID NO: 987940 - protein, 70 aa, Homo sapiens
MDRVKGTLASLCQRTYRNGCVSARTMEFFGDFVKYYSLITMVLAAAQASNRKPSPQDIAQAVLRNFSGTD

SEQ ID NO: 987941 - protein, 82 aa, Homo sapiens
MSPGSSPNTSWTTAIWLWGGLPRGQCINTGASSTEGGYISPSRELVLEFPILKEPQLILTLQIVSINVAEVYPMAQGLGEAR

SEQ ID NO: 987942 - protein, 48 aa, Homo sapiens
QIGKKRRTRETPYTILFYSHKRPVGGVWTMATQVAEGSTHPPPFSRGE

SEQ ID NO: 987943 - protein, 72 aa, Homo sapiens
RTLALICQEAKRQTLTPESQGAMDSETGLVVRYSYIANTSPLPQGIFNSKSDPILKLPSGRWPGQKSISNQS

SEQ ID NO: 987944 - protein, 91 aa, Homo sapiens
TLENPLAEPLNSRSFCPIGEPKSGGFGDLSYAKLFLCLAEKIPDGILLAIHTSCHNGMRRDPHQMAVFELVHWLPSVVWAEELILVPFSLV

SEQ ID NO: 987945 - protein, 58 aa, Homo sapiens
RGVASWFKPVVPHEVVVQRLFQVKWRRVVRGTEVTVSWESFNNWLTWLIRGLRVTTSP

SEQ ID NO: 987946 - protein, 45 aa, Homo sapiens
TQSVTDNVIVLEDVGGRSPKQRSYVSLERWLSDLILLSIYTEWYI

SEQ ID NO: 987947 - protein, 36 aa, Homo sapiens
VILAGSQPSYLSHDNAVYETELEIQGYRCLRDSVSH

SEQ ID NO: 987948 - protein, 69 aa, Homo sapiens
VDLYQDPRCHVTFMTSDFSWALCHTVITRVSLAQETSKIVWCEGQDPSLIPAFSYNADLSSRVPSLEIS

SEQ ID NO: 987949 - protein, 46 aa, Homo sapiens
CKLYAYKRFIEDPDSVVIVLPRASVTTTCKHDDQSWGTAAYEIQLS

SEQ ID NO: 987950 - protein, 82 aa, Homo sapiens
CGLPPPIPRAWTPQLGLCSNTGKRASEAGKDPGEGHTARVCCRDRASSPHWRLHLQVRERFRRAGFRCLWSLAMQTPWRRRT

SEQ ID NO: 987951 - protein, 46 aa, Homo sapiens
MHTLLLGEHNRLATELKSVNPRWHGEKLYQEARKNVGARGQIITYR

SEQ ID NO: 987952 - protein, 93 aa, Homo sapiens
MSTECGQCDMCRSEGQRDKTGSKELLATVSSPPTFTSWPCPAQPQLPWLQRTGYASHRNRMGLTGIKILTNFIDNDNTRRQVQLHDSLFRETL

SEQ ID NO: 987953 - protein, 37 aa, Homo sapiens
IRRQSRNGEGSLSRGQETLKVGVVAHACNPNTLGGRG

SEQ ID NO: 987954 - protein, 105 aa, Homo sapiens
GKGLRWSRCREGEGVLWRRLRKGKGVRLRRRSEGKLLRWRRRREGEVSRWRRLREGKGLRCEEGAQRGEGSQMEEEALRRPGAQDGKVALVGLDSASEKAAEFSG

SEQ ID NO: 987955 - protein, 114 aa, Homo sapiens
LYIVRKTRDRTEVALQIKTVRHLYAEVERLIISMHPYQLPEIIAIPIEMAYPLTCNGSENKQEINSMQHSNRKIKVFLPYWHFVSAFCRSLLISACLVWMPDAAADDFLDPEVA

SEQ ID NO: 987956 - protein, 94 aa, Homo sapiens
LSGGEGKESGLCAKEARSASLGLSLSPVPACRDVDSLVMVTTLVGRVCARLDAGVLGVLADTSVIRGDGGRDSLDPCVNFLISLLAVGWLSRTD

SEQ ID NO: 987957 - protein, 104 aa, Homo sapiens
MTSRFGRCCLSSTAKNKKSVHWRDTKSVAGSSFVKEILGMMHGSNQPSQQKPGTEMRLSRKVYGGHPRLTACNPVDCMEGRVSEYYIPAETLPAGTERKRDGMK

SEQ ID NO: 987958 - protein, 35 aa, Homo sapiens
SDGLPWCSTTDNYDTDDRFGFCPSERLYTQDGNAD

SEQ ID NO: 987959 - protein, 101 aa, Homo sapiens
FNANKDAPGCGGNFAEPSGGKMLVKAKASSLLPPSNMQRKWKDGIRMRSVKVHGSLMRAHDYGPGTIPTSHELTLWILSSSSEPELLVPVYHRGRKGDTYS

SEQ ID NO: 987960 - protein, 91 aa, Homo sapiens
GRARKAFKLPVLEVLPDVAGTICGMWTGGRVMEFSYSNCCTTEDGHAIIPDESFTIPQKQSNLEMNSDILESWANYHSSTYYSINTELSLF

SEQ ID NO: 987961 - protein, 59 aa, Homo sapiens
SSRYRERCSERDEGFIAGCEQDLAVKILVGCASSIVWSPQRRISSSAGPMREMSCVSRR

SEQ ID NO: 987962 - protein, 38 aa, Homo sapiens
PPINTIMSLILTTTTNKHIYHSMTSTTIVPVTLSVALT

SEQ ID NO: 987963 - protein, 111 aa, Homo sapiens
PKANADSHELGLNGSTVEGGAMPVEAAGRQAEIWPGAACHDARAGPGKSPWEARAGPAECCSHVIAVPGHATGKQKVGLEEFDLRKFWAYIGRHELDRNWAKKAVVRQQLC

SEQ ID NO: 987964 - protein, 160 aa, Homo sapiens
ICNDPPVSYYRASITRHRTRSTPVAHSCELTGLRSHAIAHASHLWRPPVRLTGLRSHVIAHRPHTCDALLLRLTGLRSHAIAHAPQLMANSCEDLQAYRSHAIAHAPHLWRPPVSLPAFDHTSSNSPHTCEAHLCAYRPSITRHRTRATPVTPSCELTGL

SEQ ID NO: 987965 - protein, 39 aa, Homo sapiens
IPSSSSIMSLILITQYQQHIYHSMTSSTIVPVSLSVALT

SEQ ID NO: 987966 - protein, 39 aa, Homo sapiens
MSGELAVCRVTEGASCMSGELPVRRVTEWCMAACRGVWL

SEQ ID NO: 987967 - protein, 36 aa, Homo sapiens
SGNRFYRASGFHGQTFKTGERVNPGTRFPRRPVLPG

SEQ ID NO: 987968 - protein, 122 aa, Homo sapiens
GGRSTQELGTATSSPGICEQKGAIVSRSLEGNSSKTHSKEPDDNEYAKMEWSTGRLCYLQKNPYLTFLMDSKLSLQVAQGILVKITMNSFHLNGTKLGVVHSSHEYHIGPDTPELAGAMHRL

SEQ ID NO: 987969 - protein, 141 aa, Homo sapiens
SFEKCLTVLPRPKCRWHNHGSLQPQSPRLQKSSHLSLPSSWDYRQTPSCLAFFFFFLGKLRSHFVAQASLELRDSSTPASTSQSDGFTLYSLYTSLSIDSRIAIHYFSDPRSKSLITQLPPELYTIYYKLHICTFPILPTR

SEQ ID NO: 987970 - protein, 119 aa, Homo sapiens
VHRHTPYTRPHSNTTHHRSPLTVVTTIITINFTITVVTTITTTFTITVVTTIITNTFNTSMTTPTSSPSPSPLNVVTTITITFTISLSSPTIITTTFTTHCTSPPSSPPPSTLTVVNTH

SEQ ID NO: 987971 - protein, 34 aa, Homo sapiens
PRLQVMGGGYCGKDDGDGDGGGDGDSNDDGGGRD

SEQ ID NO: 987972 - protein, 47 aa, Homo sapiens
SDILLFFFLYLTFFFLKFFLKLSFLLFFLFKIFLFILFLYGRGGRRG

SEQ ID NO: 987973 - protein, 37 aa, Homo sapiens
RYTRTCSACQAVRPSAFQVLSSRALYACSQSAQWPWF

SEQ ID NO: 987974 - protein, 59 aa, Homo sapiens
HQRGTARTTLPGVSGSSSEVRTVVHQAVLAVEGAWARPQGVWGVEPAFVSVVTKLEAGA

SEQ ID NO: 987975 - protein, 34 aa, Homo sapiens
AGPPPGHEPADPLAELDYKNEIIIYTHIWRQLDV

SEQ ID NO: 987976 - protein, 34 aa, Homo sapiens
MKQVPRSPFKVKVLPTHDASRRANYPLPTRGGSD

SEQ ID NO: 987977 - protein, 74 aa, Homo sapiens
LRARVTWWTEGAIQSPWHFSAHIRMNSHHCLVSLVGEEVVVVARRELPALPPTKAPSASLYFSASSATLNDLYW

SEQ ID NO: 987978 - protein, 42 aa, Homo sapiens
RARTEMGDSQVSDLSNLWLVVPFTVVAIQGKGLGVVGEKSFG

SEQ ID NO: 987979 - protein, 37 aa, Homo sapiens
LYRIPALYQYESLDAAQADCATMRGFPLGGPDRKYPR

SEQ ID NO: 987980 - protein, 110 aa, Homo sapiens
MLELLYLAVPSLDLLDGLASCEEHVREICSNMTHDEVDLGFQIIWIQWMAPDGYLVSHLHQGPTHAYMPLDHDDSLGLAQHEIEGAGLEEIRECYIGEPRGPMIDQRGLP

SEQ ID NO: 987981 - protein, 143 aa, Homo sapiens
VNSDSRTGGSLNDQGPVLNDIWRSARMLTCRGNLYGEACTVVVNTRRPGSMFAIFGSDRRCSSVSSVNLSYEGMHPDGEYTSMPAWLSCVLGISERSARVDAGSSLAIFGGQHGVTVSTELGLGDLHRQGDYRSSMRSIYSEF

SEQ ID NO: 987982 - protein, 47 aa, Homo sapiens
MPIMQRLIFAGQAAGRWSLLFLTTTIQKGVDHCSLVPCVSERWYARS

SEQ ID NO: 987983 - protein, 38 aa, Homo sapiens
RSSSVLLPPRSQKPWFLDDEEKSKLLAKLLKSKNPEDL

SEQ ID NO: 987984 - protein, 33 aa, Homo sapiens
RLDWLVLLVDSSDYEPVLAASVDYEDLRGGRRG

SEQ ID NO: 987985 - protein, 35 aa, Homo sapiens
MTAPGPKIGFSREAMFREHPSEELLDVQDSGILVA

SEQ ID NO: 987986 - protein, 80 aa, Homo sapiens
MTNHIFAKSLSLLRDPRRFAPFNSRGIAGPTELDTLLYCASPRLDGPTMMQHKVSTGGSCTVINLKLVGTLLRSNPTAGV

SEQ ID NO: 987987 - protein, 34 aa, Homo sapiens
ESSSDREWREKAVSVWKQKLIASKWSSRWETVIP

SEQ ID NO: 987988 - protein, 105 aa, Homo sapiens
MLGPAPTLWSVLSFSVNPFIPSLFCSCVLSNSLFKMPRTWTPSTGDIFWRASGEEEVSPKFGIPFSPFSFSFLLHTGESINQSINLSLSLSLSLSLSLFPFSLHS

SEQ ID NO: 987989 - protein, 65 aa, Homo sapiens
IKPVPVWDEDWLASRNMRVVLSSLQITQTFSMSAMNLFHFLICVFTRALYISFKNFFFVEVGGEE

SEQ ID NO: 987990 - protein, 32 aa, Homo sapiens
MSVPRSQKITTKGQVQWLMPYYPRHFAEAERK

SEQ ID NO: 987991 - protein, 55 aa, Homo sapiens
KNRARYRFGLSCPGQRMVFRWSLARAALQRDSCASPLIMVTPDHERSLDVHATGA

SEQ ID NO: 987992 - protein, 43 aa, Homo sapiens
QKTLFEKGPYPPQSKGDTIYPFGGSSEKFRRQLLHSSSGKLPS

SEQ ID NO: 987993 - protein, 154 aa, Homo sapiens
RIWYNALVIWAGHVYGVVTLVHDITSLGVFVSEEEDLVHVLGSGSVHVCEIGSGLISGLYVSLECSRLKSIWPLSCVISCLSISEEVSSLVPCLRIWVCQCLRRRTWLWYMDLGLFMSEEVGNCYRPEDLGLSLSKEVGSGPSMRIGVCPCLRK

SEQ ID NO: 987994 - protein, 71 aa, Homo sapiens
QNRARYRFGLSAAAVTFRYACVYAKPSVNRALVFSSSVNLIMSTDHDHRELPMRPLVQARAKKAGWHERRP

SEQ ID NO: 987995 - protein, 38 aa, Homo sapiens
WVTRYAGCCLYTTPWPGSSYASGVEARQALLKAGASGR

SEQ ID NO: 987996 - protein, 38 aa, Homo sapiens
RFAHALVRQEVQIGLLSAPAHTVDRVWVHLWAQGKRPQ

SEQ ID NO: 987997 - protein, 34 aa, Homo sapiens
NRARYQIPYTIPLSETGSHFVTQVECIDANTASL

SEQ ID NO: 987998 - protein, 71 aa, Homo sapiens
SSVPDPLSSNRHTKVCRRRQWKYAQALVWGLHQGLILVILPILPSMPGTCTPKPKSHLFPQTQLSYVAHAC

SEQ ID NO: 987999 - protein, 36 aa, Homo sapiens
TAAIDFYKRAFNASEQFLPGDARRPARARVPRDWRF

SEQ ID NO: 988000 - protein, 97 aa, Homo sapiens
PVPEHACLPAGRRVFTNAVHASLKQVPSDTLRTSAELQISLSWSLVDVYTTLRCMHPCTKFRRHVSTVADLQISLRWSLVDSCGSSSTRSLLEWLPV

SEQ ID NO: 988001 - protein, 100 aa, Homo sapiens
MWGLMRPSLSGMGLSVVRHLLLPLVAPVAVGVTIPLRGYCIVPSPMLPVRKEIVCVPQYNICSLPNHSIRCTMCHQGTYLYHDCPGPVQDTDCDECESGS

SEQ ID NO: 988002 - protein, 63 aa, Homo sapiens
DPHTRIPLSICASEVNERYTVKNPGIYGVCVYEKIHEITGRLDSCLSSLSLSREAEVMLDHLE

SEQ ID NO: 988003 - protein, 82 aa, Homo sapiens
AAVAEDCWWILSGTGFALSSKAAPSGHLYAANMNSLLTNRETKARLTWCPRNRMGARMFPVLDQENIDSLDSGSVFSNLTID

SEQ ID NO: 988004 - protein, 60 aa, Homo sapiens
AAVVCEPEICAIALQLVATRAKLCLQKQMDHVILSPFMEPKFNRFHFPKSIRHLKRVISI

SEQ ID NO: 988005 - protein, 51 aa, Homo sapiens
TSKVWPVGAEVSSTGSSSAACRCRLTILTGWPRDSTYTVYGEGLPSEIRQH

SEQ ID NO: 988006 - protein, 55 aa, Homo sapiens
MQTSPQNQWSGQNMGQASSSQTGTGRKKQQRTARERKEVLAETKAYRTDEEKTKN

SEQ ID NO: 988007 - protein, 70 aa, Homo sapiens
IAIVDWLLSRPFVLRASQTIHLRRRLAVRDMKPSRAVGVIKAVDKKAAGAGKVTKSAQKAQKAPGENQAA

SEQ ID NO: 988008 - protein, 34 aa, Homo sapiens
MINTLSRLHHEALSEALPEYNVGFTVKTVSVMDV

SEQ ID NO: 988009 - protein, 83 aa, Homo sapiens
DQEEGETSAQTERVPHGPHVLALAGDRWTIGAGGTWSPAEVEDFEARGSRFSKSADERQRMLVQRRDELLQQARKRILNKSSE

SEQ ID NO: 988010 - protein, 73 aa, Homo sapiens
NSLQIIEVLLRSPSTTMKQVENHRMQIDYVFITLDDVIRRSWLTLPVGQRELAGLATWNKSPDPVVTLLFPKQ

SEQ ID NO: 988011 - protein, 108 aa, Homo sapiens
FGQTIYTLLPYLDSLMQTAHTEGVTAVRALLHELVSHQVTWDIDSQLLLLPAFLGSPVLERIARNDTAYFPRARCYDYYTGVDINARGESKTLPATLDHINLHVSGGY

SEQ ID NO: 988012 - protein, 62 aa, Homo sapiens
MSGEERNLNLAECAYPIIVPSLELHYDIDSIAHIYVADLLPYYHPGLLTTFVFAKILQIHNQ

SEQ ID NO: 988013 - protein, 71 aa, Homo sapiens
RRESLVITEPQAEILHDGCHHIMPAVKGIIYQYMEEINHRIPASDPTSSKTRQIISTIRRLKLSNYQLISR

SEQ ID NO: 988014 - protein, 74 aa, Homo sapiens
ENRRYNLITPIISRESQINEEHPFTIASKIIKYLGIQLTTDVKELFKEQRTNHCSRRVKEDTNKSFMRVGINFF

SEQ ID NO: 988015 - protein, 66 aa, Homo sapiens
SWGGFNSGSFLPQNISILKTLCMQARPFQAESCGWAQGNFSRAADVCSEECEKVPRHQSQMSPTGQ

SEQ ID NO: 988016 - protein, 37 aa, Homo sapiens
MAVVLAATRLLRARVLGLSRLRFGPPAYRRFSSGGAS

SEQ ID NO: 988017 - protein, 34 aa, Homo sapiens
TLEDLQRHKEEWHGARRSWLAAAQDDPTGQSSAG

SEQ ID NO: 988018 - protein, 35 aa, Homo sapiens
FRGTRRNGTEGCVAGWQLTQDDPTARARQVLLGAL

SEQ ID NO: 988019 - protein, 112 aa, Homo sapiens
PRGSFRGTRRQRHKEVQILGHGYLWGEPLFSLPQMHTHLSLFFEMESCFVTQAVQWRILAHCNLHLLGSSNSPALASRVAGITGMHHCAKLIFVFLVETGFRHVGQAGLKLL

SEQ ID NO: 988020 - protein, 52 aa, Homo sapiens
RAQEAAGYWLDVSPAVSALELCTVGASDPSSSRERIELECTASGAASSLVPW

SEQ ID NO: 988021 - protein, 69 aa, Homo sapiens
TPWNAEITVFCVAYAGSYRPELFLFGHLGSSLKYSGFLTANQQQASSGTHIFTLGQPSPSGRFTKGDYR

SEQ ID NO: 988022 - protein, 55 aa, Homo sapiens
TRGSRSPFIIINVIIWCVEENIPPLTLVTVAANIILLCNIIIYFYGHLQVGLAGG

SEQ ID NO: 988023 - protein, 83 aa, Homo sapiens
FLFLDLQPVRLDYQHICSICEPSHLMTKKASDVKCCKAKVGPTVLLEFKFSVKLTVTSPMHPWHELHEEDETDTGVGGPPLQQ

SEQ ID NO: 988024 - protein, 106 aa, Homo sapiens
MYVINMILGSYRSRSGIYQCDIHAQLIYEDIFLIDCFAPCQSCWVHIWRHYTSGISEAAKNGSRFRLSLGFWLVDPPRCLGIANSFLDEYLELNIAKKLRRQIPRW

SEQ ID NO: 988025 - protein, 49 aa, Homo sapiens
SVPPWELGDFIGLSPEIAFHLITNSGAFSMLFLQFCFYKFKLLQLLSAV

SEQ ID NO: 988026 - protein, 33 aa, Homo sapiens
RPRGSGGMGLYGSKAPSPQRRHTAAQPADDAGC

SEQ ID NO: 988027 - protein, 91 aa, Homo sapiens
RLENGNETLSARPPKDTRYHHPVSDMRHPEALGPGLYPAEITLTWRGMRDQTQDTELVETRPAGDRTFQKWAAVVVPSGEEQRYTFNDQHE

SEQ ID NO: 988028 - protein, 30 aa, Homo sapiens
MAQAALVERVTGGQCRWGLEGLKKELLGDR

SEQ ID NO: 988029 - protein, 96 aa, Homo sapiens
VDRKAGSHGQNNAHVGTVDLGRLAPISGEWASWSPLMLYMACVSLLFSRRHHHSCPLLEGSTSVLVWSPQCSGVLTFGPRRSRVPWSVVIFRRGRE

SEQ ID NO: 988030 - protein, 49 aa, Homo sapiens
LYCLTSLGRTTRGYDLKQLYIGSEGTLGIITTVSIYVYTQAQGCEPWLS

SEQ ID NO: 988031 - protein, 48 aa, Homo sapiens
LTNAVRCRSFGRISRSQKDPDPKGLWPLAATTAMTGCPTTPVPSSVGV

SEQ ID NO: 988032 - protein, 42 aa, Homo sapiens
TKVELRILWQRQTRARREEEPADCLTPTGTSRSVLAPRHPMS

SEQ ID NO: 988033 - protein, 36 aa, Homo sapiens
MWKSADISDVSVMTREYRATEASARSVESMVISRVI

SEQ ID NO: 988034 - protein, 66 aa, Homo sapiens
MRGSCVCAVGLSSELRKCNQWMLVLSEGRVSCSSVSTTEDCIALVLKGEADGMSLDRRNLYTACLF

SEQ ID NO: 988035 - protein, 151 aa, Homo sapiens
ELFRTPSESQARVAVQHSEEVTSDPEDYKFLAVLCRVHFGTGAPPRIPAQWLQLFAIKALKYRGHCGPTRVGEPDVCYADIGGCDQCGTPLSGESLRLFPNTGRTVCFVMEYSAGGDLMLHIHSDVFSEPRAIFYSDCVVLGLQFLHEHQI

SEQ ID NO: 988036 - protein, 61 aa, Homo sapiens
DPPFPSLLRQAQEKFGKDNVTENSSILWHPPEVAHEEILLVHRTSAYWCFLSGAPRGIDSW

SEQ ID NO: 988037 - protein, 48 aa, Homo sapiens
CDPHQWVDPNGSARSTSEETPVTAMPALLAAAPPMPGLEAAWTSFSTS

SEQ ID NO: 988038 - protein, 72 aa, Homo sapiens
DPLSTRDTRHDSGHGRWQLLGSVTGFRLPSRHSSAKSGSFKSLAHASLLFPSVFCKTVTSFTKCNGLPAFLS

SEQ ID NO: 988039 - protein, 42 aa, Homo sapiens
EGEKRGFLSWGPGSRQHYAEIQVWMRFQGVCCKKMGIDHKGQ

SEQ ID NO: 988040 - protein, 145 aa, Homo sapiens
DHLSSSIHSSIHPTIHPFNIHSSIYLSIHPSTHTSNYLLIHPFTYPSIYLSNHSSIHLSIHLPIQPFTHLSIHSFIHPSILLHIHPSIQPSTHPSIHPSIQPSIHLSTHLSKYMGTDSVPNPTQHRISLVIGISSLNSEISEFDS

SEQ ID NO: 988041 - protein, 81 aa, Homo sapiens
VTSPSRSTDGSLVDTPKFLGEKYIPQVRMRTGVASQYTQAQKDDLILEGNDIELVSNSAALIQQATVNPEATVNPKATGQP

SEQ ID NO: 988042 - protein, 111 aa, Homo sapiens
RTRSVDADDVEGVEPHPDMEAIFATTFFHVLYGTNSGSLQGLQRDSCVIFICTPCGPQTRKLIHSLHFFTPGQTMRSLHSGTPGRSDDFGVRLVSYLPVTEKRRTGTDART

SEQ ID NO: 988043 - protein, 70 aa, Homo sapiens
MYSFSFLDRHYVSAAAFAGHQSMDHSKAAPGGAYGTVSPHLTMGPHSQLIVLVSSSELLRDPCSAYYLSH

SEQ ID NO: 988044 - protein, 52 aa, Homo sapiens
CIITLLSDRKLRLKEDDVPKVTSLKSELDLNCDFEATVNPQATVNPQATVNP

SEQ ID NO: 988045 - protein, 40 aa, Homo sapiens
GQRDTASVGLEIVQVKDYKRVGDQEDHGSAKRICGTRSGE

SEQ ID NO: 988046 - protein, 49 aa, Homo sapiens
ARSIAWEHKNGYNVVHDILQQFKPGRGQDLVLQFQEQTIQLELSNKPVG

SEQ ID NO: 988047 - protein, 43 aa, Homo sapiens
AHTHHKAYHYTRSRRAEIEQGKKKHCSRGVVEATVNPQATVNP

SEQ ID NO: 988048 - protein, 63 aa, Homo sapiens
LSQCGEILVDYTVDPCTFSLYLSLGISLFSSLSSSSFSLMFRLHIVLGQIEAKVESTRPRFNP

SEQ ID NO: 988049 - protein, 45 aa, Homo sapiens
LSGSGRRHFSKSESHGMLPQPGCNLLNGTQEIGPVGMTENCNYGK

SEQ ID NO: 988050 - protein, 30 aa, Homo sapiens
MIGGAKWNSGIRRIVCAHLPWFSWQNLLSW

SEQ ID NO: 988051 - protein, 38 aa, Homo sapiens
IKDTIEKLKEKKLAPSPTAGRGLAKEIDSVNYLECSAL

SEQ ID NO: 988052 - protein, 40 aa, Homo sapiens
GKRLQDVRKQDVLEMNACMLYGGEGGGLPENHPSVETRSG

SEQ ID NO: 988053 - protein, 42 aa, Homo sapiens
RYDVHRITELVSEQRKTTCAKQQQQQQNDVVKLTKEHVNRKK

SEQ ID NO: 988054 - protein, 33 aa, Homo sapiens
HVGSDIGHGYLVGGNKYSDYHRCILISLSVSEE

SEQ ID NO: 988055 - protein, 92 aa, Homo sapiens
MNRRAVGVIHSVYHSNWFSVALRGTVLMGHMVIALQCFDVCTWLLLISYNLNMQDPHLLHNGAFDPDFSQAPQTDSQAVRGPVDLPAGRDLA

SEQ ID NO: 988056 - protein, 90 aa, Homo sapiens
RQAGCREETAKDSQSALSYAQLIVQASPPPGPSCPERIYAIITKHIPYYRTDDKGWQNSIRHNLSLTRYFIKVPRPPEEPGKGPFDETSC

SEQ ID NO: 988057 - protein, 49 aa, Homo sapiens
EGHGQVITTEPVGMRRNDRAVHAEAAGTMCKGMAEQSLLGTRTQAAQHY

SEQ ID NO: 988058 - protein, 66 aa, Homo sapiens
SRGSLFCLPHHKTTSALRPETRSAQVTGHGKKVADALTNAVAQVDDMPNALSALSDLQAQQASGGP

SEQ ID NO: 988059 - protein, 85 aa, Homo sapiens
VVAGPVINDERSSWRNPWGVKEVGEAAGRSPEGWRCGSRLVPPGCKDVGCVLSARRGWLDSGVPLHVISRGSDHGHAMTYIANLN

SEQ ID NO: 988060 - protein, 82 aa, Homo sapiens
GVAPCLHGKDPSFWMLLPWLFGDVAKNLCLSGDPGPRVPLLQGIELQPISTLPPDLPRAQEPLVVTLDCPCLSEGPSSPIRS

SEQ ID NO: 988061 - protein, 37 aa, Homo sapiens
ETVDSVEGIVRTVESEEDSVVDCENFEGSVGAVESVE

SEQ ID NO: 988062 - protein, 83 aa, Homo sapiens
AEVTLRSRAEAEREEIISAGRLLDVTELRILRRLSSSRCGFRLLATLVGEIALGGQAALGDVVHTGVHDHRDIRSPPKAGLFP

SEQ ID NO: 988063 - protein, 97 aa, Homo sapiens
ADGWGGIPLVDGPVWVTRHRSPSRCQWYGPEAYSDSTAWIATYMAGVKVSNMIWVIFSLVGLGVQGGLGQQHGVLLGSHTQLIVEGVVPDFLHVVPV

SEQ ID NO: 988064 - protein, 38 aa, Homo sapiens
EAYVGYLIGLPAGRLCWTRRTKDVLLQVDDERRNASST

SEQ ID NO: 988065 - protein, 64 aa, Homo sapiens
MTMPDELGMSQAHIHEVIPPGQKDIFIFARAFNQDSYPFDGLGGTLSHAFFPGEHPISRDTHFD

SEQ ID NO: 988066 - protein, 33 aa, Homo sapiens
MKRAKNAELNRRDEDQTEQSRCMKITGFNVEMV

SEQ ID NO: 988067 - protein, 63 aa, Homo sapiens
MRMARSSVRTHDRSGDPESLVGAPDGRRKGVPESADRGVVADLGGPVSARSICVVEYQETCWD

SEQ ID NO: 988068 - protein, 46 aa, Homo sapiens
RSNGLVICWTGFWMTRTVTTICDLNLPLADLYLTATLPLLIDCMAM

SEQ ID NO: 988069 - protein, 70 aa, Homo sapiens
RSLLSCLPLYDLFLVKPMCVESFSDYPPLGRFAVRDLRHPVAVGVIKAVDKKAAGAGKVTKSAQKAQKAK

SEQ ID NO: 988070 - protein, 87 aa, Homo sapiens
MVVVYWSPQPDYINPRAVQHRDPFYVRGLTTLGYNQQSIVATPEKRVITCPGMYEDEEALTIRSTCNTEKGNAVEVLLEQNVSSTDT

SEQ ID NO: 988071 - protein, 54 aa, Homo sapiens
IPFSSQTEKSCSMPTPTALDLVDRPGRASIGGSFKAPQGQTDGVTSGALSSVPS

SEQ ID NO: 988072 - protein, 145 aa, Homo sapiens
MLLVSLRFPLILVDAGVGHLRDMLPGLAHDVLRPELLSHSSCDPDIPGNWDPCSLLATSVLSFLSQQRIMFSVNALFIYSSQKNMPSQGIFNALFLNVSSQSSRAWVLFGHSPARGRPLQHVVPAAMTKYLPTYRSYYDSVDPRI

SEQ ID NO: 988073 - protein, 73 aa, Homo sapiens
ALLVVSAGSPLSHWLMPVIGYYLMSHRSSYFTDCSECLSGVTVCIIAGGSLTGWHPDSAAAVMAHGLGRSSEI

SEQ ID NO: 988074 - protein, 68 aa, Homo sapiens
PGKPFGHLLATPTLPLVSAQAARGPGSTLAGVPAELAPYRRGDRTAFFELLQKPSSLEPLWQLSYAVV

SEQ ID NO: 988075 - protein, 72 aa, Homo sapiens
LEDPQRHKEVRERPSGGGRIVCLSSDSLGRACCGLWAMGVVVNRPMELRSKGDYGCLCCFIHITREIGESRQ

SEQ ID NO: 988076 - protein, 33 aa, Homo sapiens
DHSDVLSYALDHQGQLCVRRGNVGEGAFRQALG

SEQ ID NO: 988077 - protein, 37 aa, Homo sapiens
QSSSSGLQVSTACITGRMVKSDVTENRAQDQLMLPKV

SEQ ID NO: 988078 - protein, 34 aa, Homo sapiens
MVAVLAIGGNVLARLLRTLTRHWVLCHSDKKECG

SEQ ID NO: 988079 - protein, 59 aa, Homo sapiens
SWSAIVPESDLVRFTLSLGNLVVPAHGRSPYCMPNLVRTPCIWHSCTTVPVTPGAQADP

SEQ ID NO: 988080 - protein, 68 aa, Homo sapiens
MSIPVVITPTRPMLAPPITITRIACIKSDKVDHLAGPSINLHNIVHLDHRIWVAYSSSIMSHQVRDSL

SEQ ID NO: 988081 - protein, 73 aa, Homo sapiens
RYERFYRVAVSSSSIYLAHRYAFQNISHLPAFGNVTQFWSLIAVDHFLQCVNLLPSARFDTVNFRRNGQPESC

SEQ ID NO: 988082 - protein, 92 aa, Homo sapiens
SYTEGKCYTLEHWYQELVLYSSDAQPLPSTHCTWRQAVTRQTGARVSSTHCTCTPRRHACGDTHPRAPGRLRPQQMSVQGGSCSQVNMEPQR

SEQ ID NO: 988083 - protein, 54 aa, Homo sapiens
RSITLTKSSNQMWGEVTRRWTYTLVIRLRHNVIHTGVRIISLSYSRISLADIAQ

SEQ ID NO: 988084 - protein, 41 aa, Homo sapiens
FGIILSVTKIEILEGVYFCAGGFRPQGLATLHNSSGQGRRC

SEQ ID NO: 988085 - protein, 37 aa, Homo sapiens
FHVLRSKSPMNQDCDSNRKEVSIWTVHPACLSPAPLT

SEQ ID NO: 988086 - protein, 114 aa, Homo sapiens
GSPIMTVPGTCLGACTLGLRYVARSPAMLGVAAAAAGPARRRDVTALSFQHWNGMQRIKTGSAFPSASNSFFRDVWNWALMLGGFFFLCRCSMDLVVRSCRVMLVGVSVIACED

SEQ ID NO: 988087 - protein, 33 aa, Homo sapiens
RVIIHSYSPSMPLVYEISPALVVELRYSYQKNI

SEQ ID NO: 988088 - protein, 136 aa, Homo sapiens
MGFWNGATLESGKRSPDSQSPLSLPSIRLSTRLFREGSQGPHMKHLVAQPLGCSSSNPGSAQPHSGHSRLLYSPGYTCHVLRALGRMARRQLFAEPCGTSQRYPLTLKLGLRWIKGDLELTGSPEELGLHPLPFST

SEQ ID NO: 988089 - protein, 64 aa, Homo sapiens
MPSLGIFNALFLNVMLPATQALVLLGHSRARGRPLLHVVPAAIRKYLPTYRSYYDSVDPRITYG

SEQ ID NO: 988090 - protein, 119 aa, Homo sapiens
LGPSQCSFLLVSTLLMLLAACFFPSSVPSTTCLKLCTSLQERGVPTAAKSLACKVRTLLHPACPILVLRQLPIELLPMPWLLLLFDDCHKGTTYWSCRPLISFLQETQSVASYFALRLV

SEQ ID NO: 988091 - protein, 142 aa, Homo sapiens
LLWVLSNSAPRAPRPPSDTFVFYPGSRGPRDWHSILPFWAPESALDFHWPFGGALCHMVLTGTVLDVYASLFLIYSAKRCSPTGVVALAAGPGNRLSVFWGPKPPWSVCAAAAPVTVPTAVFRVAGEVCSVRPYLLRFPRKY

SEQ ID NO: 988092 - protein, 74 aa, Homo sapiens
AQGGGERCISGSASGSASPMELLSYFKQPVIATRTAVRAADCLHVALDLLQRKLRPLWLKAIQVSLSVLHARPA

SEQ ID NO: 988093 - protein, 61 aa, Homo sapiens
PPEAQGGLGAYLAGLSLQPVKRFLELLPVAWSFRSPPPAETRHPSWECHWPLVLPSSLVPW

SEQ ID NO: 988094 - protein, 41 aa, Homo sapiens
MGTARREIYTLSAAGLLVPLPSLVPLASLVPLGASGLLEAS

SEQ ID NO: 988095 - protein, 36 aa, Homo sapiens
SEDPPEAQGGRGTKEGEKVYILALKELRYVLYGRCD

SEQ ID NO: 988096 - protein, 62 aa, Homo sapiens
QRHKEVHRFSLRIPIGTVHHPVLPPMQCCSPAMVSWQLLHLPKVYLPLVATGTHEIISISPH

SEQ ID NO: 988097 - protein, 39 aa, Homo sapiens
FRGTRRLLRILVGPGEIYTLSAAGLLGALAPWCLWLPWC

SEQ ID NO: 988098 - protein, 45 aa, Homo sapiens
DSGRCRGQAWDVSVRRVGSGGTSACLNWQSVLRSKCRLRPLLGAL

SEQ ID NO: 988099 - protein, 63 aa, Homo sapiens
DRGIQLYSTAASDLAPLPASYPTVTPPETSTGFCEHVLTSKYQLSWSLGSRSYCPLGVPRGST

SEQ ID NO: 988100 - protein, 50 aa, Homo sapiens
MEITALAPSTMKIKIFAVLLERKFSVVVSAAPSCASAVHASSHDVVSMQR

SEQ ID NO: 988101 - protein, 66 aa, Homo sapiens
MFGRYADSLCFGVVTVTYPSGYRGRGCPQDSCSGIDHSPPVFSSLCHLPSLALPDGALLVLPGLAL

SEQ ID NO: 988102 - protein, 80 aa, Homo sapiens
SEDPLQAGISHGLLFHQTGSCTFDEYFKSKLCPLADPRSNLCALCIGDQQGENKCVPHSDERYYGYTGAFRCLAEKLLRA

SEQ ID NO: 988103 - protein, 39 aa, Homo sapiens
LQDPPRRPASQQDLLKELQKQLEDKHSTHSTNCFIETRK

SEQ ID NO: 988104 - protein, 37 aa, Homo sapiens
PAATGFSIWSAFITCDALRGGLYGHLNLRECQIYSLI

SEQ ID NO: 988105 - protein, 37 aa, Homo sapiens
MLLIVLLVWACSSVTQLGSLRARPSCRYVVPICHLIS

SEQ ID NO: 988106 - protein, 93 aa, Homo sapiens
VSYSIPRPPSFVSAKTGNVASLAVWGALILRIPAWMWKDVFGVYDRLTGFGWIAGKGAAGMHSLILPPWRPSFLAFFETESCSVAVAGRRCGG

SEQ ID NO: 988107 - protein, 114 aa, Homo sapiens
GSPGRQASHVGSGYQQDVASQCVFRLSYLLDGIGLGVPEVDTRCSMAHLKSTDIWYLQVQAIVVHALLSHALCGGLSAGKIYFSVRLFADQPWPRLVKPLSSTEEYHTLSFVHC

SEQ ID NO: 988108 - protein, 54 aa, Homo sapiens
SIKEPINRHILDTSVFDTVPYCVSLLFFYRSSTILFTGQIRIKHSSTLNACEYT

SEQ ID NO: 988109 - protein, 122 aa, Homo sapiens
MLLVTLRIPGRQLLTVLGLLVEPLRLAECLSVFLSGLPIYFRFNMLKVIHFYFIFIVIVDYDKILFLLALCHSLIPEYNMLINKGPVISHRKAVTVLAECHMEGTFYAIYKNSVFALDSNKL

SEQ ID NO: 988110 - protein, 62 aa, Homo sapiens
KTNPIYLSYAQDVVRLLKDMTWSLTKSITSEIHTSDIILYTPKQHTMAAVYLSYLYHPTFRY

SEQ ID NO: 988111 - protein, 119 aa, Homo sapiens
MSHGTIDFLHITDNDGEKTMNDTDSEAEIREALRVFDKDGNGYISAAELRHVMTHLGETVNRRTTVDEMIREADIDGDGQVNYEEFVQNDDSNVKTLYRMCKITCTTSYISLFFVRNLS

SEQ ID NO: 988112 - protein, 46 aa, Homo sapiens
MALVLHTILGPMLLNRPLAWVTSSLPSPSNVKGKILLKGKTLGGLL

SEQ ID NO: 988113 - protein, 104 aa, Homo sapiens
LSFPPAYYFPHFDLGHVSLPRLRATAPKVADALTNAVAHVDEMPKALSDLSELHAHKLRVARYNFKLLSQCLADRPWPTTYPDRVHPIQCPKPREILLDVDLAR

SEQ ID NO: 988114 - protein, 75 aa, Homo sapiens
LVFPITKTYFPHFDLSHGSAPRFRATAQPVADALNNAVAHRGRNAQLRCPPMKLTMNAHNAIGVDPGQPSMLHNA

SEQ ID NO: 988115 - protein, 53 aa, Homo sapiens
RCAADVRDVRRAPACGDTPKLGNRGYQRRLPSDRPMYPGDCPPETTETPKCSS

SEQ ID NO: 988116 - protein, 74 aa, Homo sapiens
GCTPLVAQDPAHVTPASRHQAECIPFFRSMPGFTGSHISIRNQINALTSFVDASMVYGSEKPLDRNLRKHVQAA

SEQ ID NO: 988117 - protein, 41 aa, Homo sapiens
SHSSEQEMTQANLPSAGNRHGLSHKCLRKCTWGQCERNTWA

SEQ ID NO: 988118 - protein, 34 aa, Homo sapiens
APPGGLLKPLDGWVHTSVPVSCVTGGCWNDPHVS

SEQ ID NO: 988119 - protein, 46 aa, Homo sapiens
MHGSHSDVVSELLVPARSQLSRCCARSLTPKRSEGERNTVAGRNTG

SEQ ID NO: 988120 - protein, 65 aa, Homo sapiens
MTQAVSLLCSTEHCNALGKERRVPGFHSWHYAGPNGQHSTCTAFFTGAGSRVVVVNHICDLGYVI

SEQ ID NO: 988121 - protein, 53 aa, Homo sapiens
MVRKRNAHMPRVLTNGMYAEVMQATSIQALEGNISFLSLPLGLMEGARCGAPN

SEQ ID NO: 988122 - protein, 48 aa, Homo sapiens
SKAHEGSLSLYCEWLHTQVVSAAARLNEAMTLATRMPADLVKSAIPQG

SEQ ID NO: 988123 - protein, 55 aa, Homo sapiens
REGVQDVSLQAYTVAHVKLDSYQMSTELLIRKLPFQMSWCDEHVLSDFNNMICCF

SEQ ID NO: 988124 - protein, 32 aa, Homo sapiens
MEDHSSSGIIGCSEPVIIAICTPVWVKEKGPV

SEQ ID NO: 988125 - protein, 81 aa, Homo sapiens
AELVRGLEMLLMVYPCTQRVDESFGDLTTPDAVMGNPKVKAHGMKVLGAFELMGWINWSNLKGTFATLKMSCTVNMLHVES

SEQ ID NO: 988126 - protein, 74 aa, Homo sapiens
MCEVGGKLPYCLLQVVDTTITVAPSPQERTSFVLDVMGYVSSFKCWASVSRPCACRVCTMGQSPQFPQGGPGTD

SEQ ID NO: 988127 - protein, 59 aa, Homo sapiens
MSPRLVLNSRSQSDLPASASQNAGITGVSHCVRPQLVIFESQCLRLRFCNTKAFFLVRH

SEQ ID NO: 988128 - protein, 43 aa, Homo sapiens
IRVYDCICAPGHAILRSASWVARTTGPPHPANFLVVLVEAQMQ

SEQ ID NO: 988129 - protein, 71 aa, Homo sapiens
DPSADNSTVDDNPDFDNSTLWHRDEEEKFFDEEETEGCASPELGWGLMAATLPTACPIPIPNKAADSRPAQ

SEQ ID NO: 988130 - protein, 52 aa, Homo sapiens
NSKMHTDGDRPQDRLRSEKEFTLLPMNYPSRHRRLSGQPPYLSATSIEHRPL

SEQ ID NO: 988131 - protein, 40 aa, Homo sapiens
RNSVSLALRVQNALHCLLASERCCGGGKAAQQLREGDVQR

SEQ ID NO: 988132 - protein, 68 aa, Homo sapiens
CRPSAPSTNSMYRHYSFHVERHSACSLGTWIQWNYMGASVCVAMERYQLCGSVEERGRITLIMTHCQY

SEQ ID NO: 988133 - protein, 128 aa, Homo sapiens
ALLREHLRRRAPDRRVSSTSLSVGRIDQDVLVHPLSRSACRRSAHPTSCSPCVSSALGFCIIWQEKVIGAHVATLLRQRFTGEQNRFAIDLAVVSRGIDSWDRSPAPQHHAIRVIEVIARASEPPDAT

SEQ ID NO: 988134 - protein, 58 aa, Homo sapiens
RHRDSSLTLFGGQHWCSQKPGTCPGGVHRRGNIGGEVGGQDHQQAVAEELEVDRVHPK

SEQ ID NO: 988135 - protein, 102 aa, Homo sapiens
VQNQVSTCVPVAPGGDELVLLSVAVYKGCVDVVCVLLTPYIMERITRLKSYGMIWMTLALFMYAGKLPYLMFSFMIRTFVNFPETTSSRPESWPEMGSGAVL

SEQ ID NO: 988136 - protein, 38 aa, Homo sapiens
VCRHSTRLEDVQNGRATGFLLKENIRPFQLYEIYLCTP

SEQ ID NO: 988137 - protein, 41 aa, Homo sapiens
IPLILIVPQHPLVVLIRIDSASLADPSWQSNSCFPVMKCAH

SEQ ID NO: 988138 - protein, 124 aa, Homo sapiens
RGSAKKRPLPLVVIGITMNTVAAARFRKVDVRLNDENKFVDEEDVADGESVPDEGEVHSCLRQGNMTAALQTALKNPPINTKSQSVKDRPGSIVLKVLISFKANDIQKACQSLDKNGEDLLMKY

SEQ ID NO: 988139 - protein, 74 aa, Homo sapiens
IPECSPAESLQSTHLLPSTALFHHAQLIFEGKTGTGLRHFDQAGLELLTLGDLPTAASQSAGIIAVSHHDQPQW

SEQ ID NO: 988140 - protein, 80 aa, Homo sapiens
TRNSRTSLKEYDGLLYLENYPKLKLKHIHWPGAVAQACNPSTSGGRGGQITRTGIETILATTVKPCLYYKYKKLAERNTG

SEQ ID NO: 988141 - protein, 108 aa, Homo sapiens
MVVVYPAIVAIELVISSYDFVPGGTLSSCSNRVSSGVGSSGTNIDWLIQWWFMNCVMVSLSVGSVFNRRRISCLASSETSDHSGLGKPYWPRRILLFIPGEMAWPVLE

SEQ ID NO: 988142 - protein, 133 aa, Homo sapiens
QLPSNAFVSTAKWQLLFGLKLLNMMAEEKLVDAWIAAPRKQKKAWRSCSRAPLEGCLELVCTLPCVPEDWEFLLSVASRVFVLYPVLTCYGELRILSSSPLSQAVTMWRPGQLEPRPSSQAEQGGPGTLGLPL

SEQ ID NO: 988143 - protein, 135 aa, Homo sapiens
GRSASDEKSAVTALSGQGELLSKLVVRPCCTLVVVYPVTHRFFESFGDLSTPDAVMGNPMVKAHGKKVLGAFSDEAWLTWYDLKGTFATLSELDCDKLYVDPENFRLLGKVLVCVLAHHFCPEFTPPVHAAYQEA

SEQ ID NO: 988144 - protein, 57 aa, Homo sapiens
GALQVDVYSPLRVHALPWYNVPVCTLWDTDAVPRKVLLQHGSHGSTSSMDPRSYPVV

SEQ ID NO: 988145 - protein, 43 aa, Homo sapiens
YPACRGVQGAGLHRVKKHLQDLSWRNLQSSDNEFLKALGSPDR

SEQ ID NO: 988146 - protein, 103 aa, Homo sapiens
MTRRKGRASFLPCLSWFHLARACCFLRALALPPVLLFVPFCFPHSLPQLISSSSRPLSTLSKHITGDLIATRSECFAVILLGLARPGTALCSTPERGEHELVC

SEQ ID NO: 988147 - protein, 33 aa, Homo sapiens
MKIIVNKDAKSTLRVLYGLFCKAHAGRHTWDRD

SEQ ID NO: 988148 - protein, 75 aa, Homo sapiens
MVSTFLALRRVGLSHLHTQVQQRFWYSALGVLLDIKYRDLRYFLLNSDLNFQHCPLHLREGTMNSGSGTFISAYP

SEQ ID NO: 988149 - protein, 32 aa, Homo sapiens
MSVHVHIALQHIPTHLIVEWIAKLMGDLQRYK

SEQ ID NO: 988150 - protein, 109 aa, Homo sapiens
TERPRSSYQGQILPSQTLTDPDPSICARSHLLRHGQTQILIPASNPTSSDMILHEQTQILVSVPDFYLLTHGETQILIPVPDPTSSEMDRPRSSHRYQILPPDMERPKS

SEQ ID NO: 988151 - protein, 49 aa, Homo sapiens
RDQTAYEDQKGPGPEKTTSPCDYPQLQQKTGSDLRPSASASTSSLAKGE

SEQ ID NO: 988152 - protein, 36 aa, Homo sapiens
QSSCRIINFEPHCLRRLPSDENTLSPLSEFSEVGLT

SEQ ID NO: 988153 - protein, 122 aa, Homo sapiens
SPERCLLRDNVHLTLGGETFNDLLIISQDRGMNKEPPWPISSLLSSHLLGPSPGAKHLLCLVRLIYLNGKYGCGKLKSQEVTLLDQSHVDQHQHKDQNPHLSPKPLVQNPVAASGQILTDLP

SEQ ID NO: 988154 - protein, 47 aa, Homo sapiens
MRARIIPDSVTFGSGRDLQAKSGAAVRRGSRSSSKLLGCANDPGLGK

SEQ ID NO: 988155 - protein, 50 aa, Homo sapiens
MTGSNAEEDAPNLGASCPALAARFASDWILSFPQMMVAHGNKCGVPELEI

SEQ ID NO: 988156 - protein, 69 aa, Homo sapiens
MAKQYELGLGQPPSRAFGLPAKDPQSPADWSSGLSSTIDRQPLRRLAAVSPHGTLALSPSDLEQVHQLG

SEQ ID NO: 988157 - protein, 37 aa, Homo sapiens
MRGPLMRGHLCVTYAWGRCWNRVMSSSPVGLAPGDAG

SEQ ID NO: 988158 - protein, 47 aa, Homo sapiens
EDPATYTHFTTIPDFNGPPSHYRFGFSAQLSVSSLVWVSQAPPRYKV

SEQ ID NO: 988159 - protein, 132 aa, Homo sapiens
YNLIFSTDTLSSTRSNRLLKLEHASRSSGTMVFSSIRSSKVFSTLLILVSHSSHLFSRFLASLPWIQTSSSSSEKLVITDFLKPTSVRNRQIEKLKMIKSSRDQALAEHCLAALTECAASGDGKFLALAVDA

SEQ ID NO: 988160 - protein, 150 aa, Homo sapiens
KKGRWVFHSYHEEIKAGQLRFTTLAYPVLCLVAKSILTDPHQPAFPPRPPTLSASVDVCCCVRNAPSCSTASTPGDSCGHQLPGLTESLVALFTLSRICFLGANPPFYNPLSQASYTAPSSFRACGRPRSLSLDAEHVRGNERNLPEPFP

SEQ ID NO: 988161 - protein, 58 aa, Homo sapiens
ANSLVIRDCEKEVRAWGYALLVLHLGHHASTKEPLHNNNLPPRLPRLLLAVSNRIPAD

SEQ ID NO: 988162 - protein, 131 aa, Homo sapiens
RTPRAPYQLQYLVLPETPPELVSPRVLEVDTQGDRGVSRDGLFPVSEAQVQLAVGDQRLNRIVIYGNDSFVGQGPSVRVTAEDRGAPAADVCTIVLGNQSQETLRRVTIYSLPVPIVILTKPEVSKGPRDS

SEQ ID NO: 988163 - protein, 38 aa, Homo sapiens
EIHTANSSGLTMRALVVSAVIDNEMETQNFKCSSFILV

SEQ ID NO: 988164 - protein, 33 aa, Homo sapiens
QAVRKNIFSAPVTTCMSSQLAVVQIQLLFLVDN

SEQ ID NO: 988165 - protein, 69 aa, Homo sapiens
GGLVEVRAGPEPARPFTIPLSSHRPLRCLNTGQGDSMCALRIGRQRTEEGREQPHALGGALWPQTRAQS

SEQ ID NO: 988166 - protein, 45 aa, Homo sapiens
MTSDWKMAYKQSERFTYQRCMLDWGRGRSRGMTVATRQDTSPDET

SEQ ID NO: 988167 - protein, 141 aa, Homo sapiens
QEVSSGAVRRAKALRYGVRALAEKFPVISVPHWPRNRATGRFEEDFISKRRKGLIWWINQHGQPPSAGAVRSLPNNFLDVAQAAPNEKSLESRGKEGKGPRRNEDGWGAKLSFPDPLNNAPPAGCPFDLALPGGTEGFRIR

SEQ ID NO: 988168 - protein, 116 aa, Homo sapiens
PGSGWEVRERSEELRVVVASPEYHDTAAWTSAAGIPSTPQSRHGIPPFRLVGSPNFLLSCGPLGFLGFSSFSSLPIPFILNTLWRSIDAIPDNQKFKQLQRELSQVLSPGADLHPA

SEQ ID NO: 988169 - protein, 50 aa, Homo sapiens
MISTDLTARFDLGGSPSLSNLVSPLSGGHHIDAELSADTLIGIAHYSPEL

SEQ ID NO: 988170 - protein, 58 aa, Homo sapiens
FRRRALKQLPKPPGADHYRGRGTPAYLDKPEDVAYTDCWTSCRALHAEAQHCMHGGGL

SEQ ID NO: 988171 - protein, 47 aa, Homo sapiens
MPFGASTSFGDRSLQAPSHCLLVTLWRPTPPPKFTPVGARTPCDKFL

SEQ ID NO: 988172 - protein, 44 aa, Homo sapiens
MVRYIVCSGQVPPRLVGAALDWKTNSAWARVSTSVPIEWPSPKG

SEQ ID NO: 988173 - protein, 97 aa, Homo sapiens
YELRTTFLEPQPVTAHTPAESTCRNSGYSERSEVTCMWGARGDAGRALRRACVLRAIVAAGSARSVTDVFTGPITVGSHTMSGSLLGCLLVSFGWPL

SEQ ID NO: 988174 - protein, 48 aa, Homo sapiens
SHRQLLWVGRRFTRGITTNPSTVSPAQRPPCVLWSSLLLPHPYPPDAS

SEQ ID NO: 988175 - protein, 35 aa, Homo sapiens
MVCTLFWGTAQGANTTVTTQAREEPGPTKHPGGTP

SEQ ID NO: 988176 - protein, 46 aa, Homo sapiens
FPTGSCMGCRRYEWHHNKPSKSSRHSGSLCSVVFPAAATSFTLLPL

SEQ ID NO: 988177 - protein, 38 aa, Homo sapiens
EVATRLHAWHVDDMPSAVRLSDRTRTSSGGPVNFKLLS

SEQ ID NO: 988178 - protein, 86 aa, Homo sapiens
LDDHVLIHSILTVNHFLFGTDQPPILLSHSRAFALRQGWEGVEGVERRDLHTLLRAHPHVHRGLSDRGSELDHICTLLLKELTNFL

SEQ ID NO: 988179 - protein, 80 aa, Homo sapiens
FILQPGHHLLAQTHGAVNGKGSLKGQPGEFKPELARYLVKFLGCYAEHKLQFWAVTAENEPSAGLMSGYPLQCLGFTPEH

SEQ ID NO: 988180 - protein, 130 aa, Homo sapiens
GRPRRLEHSEWTLPGLLSLAPVVTQEPALLIDLTSHRCRRTRSGVGWKRVLRSLCHSRTRVPLLAAIYFLMIHVLLILEFYGPSIDLVVTLWTTPLKNWNSLTSNIRKSIPVEQSSHLQVLFSNSSRKVP

SEQ ID NO: 988181 - protein, 132 aa, Homo sapiens
GVYGRKKHDSLYAWCVRRRQFQLTNCESEVLHTGLRRRWMECPIGTFSILELDGSTEPIEAAVRFFSASCVPRADEGQFPHLCRLCAGTGENKCAFSSQEPYFNYSGAFQCLRDGAGDVAFIRESTVFEDLS

SEQ ID NO: 988182 - protein, 38 aa, Homo sapiens
TQEKVGVSEQARGRGAEKRRTGCIGAKHRISKEEAMRW

SEQ ID NO: 988183 - protein, 91 aa, Homo sapiens
KPMMYPFGKCTTETGMMVEYAPNILEKKDGLALLKTAIVDKLATLISVVIGMDVAASDVYQVMEKYDLDFNVSLNVTPARYIIDLNRMTDL

SEQ ID NO: 988184 - protein, 109 aa, Homo sapiens
DVYRHAGREMASSPECSEMPLDLSSKYNLQKLPFLNQRKTPPMPVKTPVHTSSKALLSTVLSRSQRTTQAAGGNVTSCLGSTSSPFVIFPEIVRNGEPEHLAEELNCTD

SEQ ID NO: 988185 - protein, 70 aa, Homo sapiens
NGPINSRSQESDWVHGQTLSQDWIIHPEGPIIEPREQVEAPQVLGPQVLGLQESNRIPEVYYCLIQELIV

SEQ ID NO: 988186 - protein, 35 aa, Homo sapiens
MQTLIVMTPSWKSGSEENTFSLEEVDTLGLQGHQN

SEQ ID NO: 988187 - protein, 74 aa, Homo sapiens
IVQLEAQDSRQCGRQRSILKSQACHFVRTHIFIDLASRYGHAHPPCIMPCFRIGVLHADQVKQCTVPSPLQGRS

SEQ ID NO: 988188 - protein, 45 aa, Homo sapiens
LTLTQSCCCTAYSLSLSTPQPTAQITVSYTTPERVMAAVNGHSNS

SEQ ID NO: 988189 - protein, 77 aa, Homo sapiens
SDFLCNTLESACKICSDPTEDEIVFLVPDPMQKPCLENYCGSIHYFTNLKSFILFNLTSTIFGGSSYSTNSSSRLLS

SEQ ID NO: 988190 - protein, 52 aa, Homo sapiens
MNSWAKHSARPQTLHPDRFSHILPIFNFIATFCMLMPEENFTADHPFLFFIR

SEQ ID NO: 988191 - protein, 122 aa, Homo sapiens
MTSLAAHGITSRVEWLGEDLLKRQRPGVVAHAYYPSHFGRLKWVDHQRSGGSRPAQPTWQNPIFTKESTMTPRHGGTRRVSQLHLRLRQDNCLNRGDGGCSEPSLGHCTLAWQQSKTPSQKM

SEQ ID NO: 988192 - protein, 44 aa, Homo sapiens
FWAYGKRALGAWIPQGRNGSYQWGPVPCWFARTPFNSVTLPFRY

SEQ ID NO: 988193 - protein, 48 aa, Homo sapiens
PEIMDYYHKLVMLSTMHEDQQYRNFSFCLSFDHMVYGLTLHLQRHAEN

SEQ ID NO: 988194 - protein, 102 aa, Homo sapiens
SWGLETFSFHCVLSEMYFKKNGFKKFRHGIHYFDQAGLEFLASSSLPISDSQRAGITGVRHHARLRRTFEHTRQAVTYWDEREMGTCQSSVSTALAVPTLAV

SEQ ID NO: 988195 - protein, 57 aa, Homo sapiens
QGLDWSAVTFTSGINMHESCAACCGSCTPLFPLHSLPTNDLWTIFAIKISLAPDMPD

SEQ ID NO: 988196 - protein, 33 aa, Homo sapiens
TECCASVLLIFDSDIRTFHSHFSLRPEIVHSQP

SEQ ID NO: 988197 - protein, 37 aa, Homo sapiens
GLSAVCLPVLGSLLGMSSAGGSQKLTFRGLQFSFTYR

SEQ ID NO: 988198 - protein, 54 aa, Homo sapiens
FAWLFSFSALLLLVDLGSVAFWSFLAPPGCGRCPSPGNHTPESPGPAPQSGRWE

SEQ ID NO: 988199 - protein, 41 aa, Homo sapiens
RTPGGLGVVYGKSSNSQADEMDRMKKEYTDCVVTLSAFATE

SEQ ID NO: 988200 - protein, 85 aa, Homo sapiens
TSHVAIDRYACGLVTTYSSADLSRLHLGHLSELIWVGWAWRYLSGLQWLRQRLSTPKWPEMGRLDLGTPQWAEMAEPGLSTPQKD

SEQ ID NO: 988201 - protein, 77 aa, Homo sapiens
RVAHVRTARCVHVVHVRHGVGQRVGTFLLLALNLGSAVAQVEVREVGLGGGAGQEHPLQGLRTILASVRRRTYPSPA

SEQ ID NO: 988202 - protein, 132 aa, Homo sapiens
EFRGAPYQLQLGPPPNVYGITDSTPVQYYSGSILQPPLRLIVRAIRGPMTHLPLTAKTGLHGATLGCVIQSGVWGRIQGFCWYQYMSRILELALQVMVTLSPGDADHDCWRLGELNVKIRHRQSHLRLNRLH

SEQ ID NO: 988203 - protein, 114 aa, Homo sapiens
DRGGPTAAVLSPVIVSLRRQVYPSFSSHRCVCPRAVLFENYSLVLELFTCLCPHLTYEVCDVNFYILCSMSKLIRTRNYVARYVVCTSLYFYTVKQWIPEETLCHQYENRKHTS

SEQ ID NO: 988204 - protein, 39 aa, Homo sapiens
MLREEKGNVEWAKSGANMRGVRDPSNLTLGISLPLSKCR

SEQ ID NO: 988205 - protein, 62 aa, Homo sapiens
LLEVSRVACLVDSFFPSYSSVWCRLCMLIPSPFPGTLPIIQLFPGESAVRVLCCLMKSTQAA

SEQ ID NO: 988206 - protein, 68 aa, Homo sapiens
LWTGGTDGCLHGGFGGPLLCTTVAHGIVSYGKSSGVSSITLLLGSPVFALDKDNNEKFKLLDQIETPL

SEQ ID NO: 988207 - protein, 129 aa, Homo sapiens
PSAPSTASHCHIAGGAIDLLSRVLSQASADLCGHPEAQTNCHVQSDQRGVVEHWYDVRNRQQDVRMTAIQIGGAATTEYTEMKALLDASETTSTRKIKEEEKRVHSKFDTIYLILLKKKSEIQTLKEEI

SEQ ID NO: 988208 - protein, 103 aa, Homo sapiens
PSFTTRNSANRITDAILSTLGPPPAQPQRGGDGYAPPPFPSYPAPGCFPKVWQPSAAPCYGPFSGPLLPKRTENKPQERHRLNAGRQPSPIPTNIQCRPPLQE

SEQ ID NO: 988209 - protein, 45 aa, Homo sapiens
MSLLLETADTKPKVYEMEVLAAGPGEEEDRPFANEHAHFCDRSGA

SEQ ID NO: 988210 - protein, 82 aa, Homo sapiens
GSFLTIYGGQLGAHVSTELVQRGMHRSVEYTSTRLHISDIGRNHGSHVSTEHVYGGMHRSGEYTSSCEHAIAARVLKDTLES

SEQ ID NO: 988211 - protein, 60 aa, Homo sapiens
DLMESSTVLTMIDGTCTGGMHQTMSEYTSTRLHLKNFGGQHGSQVSTELVQGGMHRSGEY

SEQ ID NO: 988212 - protein, 39 aa, Homo sapiens
PVLKLLCHCLLVNSVEEVGGQAHQQAVAEELEVDRVTRS

SEQ ID NO: 988213 - protein, 44 aa, Homo sapiens
RQVRPQGIVLSQKPSTCPVHLHSGWIPDLVGPAKLLHVPGAPPA

SEQ ID NO: 988214 - protein, 75 aa, Homo sapiens
MLLTRNDFFNTAWITGKAYVTMFGAMRELRHAYNRYELAASGLFQSKECSKLNDSLKLSSTFNLIGFQCSAEMSR

SEQ ID NO: 988215 - protein, 86 aa, Homo sapiens
YAGLTMDEKCPRIYPLQNYILGRNVFHTKVDEEDECRKVVAWNTAWRQGAMIAPSWFGRAESFPNEYALCFWRSGRVQYLPGVGPP

SEQ ID NO: 988216 - protein, 92 aa, Homo sapiens
GSRSSQLHGVGFGTCLHVTDLSWQQPQLELHSAKTPAGPAGKSLRHSRAAAIITKFLPLQQQTGVLPPRTQESRPSDLRKNAGDTLPQEDLP

SEQ ID NO: 988217 - protein, 53 aa, Homo sapiens
IFAGLSNCPPPLYCPLLKVLNTCAFYQGQTGVRLLTPGGLSVSTTQTILVPHL

SEQ ID NO: 988218 - protein, 94 aa, Homo sapiens
GETSTADWRPDVLCYMTRTEGLTFQRGWMALWTSNRDWAAYKQGFGSQLREFWLFNDNIHALNCPGKQQSSVYNLVDFEGATPSLLSTNHSTVA

SEQ ID NO: 988219 - protein, 37 aa, Homo sapiens
YGTTYAGYRRKQLLDHLETGSSPESNLFQSTSVCRPL

SEQ ID NO: 988220 - protein, 116 aa, Homo sapiens
MVMPHVSTGACECRSVRSSSASLKIRIHLLGDSDDGRSPARRFDLSCSLFGTGRADPSYDVSDGMFHISFYEELPLSFPLRLFKEERLLLSSPSGFLQPRNFFTDPSIEPRFTMLL

SEQ ID NO: 988221 - protein, 107 aa, Homo sapiens
QSSLPVTLSALTECNLRGSSTTKNFRTQGLHDFTCPCAYSTCGFLYSILGQVKRSAAPDTCAPSWAPPGILQGGWLLAGGHRDRAHQLQLNLDEACVRTVLVQAHEE

SEQ ID NO: 988222 - protein, 74 aa, Homo sapiens
MSHTVRKAAQVAALAGGAAVLAAQHLAALGGPVPSPVAVTLPEGTEQLLPWPRHHVLGRRVSSRLPIGGLKVGE

SEQ ID NO: 988223 - protein, 51 aa, Homo sapiens
PWCGEEGRQLQLNELQGLKSCHTVPSQDRVNGMSRIGTLTSILESGRVHRE

SEQ ID NO: 988224 - protein, 125 aa, Homo sapiens
VRQQGHGRAEVLLHIQTGRRDRGLPTSQNDGRPGRDARHFLDGMAARQRRSSLSRLCSQAEGLLTSQTMGGQAETLLTSQRGGGWAEAAISALWEAKAGGWKVEGCSQPRSRHCTPAWGTIEQLS

SEQ ID NO: 988225 - protein, 49 aa, Homo sapiens
QTQHRGGQGSVAFTCDPEVQNTTYLWWVNVIAFPVCPSLKPINLLFNDN

SEQ ID NO: 988226 - protein, 138 aa, Homo sapiens
LSQTTAVSWRNTKQQFQHAATAVYTQVVLPAQRSLGPGRLCAVRFSLRLQLWPLSDLKGGLGVLKDGTEEAHALSHSTELGWGRGRRDSAGSLGSGTVHLQGVGRHGPVPSPISPCDFRWTSVLSHQPMLVPLDHVLA

SEQ ID NO: 988227 - protein, 94 aa, Homo sapiens
DKRYSAEMCPGCSSQCEVSAQTSQAGTSCTEVSDGIILSRLATVADDHKGVLESLLETPDPCPAKMGLKEVLCARKTLHNIMKAPGTQPLVTRL

SEQ ID NO: 988228 - protein, 49 aa, Homo sapiens
IRYLRSALLFTGRHELISAGRCLRSHPVLKDDATLLRCCLLVVYNSQWG

SEQ ID NO: 988229 - protein, 85 aa, Homo sapiens
MKLVSPGPPRAHLPGPLQPVPCALVPSCICWDVAVQRQREGHRDPAPMIPTLQLRAELLPSQPGQTGAQGKLPEPQQVRLRVCLR

SEQ ID NO: 988230 - protein, 57 aa, Homo sapiens
GQDQSSFLRHNVFSSHWFMTDIAIGSAIGDYNYAMFLNKLISLPQAFFKFFHLMLQQ

SEQ ID NO: 988231 - protein, 36 aa, Homo sapiens
MGDCSDWALVTLVLGMEQHLLFQLCPTEFTWDNDAL

SEQ ID NO: 988232 - protein, 72 aa, Homo sapiens
ARAIDLKLEVLWQCGMGWVTSSERRPSRGVPILNIQQLAEVCPQAKKLLPPTVTMRAAHTHPTRAQGARRSQ

SEQ ID NO: 988233 - protein, 124 aa, Homo sapiens
IRSREEDSKGRYERYPEATFRRSGVSREVSPLLTIHHLNKDIDLLQRVSAIPCVATFAQLSAGPESWLKSQGKEHSPEAPGPNPILRRLSQRLCLSTELSPEVAKPQIKASKTTVTGDKDSVNL

SEQ ID NO: 988234 - protein, 79 aa, Homo sapiens
MTDPHHPRLSGKVLVFSATISNNNDFNSHSAYCPGLTRLPANVLSEWLSPRDGRRGGVSSQEELSAKPRVPSKGALTPG

SEQ ID NO: 988235 - protein, 46 aa, Homo sapiens
FFESFADLSTPDAAMDNPKGKAHGKKVLGAFREGLAHLDNLKGTFG

SEQ ID NO: 988236 - protein, 103 aa, Homo sapiens
MWGTEKQGLLLLLCPEGAKCAYRKRGALWAFLLSTGKFEECLEYVMSAGLLANACIPALREAEADGSRGQQIETILANTVKPHLYYKIQKIEPGVVVGACNPN

SEQ ID NO: 988237 - protein, 37 aa, Homo sapiens
MPGKFLVFKKHGVYPGKPQGSEFPDLMTRPPKPPKVM

SEQ ID NO: 988238 - protein, 34 aa, Homo sapiens
TWAYGDVAPGASRAGADERDAVGLVLDAGVIGRD

SEQ ID NO: 988239 - protein, 91 aa, Homo sapiens
LKGTDPPEPIEAACGQGSYTASCAPGADKGQVPNLRRRRAGTGENKGAGTSQEPYFSYAGATKCPRDGAGDEAHSRESTVREDRPDEAERD

SEQ ID NO: 988240 - protein, 81 aa, Homo sapiens
RPLSLRSSFVQSLWTEREFHSHTQTTLIHTFYDLKIQKNKHKHKGVSDVTHSEPDQLWDLDLVGAFCHKFEFELQDVHRAY

SEQ ID NO: 988241 - protein, 79 aa, Homo sapiens
WPDGSELFIAHLAAPKMWGYTGVSTHTVAPLVIKRDKAAEIKIMYAGENFVMQIPALWDLEPLTQPPVGLSVAIQYNGN

SEQ ID NO: 988242 - protein, 106 aa, Homo sapiens
AVTVFFFVAPVSLSYEIFDCNCIQQALHRRVIRCFPLDDHGGFARMNHMQLTGRKPAVRDHLHYNAPRGWPLLGYHYTDQKQILLILTDNDRLVEELKLAKLFGLR

SEQ ID NO: 988243 - protein, 43 aa, Homo sapiens
MHGNKQHLQKDFFLYNASKARSKTYINMREVSQRFRLPPSEYV

SEQ ID NO: 988244 - protein, 111 aa, Homo sapiens
KGPAYVSLFYKGVAEPGPVRAAVQEWPETMLLSAVRDGLRRNGPRGPELKRVVRGVDIACEGSSRPGGEFEGHCALVSVGMNARTLYFQSKRGFDLSLSKVPRLYSQHVSH

SEQ ID NO: 988245 - protein, 48 aa, Homo sapiens
VHEPKKKVDLTKYLENQAFCYDFALDETASNEVVYRISPIASTIFPSL

SEQ ID NO: 988246 - protein, 35 aa, Homo sapiens
MMIGLSSQPGIDYLCYYHMQQNILGLLTFLAQILL

SEQ ID NO: 988247 - protein, 98 aa, Homo sapiens
RSYKPDIAEVLEPRRGRDHLTSRFEIILAPMVNPCLHYQSNAYLGVVCRAFYCSYFGGLCARMTSTPKADVPRSAVIAPSVLLPVVSRMRGRSCVGRC

SEQ ID NO: 988248 - protein, 75 aa, Homo sapiens
GLTSIGARHENKQSNSRSCWYRVMTDSYRFTEYRTCEIRRCLSEDVAICCWDLNDEVATYVGIYSARFVGPGRSS

SEQ ID NO: 988249 - protein, 50 aa, Homo sapiens
LEIPLLCPAAQLLLKWFQTYKKVAMAPTTDISSVALFTSQLPCIRTRTVD

SEQ ID NO: 988250 - protein, 141 aa, Homo sapiens
SSKDPPPQLLRRHSCPAPRFSLLSRYDFTRSADACVNAVRLLSGESSVSYVLCQRPAIPVQSQYALVKGLPLVIWYSMGKPVHRSLSRFQWYGQRAYRDTHILNSNEHGCGVEGLKHHQIHLLMVDLLCQAGLSRQHEKYR

SEQ ID NO: 988251 - protein, 70 aa, Homo sapiens
WGCLFPKNNDTEIRPVINFSFYKARRVRNLLETSWKLAQVGSCGLRKDTIYRMSKCITKQQVLTEKLWRS

SEQ ID NO: 988252 - protein, 37 aa, Homo sapiens
ECWYLHPGVLARIFRKSGGLKMQPKRGWYTSIYEAKY

SEQ ID NO: 988253 - protein, 41 aa, Homo sapiens
LLPWCCLSSSVSSLRNAVWYGAVGDSAYSMGCVSMAEPAEC

SEQ ID NO: 988254 - protein, 111 aa, Homo sapiens
MEGRESIMQRFAGSVSPMNSIYFKQPVQPPGRGEGRDYLHCGLDLLQRKLRSLLAKAIQIVTDVLTPAQLIVLSTSSGCAKPGRGDDMPLEQDNYRTITGNVAKQDAAPGW

SEQ ID NO: 988255 - protein, 42 aa, Homo sapiens
LSQHHGPPIPTIKQAVAATRHGGEWPLDYLHAGSSTCWTRKL

SEQ ID NO: 988256 - protein, 71 aa, Homo sapiens
LRICRVDQAQLNIWRSARCSLCRRNLYSCMHRGGEYTSDQAPCLTIFGGQHGAHVSTELVQGGDAAIVVNT

SEQ ID NO: 988257 - protein, 85 aa, Homo sapiens
TEVYCGRSKANSFLQRGPHLLQEPQKAFVWDLFPLPYIHAGHQGLMELLENHLVRGSRLYLAHGIPGARCEAPPDYTTRPLLVAS

SEQ ID NO: 988258 - protein, 41 aa, Homo sapiens
KGVAVIDTRHNRAAIYESTACGDDSQCPWVAGIEAYQHMSR

SEQ ID NO: 988259 - protein, 47 aa, Homo sapiens
MITNARTGHGTGSPPAPLVRLDGVQSHPEVREFDDQRLANLGEQPIS

SEQ ID NO: 988260 - protein, 68 aa, Homo sapiens
TIPGGCGGPLSRWAVAGGRLPGQAGRPPQMGLHVGRPARAEGLACARLHQFATGCGQARWALWSPVVP

SEQ ID NO: 988261 - protein, 133 aa, Homo sapiens
VLHCNLCSPWALWICARANPWRQSRAPLPIGTHGCCPIRDPGVSESLLDCRAVSCNEDWETVMIHEDRSWEQPSPFSLFLDLYFGIIWPLPSNQWNGGCRDGWELAANPALQGKEAVQTDPSIEWPCYLHPYY

SEQ ID NO: 988262 - protein, 72 aa, Homo sapiens
IAGTPTDSTVGEDSQSEPRSALVLGSGAFSLVLSLLFCPAGIVAASCRVLMSLMWVNIKATGAQPPGSAQYH

SEQ ID NO: 988263 - protein, 58 aa, Homo sapiens
MSSYRLHLCSGFIKTMAHRMGTVAHTCNPSTLGGWDERVTGGQEFETSLAKMVNTFSL

SEQ ID NO: 988264 - protein, 115 aa, Homo sapiens
MPTLKSVGHQSTNWMVRLVLMVASGSIGIFGKQVNTVQQAASHVFTMARVTFHHLVGWLKASIGDLCYRKLFMVGFLSRDDRGLCGQREVAAGIGHQVGLEFCQVNIQGSIQSPG

SEQ ID NO: 988265 - protein, 36 aa, Homo sapiens
GQLRHHLGTPSPPRAGSGPGPPKPGLHLPPCTVGAQ

SEQ ID NO: 988266 - protein, 48 aa, Homo sapiens
RLCQAALDLVPAQQRRLFLGTVTSPLQGSVMDEALGALGLPVPSWACS

SEQ ID NO: 988267 - protein, 114 aa, Homo sapiens
NRGGPCICALYSHSPPSLEKTHQYYYNSTEYVHSNCGLNKMQSLFTKCSYFPKYECKHLDGREYSLNPPRFPTTFRKEYSERLCGNNKNLPLRPGTVAHTCNPSTLGGRARWIT

SEQ ID NO: 988268 - protein, 64 aa, Homo sapiens
MHEEKYCIRCTDHVVSHLESRRRCRQCRLLDRDHSTAEDLTGVSWVVNVSRGGAKYRRMSLYVS

SEQ ID NO: 988269 - protein, 43 aa, Homo sapiens
MRQTQDLCLSACAVLCLIERRRGNVGGRSPEPGHKSTTLWHLS

SEQ ID NO: 988270 - protein, 85 aa, Homo sapiens
RFPTKGDSPSMAMKHSEQPTSEILAILSELSGPGSTPAPGTRELITVRLRVLHERTGALHGLAASGYTATPSLELARLLLLHDAL

SEQ ID NO: 988271 - protein, 40 aa, Homo sapiens
KTIPFFSLVLILAIDYEGAFTEFNSQSQNPTVLGRVIVQQ

SEQ ID NO: 988272 - protein, 110 aa, Homo sapiens
AQPHVDAEAPGARCSRGRAMPSYAVTVATGCQWFAAQLTDYDLPSASVGSCGLYARITCVVQALSTTDFDAWLRWIHTDVSCGRRYLGDDPAWVRIGEAQVRGLNDDVVP

SEQ ID NO: 988273 - protein, 67 aa, Homo sapiens
TECGDALERDLWKRSPHTPCTLRLWELLRYAMRLNELGKSLGFGWETCSYQYYATGCLSAPSSLRMF

SEQ ID NO: 988274 - protein, 114 aa, Homo sapiens
SPCWESSVRYIVSQYQIIDPLIPRESDRCSIYYKGPLVEEQAVGMLIHELECVPTEACSIPRMRVQDDGGSDQNYDIVTIGAPAAHCQGFKSGGLRKKLHKFEETKKHTSSGCQ

SEQ ID NO: 988275 - protein, 31 aa, Homo sapiens
MSVRRIIPYPPSFKSSAASTIDPAMGASALS

SEQ ID NO: 988276 - protein, 102 aa, Homo sapiens
LLLLLLLDLLLLLHLSVLELLLHGTLLSLEHACCCCCHAAAAVAPPAAACCELLLLLLLLACCLLLELELRSVALPLTLQPCCEEPSPRSQEADGLRETLAV

SEQ ID NO: 988277 - protein, 69 aa, Homo sapiens
GALDGSPVGPLVDAVDSLSPRIFHERLLPLDSMSFASAHSRMIPRRIVGANKKLMSSSSCPLASIEDFF

SEQ ID NO: 988278 - protein, 33 aa, Homo sapiens
MGYELHVHVSPLSGCVIEGSTLDIYLYMVGFLR

SEQ ID NO: 988279 - protein, 69 aa, Homo sapiens
LCAAGHSMYDWPALEKRVVYAVLSVVAHKNDALSPYFSEGGPDLHHSELSVYVNTEKGFSTLALLTFGA

SEQ ID NO: 988280 - protein, 37 aa, Homo sapiens
AVTLEDSRQGPACCERTDRTIAQGSCRLLPSPHAGPV

SEQ ID NO: 988281 - protein, 68 aa, Homo sapiens
LEALLGDDAIHVRVRSHTSLRNSILHGIPWQLYNYVATMPDNSISAYGMQGKIRLQRSMDQNAGKALS

SEQ ID NO: 988282 - protein, 68 aa, Homo sapiens
KLEDPRTSFFDSKGIGTRNTFSIYSEGGLLPTVNAWVINAKAAMLHVGNRVKKNWNNWNFNYTLKKET

SEQ ID NO: 988283 - protein, 41 aa, Homo sapiens
SSGPPRGRAHAVIIQGENSSSRKPKSCNSEHLALGCHLGGV

SEQ ID NO: 988284 - protein, 30 aa, Homo sapiens
FRDPHLEVEGEGSLQPGNSTSRGNIIETPP

SEQ ID NO: 988285 - protein, 34 aa, Homo sapiens
PRVLLVPVSIGILPVPSLVAPPTHLPECLGCLAL

SEQ ID NO: 988286 - protein, 70 aa, Homo sapiens
YGRRPGEDVLSFPTTKTYFPHFDLSTVCQGYGPEEGGDALTNAVGQVYDMPKALSDLSDLHAHKVTGGTG

SEQ ID NO: 988287 - protein, 76 aa, Homo sapiens
KISLIRGSLDQDRRLLVDGQEIAVSLLPGMATCLDQYSLQNLGSTSTSWRGHIAANVPMTFATRAGMRHKKGASRS

SEQ ID NO: 988288 - protein, 82 aa, Homo sapiens
GSVEDARSYKYGDMLQRSEKEIMTTIPSTIASRTIKYLELTKDVRDLYNKNYKDIAERKEIKENINGNTSHVHGLEDLILLY

SEQ ID NO: 988289 - protein, 41 aa, Homo sapiens
MVMRLSSAFVVLSWLSQNSNEDVSPCATNTIMTAPCKAYSG

SEQ ID NO: 988290 - protein, 36 aa, Homo sapiens
QHLSRMHGSKHAKCSSMHALILHGACKSNLHAAAHS

SEQ ID NO: 988291 - protein, 105 aa, Homo sapiens
CQDRINKGIIDGPGMVGSSRVYSPVMLCARPDHVCGTHDGQELEISAVPTGESPSVLQIRINYSGLAVGVCTPMLLGRLSQEICLEVWEMDTCREAKISSIAVQA

SEQ ID NO: 988292 - protein, 63 aa, Homo sapiens
RSMVMSGMENVLKSYNYTCNCDVGYYAAQLSARDSVGAFARPHQLVYHRTVHHYFAETFSLQT

SEQ ID NO: 988293 - protein, 103 aa, Homo sapiens
QTMVMQWPWRMCRNSYNYTCNCDVGYYGPQCQFVTSAVTPLEAPELGTTGLYSLIWETSAFRLTAAAFRLPLQGTNLTLRIERNHHVDHFGNLVTLQEPILSS

SEQ ID NO: 988294 - protein, 137 aa, Homo sapiens
MYENIISNYTCTVMWGTMGPVSVRWFTCEPLVGPSTWATTGLYSLFGKLQLQPHSVPSTSTEGTNLTGIEETTCAPSGNWSSPEPTCQVIQCEPLSAPDSGIMNCSHPLASFRFTSACTFICSEGTEFIGKKKTICE

SEQ ID NO: 988295 - protein, 75 aa, Homo sapiens
TRCMMMPIVGNIVLADSRLLQLGGYGIIRLTLILKPPDKTHISLTPIPCTYTLMTAIHYTQRFHTALPITQHPKN

SEQ ID NO: 988296 - protein, 42 aa, Homo sapiens
LVIAHSLGIIYRDLTAENITTWIEEGHIKITDIRPRVSAGHM

SEQ ID NO: 988297 - protein, 38 aa, Homo sapiens
MACYISHAGSTGLKFYFDHPSGSECVINIPNVVARVGG

SEQ ID NO: 988298 - protein, 83 aa, Homo sapiens
SPATASRISAHVLHPVWVEVLGRVTDVSMKGLKADVLLLFAQHVNGILARLLWTVAHITGAVALVVTFDLSLRWAFQREAVAG

SEQ ID NO: 988299 - protein, 75 aa, Homo sapiens
SVGVCIQIRPFDRQNRLFDKSTCWHPVVLSDILGDVMFTGDMHIAGVVQLRKWSKPVSPLFPGQTRSYVSPCIES

SEQ ID NO: 988300 - protein, 62 aa, Homo sapiens
SYLFSSLSGVDLPFTPRPSLLTSRYQVPAFSLVLEQVRFLEDEIHEFGSNQESSLSIYSDCY

SEQ ID NO: 988301 - protein, 41 aa, Homo sapiens
PKQALNQPAGGLKQLKSLSSGISCFSSLHSVSSFRYTCILK

SEQ ID NO: 988302 - protein, 109 aa, Homo sapiens
RIALTCTRLPGSQVRFWGPLARDTLVWDTPYHTVWYCDFRTGKIGWFLGGQFSVSVNCLDQHVRKSSDERCFDEYSIPGWVQWLKPVIPSLREAETGGLPEVQELETSL

SEQ ID NO: 988303 - protein, 35 aa, Homo sapiens
ISWRLSSCSYFVAWIPNNVKTVCDIPPRGLKMAVT

SEQ ID NO: 988304 - protein, 79 aa, Homo sapiens
RPECLIAEAVERVAGIPEEQLAILSLLKAAVWNRIIEPVAAMRFFVAMLRLFPEYLKGEELFGLTEHAVLRIAESLPGV

SEQ ID NO: 988305 - protein, 34 aa, Homo sapiens
MSPGECGGCSSLAGNAAGVAGRFLCLQVRGKRLD

SEQ ID NO: 988306 - protein, 48 aa, Homo sapiens
PGVNLSSQELFRLVLKGASRLGFLCKHLVPLVGRGSQQDSSVARSGKK

SEQ ID NO: 988307 - protein, 67 aa, Homo sapiens
DLLVGTGRVWRCMADQKSSEKSTGKLRHAGKPRLTKYYSLIGPGITCEHTGSTSKQHEHHNEITLRS

SEQ ID NO: 988308 - protein, 71 aa, Homo sapiens
CIPPGVCCADRAMLSAGFRCAAGYQVFAQDGRAGRPFEGPMLETAAVRDRPDDSAALREPTRRVPSAQPGT

SEQ ID NO: 988309 - protein, 120 aa, Homo sapiens
IVTNWDLTCEKIWHHTFYKRRCVVAPAGAPIAAVPEAPLHPQGPNTDKMTQIMSDTFNTPRVMYVAILAPLLLPLRLWALQLALFLSSVDGVSHTVPLYQGYALPHALLRLDLAGRYLTD

SEQ ID NO: 988310 - protein, 110 aa, Homo sapiens
MTHVELLLATTNDMACHIVEALHPLAAFIALATHVNTCGKLTLSTWQLGLKDSRIHGHGSESGPDRLGTESACLITSILSRTYCALSISWYSFERSYHARTPSSSHIALA

SEQ ID NO: 988311 - protein, 49 aa, Homo sapiens
MVMSQLRAKTMVPTLSILHEVMELCAFTCVIDFALRIVLIYVLRVVVHL

SEQ ID NO: 988312 - protein, 66 aa, Homo sapiens
MRYEHFRYMLSVRAVDCGVILILVPRPDRGRISSVGAIKAICFKGFTRDYAQSLMYAERMYYDLLT

SEQ ID NO: 988313 - protein, 40 aa, Homo sapiens
EIPYQAVLSCIASCRTTGIVMDSGNGVTHIVPIYEGYSPP

SEQ ID NO: 988314 - protein, 45 aa, Homo sapiens
SAVMSILKRCPTSLVIREIQIKTTDESQVVVAHACYSRYFGRSRP

SEQ ID NO: 988315 - protein, 72 aa, Homo sapiens
EARLKPHGYQLIQLWNLHIAGQRGLTVEEPEGHRDGTQGLEKAATQSLLLNILLVSGNSEAACLDKFNLNGH

SEQ ID NO: 988316 - protein, 86 aa, Homo sapiens
HEYRLPREPGQPCAECCEEIHSALGAAGLRAIPSMYTLPSHGEPHTMPTTVPSAACTQTVRRLTGSPNRDRKLQDSRCALIVGDPR

SEQ ID NO: 988317 - protein, 49 aa, Homo sapiens
MPSRAILRRFNVLQLSYYFFDATVDVILLLSIPLIFFMLHHCRSEGSLR

SEQ ID NO: 988318 - protein, 34 aa, Homo sapiens
EDIMEVLQTTKLELPYDPAIPLLGIFSKEIKSRG

SEQ ID NO: 988319 - protein, 66 aa, Homo sapiens
WIREQTTVDHFWGESLRDTDCPAYSWGVSQIMLGRGEAVARLSVCMDYAREREAVATLWVCCVTGW

SEQ ID NO: 988320 - protein, 39 aa, Homo sapiens
QQQQQQQQHSLLSAPGPAQAVSFSGGLPSREPTAGIILF

SEQ ID NO: 988321 - protein, 36 aa, Homo sapiens
PAEAKTGGSLERKRPRPQRALIVPLDSSLRNKARSY

SEQ ID NO: 988322 - protein, 122 aa, Homo sapiens
RLRWSWNTPGAWKSFSSASPAEEAAGRAAGSTKASGRSRHLLSPLHCWAVLLQHTRQQSRESAALSEVLAEPLAQRLSHIAEDVGRHGKKSRDLQQQLQYELLQVVSELQTAKKTYQAYHME

SEQ ID NO: 988323 - protein, 69 aa, Homo sapiens
ILGRMASFLSRIVMMPQPARSVSYRNSPRRMRSASSVFSSSRTRTCDLHLLLLQHDEGQAVEIHGVSVL

SEQ ID NO: 988324 - protein, 67 aa, Homo sapiens
TTNLQDGEGLHGNGDPGSPRPLAATCRWRSQWSRASMTLSRSCVLLQVVGHLVLEALPLFLQPRHRL

SEQ ID NO: 988325 - protein, 76 aa, Homo sapiens
NRVQEDPQSEQAQSKRYSAVSTAAHVSTELVQGRHAPQWVNRRLTRLQLTDIRRSRTVLMCRRNYYREACTRSGEH

SEQ ID NO: 988326 - protein, 66 aa, Homo sapiens
GRRGSLGIRAIPRTRCNTGSRITAYLLYRATPIPRASENPCAESPHLNVLFYPRAIIARVHTSMNA

SEQ ID NO: 988327 - protein, 61 aa, Homo sapiens
MISKVGKHIDVLTGKVGGPVTAGIGAGVDSNFEYLVKWSHPCFMDKEAQWHMFLRCITQAI

SEQ ID NO: 988328 - protein, 68 aa, Homo sapiens
MIKLTRSCPCGACRGWVLSSEQRPRLGTDVRIVNRRHLNGKVAAITQGHTKHKGTRDDSNSPGGPGTE

SEQ ID NO: 988329 - protein, 53 aa, Homo sapiens
FEFVCSWAYWRGLCEDISRRWTSRRPMTESLQKKSTLAKILIPILSHSSHCSY

SEQ ID NO: 988330 - protein, 107 aa, Homo sapiens
ALSTLDAHGPQRLVSCCTVPARRRSTVLSFQHWRRMQRTIEGLRLPQCLQELVKGCLGTGSLMLGGFCGLCRCSKDLVVRSCRVMLMMSFRDLESSRFAGMIWLSLI

SEQ ID NO: 988331 - protein, 32 aa, Homo sapiens
MERMRELRRPVDPLTNDKARVDVERENHGRRT

SEQ ID NO: 988332 - protein, 35 aa, Homo sapiens
MRSLPRLVTVAVCSSRMCTSACLRLFPLLQLALDD

SEQ ID NO: 988333 - protein, 51 aa, Homo sapiens
EHLWAPTFNVTVTKTDKTLVHADRHTKVSKDDMIQQRNVLQMASQPSDVRR

SEQ ID NO: 988334 - protein, 63 aa, Homo sapiens
NRGDVSSGSHPIYTYSSAALLRAITARISTPYLPTRRGIQNYHDSLFYYLLYTHSSLPILPTD

SEQ ID NO: 988335 - protein, 31 aa, Homo sapiens
MFNKWQRRSGSMTLQDCLGPSSPDFSKLSEG

SEQ ID NO: 988336 - protein, 66 aa, Homo sapiens
YKRTPAGRFVGRQVKGWNTPVTHCRLLNSGAKASRIEGVNRGLLEEVVYVDDISWVDRGVSKITED

SEQ ID NO: 988337 - protein, 82 aa, Homo sapiens
TLEDPRQAGSSCCPGWSAVAIHRRDPLLISTGVFDPCSVSELGAGSPLLKATLVGPPPGGVHPYFDANLSCGTPRNSGIKRN

SEQ ID NO: 988338 - protein, 45 aa, Homo sapiens
RSPAVSSEAAVSADACKSPPQAWRGTGLFLQTLSYDSSRSQVNSW

SEQ ID NO: 988339 - protein, 35 aa, Homo sapiens
MAEVSKDPRQAVKGPLSGDMLKGKTSQASVWSGPA

SEQ ID NO: 988340 - protein, 60 aa, Homo sapiens
RAVSFSGVSARAEFRRSVAVALFGSHCVDCQGVILVGCLVLLGSPLVIHCSSNPSASSRS

SEQ ID NO: 988341 - protein, 35 aa, Homo sapiens
MVLSSGAALAAGVVWVLAVVRVQVVCRQIRSVMVP

SEQ ID NO: 988342 - protein, 69 aa, Homo sapiens
AEEQGLEPGKVGQAETCRYGCNVYEVMPSARRNERERNSQELALREQRWRALLEASLHPGSVTMACPAS

SEQ ID NO: 988343 - protein, 65 aa, Homo sapiens
QPVAAHAGPQHELRVQLAGFFSWLGILQRTQKGYVYLSYAFSLCQLLLVNADTTVRNMPFRVLKA

SEQ ID NO: 988344 - protein, 89 aa, Homo sapiens
MTKIDNTLKIMEARYVTMSEKTDAGLFEEQLPASSPKTPRRVFTVLMILQQTGPSGDMRKPVSAHANCYMLPFQGEIFLQKWVLELTNL

SEQ ID NO: 988345 - protein, 58 aa, Homo sapiens
GAFRSDSVTLRGTPVCATLGKLSFPFACARSRTSGRIARFEADAFLDRAFSADVDSVE

SEQ ID NO: 988346 - protein, 101 aa, Homo sapiens
MNGWETPWLVHMAKKEGQPPLLNAPEGIRRPYSPEHLVLQVSVTPSRYLSVGFFPKEASIIMQIFLADETISVLTNHVEGLFELQRRSHGTQTKTSVLKGK

SEQ ID NO: 988347 - protein, 35 aa, Homo sapiens
GVASSSQDRDWLRPLATRKQECSADTDRSAHGSCA

SEQ ID NO: 988348 - protein, 32 aa, Homo sapiens
MSAVENIRPNCAVSVAEAFLDRAFAADVDAVE

SEQ ID NO: 988349 - protein, 102 aa, Homo sapiens
TLTLNISLMNRPAPEEIFYENMRLDDTDNFTNATLNTFTEELKKYGVTTLDQFCEATWEEAPLEKEGIHVLDRPLDDGAPPNNQILHDWLNLLKPNFLREGR

SEQ ID NO: 988350 - protein, 63 aa, Homo sapiens
MAREKRRPSPVPSERRSTISQDRMTHVQLLFTWNPSPLRTSKFSFEYYATTTKIEKLWRTETL

SEQ ID NO: 988351 - protein, 86 aa, Homo sapiens
DRTLELLHKSLGETVVCTREAGWHVSSSLDTTIAIYPIILPSESTNFPAVYGDKTVGGRPSVITGNGIGYMKQGAPRSWQSSRDSG

SEQ ID NO: 988352 - protein, 55 aa, Homo sapiens
PHSCQDAQLLGASVLKKAGIAGTCHHARVGFCIYRYQTGAFAVAWPALCSRNIRE

SEQ ID NO: 988353 - protein, 31 aa, Homo sapiens
MHFGAITCSHEYSLPVLTGPTLFGLLMVDPS

SEQ ID NO: 988354 - protein, 46 aa, Homo sapiens
STTCDKVKQIAKQTVKHHTSCLITRSCPTGNVGSESGTRMWGTHCL

SEQ ID NO: 988355 - protein, 44 aa, Homo sapiens
CEHVGLDYRRTAHFSGISPVSTFSTVVQACIQMSQGTGSIVLHH

SEQ ID NO: 988356 - protein, 38 aa, Homo sapiens
QLMLWVMLEDPGVILAVTSDVAATNICTDTFLTLKPTL

SEQ ID NO: 988357 - protein, 141 aa, Homo sapiens
RITSDSPPSLYVSERNELLIQFYQTLSLTADRFIGHYIFRPKKLTTTEQPVIITFPVTTRLKTTVGSCHHTVKTDGDSWRANIVQSDFVLAGTVITNITRDGSLHATISIIKIYEGNLAIQQAGKNISALTVVCEQCPLLR

SEQ ID NO: 988358 - protein, 36 aa, Homo sapiens
MIQPSIRIFTLLIEPHLNPRSICKYLKMRLMGCTIT

SEQ ID NO: 988359 - protein, 76 aa, Homo sapiens
RPASGVSRRSRGIVKECCFRSCDLDPHGDVLCYPRQVREGRVRTLLNVLPDNFPRYPVSQFFQYDTWKQSNQRLQQ

SEQ ID NO: 988360 - protein, 92 aa, Homo sapiens
MSRAASLISALESQSDSDGKTRALVLVPHTLVTQGCPTQLQGALFFSTAHEAGFCPPLAPCVALRGLGPSEKRFTIRSSWGKGGGSARDKGK

SEQ ID NO: 988361 - protein, 45 aa, Homo sapiens
MDSRYPPITSTGNNSLWPVAPPIISATTPTGSSSEIYHHHIESST

SEQ ID NO: 988362 - protein, 181 aa, Homo sapiens
MPLCCPALMPLEQRGRKDVYVYRIRQLKIPVSSTTKASSEGDSITDAFMCLQFMDSFISVQSTGTSLALKTPGRQGCSEKARSEREPRSISSKLLTGGPLDVSSGVTWDRLQATQPGSARGDHPSGLAHSEVEQVGEELELGTQPCPWVGRAWWAQGPHRLLNDPQHRPLDVGDGFSVHGR

SEQ ID NO: 988363 - protein, 53 aa, Homo sapiens
ISIPDVERNMLYISVNKVHLYQDHNTYNEIPSHTSLDMVDRLKRSVKEQSAWT

SEQ ID NO: 988364 - protein, 116 aa, Homo sapiens
EELKICIKETPWTQNLSPLIPLTPLILKHPSDPMGTFTPCSRNPKHHPWGVPPTSHLGPPWWHSVFQLCPQVPSSDSEGLTYLELQAVTASTQPPSPPAAPQPSVIYTEVAVRGRH

SEQ ID NO: 988365 - protein, 143 aa, Homo sapiens
VRGRVLVVTIINLFIYFFESRSHPRLECNGAISAHCNFRLPGSSNSPASASQVTGITGACHHTQLIILYFSRDGFHCVTKAGLQLLNSGNPPASASQSAGITGERHRAWPVFLFRDYYGCLGFLAFPYEYVISFPYLKKDKGK

SEQ ID NO: 988366 - protein, 75 aa, Homo sapiens
PEKGFRAQLAAYGEKTTLLVDTYDIDNAVRTAIRLTEGASVRVRIDSGDLSIVARQVRDLLDDLGAPNTRVIVTS

SEQ ID NO: 988367 - protein, 70 aa, Homo sapiens
PGDDSVAEAHKCIESEELSPHRAQQQPHQGLHVISKPHIHSVARRGLDELQVPAEISQSQVYGGILLDVD

SEQ ID NO: 988368 - protein, 49 aa, Homo sapiens
LSCNIDRWEGHGLTAAISLTESWATVSYVAASTDIEDSHHEAMSRVGAT

SEQ ID NO: 988369 - protein, 105 aa, Homo sapiens
MTAGHVQCPGTRHIHHRHLALGILHDLPRVHLRDVIAVRTLTLLLLLHGQGGRLCCLRLLFLLLLFLFFWATFFTIRPRSYFIPRVHLEPGLQLPGFGGICACED

SEQ ID NO: 988370 - protein, 99 aa, Homo sapiens
QQLFNPFVLLRILLLRCGPCRGATRTVVIDSPLSKNPCDFPDHVSVVAMMGDGTSQQRQHASFHQVLQILYMLQASVTHTADPRAGQVSLISILGQRGH

SEQ ID NO: 988371 - protein, 39 aa, Homo sapiens
FAPSRCPPPLLRGSLPLVFRRAGPRPPFGGSDVSTLRTS

SEQ ID NO: 988372 - protein, 70 aa, Homo sapiens
RAPYRYRCAEGNPECPAVWNEVTEVENSMTLTGGHLSLRREWEGFYSREFVVSDTRRFSVLVYVNCPTDT

SEQ ID NO: 988373 - protein, 42 aa, Homo sapiens
STATEKGSIDSASSILVWIDEVEWCRSGYADQDQLVHLFSKY

SEQ ID NO: 988374 - protein, 134 aa, Homo sapiens
MACVSERVPVTIVDGHTSLPSCLGAHTGEQYKLTLINECESRESDTRAVLVLNVFILFSPQLSLITEYRLLLWAQLCPPHIDLGHPKPLGTVRKHISVSKPPSLWYFVMAAGADQDNYVAGTIYRMALKCFNFT

SEQ ID NO: 988375 - protein, 47 aa, Homo sapiens
RVISKLLIYKQSSQFGLQSAGITGMSHHPSLGHDIFERTICAKTKGN

SEQ ID NO: 988376 - protein, 41 aa, Homo sapiens
GILLLSSASSATVLVYNSHNSAALGLVEIVFEEAVIIFIGV

SEQ ID NO: 988377 - protein, 62 aa, Homo sapiens
VYEKSSGGKGGSYSQAASSDSAQDSRCVSHSLNKAWRQVLVSGLEHAVISFTASHFVYFNEP

SEQ ID NO: 988378 - protein, 31 aa, Homo sapiens
MTTEVRTYYVTQSLDNYYHWGTALTRYTRGT

SEQ ID NO: 988379 - protein, 73 aa, Homo sapiens
TDLEDPGMLAENGTTNYFNFIWNQKRAHIAKTILSKKHKGRGIMLPDFKLYYKATVTKTAWYWYQNRYIDKGK

SEQ ID NO: 988380 - protein, 104 aa, Homo sapiens
DGLENKIRSTLNEIYFGKTKDIVNGLRSVQTFADKSKQWSSEAMTVVCALNEKAASAKPSVSLLTMTLPWTPLDSVSLENCFLAPIPFVPFLSPDEVTLTCCIN

SEQ ID NO: 988381 - protein, 35 aa, Homo sapiens
MMCSMHSTHVAGGWGITPHSYVHALPDKCALVMRM

SEQ ID NO: 988382 - protein, 73 aa, Homo sapiens
MGARCRRSLQCLMGDGLLKAATILITDSGRRLQIGGEVSRCGVECYLDNPIGNRDEACNLAIAINDQFQRWAS

SEQ ID NO: 988383 - protein, 34 aa, Homo sapiens
PASEVIRNHGYFYIIDWSNQEVTLEGGSDGYGRG

SEQ ID NO: 988384 - protein, 60 aa, Homo sapiens
MGLGHRLQAWWKRPGQCSRDVVICPDASLKMQKKEGPYAVVASTMEVIWGAQNLSRVWLL

SEQ ID NO: 988385 - protein, 42 aa, Homo sapiens
VLGESRELRHAHSEAKSSQAIEESFKLNTHYLKNPKHMTELT

SEQ ID NO: 988386 - protein, 64 aa, Homo sapiens
QVWCIIEQCEDEPEMKQCDCLTVSPGARGWNNPDISTGSSPSFSHAMAGTSLPRSSLGPVFGSG

SEQ ID NO: 988387 - protein, 84 aa, Homo sapiens
YLGLARIARQHDGPTRDDTEKRRECEIDRAVASEYKSPRQQFHMRRRRKLEKLHALRANKSLKNEDEDQAGYDQTDTNMALYLM

SEQ ID NO: 988388 - protein, 40 aa, Homo sapiens
VEALRSGAQERFVQALMPLRHLLFQAHQLFNLHQEPAVDV

SEQ ID NO: 988389 - protein, 46 aa, Homo sapiens
MALVHTVLYPHISSIKAAPKCISERTSYLRSSIGFCTPKTYLISPT

SEQ ID NO: 988390 - protein, 53 aa, Homo sapiens
RATLEDPYEALGEIDKFLERKKLPTPTREEIENLTRPKERISNQKPFRKEKPS

SEQ ID NO: 988391 - protein, 70 aa, Homo sapiens
SVRYEGLGLRLGLTLTDPQEKQLVLASLYEKSRTLSPDTLIARAQIRGCGHTYHQATDVFHKHVLTLATK

SEQ ID NO: 988392 - protein, 106 aa, Homo sapiens
SRSSATPQTGCSAGHTKYPFHSIPFHSTPFHSTPLHSIPFHSTPLHYTTLHSTPCVSIALHSIPLLSSKLHSTPFHSISLHSIPFHSTALHFTTLHSIPPHSTGYT

SEQ ID NO: 988393 - protein, 102 aa, Homo sapiens
IELGTSATPQTAHIIATYRSHHTYSPLTNAIAYLQTGNTNSQQYTPDIHGRHNTHVLHEHTTYSTMYATDTPPDTHIHTRYTPHTHTYTHIHTHHTHSTGYT

SEQ ID NO: 988394 - protein, 115 aa, Homo sapiens
ELGPVYSTNRTHKQDTHICNRQAVLSTAHTTNIRTTHNRPHISVHPHNTYNAHNRPRTTDDTPSSHDRHTAGQHIQPITQHTQHTTNTYHIPHTNTYHTNHTPHSTGYTLFVEVA

SEQ ID NO: 988395 - protein, 155 aa, Homo sapiens
MTLKNLVDAKPVGSAWAGNECTATNPALCTFEEQARQTVYGTCCSLHLAQQSFVINRIDSSLNETCMLEGSLYAYIIPNDSYLCFIRFVREHLYQVRYPLARADRQRLEKLRPVLQKHAREQGMDWLNLAALAFKESALDPGARSSGGPTVCGGS

SEQ ID NO: 988396 - protein, 52 aa, Homo sapiens
AAHSVCAWRRVACVGSLRSLPSVFRVPSRVGCASLVLAWSVGCWWWRCRTQL

SEQ ID NO: 988397 - protein, 92 aa, Homo sapiens
PDKPCLSYQYLIDEMSTGVGQCRYRPHRLEKHTLCGIWPKPWSDTGPGRIVSVYGPTESTTFATYYPLCELRDEEYLPSPSASRSRTPIRNL

SEQ ID NO: 988398 - protein, 200 aa, Homo sapiens
GREGAKPCPGPKHYRLNTCSYSQVLWGLAGPAKTKPLAPQEHYPNLARRNNNKLNIIICVPKRKGMFPRKNKIEGPFSIIKGRASLAGVFSFPSHLWGAVQSKSTPCSSSYGLAWPDRLKVPSLGLGKPELGAEWCQMLEICLREGVAPGVHSGEEHSCGRTKEGKGPLLLVVNLRADRKLSTGLVTEDPGHPMWQVQGS

SEQ ID NO: 988399 - protein, 67 aa, Homo sapiens
VVWLCWVMMMELTVEVVVTVVVLVMMMMEMTVVEVVVVVKVVVLVMVMIVKAVGVGVAVRVVVSAIF

SEQ ID NO: 988400 - protein, 78 aa, Homo sapiens
LYRTRTSSSTGISIIIITNTTTFTTSSTVISIIITSTTTTTLTNTTTTTTCYFSYFYRDGVLPCSTYWSQTPALKRSA

SEQ ID NO: 988401 - protein, 33 aa, Homo sapiens
VYEKARDDRYYPTTTVIIIITIIIIIFIFITFI

SEQ ID NO: 988402 - protein, 54 aa, Homo sapiens
MVHPYFALYSFEISVQCQVKKLCLNACWASSHVISILCMDGMTLNLDSPLLATE

SEQ ID NO: 988403 - protein, 40 aa, Homo sapiens
FVPVYRGVFKALPFAKRLSEWLMNHTHEAWVTNNKGWMNL

SEQ ID NO: 988404 - protein, 62 aa, Homo sapiens
RPYLGNKKERKKLLQPPYRSAVTTLISQQPSTQGKTLYQQRDYNWLKAQMIVAFFSNKEGKL

SEQ ID NO: 988405 - protein, 37 aa, Homo sapiens
DAQWKTCKCRYAFEILISFPLDRCPIVELLFTHIFVQ

SEQ ID NO: 988406 - protein, 41 aa, Homo sapiens
KLSSSSSVISLANSKILRVLASRPFALHDSNVLVCTDVGRE

SEQ ID NO: 988407 - protein, 58 aa, Homo sapiens
THRASTQQTNPNRLYVFLMYKLGEKVSKHHKEQKSYRGSISIHGTGASQIEYQKPELK

SEQ ID NO: 988408 - protein, 48 aa, Homo sapiens
LRPAEWNYWYNIDERDHYGLRYGEKTILGSMSKCGPGTLEIPRDPFRG

SEQ ID NO: 988409 - protein, 44 aa, Homo sapiens
HRGSPSYSINIKPENFSVNCSLPNENQTNIPFNELNKSHAHTDA

SEQ ID NO: 988410 - protein, 34 aa, Homo sapiens
FIEDPDILRERGKLSVGDWLNALQSEAIDLLKRI

SEQ ID NO: 988411 - protein, 33 aa, Homo sapiens
HWQTKACVWAQDPTQCLQHLSEKVADTHQEFSA

SEQ ID NO: 988412 - protein, 79 aa, Homo sapiens
SRGSGLPTGMYAMKHVIIPRIEGTLANIITELDEREREESIGKEHTREEKDSKEKNLRRTGSKGEQLGEVREPGGPVVK

SEQ ID NO: 988413 - protein, 40 aa, Homo sapiens
APADLEDPVSFCQAYPGSSAGLSQSVDADIEDELGDSALS

SEQ ID NO: 988414 - protein, 54 aa, Homo sapiens
SCLEDPVCRDSSSGMSLGWLSSVGGGSPPSSTPPPPPPAGRAISTKVRLLSSRV

SEQ ID NO: 988415 - protein, 40 aa, Homo sapiens
MEQSIKMESYYERGNHVNLKHLSTRETHESKNDTQMYADE

SEQ ID NO: 988416 - protein, 86 aa, Homo sapiens
MTGAHHHAGLVRVFTVETEFGYVGQSGLELLTSGDRQTLTSRGAGIPGVSHGTGPNIWYNPSLGFGNSNNVNVTQFGYGPKYLGAY

SEQ ID NO: 988417 - protein, 49 aa, Homo sapiens
VDLLSLTTRSRGRIIVDADALGWLAATLRFPDFKEEQGEGDGDDGGENL

SEQ ID NO: 988418 - protein, 51 aa, Homo sapiens
KFLVDNHISLHGPSGSLTSELKGSSGLGLPKCGDYGSEPPHRALNYFYSGK

SEQ ID NO: 988419 - protein, 46 aa, Homo sapiens
VCRDKGGYCNLQRCYDLVIILVKFDSGKNHQWMLHPVVWDSMIMQA

SEQ ID NO: 988420 - protein, 44 aa, Homo sapiens
SKQGYVLISCGSSLLLHAYFHTVTSFKLLITSSPLTRKFHAVRL

SEQ ID NO: 988421 - protein, 44 aa, Homo sapiens
MQGMRYILGFITERSVPSLRKRAPAWNLIIHSWRYAVHSLQVNG

SEQ ID NO: 988422 - protein, 98 aa, Homo sapiens
QLAFEAARARDHASADDVLFIAEDQFCHTGHSMGPGTMATFGDEQMDLSPTRSQELKLDRETKHISCHSTQCMGLMRKGFDKERQPFIQQIFEGGCTW

SEQ ID NO: 988423 - protein, 36 aa, Homo sapiens
PRFPVPIAPAIRRSKGRVSVPLWPFTLSGQLPIIAL

SEQ ID NO: 988424 - protein, 92 aa, Homo sapiens
MSEPRSRYRNDALMRFMTETKPTVELLPVKGEVRPKELQPRHSIGADSVPANTENEVEPEMPALHDDRGPTTQPGSGMTDITTEEMAEVNMY

SEQ ID NO: 988425 - protein, 73 aa, Homo sapiens
DLETVSSSHTDYYYFQDSPELGLVNAGEEPAVGIGKGLAVRRLLCLLIEPQQGADNCDVTNDTRLIIRKAFVY

SEQ ID NO: 988426 - protein, 55 aa, Homo sapiens
MGALLNRSRLKSVLDHPLPNKAKTHLSLPKSRRRHTIDYESGLMLLNHTVSKDPE

SEQ ID NO: 988427 - protein, 124 aa, Homo sapiens
FGVFAGFPPLIRGLSGTHGYARHAPWHEAGYEDNLGHQAVSCHLRYHCTVLMGTARALPFPTRTATHAHGKGMEQRQSVNSALCQHPPSHSNWGQSPHHAAKWMTCPAHIATRGAITWQTASYP

SEQ ID NO: 988428 - protein, 51 aa, Homo sapiens
RRSSHMASLLWFPAGDVAVEEPPAHSIRCLVVERADHEYSLEFSVAGQHWD

SEQ ID NO: 988429 - protein, 40 aa, Homo sapiens
MAMCLIEEYATERYKVLFVVRKMELVIIMPHTDEYKEVLK

SEQ ID NO: 988430 - protein, 59 aa, Homo sapiens
MSICQNIFGPCFITRRSVDIYVVCLEAASISHSTTEDLKRRYDLSDSDSNLSGEDQSAW

SEQ ID NO: 988431 - protein, 54 aa, Homo sapiens
SSFLQMRRRALCWCCNEHRGFLHLSSSGMPPAGIIEPCRSYWGEVYKVKVVSAV

SEQ ID NO: 988432 - protein, 57 aa, Homo sapiens
MACSEDKRAVKTPPYCFVNCAKRTLSSSTQAMFEIVSLYEGIEFYTSITRARFEELN

SEQ ID NO: 988433 - protein, 66 aa, Homo sapiens
MGHSLFYLRHQLSKALSHDEARGMEDHPARTLYPEVQVMPVRHTPSAPQFLIYKTMAIPVPLACSA

SEQ ID NO: 988434 - protein, 94 aa, Homo sapiens
MAARPDFHPDKIVRVIHYPHWVGFSVADFDCFSATFNVVPPFFVVSFILSYQWEFVPRRKRPHRWGRFRLSIAVFPCSRFVFNFFAHRSNCWFR

SEQ ID NO: 988435 - protein, 59 aa, Homo sapiens
NTQRLLEDPRVYEIAVKYQHSVSGHYLNGRRCPFQICPFDRRAEAWNRFKARKSSAHSL

SEQ ID NO: 988436 - protein, 68 aa, Homo sapiens
MAILSSDAVHGLRAAELCLGCLHPGAHLSARVGLPSKPLLYLEQQGARGRIAMPPYFNESGFPLSKDW

SEQ ID NO: 988437 - protein, 47 aa, Homo sapiens
GYGMYTVSNGRRDTIDSIDGCLFQRCSLPLHEGSTASTPALLTLRST

SEQ ID NO: 988438 - protein, 61 aa, Homo sapiens
VITGLSSGSDSCARGVSALYMQLQQCHITPRESSDSSHTSLHLGLTAKDAGTPDINPHPTD

SEQ ID NO: 988439 - protein, 68 aa, Homo sapiens
SAEVEDDIYVLSLIHGHAAQTSEDLTSATNIVKWITKQQKCQRGFSSTQDTVVALLLCPNNGAGNIYQ

SEQ ID NO: 988440 - protein, 125 aa, Homo sapiens
RSTLQIPIPLVIQTACRVRRIYQWTIYAHIHKLVTVVTMNKCTMLLSCCTIMFPILDVWHLPWFTWAEYQAAVDGARKANSTRTWKEVCFACVDRTEFRLAQMCGLHIVVHADQLEELINYYQPV

SEQ ID NO: 988441 - protein, 75 aa, Homo sapiens
QDPRFPLLIRHTFRLGNLLKERFNWTHSSTLLRDVSQSVRHGQDGASHILRSIVAVQGSSGQVTLYFYNHHDSLQ

SEQ ID NO: 988442 - protein, 73 aa, Homo sapiens
GGTPTKRDKQQARSNAAQNAQPSHTPTGNSEEKPRAKNDKGNEAKQTPGAGKNEPATAAHEPKEQKPARRGGE

SEQ ID NO: 988443 - protein, 58 aa, Homo sapiens
FGVFAVVYGMDVPTQADGQDHPQELDDGHTHAHAEDDAHVLLQPRMHLVHAALLVHRP

SEQ ID NO: 988444 - protein, 68 aa, Homo sapiens
MMYWRYAVSESSVEYQPFNAEIVICGFEATDTVLGVQYDWDGRFRTIKEEYKGSLMLDGNHPYSAMAS

SEQ ID NO: 988445 - protein, 55 aa, Homo sapiens
LKKKRRVESLEDYGIPLSQINISSKVKGKVRKTYLIEIITERRERHPSRRKLKLY

SEQ ID NO: 988446 - protein, 70 aa, Homo sapiens
FGVFALYREARICRLLKTSKHGRLHDSISEEGFHYLALDLVTGGELVEDIAAREYYSEADTSHCIHQILE

SEQ ID NO: 988447 - protein, 73 aa, Homo sapiens
FGALALIKGVIFWQPLSCAITAPSVAVPECIRLGVQSLNMLPNQDTGSSSVSALGHRLAVDMQATWVEDSYNE

SEQ ID NO: 988448 - protein, 47 aa, Homo sapiens
EVIRGSVYPASAVLLRRVRAKTTTSTRSNEEPHSQVSAKKWNLNFYL

SEQ ID NO: 988449 - protein, 88 aa, Homo sapiens
TVIFYQWKHSEVKTAPNNGCAEMRSADLGEALARAVIPQQKDELRETLKSLKKVMDDLDRASKADVQKRVLEKTKQFIDCNPNQPLVI

SEQ ID NO: 988450 - protein, 41 aa, Homo sapiens
MSQAYLVHFLTQTWNSAISPQQSWFLYMWRQYMANHNRGTG

SEQ ID NO: 988451 - protein, 70 aa, Homo sapiens
WKLRKAQKYKNNALIKKSLYEKDTCTRMVYSGTIRNGKNVEPTQIPINQRVNKETVAYVYDGILLSHKKE

SEQ ID NO: 988452 - protein, 78 aa, Homo sapiens
TGQHSNSGNTEITTNMLPEKSNPKTCNRQIYQGWNEGKYIKGSQRGRVTHEREAHPVLVLPWRIYSQNTLQVPEESGA

SEQ ID NO: 988453 - protein, 120 aa, Homo sapiens
KRKSSQTNNLTFYLKLLEKEQPKPKDRRRNEVIKFRAEINEIEDGKNRPVTTKEIESETKNLAGKKSRRSDAFLVNHQTFEESIPILLIFFQNIEERIPPNSLCEASITDTKGRQSTRGK

SEQ ID NO: 988454 - protein, 33 aa, Homo sapiens
YYTTVADYKVAKNNLIFLPAEQWTHIPHPVDLG

SEQ ID NO: 988455 - protein, 31 aa, Homo sapiens
MKTHDQHFTSYEPYHNWPPQMAMSLLCTPRV

SEQ ID NO: 988456 - protein, 39 aa, Homo sapiens
MTDCRMSCDNIASGYSLLTVLQYSEEAESLENRQDIDRN

SEQ ID NO: 988457 - protein, 92 aa, Homo sapiens
ALHPDTSEKAKDVLFDQLHGADYSSEHYGSGKLARKMSNAWMSYLPLKFLRTACAMSCGEGFLFEAFAAAKNHIARGCRSPRRPKEFLVLTR

SEQ ID NO: 988458 - protein, 76 aa, Homo sapiens
YHHIIPIPIIITITPSLLSSPFTITVIITIIVIIIIIPIYHYIIITISITIITITFIITVIPIYHYIIITITITII

SEQ ID NO: 988459 - protein, 77 aa, Homo sapiens
PIIIFLRVTNPVPTVMNRPKGSCEQRKEDWMRGRAKGAERGGESSEASSDDTRNLDCYSYSLYSDYLQYPDMVPIDL

SEQ ID NO: 988460 - protein, 53 aa, Homo sapiens
MADGDIVIMMIVMMMVMTTLMVNGDDSNDGGDGDDDGDEDDMMMMMMVMEKGD

SEQ ID NO: 988461 - protein, 79 aa, Homo sapiens
LAVFPRREHTITRSLSDTRDDKVGRTTHTTHTEDKTHTRYTSSTTHNHTTFSDHHNTVDTNIAHTTHNPTHNHTVTISR

SEQ ID NO: 988462 - protein, 55 aa, Homo sapiens
PVRTDRSAAHRFSICCIGDYNGTSVWCSAAKEVHRIVGIVWQALIVPCAEALRGR

SEQ ID NO: 988463 - protein, 58 aa, Homo sapiens
ASSGFVITAASSKWSMLQQSATNRKPTPKAHCNRLYYRKLQGDKDAIKAIGHLYWTIL

SEQ ID NO: 988464 - protein, 40 aa, Homo sapiens
MYLLSMMNITYKNTEYAYKNYALINVRYYNLGRAKRNDDI

SEQ ID NO: 988465 - protein, 90 aa, Homo sapiens
RIADVICNDKTPKLYHGDSPTVIHARCGQISGSSDSMEAVPVDVSVVKVTLSLEFLCILCVTIVRADPSHPLKPLSRGLSHPTDTIRGKG

SEQ ID NO: 988466 - protein, 56 aa, Homo sapiens
NATLTGHMCFLVLRHRSLHVQALVAVGDHASKPMVTFAANINKESIVDVEGVVTKS

SEQ ID NO: 988467 - protein, 38 aa, Homo sapiens
RPSSQVSRCVYTSLIRVSSVRSPSLIIVPQCTLTRTHH

SEQ ID NO: 988468 - protein, 48 aa, Homo sapiens
APLFHKRADIVILLVQILAEKSVTVHMCRLQSVAPDGSEKMDVEDENL

SEQ ID NO: 988469 - protein, 47 aa, Homo sapiens
MRIFRTVVVRALHIRCHQDLIAQVIDLPIGQRSNGIGRNLDRLAIER

SEQ ID NO: 988470 - protein, 113 aa, Homo sapiens
QKIGRSRHCELFIVSHRLSSPLFFYHNIAVRLHRPSTDALGLASAERMLVLEKVPGKKKWILQFWRRGAPSSLSNSTVLAFQPGERFVSEWPQKENYGQASVDNGSPAFFGSC

SEQ ID NO: 988471 - protein, 76 aa, Homo sapiens
QCTQSHLSNRQVSHDPPALSLQWFLSGFKIKFKLQDMAPASCSDLNTSYLKTLGSNHNEPLVISSTYCAIGTIHIL

SEQ ID NO: 988472 - protein, 117 aa, Homo sapiens
WKLSLLPNTGPATRRSGGFHKCDAVSMEVLLPCAVHFEVDVHFPVFEEARLLYPDRALFAALVRKQTHVLSREHSAALVVPEWHRAGTDPLVGLNERMLPLEMFTVAVSYIRSKDPK

SEQ ID NO: 988473 - protein, 40 aa, Homo sapiens
EPGVDAAVSIVPLHSGLDNRVRPCPPTPQEMGSYSRDYSV

SEQ ID NO: 988474 - protein, 36 aa, Homo sapiens
GETDPEGRGTPQRQPKDIENQSLSNEPAFTARKTRA

SEQ ID NO: 988475 - protein, 38 aa, Homo sapiens
MCLNVPESTVKLFTAVISTPDFDPRVNNLHLLTVIQQH

SEQ ID NO: 988476 - protein, 77 aa, Homo sapiens
MRLSATEGSREYSRMTLALCTGTGLMLEISAASAKAASSMTSLSENTRLTSPLPRAVAAIILRTVKASSLTRLWFPM

SEQ ID NO: 988477 - protein, 38 aa, Homo sapiens
MDNFRMTISMIIYSCLKEERKILENAQRFNQAQSGNIQ

SEQ ID NO: 988478 - protein, 87 aa, Homo sapiens
WRISKSRAVLQSLRNLEVSTVLNVSTELMYSVGMHRSGEYTSTRLHVCVLVEVSTVLTCLKELVYGGMHRSGEYTSSWRHACMLGYW

SEQ ID NO: 988479 - protein, 91 aa, Homo sapiens
PGYVAEAGLELQLLSQAEAPQTAGVQEFWAVARYADRLSALKFGINMMTYCERGTTRLPKEEENRSSLSTEQGKTHVLISRCIAPVNSHCT

SEQ ID NO: 988480 - protein, 54 aa, Homo sapiens
MALTRRSSKSKRRAKRFGSYDIAILQIGVPPCNIVAIQVLSMLSRKPRLQLHNR

SEQ ID NO: 988481 - protein, 70 aa, Homo sapiens
PERHVRGGITSVVGVALLIELPLAAIDGVVHCRRSPARDGRCAGDQPGRAPFLEGPSPARAVHPRIACSA

SEQ ID NO: 988482 - protein, 97 aa, Homo sapiens
RIPVAGPAPSTCTTAHSQVQVAHGWHAGPPSHVFPASRTGRCAWRSRRGQGPMFLSRALSPSPGPVPSSAIAMFLLGGHPRQQSAPCQAMPQLVTHG

SEQ ID NO: 988483 - protein, 48 aa, Homo sapiens
DVHEYMGSTNGMNRKKKCHMYNNFFKKVKVNYWGDNSSPLPPPAHSSK

SEQ ID NO: 988484 - protein, 38 aa, Homo sapiens
MRFFFLETGVSPVSPRRECKGVISAHGKLRLRGHEILR

SEQ ID NO: 988485 - protein, 44 aa, Homo sapiens
MGDVTFFQWGNHAVARKKAVCHLFGPLVSVFLALSIRIRPEVLK

SEQ ID NO: 988486 - protein, 30 aa, Homo sapiens
MIFHKYDNSSFNEEKTVFSTNGIGKTGYAH

SEQ ID NO: 988487 - protein, 89 aa, Homo sapiens
MCMSLSLNQELEIIMFSEKGMKAEGGQKLGLLHQTVSQVVKNAKEKLQKEIESATPVNTQMIRKQNSLTADVEKVGGVRIEDQTSTFFQ

SEQ ID NO: 988488 - protein, 46 aa, Homo sapiens
RVHIGLTRFKQLPASLDVLLGFTGIVKVDCLIVFQFLNIACQVHND

SEQ ID NO: 988489 - protein, 90 aa, Homo sapiens
VTRGKKSEHSVVNESARKIPMLLGKAYERHQRRTIGLTVLAALMVPLTAGTMLMLMPPARAVDNWEVEGANGTLHVYGALTESACSLEMT

SEQ ID NO: 988490 - protein, 100 aa, Homo sapiens
RRQSFRTDLRVGVPGYITLGDYARTPRNAFTAQPGRRYLMCGRATDQMRGLHRLSRLDNLRMRIQFYLRSEGMGAKVHVLKGEESRPSATVPKSPLSCTH

SEQ ID NO: 988491 - protein, 73 aa, Homo sapiens
AIEHGTHRDLPLRQDKTTRLGHGVECTEASYMLLQKLQQNADRFPDRHKTIYASQIVIPKYLGFKYNIRYNRT

SEQ ID NO: 988492 - protein, 42 aa, Homo sapiens
CSGEISAQYELRSRVHSICPASAYQVAGTCRRLSVTPWSKFA

SEQ ID NO: 988493 - protein, 159 aa, Homo sapiens
MWEWRSEYGDHILDELQRIYSSQAKKATWMQMMCDGNQCRADQSLTSPPPRDLLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSHVI

SEQ ID NO: 988494 - protein, 153 aa, Homo sapiens
MRSHMRDHVVLAYGSCIGGSRIMTCSAIQVDASTVILYLYMAVEYAMVYMCQIVFIQSTIAWALQVECKLCYSEEYCSEHICACLYGSNNLYSFGHIPSHEIAGLNGRMFQVLLEITQLLSTMAELIYFPTSSVYAFPFLCNLASICNLWAFK

SEQ ID NO: 988495 - protein, 55 aa, Homo sapiens
LLGSLLYLSRRPLISYTPTKSLMPASPGALESSPRDPGLCAWTPLWPEPGGASAH

SEQ ID NO: 988496 - protein, 86 aa, Homo sapiens
YTCMGSSRVNATLRGIQPPTELGLQVRATEPSYLSYIAYRRGFTILDRMISSLDLVIRLLRTPKCAWDYRCEPLVPGLEHYSHVKH

SEQ ID NO: 988497 - protein, 160 aa, Homo sapiens
MHINCLFIIKCNDLMQNVIFNLSYDEGAFCLLVVAWGFRAQVKHITPTFKIASSCCYSTLMVMCKKLKFLGFPVCTAEVKKELGIGHPLWDNRYTSYLSLSCHRFGLTPKNKNNNNLWSTQGEGRTRFKHWTSEYDSLPKTLKYLNVAMINAEVLPLTVM

SEQ ID NO: 988498 - protein, 32 aa, Homo sapiens
IEDLEATFLSVTSVPSVLKALVRPLHVNAKDG

SEQ ID NO: 988499 - protein, 69 aa, Homo sapiens
RFGVFALVRSEGITEESCVWWLTHVNRQHVWEAKGRSRGQEIETILANTVKRLLYLKSKKLAGHGGTHL

SEQ ID NO: 988500 - protein, 107 aa, Homo sapiens
VSHCTQLYGYHQYLHERGPIYGGQSAVQCDDRRLTATLHLPGSSESSDPASPVAGIIGTRHHAPLIFAFFVETGYHHVGQAGLELLPDLRLSAHLGLPKFWDYRREP

SEQ ID NO: 988501 - protein, 122 aa, Homo sapiens
FGVFAKFYQQKRREELRRHFRDFGDSLTRGGKGFLRGVVGGVTGIITKPVEGAKKEGAAGFFKGIGKGLVVAVTRTTGGIVDMASSTFQGIQRAAESTEEVSSLRPPRLIHEDGIIRPYDRQ

SEQ ID NO: 988502 - protein, 66 aa, Homo sapiens
TALKDDSRLKGEFVTECAADVALHVISCSKSIQLPCRAAICHTVTTSRDILVWNPRRDSLVSMVVG

SEQ ID NO: 988503 - protein, 57 aa, Homo sapiens
PEMCSVRADDLVENHQIIWSLFVSIFKAGIRTNEQITATLYWVFSSQDCNGDLNPSS

SEQ ID NO: 988504 - protein, 100 aa, Homo sapiens
SKLYAGACSKIIRGTAYLSSGSQSRSEYSVELHCLSTEAGAKALANRAVERTHRGQSVRLIRMQRALDPGVLIQILVFTWDFTWILALLSGEVDHFQPTV

SEQ ID NO: 988505 - protein, 68 aa, Homo sapiens
MHEMRIVSGPGTSGSHCNPSTLGGEAGGSRGQEIEIILANIVKPRLYEKYKNYLGTVARTCSPSYLGG

SEQ ID NO: 988506 - protein, 110 aa, Homo sapiens
EQQHTGFQETSVLMKLGLRSKRTKQQYSGEDRKRVQEPVRSGEGISEAETETANNMVTDIYVKKDPREGTRVQFGEQQQHTGFQEPVFDDARTEEQASKQQFVVNLGKES

SEQ ID NO: 988507 - protein, 63 aa, Homo sapiens
SVYCAFALIAVCAMALVSTMSHMHNLVLSAISFPVNIQGISSILSKTKQNIDYVCHFSCARSL

SEQ ID NO: 988508 - protein, 83 aa, Homo sapiens
VQIQKYEAPERVKRSCNDAAIIIRLEVMMGDEDEKAVESVCVSSAWLENSPVDAFGGSVQAHKDVSRQFHHADDVGLGPEEAR

SEQ ID NO: 988509 - protein, 38 aa, Homo sapiens
YCYLVGDCYLWDNWPPESDRKVPILEDLLMRILVIWAV

SEQ ID NO: 988510 - protein, 98 aa, Homo sapiens
VALITVERHASGGDYWGILNPGEYGVTGHAWGYTPSAKTCNVDYDESVPRQCNFILARSNWNRIREIVAMNGNRPIPHIDPSRPMTPQERLTGQERLT

SEQ ID NO: 988511 - protein, 94 aa, Homo sapiens
AGSTVVALVGRLGEYSLLPEVGGQVAVGLRNGIKGGLGESCPVVACAAPWLMVSHRYHAIMMQLLSAHGRRRCHVPWCAWDEAYHTEPQLAPVT

SEQ ID NO: 988512 - protein, 47 aa, Homo sapiens
SRESPEWKQHIYNEIVNINPIARKDSRRRNGMKLEGLILHGTGGQTL

SEQ ID NO: 988513 - protein, 82 aa, Homo sapiens
ISAKREINANIFLSVTTAVHASVFNALRLVSTLLTSNYRYSFKNKEEFTILQYPKTPKLAIDIKAENLRRYAFLDKFRPHVS

SEQ ID NO: 988514 - protein, 85 aa, Homo sapiens
KGSPNNSPFLTITSMTRVIEVSYWGNNAGEENGDLKHTRAGLKGPFLPFDYQRPPESRNLGTQLEFLIMGITGSWGKMVFRYHFP

SEQ ID NO: 988515 - protein, 103 aa, Homo sapiens
SPLYRIPSGSLGEEWKGYVVPINGGNHKQGFPMKQGVLTHGRVRLVLSKGPFCFQPRGTGERKKKSIPGCIVDANLNGLNLGIVKKGEKDISGLADTTVASRL

SEQ ID NO: 988516 - protein, 37 aa, Homo sapiens
QYDWCLNKKGKLGHRDVHKDNVKSHRDKMPSTSQGER

SEQ ID NO: 988517 - protein, 189 aa, Homo sapiens
MLSSVILAAGVFLLERISCASSGARPERCRRGVSERFRVTGRDRGDWNIHWSLKRGWNERTVWKHWNTALFLHDETRYPVGLADRPDSEIPELRRLSFVNIQQLLDERPPVGLKVPMPARGYSEWTDRPVPVLEEPMIRAKTGIERRLKRSLKYNCGEPHKRDARGSAGNDEPDLVCDPGRARVDQARR

SEQ ID NO: 988518 - protein, 157 aa, Homo sapiens
LEDRGSVISHLSLLSSWDYRHESPVLRNNTEGSHVTFTQFPLVVISCNVVHYHIVYTCNDGTLSQQDIDIGTVKIQNIFHLHKDSLNLHLDSWDYRHESPVLRNNTEGSHVTFTQFPLVVISCNVVHYHIVYTCNDGTLSQQDIDIGTVKIQNIFHL

SEQ ID NO: 988519 - protein, 119 aa, Homo sapiens
NSGSPGEAHGQEGSAAAQLDVLRLRSSFMERRKKGSASLKDELLRALKELMLKDQECERLSKVREQLEQELEELTASPFEEAHKMVENLNMKQAASEKQLKEARGKIDMLLAEVTALKT

SEQ ID NO: 988520 - protein, 54 aa, Homo sapiens
ATQRDLISTKKNKKNQLCVVACTCTSSNWEGCNGKITSAQANWAVRIPDEDCSE

SEQ ID NO: 988521 - protein, 136 aa, Homo sapiens
LVIHPLGSQSSGAYRHEPPHRAWDYFLSFLGLVLVWETESHSHPGWSALERSSLTATSASWVQMLLMPQPPKEVGLRGVVHDGGIIVVLLCGVVVVVVVCGVRVSLCHRGCGGVVPCRIILTSAWWVQAMLPQPPK

SEQ ID NO: 988522 - protein, 124 aa, Homo sapiens
MRCSTCRRKKKKMHLTIQALEDAAGGGGERPGEAVRWKKVTTEAKLKNLEAEPIILEDPNCKLAKEKKLLEDRIADFTTNLAEEEAKSKSLAKLKNKHEALITDLEERLRREEKQRQGQEEHRS

SEQ ID NO: 988523 - protein, 78 aa, Homo sapiens
SAGLPSPSPGSILTFGGRRVNHALYVHLQPGMSREGPAQPQSSPVQATFEVLGFITHLYAGADVHRHWDVRILLTNIR

SEQ ID NO: 988524 - protein, 36 aa, Homo sapiens
SLPDAKEREARPDFHLYRVIQNKEGARVKTDGPFGG

SEQ ID NO: 988525 - protein, 38 aa, Homo sapiens
RKHPFTQSSFSQGGTSSSPSGHPTLPQISQGGGHGSSQ

SEQ ID NO: 988526 - protein, 66 aa, Homo sapiens
LFRTSGSNRLGLPKGGDYRREPPCRCRFKFSTDWIIYGGTCTYFLIQNMTRAIRALESGRSEEETR

SEQ ID NO: 988527 - protein, 76 aa, Homo sapiens
SPYHARPGVPRQAPGGCHAAIFSHFPILVLMPSLVGSSIQGLLPGPILAPTTLTHSLGLITGTGFQGHRQLAHSVT

SEQ ID NO: 988528 - protein, 90 aa, Homo sapiens
QVSPTSASQSAGITCVNHHALPAGSFLMARVVSSPGMGWNLGGMIICSLMVSRREGNAIGFKQHFNGQLQRWITHAVRKQTRMRVSSWGT

SEQ ID NO: 988529 - protein, 45 aa, Homo sapiens
PAGLFHYRQGEVLGQELFFDIIQGPRGIRSAPKLPTRSGKGREHP

SEQ ID NO: 988530 - protein, 68 aa, Homo sapiens
MLQCSRGSLRVFTWGADVYMSGPASLASIFYAVARRAYCEGCYVSTLEKCAPVVPAHPGAGSCGLWGK

SEQ ID NO: 988531 - protein, 32 aa, Homo sapiens
MSWPVGYAGAFMILSRWPDHPYGRATKAHGDS

SEQ ID NO: 988532 - protein, 78 aa, Homo sapiens
TVKGGVNPEPFRATQKVFTRQLGLEHDEKLVSYLSRLRNMERRTKQIQPWELNRAELQDRRGQAKVLERELRDLTTWV

SEQ ID NO: 988533 - protein, 57 aa, Homo sapiens
VLGTVGNNVNPHNYKQESFDQGVTYTERDTESQTQSTIHSPRKIQAQAPLAGRGFLQ

SEQ ID NO: 988534 - protein, 51 aa, Homo sapiens
PNLLIWALHAVVCLQADCSQLDLGLITSQSFLLFSQLMRLPCGSWTPNGRQ

SEQ ID NO: 988535 - protein, 39 aa, Homo sapiens
MAVEKYLMEWEPAQVSVRARAPQSSRRRVGGAVTRRVRS

SEQ ID NO: 988536 - protein, 34 aa, Homo sapiens
PLLKNPLSRIVGFVLAIDRSSDAFGQFADRGSQY

SEQ ID NO: 988537 - protein, 92 aa, Homo sapiens
IVLYITGEPSKVSHRWLSYSVAPVRVLSAPPDFHFGQINRTPKFLRTFPAGQVPAFRGRVMDSVLFESNAFDYYVSTEELWGSTPYAAVQVV

SEQ ID NO: 988538 - protein, 38 aa, Homo sapiens
CQKYNGDKMICRKVLCSPSPSCCQRPQGRSVVTPATCV

SEQ ID NO: 988539 - protein, 108 aa, Homo sapiens
CGSFLTLEIELQSQLSMKASLEGNLAETANRYWLQLSQIQGADWAALEEQLGTMLRCESGAAEPVNTKSVLDCEARGWMQEICHLTAACLEGEDAQPVTQYKKEPVTT

SEQ ID NO: 988540 - protein, 72 aa, Homo sapiens
VALDGPRRVSSTFRACLEEIQSKLQILAASVWWMGINFSELGGKCGFLFLHLGGRRWEPGSLAHVAAPSILQ

SEQ ID NO: 988541 - protein, 107 aa, Homo sapiens
VGLQVLAIAPGRWWIFKNTVLKQTVGQQRSTQIENEKTSDPTVANTTRGKVCAGPGAPRRMWEGQAYVWRTVVSGAPMERGRKRGTTGMLETAGVGAGERCIVLWST

SEQ ID NO: 988542 - protein, 49 aa, Homo sapiens
PDAWPCFSLRRCRAKGSCLPIRGVPALELHGAQAWRVQAQQHRRLPSSQ

SEQ ID NO: 988543 - protein, 38 aa, Homo sapiens
VGLFLTEVEHRSIVGGDETEEKCERECLRICPEVKVHD

SEQ ID NO: 988544 - protein, 53 aa, Homo sapiens
RAAAVALDGSRRGLPDHFRRVVPGAPPSTGDWSYPRPGSSRHDSALPPSDDGT

SEQ ID NO: 988545 - protein, 138 aa, Homo sapiens
MESEELSLPWPLSHLGIEERLFPAAIPSRSVRSVSVRASSVWDVRSASAWLPHLGREECLCLAVTPSRKQGTDSCLISHRLGCEERLCPCRPVWNVRSASARLPRLGLEARLCLSAHRLGCEARLGPGRPVWAVRRCS

SEQ ID NO: 988546 - protein, 34 aa, Homo sapiens
GSLPDLSGSPASASQSAEIKGVSHRTGPNTGILE

SEQ ID NO: 988547 - protein, 30 aa, Homo sapiens
KGRGLNLRLPQLKQFSWPQPPKVAGDNRGC

SEQ ID NO: 988548 - protein, 61 aa, Homo sapiens
TTRFLYGDVSQAYKHSMLNMVIISSQVKLYYCQNLPSRKCQNANPESTENLGNIFNLVPFP

SEQ ID NO: 988549 - protein, 37 aa, Homo sapiens
TKICIPPLSSAGDSFWMLSSARVRPSSSGFPAKINLV

SEQ ID NO: 988550 - protein, 67 aa, Homo sapiens
LWIITKARKMKEMTRRKKMEGRKKGGEKKDGRKKHEEQRHSSHFLDFETTVWSDSYCEKGLRNGLRG

SEQ ID NO: 988551 - protein, 101 aa, Homo sapiens
STGCRLTGDGTLMSKQGATESRQVVRSYYKFSKVARYKINRTISGIAIQENFTIQKCNIKKTMSFTIASKRLKFLGINSTTGGLRLNTTNHCCQEITAWPR

SEQ ID NO: 988552 - protein, 57 aa, Homo sapiens
ETGVKSRRQKWQCVERSRDGRSSLGNKSETLSPQKTTDKQKNKTPAQVWWLTPVIPA

SEQ ID NO: 988553 - protein, 69 aa, Homo sapiens
YPQSVIHDWATSSYMMSPERFRKWNVTSLETLKALLAVTKGHEMSPQEAPMIDRLCEGEGATLDIRYPK

SEQ ID NO: 988554 - protein, 71 aa, Homo sapiens
GPRGGAGGAEYWDRETQKYKRQCQTDRVSLRNLRGYYNQSEAGSHTLQWMYGCDLLSRKGASFAGITKSAY

SEQ ID NO: 988555 - protein, 49 aa, Homo sapiens
FSVWIVAFSGPSDEPIPYRVHVDGLHRSDRQTSTGRRARGVRSTGRATD

SEQ ID NO: 988556 - protein, 42 aa, Homo sapiens
NCGDVMSLSLAPDTRLYVSGACDTSAKLCDVREVHMPQTFTE

SEQ ID NO: 988557 - protein, 83 aa, Homo sapiens
LGDNWKLHRVKFLVAPANFKREKELARKLEYDGLYITEQPEATDVQGQWDRLVLNTPLLSLSNYWDKFVTRKVLDKHGDIYGR

SEQ ID NO: 988558 - protein, 143 aa, Homo sapiens
ILPSELLVYRGEAPSGPGRSHTSSASVRPARSCSSAQVQALSEVCVLVLEICVSRSQYSGPSCSIHGARGSFLGLVASLSNLTNSVSSTEPTVMKRGSPRPGRDMAVWKYLMEWEPAQVSVRARAAESSRRTVRGAVTRISAS

SEQ ID NO: 988559 - protein, 59 aa, Homo sapiens
SEANSLRFTFGSPEGRDVTDNRWVVLRARRSVFPGVISSVSASTTSSGIVASRKGEKGI

SEQ ID NO: 988560 - protein, 57 aa, Homo sapiens
EHLTGTSEADLAHQDVLHVKVQEGALVLDGTTSISCVTRAERHQQPQHASIVLVGLK

SEQ ID NO: 988561 - protein, 61 aa, Homo sapiens
SGSRGSRQSILTSYFFDFLDRFWFKISSSSGVSWAPFWRPRGSAIVGDSIPRVRYRCAGRL

SEQ ID NO: 988562 - protein, 42 aa, Homo sapiens
MIPDEHLTNSKILPPAATSRVTSIMVQHFRYHINQSNIHEEA

SEQ ID NO: 988563 - protein, 54 aa, Homo sapiens
CGDLTGIPASSHLQPQARGGGLKVSTSHSQQHTNTLVVHLFHTAHRSRVTGSSH

SEQ ID NO: 988564 - protein, 51 aa, Homo sapiens
MRIHIFIRLMGLARHLPPQFSWRGFFCIDIHFQPIEGRLLATVARYSLIVR

SEQ ID NO: 988565 - protein, 79 aa, Homo sapiens
MRSSEEWNRGRARWLKPVIPALWEAEAGGSQGQEIETILANIVKPRLYQKYEDIERGVVVGAYSPSYSGELRQENSVNP

SEQ ID NO: 988566 - protein, 207 aa, Homo sapiens
MASNMGVQVISRELRIQANTTAYITWSALLKQTPPCEVKAAPDITGHKRGENKNEGQDATMYGKSVGYPHPDGIWRKKENGMPRDMVNTSGRFFIITKENYTEWNMVNLQITEDPGEYECNATNAMGSASVVTVLRGRSHRAPLGPFLGILAEIIILVVIMVVYEKRKRPDEVPDDDEPVGPMKTSSTTITKDKTCAENTIKYGYIS

SEQ ID NO: 988567 - protein, 67 aa, Homo sapiens
LAKDPANRVIFSISGRRALTAITGAVGHALASSINRRQVGPFPSRQRGAEGARSQAGGLGSDAVWVS

SEQ ID NO: 988568 - protein, 47 aa, Homo sapiens
MSGLLGGAPHASVPTIRGMILILIFAEELDSTVIIETLILCTKETLS

SEQ ID NO: 988569 - protein, 84 aa, Homo sapiens
MGHAFQVLVVIEVTLVWRAAGGLERRPKPVPQKARVVGKVDQGVVIRLIGGESIAHSQPLKVMLGILHDQHGQGGDVDASIALP

SEQ ID NO: 988570 - protein, 66 aa, Homo sapiens
SGCTDAQAVPSASFAPSIKYWYLRSVPGTSRTLASLAHMWKYRSFMSYTERFLELMVVIPVMDNNK

SEQ ID NO: 988571 - protein, 34 aa, Homo sapiens
GFSDGYSQDRGSERDRGDTEVFRAPLLLSGSFIL

SEQ ID NO: 988572 - protein, 32 aa, Homo sapiens
LTILQLFKAIFQLLLGPRPSWKCIFLSSQEPE

SEQ ID NO: 988573 - protein, 35 aa, Homo sapiens
VEVGSKDGWAFAWPARACAERAYALHSRGGTVPYL

SEQ ID NO: 988574 - protein, 33 aa, Homo sapiens
YTEPSLVAKLEELEIGRPSTYASIIRTITSRDY

SEQ ID NO: 988575 - protein, 51 aa, Homo sapiens
MVNVHPVISPIASARVAGLRIIPRTAEVTVRSPGLRTPLISMHMCSASTTT

SEQ ID NO: 988576 - protein, 49 aa, Homo sapiens
CILATNFLPGLSFPSPLFQVSSHHHLINQCISRATLQASTQPSPIIHFN

SEQ ID NO: 988577 - protein, 38 aa, Homo sapiens
KALRTQLDLRRFRIYSNHSALEWVALKPLQAPLETMLQ

SEQ ID NO: 988578 - protein, 77 aa, Homo sapiens
RVSSGVGLGYSGQLHGKECVHRRRGECVVPPDLMQLCVPSISLGLCSCTEFQCVQQRVSVRSEEGFGSAADAVAGVG

SEQ ID NO: 988579 - protein, 93 aa, Homo sapiens
EVDLEGSLWVSSGQCHENSIDVFDVRRAEWEQTCAAQEGAGPSIQRCSLVPHTAPEKVRLDLPHGTTLCRDRTEFCTSLDLHLTTSRAASLFL

SEQ ID NO: 988580 - protein, 146 aa, Homo sapiens
WEGTAGQGGADRATVVAYVRGPETVGSWGTHHRQGASTLRLIPTRGPCRNSAISGAGSRRQPKADIASLPMMLTGFPDSSRLAPKADPIFPGPQARRFSATFPRCRRASSWPAMTCPPRSSTADASPSGEHTRFTQRCMPEDKYTY

SEQ ID NO: 988581 - protein, 51 aa, Homo sapiens
EQNGQWLVLVGMMWLRLQMWPSEHRNEAELSLVYVPLHGSHRWGHRCKDAR

SEQ ID NO: 988582 - protein, 69 aa, Homo sapiens
QDLTVIIRPRPPKVLGITGLSHGAGPGWFLVFGDGVSFCGPGGSTVMQSQLTATSASGVQLILLPQPPE

SEQ ID NO: 988583 - protein, 195 aa, Homo sapiens
LSSQVAGTTGRDVSGVGCRGSADLMAAVPDSQPQGERYPSPKGSSFTVTRRISTLLTPVTDAKLTAMSSSLQSRGTLELHKRQCPLEELYSIPEDQEPEDQEPEEPTPAPGARLWALQDGLANLECVNDKYGLGRDKSCEYGCDEPLLKRTDKYRTYSKKNFRISRQVGPKTSYMAYIDDSRGNGTFVNTELVRM

SEQ ID NO: 988584 - protein, 84 aa, Homo sapiens
MGAPGMHRLVEDGQGWSWGCVLTGKPGGQNGIDITGSPRSPLHCNWHLHQAIRPQVPAQSMSQRKTQRSSWNVCARLLGIACSA

SEQ ID NO: 988585 - protein, 36 aa, Homo sapiens
RPRQKYQLTIHTADLIHQANTVWPKTPTINHIISMN

SEQ ID NO: 988586 - protein, 42 aa, Homo sapiens
VDSIDPPSKTEEAENTDNLLGTINHITTEDPQDYSHLIYDEE

SEQ ID NO: 988587 - protein, 38 aa, Homo sapiens
MIAQAGYSSSLFYVISFTSNGMAGRHARSFCRRVNDRS

SEQ ID NO: 988588 - protein, 41 aa, Homo sapiens
HSIGSGVLHAQVFKFSHQLLTRFQRIVFIFGHSGFGLLRHY

SEQ ID NO: 988589 - protein, 95 aa, Homo sapiens
NTGSEAYGSLTEANLPESQVASGAGAGAPIASSPEKAEEDRTLAGNQGPPALVSYTHSLMEWCHEVTTGYRGVRISNFTTSWRNGLAFCAILHRF

SEQ ID NO: 988590 - protein, 37 aa, Homo sapiens
YRHARQGEITAVQASQPDNRVVQPVQAKCQYAPGQNP

SEQ ID NO: 988591 - protein, 33 aa, Homo sapiens
VLGIRNHLLWERLRCGIHSWNLALFDPQLRMRH

SEQ ID NO: 988592 - protein, 54 aa, Homo sapiens
MARCRELLYAHHFMKNKIGLSGLKVTFVLPLKSGSGPLKSVRRQSFGKIREESP

SEQ ID NO: 988593 - protein, 110 aa, Homo sapiens
AIAGAEPIPLYRPEVPIYSVDIPAAQVMTLQALGTFHERQGEQSLLTGTGAMPAGWGRAYGSDFNKSWSGTGAPSFDGTSRGFQVGHDLYASETSGGQTQRFGLFIGQSR

SEQ ID NO: 988594 - protein, 35 aa, Homo sapiens
LCHQSSMRASTATLAGSAKEWPLELTEPDVSTCWQ

SEQ ID NO: 988595 - protein, 53 aa, Homo sapiens
VGITVALLMVAGLTTQGVDMCGDGFSAELSDTAHEKLNASRGFLATLVDVVVQ

SEQ ID NO: 988596 - protein, 71 aa, Homo sapiens
GTLWRVLVPARRGAAPPDLPCPPGDVTPRPQTDDLPLVLLCWTAAPAGVVGADSGGRLLATRLIMLAAVAA

SEQ ID NO: 988597 - protein, 79 aa, Homo sapiens
CSSLYDIWRSARMLTCRRNYVQEGMHRSGEYTSTSSMYACLGGEHGAHVSQGAGTREVCTGSGEYTSSWRHACMLGSLN

SEQ ID NO: 988598 - protein, 154 aa, Homo sapiens
EHHASSSGRAGVTLPIPHGIWNVGLGDGVSLLWPRLECSGAISAHCNRCLPGSSDSSASASRVAGVTGAGHHAWLILVFLVDAVFHHVGQAGVEPLTSGDPPVSAFQSAGITGMSLGAWPFIWNLKKTNSIVAQLKLLRGWWPVLTRGNRHPGV

SEQ ID NO: 988599 - protein, 86 aa, Homo sapiens
HLSFPYGHLSLGLMQDLQQKVVYHEIHGGGVQCVLPPRSKEDILGSECIPSRSPSTHGAEHSVAENRASFINQLVHLDLLSLRLQA

SEQ ID NO: 988600 - protein, 43 aa, Homo sapiens
SSSSRQPLTVQVCSCHTHCGPPKPSSQAFSSFYTPSSCTSGLF

SEQ ID NO: 988601 - protein, 50 aa, Homo sapiens
SKKSEVAHFCSGSSSCGPSGFKILAIITGFPPYDLPFVPSARIPEPTRSD

SEQ ID NO: 988602 - protein, 46 aa, Homo sapiens
TLEDPPYAAVQRAPVTPGRVAIVFSTGSPTCAGRMPHSPGFAVGQE

SEQ ID NO: 988603 - protein, 42 aa, Homo sapiens
QSVAAGGSTCNVSSADGRSAQLDTSNADLDRWTLPLTVSVAE

SEQ ID NO: 988604 - protein, 56 aa, Homo sapiens
DQVPVNGIAMAPYMISVALFVAAISTNMIFAKLPSGRHPESRWAWLKSRSEINGII

SEQ ID NO: 988605 - protein, 90 aa, Homo sapiens
SRGPCGASRALRGSNIKVNSELNPSTGNRSREQSSEAAETGVSENEENPVRIISVTPVKNMDPVKNKEINSDQATQGNISRDAQQGGTEL

SEQ ID NO: 988606 - protein, 61 aa, Homo sapiens
KVTERGPVYEAFAQPDAASRSSQFLNLHEGIVACSLDDDAGVFVFAQQVHHNAMRAVMDVG

SEQ ID NO: 988607 - protein, 36 aa, Homo sapiens
QVGQRSALRGLSYSSGQGRALLWPGLCSWPGQGPAL

SEQ ID NO: 988608 - protein, 42 aa, Homo sapiens
MTAATPTDRRSQEKSERRNDGIDETAAEIITALGGAENIEDV

SEQ ID NO: 988609 - protein, 84 aa, Homo sapiens
PLEDPPRSAADRPRQVLGRLVFSARGGRMSSISLTWQPGRIALAQARHIYACFLTQTGGRCSKSALSNAPVNPHLITARGSKRS

SEQ ID NO: 988610 - protein, 46 aa, Homo sapiens
THLQEMVNFSPMAREGPRRRSGMKLVGTHLAWHRRPDTDQGPVLVT

SEQ ID NO: 988611 - protein, 34 aa, Homo sapiens
LSYEYRREHLFESRVLGASTATYFLPSAMLREHI

SEQ ID NO: 988612 - protein, 60 aa, Homo sapiens
RQGDRWSFDFDRLDRWSRIARRHGITHLEFSHLFCQGEVDRPADVYDADGNHLFGSHLPT

SEQ ID NO: 988613 - protein, 54 aa, Homo sapiens
LAVKRKRDSRTPRSDCVINSGVWAERSTAFLLATNYTVRILELTLEVMVTLSPG

SEQ ID NO: 988614 - protein, 69 aa, Homo sapiens
PKQTHRSRSRDRSRLTTAGIETSYNAQEQQSGQSNKIENPEEKEKRGSDDPPRSVTSGSREKQSEDHKH

SEQ ID NO: 988615 - protein, 36 aa, Homo sapiens
YPTRCLGPYRGKRPYIEHQQHNKYEKYTQSDRLSPF

SEQ ID NO: 988616 - protein, 137 aa, Homo sapiens
PATMYPILQPLDYYAVTKRATTLLDSGHILILVKKVSHRFSGRGQLKPKLVLEKMYNRSFKKINYIKFAGHRTPIQTTVNGEDQKPQNTILRENQPIRCVHSCNGEAFPGGLNSQNSGLLDVTGNSLQFHQNILLDG

SEQ ID NO: 988617 - protein, 66 aa, Homo sapiens
LLLDRGEGVHLRESRPGHSLHLGSGIECHRARTERDHAAVQAIIAVRQTLEIAHHGGFGVVARKDR

SEQ ID NO: 988618 - protein, 123 aa, Homo sapiens
GRASLTAKDGKGILDSHTIGNRAYGFHGPKVSGHKPVWSFLQISIATGTTVAAPDFRFFPLSTSFGIQRSIRSSENADHMARPGFHDYLEYSSSPVWSAGSQFIPLSVVYFAPASLEEKVGLL

SEQ ID NO: 988619 - protein, 51 aa, Homo sapiens
MTAVIYLPMEKTRERRPWWGGCDVTAFDAGAMLLFTTVTYTGLWVARPPAL

SEQ ID NO: 988620 - protein, 37 aa, Homo sapiens
MSIFSKWVVSGGPTVLRSAEMGHVRTFHFLRARIVLA

SEQ ID NO: 988621 - protein, 49 aa, Homo sapiens
KSAATNDSQLGNRMLKGETVVLASDSKRKRLQPPQTLPRQSFIVEGLRQ

SEQ ID NO: 988622 - protein, 49 aa, Homo sapiens
MAAPIALGDLSRHARRDPKSAGPRPGGFEGQERVTCQDAIDRAKSDGQG

SEQ ID NO: 988623 - protein, 36 aa, Homo sapiens
SACMPESTCIHHCGLPSVKFRLHVSTGLTSNIVSWS

SEQ ID NO: 988624 - protein, 112 aa, Homo sapiens
PGRRILTQHSTPRKNMNMEISFTLNLIAQLYLSVVADTVIAGTVLGSYDALGTDLKETYESFPFWSWNHSLDVVSGFMSCVPNVKVLKGFWVVWGRLGIRFNRVYFLNGFYK

SEQ ID NO: 988625 - protein, 33 aa, Homo sapiens
VSLLLLYAPVWVLPPRLAPLSRASTSILVQLRC

SEQ ID NO: 988626 - protein, 77 aa, Homo sapiens
AEYEQPEGPPGSGGVAAVDTYGRHNYGVGESFTVQGEVHTSGDCVSQRPSPCSTTTSLVCSVNGFYPGSIDVRWFRN

SEQ ID NO: 988627 - protein, 88 aa, Homo sapiens
AGLFVTSNCSASGLCPRGPGVHALSRPYAPRHTLFGEATAPGSNNQPHPASAIGVKCATSIDRWAWPDPQNESGLVYPKSRKLREHTE

SEQ ID NO: 988628 - protein, 120 aa, Homo sapiens
LLLSSSPSSSSSSSSSTPMPSAQGPQYPSLRESLGGVLFKAGQGKEGFKLVPVLILPVSHLSSFDLREVQVFQPLFATDLQLDLPGTQLAPVAVVQRQGGPLFPGQLLPSFHWLLPKKPE

SEQ ID NO: 988629 - protein, 86 aa, Homo sapiens
HDRWDDASDWSSLLFGLHSRDITTGTTNPLPDCDGRCGTRATTGYTSRSYTCAPRRVHYRDDDDPYYMVHGLTRAGTGLLGAGYPT

SEQ ID NO: 988630 - protein, 71 aa, Homo sapiens
MLRCLEDPPGQSLWRGSKIQENQSNWFRRNFYFLVSNDRLVLLEFLSDISAVQGLTPVIPALGEAKAGRSR

SEQ ID NO: 988631 - protein, 111 aa, Homo sapiens
STTQEGDCHRFPSGKLKTELNNQMLSRSAKGLGLGPVSTGIYDDNSFIGQTFPHTPWDGHLWSRRELMPAYMCSATRMHTHSSMPYLKIQTPSPEVWLDMIQLCLFCICAT

SEQ ID NO: 988632 - protein, 99 aa, Homo sapiens
QEGGKPTKLKPYTLSRKTQHHGGCLTTRDTYNRIKTDSSHTLKGQTEKGKRSHMIRNNRNKSEDADLLLALHPEIPEGELVLLHRDVLNIKRTPPVAHF

SEQ ID NO: 988633 - protein, 77 aa, Homo sapiens
VGQRGVTCLGQDTQHPSGDCMKCQDVLLSQCHGKEAGFQCQLEPGVTHFPGLPEDQCAGSNQHHTQHSRHLGSCEAT

SEQ ID NO: 988634 - protein, 82 aa, Homo sapiens
STRGMPSPMPFCVWTWLGGTDWLPYEESYRTRFRFTNTGQPENVRDIKEKLGYLALEFQPKKGTGGFNFFLEKNYQLAGGPG

SEQ ID NO: 988635 - protein, 44 aa, Homo sapiens
TEAHLDVGVHVFAVWTQLRCFDEQISHLVVQKLPAVKPKSEAGE

SEQ ID NO: 988636 - protein, 53 aa, Homo sapiens
RWVNSTCRSTLKTWGLCDETRLGIFGDCPMAQEVRNIIIHPTSLNGYLKLVSY

SEQ ID NO: 988637 - protein, 64 aa, Homo sapiens
MVERDYHLIDISQTPNANKVERGSETAGDKLPGSRGKQPKSPAKGPKCVLSGKGCGIAKTTKRL

SEQ ID NO: 988638 - protein, 73 aa, Homo sapiens
MERIRMDIRKVDAVFVGTGDLVASHSPGVDTQSTPSNLKVACREDLCLPLHQRSAELTDPCVQNAHGRGKDVR

SEQ ID NO: 988639 - protein, 33 aa, Homo sapiens
QGSKDPAEGDGAQPEETTRDGDKPEETQGKAEK

SEQ ID NO: 988640 - protein, 45 aa, Homo sapiens
NPEFPLFGRLKQENGLSLGRGARNEPGYRHCTPPCVRYRASICNH

SEQ ID NO: 988641 - protein, 33 aa, Homo sapiens
TLAARMTASRLPASHFQPDRTNALVLASVALKS

SEQ ID NO: 988642 - protein, 60 aa, Homo sapiens
PLRVPDDHACIGNSTRRRTTYTVSDGHVTCTVDLVDDNVHVTVGLLTRPVDLGFTDTTLY

SEQ ID NO: 988643 - protein, 70 aa, Homo sapiens
TLKDPLMPPDLFISLEEQHWDDDEQNGHEDAQNQGPYVQALGGGGISLGPGHVANHLSVPRLHGVGECYE

SEQ ID NO: 988644 - protein, 134 aa, Homo sapiens
VSSPPPPLIRGGHGLPGWLSGNFPSTQAPPANPLRHRPGFPDLISSRSPTPLRLSGFLAASGTFQARKLHRQTPSGTFRGSRTSSPPPPRLLSRRHHHSGPLRGSIPGRPGLHELRVLGRVLPIRLPGQEETGR

SEQ ID NO: 988645 - protein, 79 aa, Homo sapiens
MGKCRNDSGLSVPQKGVVSHFTSGEGHIRALGTVTACRPECNSLLFYLSSSSSTSGSDHSSSDHSSKENQSIDAHDGDG

SEQ ID NO: 988646 - protein, 48 aa, Homo sapiens
IFTASWYCSGDADCVIPVHQNQSFQISTFDLSTAGLVNKQSFGNGGKI

SEQ ID NO: 988647 - protein, 107 aa, Homo sapiens
PGRAGVLTGKVCPLPSQMAASKISTHPSEPGANLNFPGKVAFHHHHHNHHHHHQHQNQSPSSPFPSRLVSLSLSPGLFLSLSLSLSRSGSFFLSLSLSLSVCVCLGS

SEQ ID NO: 988648 - protein, 90 aa, Homo sapiens
RVSSDGESYAGHLHPHPGRCWVMQDPSMNLQGLAVGKGLSSYEQNDNSRVYLAYYHGLLGNRLGSSLQTHGGSQNKCNFYDNKDRECVTN

SEQ ID NO: 988649 - protein, 70 aa, Homo sapiens
RVSSTSISRGKEGPGQPSIGMTDCQVACQDFGMRRGDGWMEVKVEDYRGDARDYSIDVSTLFRPRSDNLC

SEQ ID NO: 988650 - protein, 130 aa, Homo sapiens
LLFFLSFLLLLLVLVITEGRQHLGQVEALQHLRKRFTAFFSQVVAIQVQLLQLSLVGQGLSNSQGSIPLDFKKDKFSSFSWGRPPRMASARATAPWERTRQSPKLITSTGRKVFKVSARATAPFSGKVWS

SEQ ID NO: 988651 - protein, 102 aa, Homo sapiens
STTSLVKAELPDTGGKHSQNEITFFPGEDAKNRQNVNEQWTPLMYAFFTNQRKTTVLLEAQEAPRVQCTHLGGERFHTLEVEDVIQVHVVEVFAVNEKVEHV

SEQ ID NO: 988652 - protein, 151 aa, Homo sapiens
GFFDRELLPTFQNSVEGRAQWLTPIIPAPWEPRQADHLRSGVGDQPGQHGETPSLLKIQKLTGHGGTCLKSQLLGRPRWENHLNPGGRGCSEPRWYHCTPAGVTEQLALETNKIVLSVLFGSLTFYIKSDLWKEFPYRHQEKGFKRGESGR

SEQ ID NO: 988653 - protein, 124 aa, Homo sapiens
PESKQSQTVFEGKLTRCIQHLTRHKHIRKGERATKHGQGKTKSHEVGVCVDLSFLMAKVKREMLLTAQNQPDWFEVLFFSSPNKFTGAFFASLMMAFAVSLALSLKALTTLFIWDLCFKKKGPM

SEQ ID NO: 988654 - protein, 117 aa, Homo sapiens
QSPNSAQSANSAHLLENSTATVSEAQRKAHVYYRARVSETTISELKATPLMELIERLGGWNITSPWAQGNFHDTLPVGTGHYRTLPFFFVYVSGDSQNSNRNLIQVDQSGLGLASRD

SEQ ID NO: 988655 - protein, 86 aa, Homo sapiens
DIYVWEEEGVIFSGEKKMTIMVREKLVIHAPGILLVRECARAQHRTLNTKALTLESQGTIYIKESGPCHGNPMVRSQIKLKSGGLV

SEQ ID NO: 988656 - protein, 67 aa, Homo sapiens
GAKTMKPESPGLLTQTRPWTQVGCEGGRSAVGLRISLFPVLPSRVSEPEGGTGLDSSSQLPRGHFPV

SEQ ID NO: 988657 - protein, 46 aa, Homo sapiens
LSPQRVAVDLFAGGDDLAIRDLFHKGTHRTGGHRFFLVLSQVGILS

SEQ ID NO: 988658 - protein, 94 aa, Homo sapiens
KTAFLREYATWRGELITDTGSRGGPRAKYADEWIIFSETLRVKKRLRIQAEKLAALYEVKHDETMTRMVARYDVTDLTKIEMRSALSTQCEQGS

SEQ ID NO: 988659 - protein, 47 aa, Homo sapiens
HYRTYDIINFFFSVNELKLNLTDCFTLLSSPNIASSTCDGNVEPAVH

SEQ ID NO: 988660 - protein, 63 aa, Homo sapiens
MIWQIQSLSIMVIPHLNYKSEKKIFELKDIQIWEHGETRKFLLLLLATSFNDFFWTYHTHYNN

SEQ ID NO: 988661 - protein, 64 aa, Homo sapiens
RIPEFPLCGILLLVTLCELAFCKDHRGLKRHMTVHEVLGWPSDWTGSLLTATGGGSAYQDDRFH

SEQ ID NO: 988662 - protein, 43 aa, Homo sapiens
HTTSSVREWEVPQKNAHLKDSDITKPVAAIQALAALLAASDYT

SEQ ID NO: 988663 - protein, 59 aa, Homo sapiens
TPLSETDFKLAAPTLGRIPECTACTRSYKRVRVEAWRQGNRHRGLSERYGRHVGLLTTY

SEQ ID NO: 988664 - protein, 170 aa, Homo sapiens
WLRHGVSSEAVAKMSVGLLGIKGMTAPRGCTLRKLVHVAGKFRTSCWQETTNPCHVDLSTGLLEYPRSMATGFSRANNSREGKVEASLSFLFLRWSLTVSPRLECSGVISAHCNLRLPGSSDFPASTTQVAGITEVCHHAQLIFVFLVETGFHHVGQAGLKLLTSGDPPA

SEQ ID NO: 988665 - protein, 49 aa, Homo sapiens
TIRELRAALTDLTLSSWRIALSDPAAKENCMMHLLRSLPDPNLITWVPS

SEQ ID NO: 988666 - protein, 62 aa, Homo sapiens
MPLNDAYAICHLFFKFFYFTFPSFMIICTIRIELFSTIWISVNSLRYNTQGRCLKWKISELY

SEQ ID NO: 988667 - protein, 54 aa, Homo sapiens
MPRVCDPRRTKLAGLAKDALANDIHIVPADINHSSHRYENGFDAARGQKILYAP

SEQ ID NO: 988668 - protein, 41 aa, Homo sapiens
SGAWAAHLILPVLSLSIVQAAVMTRYVRSAFIDVLTDDHMQ

SEQ ID NO: 988669 - protein, 74 aa, Homo sapiens
IRLKSNGLKNPSCVFGGAIIINVPVNANQCLIGFLCMSNFLCDTVWCQSFCIFLNRSWHKCKGFPRLSPWSVSP

SEQ ID NO: 988670 - protein, 49 aa, Homo sapiens
VPYFLLYEEEEEDMVVEDLVMTTMEEEIMEEEDEEESESEAKSVKVKIK

SEQ ID NO: 988671 - protein, 41 aa, Homo sapiens
EEEEGLEDIDEERDEDEGEEDEDDYERDEGEEDERKDDLIE

SEQ ID NO: 988672 - protein, 42 aa, Homo sapiens
SEKVLNLPPPGSCEFLQEVNREDASSQKLSITARSSPVLGLL

SEQ ID NO: 988673 - protein, 46 aa, Homo sapiens
GTFMAEETSAKVLRYGWSRVSKGKSDSMMNACTPVQGLYMTSGDGL

SEQ ID NO: 988674 - protein, 42 aa, Homo sapiens
DTCDSSDSSLASTLAGAAAAAGAAVVQQPQGQQPQRQNDQPR

SEQ ID NO: 988675 - protein, 44 aa, Homo sapiens
YYTEFTSSEKDEYACRVKHVTLSQPKMLSGGEFSVVQEIERPVL

SEQ ID NO: 988676 - protein, 183 aa, Homo sapiens
RHPRGTNGYCLRFAERSLRPWRLDQHPGFLFQHSILGPSAALVHGPLSGKELGGLPWAEHCSESPGAQVRPSCPAGKGPGPATQFSSGSFPASSSSFRPYLRILCLFGYQEAPPGPKDSGFVLTVTGPSFPGLPGSAGPVWLSFSLESSCTLRPLWVSSCYTDEETEAGEAASGRFFSQGLKR

SEQ ID NO: 988677 - protein, 41 aa, Homo sapiens
VQTVLRVKTVPRVQTVLIVQTVLRVQTVRRVSNSAQSPNSA

SEQ ID NO: 988678 - protein, 57 aa, Homo sapiens
MKALRRCLHDVITNQSSACQKKKVTETLLNGGSDYDSIKGPTMPGCIIFDAHECMIE

SEQ ID NO: 988679 - protein, 87 aa, Homo sapiens
GKGTLNKGGQRQRWGATVHGDGEALLSGEGGMILVGQRQPPGSNGTQPTLMKTSLTHIQGLCFLTLKLETLLATKDSGWGSAFGEPD

SEQ ID NO: 988680 - protein, 88 aa, Homo sapiens
TVPLDHNQPNPEPNTATVPLDHSQTPTEPNTATVLLDHSQPNPNRAQHRHSSARSQSTKPQQSPTPPQFRYITTKPQQSPTPPQFRYI

SEQ ID NO: 988681 - protein, 36 aa, Homo sapiens
NLAIALALRQPLRGLLLFYPVVTLLPDDYGTSWQEF

SEQ ID NO: 988682 - protein, 67 aa, Homo sapiens
LGDSQDGDTVFTASSSCLVRPWAGDKEEAQIINRLLLPSSHGCLLCTRGRPQQSAQPTTSLTHILPE

SEQ ID NO: 988683 - protein, 129 aa, Homo sapiens
MAAGTLFSYPENWRSFKAAIAAQHSGAHLRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATE

SEQ ID NO: 988684 - protein, 48 aa, Homo sapiens
GRKLSLLASRAAPLALVIWAAVSAAVMSSGPSLRRCNPCRLGYTGYTR

SEQ ID NO: 988685 - protein, 82 aa, Homo sapiens
TPQAPSSKRYFVCLATVLTFRRNLYRRLHRSGEYTSTRLPSLRYLEVITVLTCRRNLYQGGMHRSGEYTSTWRHSMHSSGNW

SEQ ID NO: 988686 - protein, 136 aa, Homo sapiens
RVQTVLRVQTVPRVQTVLIVQTVPIFLTVPRVQTVPRVQTVPRVQTVPRAQTVPRVHIVPRVQTVPRVHTVPIVQTVPRVQTVPRVQTVPIVQTVRRVQTVPRVQTVPRVQTVPIVLTVLGVQTVPRVQTCAHRIT

SEQ ID NO: 988687 - protein, 47 aa, Homo sapiens
WKADFKGSPRVQTGPSPSCSPSCCLTVIKLLVYDLHAARIDFQIWRL

SEQ ID NO: 988688 - protein, 36 aa, Homo sapiens
DPLLPDPPINNPPSRKLQTFSSVLDTKWKVSLTIGC

SEQ ID NO: 988689 - protein, 49 aa, Homo sapiens
ESKQCPESKQCPESKQCPESKQCPESKQCHLIPTLGSGSSPLSGLEWSI

SEQ ID NO: 988690 - protein, 42 aa, Homo sapiens
LGPHRPGLAAADTQVPGRPQFELDIEPKVSSRLSSTEALNDS

SEQ ID NO: 988691 - protein, 57 aa, Homo sapiens
LDVSDRGQEGEIVNLRNRWSSLGRKTVSDSPVVEQVFHIRKTTIDIDQLVGDRPMSS

SEQ ID NO: 988692 - protein, 30 aa, Homo sapiens
MRWCGTKYRPATEEQVSAHQEAGSSQAELY

SEQ ID NO: 988693 - protein, 35 aa, Homo sapiens
MPFCGSEEADKFTGSLQANAQSLKEYRSILILFPR

SEQ ID NO: 988694 - protein, 39 aa, Homo sapiens
SEARVDTSVVGGLQCVQGLPNSRGSLYVLYVLLCQGLGG

SEQ ID NO: 988695 - protein, 38 aa, Homo sapiens
SSLTDALLLIFLFFCLFLLLFLFFFFLLFLLLLFTSVV

SEQ ID NO: 988696 - protein, 37 aa, Homo sapiens
RVLLQKLHHAKAVVFHGVDMRGAAALNVHCVDIGTTH

SEQ ID NO: 988697 - protein, 72 aa, Homo sapiens
VDPLKSTRLILTNILEVTHGAHVLDENLYSVGMHRSGEYTSTKAPSLRYLEVITVLTCRRNLSREACTAVVN

SEQ ID NO: 988698 - protein, 46 aa, Homo sapiens
GATPHKALNTLLSAQDAHQRPGPASVLPGGPVTCLSERGHAHYGWS

SEQ ID NO: 988699 - protein, 30 aa, Homo sapiens
MAHHNYPHTPYTMPDHPTKRETQTTTYLPD

SEQ ID NO: 988700 - protein, 105 aa, Homo sapiens
GHLMEQQNKIITASVDNANILLQIDHARLAADDYRTRFETEQALHLSVEAEINGLRVVLDDLTLAEPDLEMQIENLKDVSLANLKKKPRWRRGPALQGQVGVEIK

SEQ ID NO: 988701 - protein, 98 aa, Homo sapiens
MLLLLPILQVFAEPLNAQAIQVGSQLAPPSRAASHLRYGDLEPAMSCRWSNERSVLDSGLMYSLPVVGVLPVPAEEAPVRPHVAAIHYLDGVRTGLAL

SEQ ID NO: 988702 - protein, 33 aa, Homo sapiens
MRTVHTTRRERPSAPARSHASTAGCETRPRSDG

SEQ ID NO: 988703 - protein, 50 aa, Homo sapiens
MEGSNGGSSRASSCLLSTRISAELTTECVHTHELWAWMFHVTGSVTVVRS

SEQ ID NO: 988704 - protein, 53 aa, Homo sapiens
MYGCDLGPDVRLLRGYNQLAYDGKDYFALNEDLSSWTAADTAVQITQRSSRRA

SEQ ID NO: 988705 - protein, 109 aa, Homo sapiens
NLMLNSLTGPATMLSTSFHRPKTSTTFLESPQIENNSWVRDIPAVPAAFLVINGLGGRVPPRPWWRRNLVNPSPVQFGSFWGGIPYWGFPILPRLMALRILTGPMALPL

SEQ ID NO: 988706 - protein, 45 aa, Homo sapiens
VSKYDPEQTSYVDAKEATVYVANSEEIIGRGDNYLSLVIAGCPDR

SEQ ID NO: 988707 - protein, 103 aa, Homo sapiens
MYRNLCTYSTQFCSELLPDRLIQTLQQTHYAVTSGTNVGLPPVHSGRYEPEVVNSDSSPSNTVTYLHYRLTTSQPSPAHYSYPIQASSTNASLISTSSTIANI

SEQ ID NO: 988708 - protein, 56 aa, Homo sapiens
RERTTGRGFTLAWVKRIYIKTCYGQKLKGILPLSPFISFDHRLQNIAYKINPMPLS

SEQ ID NO: 988709 - protein, 36 aa, Homo sapiens
RNEIAHNSMKKVRGTAKANVGAGKKPKEKGAAMMLA

SEQ ID NO: 988710 - protein, 49 aa, Homo sapiens
VRQIQTVPRVLTVPIVQTESRVQTVPRVLTVPRVQTVLIVQTVPRVQTV

SEQ ID NO: 988711 - protein, 85 aa, Homo sapiens
QCLLSFIADQAGARKIYAVEACTMAQHAEVLVKSNNPTDRILDIPGKVEEVSLHEQEDIILKEPMVYMLYNELMLESYYTHKKYL

SEQ ID NO: 988712 - protein, 116 aa, Homo sapiens
VLVTLVLHTQAARGVVADLPAHRAVIFNFLYESLLAGAGRPGYGRGCPWPAEPRVIISRKGWNMAWKFKGSYGEKGIKLRTMRDLGKKNGGLLVGQLQGRNGRYSGAPSVKNQFRK

SEQ ID NO: 988713 - protein, 119 aa, Homo sapiens
SQDPPEPNSALVFHSFSTHNPQSQWHLSPSLTYPDLAAVCSGPPPSHHHHSHRPAPHRHLRAVAGQGCHFPCWGLQVWGCMSLNCRRMRSHDFPSAKLERDNRHSHRTDWLVPCHYSDS

SEQ ID NO: 988714 - protein, 55 aa, Homo sapiens
SSVPQSPNRALYIKSTMGKPQLPILRHCLDSGHCLDSEHCLDFGHCLDSEHCLDF

SEQ ID NO: 988715 - protein, 41 aa, Homo sapiens
MGWWTYNVLVLFTLGSLAALGGGLGFLGPLKPCCCRYYSYK

SEQ ID NO: 988716 - protein, 35 aa, Homo sapiens
ESKQCPESKQCPESAMEREKEQFRRLFIGGLSFEP

SEQ ID NO: 988717 - protein, 70 aa, Homo sapiens
NNAFWEGGKELDAPGTQSTQCLAAAAVLGLEGTPTGDTSTKECVAQRGRLLLEPPHSELHTFRKSLCRMG

SEQ ID NO: 988718 - protein, 44 aa, Homo sapiens
LSSTASSIEDTFVGYLTGIVWGAGYRMTLLRRCAAMRGYNTGDD

SEQ ID NO: 988719 - protein, 71 aa, Homo sapiens
QSPNSAHSPNSAQSPNSAQSPNSAQSPNSAQSPISAQSPNFAIPQPVFLIPPVFYFGLLEAGLYLDQVFVF

SEQ ID NO: 988720 - protein, 55 aa, Homo sapiens
TLARYPSGHCLDSEHCLDSGHCLGSGHCLDSGHCLDSGHCLDSEHCLDSGHCLGS

SEQ ID NO: 988721 - protein, 72 aa, Homo sapiens
TMIRPQHVVFHSGMLFNTYEVMLSPSILYSRENNIYPPNSDSPPIFYRMNIDIPREAFRSQGSAMKPQPKLT

SEQ ID NO: 988722 - protein, 38 aa, Homo sapiens
IKWVEDENQVFPTYNQLTSCSLNFSIRSQSSSFPVRCA

SEQ ID NO: 988723 - protein, 51 aa, Homo sapiens
IRHYDCSISAIIHHHRGLVLSSHVESGTSHIMFQTKPGRVWTQTWSGVILL

SEQ ID NO: 988724 - protein, 42 aa, Homo sapiens
SCSSLFSTSKLRSVLVIAHAALSSDFDTVDELMLPFSLIFIL

SEQ ID NO: 988725 - protein, 45 aa, Homo sapiens
VLNSLSSLQRCGSPGALLLQRIATLVSGIAGGAIPGAGTRVCARP

SEQ ID NO: 988726 - protein, 45 aa, Homo sapiens
MAVPWGFRSPQHRTVPLLFHWSLFVMLVKSILGEEPHWRCVQNRH

SEQ ID NO: 988727 - protein, 76 aa, Homo sapiens
SEILASISHVFTTSPYEPSCLAQLLTNHAHISAPASSRNPGITTKLPTFSCVTPQSLARVYLQTSGTLLSVPATFQ

SEQ ID NO: 988728 - protein, 64 aa, Homo sapiens
FCRKHAARLPRGSLFHGCGILVCGGLLARRLLWNMAAFQNQTQRGNDMDAAVTEAAPAQSWAPL

SEQ ID NO: 988729 - protein, 36 aa, Homo sapiens
ILDLLSACMVQPAQYLTSSRKPLESTPEASWRRSRY

SEQ ID NO: 988730 - protein, 33 aa, Homo sapiens
ESDIIEDPGIDYLCRRTCSGKVVIVMQRHDRRD

SEQ ID NO: 988731 - protein, 37 aa, Homo sapiens
MQFRKPLQHLRHPQPGSDVSTSMARHSRVYVIDDVQA

SEQ ID NO: 988732 - protein, 37 aa, Homo sapiens
AGLRRSRYARRSRSRRSRYAGIPGPSLHYYPLTRALP

SEQ ID NO: 988733 - protein, 46 aa, Homo sapiens
SWHEDISYEVIALYRRRSTHQRRLKKGVDHHPVSARSTPSSNCLAV

SEQ ID NO: 988734 - protein, 74 aa, Homo sapiens
YLDLLAYLDLLAYLDLLAYLDLLAYLDLLAYLDLLGSFQPLEPKASESLGMFPIQKFRQWVSGWPLRGLPALMF

SEQ ID NO: 988735 - protein, 34 aa, Homo sapiens
MLFPPELSGSVSLNLKEHHCALRRSIPCVTSMAM

SEQ ID NO: 988736 - protein, 31 aa, Homo sapiens
MPGQRQALGWSGLTCQRLCHRRDRGRVRRAL

SEQ ID NO: 988737 - protein, 159 aa, Homo sapiens
SFPLLLVRWPTAAQVLRLSSSVSAGPCFERLLPGVSWTERRTSPCPTCACVLLAFARLNFHPDQEDQFFSLVHEKLGSELSRLETALQVDLVWALCVLQQAREAELQAVLHPEFHIQFLGGKSQKDQNTFQKLLHINANALLEYPEYSGPPSGCLGWWP

SEQ ID NO: 988738 - protein, 70 aa, Homo sapiens
RIASGSAELARHGGRLPHLPIALRNQHRQPTLAVRQGLCLASAPITMMEAPKPLTCATEDAIRLTPCTPV

SEQ ID NO: 988739 - protein, 54 aa, Homo sapiens
FSCHTIPLKCCLFQSASSSVWQSSAGKCIVEQGTYSTQPGVAVAAVGGCGIGRR

SEQ ID NO: 988740 - protein, 138 aa, Homo sapiens
MGDSPTSGDRRWSHLGRQDVSGIGGFLVSVTSRMKLWTLAVSVTVLKDGVSGVCSFCCSDMSRLSSSGGFMVSLTSRVKPQTFAVSATALKGGTSGGVSSSQWVHGLTDFRRMLQTFTVSVTAHKGSTDPKSEQQQDL

SEQ ID NO: 988741 - protein, 34 aa, Homo sapiens
RKCMKSESLVRITDRLTGIAQGGLTLFADCRDEI

SEQ ID NO: 988742 - protein, 33 aa, Homo sapiens
TQAHFFTRSNWITPYYTYAYKTLPNYQLQKCAW

SEQ ID NO: 988743 - protein, 61 aa, Homo sapiens
MGGQTGRVPIILQIPVEPLCPTGSVPDIFSVSLFSSLMKDTGAMGKQLGLPTIYFRWGGPE

SEQ ID NO: 988744 - protein, 68 aa, Homo sapiens
PRRTSPRKQTDLLLFSNRGKPKALSITSLISRLQSLHHHMMGSNSEGRCAPTGSSPEHWTQKCAWVRL

SEQ ID NO: 988745 - protein, 34 aa, Homo sapiens
SCKIIIREQVGLISFVMKGKISFHDYTLSPSDPS

SEQ ID NO: 988746 - protein, 51 aa, Homo sapiens
MDGGNQRGKGMPPQAFDTAFKITLFLCLIRSSPILGVTDARISANTWISRL

SEQ ID NO: 988747 - protein, 131 aa, Homo sapiens
IGRSVHSSIHLIHASVYPSIHLSTYPSSAIYSSIHPSIHPLIYLPIIYHLFTHPSLSSMHPSIHPYIYLRNQQLTSIHPTIQLIHASNYSSSYLSISYHLFTHPSISSMHPYIHPFIYLPVHHVPSIHPTI

SEQ ID NO: 988748 - protein, 43 aa, Homo sapiens
MGQSDFGCCCCRFRELEEGCGWACADCRRGADLEPLVLSAWLD

SEQ ID NO: 988749 - protein, 66 aa, Homo sapiens
QHIHNYEKEVKQLRKANDILKKVHVYYTMTDHAKKVHCNSRFGCECYHCIFCLVNMPSVLDYFGST

SEQ ID NO: 988750 - protein, 35 aa, Homo sapiens
PASAGQMAGGAVLTETVFAWPGIGRLMFDALLQRD

SEQ ID NO: 988751 - protein, 113 aa, Homo sapiens
MLVSTRVLMPTRLQLEFLRRRGRDSLAKKTQGNEGVLRGESRPCQLRISPQLKVSFPQAGLRRSLGQREEQQQGGTGAFYISFRSSRVWSSILCVQRCSSLVHFSLSSRSSIV

SEQ ID NO: 988752 - protein, 38 aa, Homo sapiens
LFTCERDYTGNSITNGDASPRISGMLQHQSGRNRHHDP

SEQ ID NO: 988753 - protein, 88 aa, Homo sapiens
PRPDTARCSAFTWRLQVLRPPIVDHHVIGQCQPLCAAGLGGDHPVGQRGVDAVALHQPGVLHCFRCIHQQHPVQPRIGVTPTDLGQQR

SEQ ID NO: 988754 - protein, 108 aa, Homo sapiens
MVTEATVRSGATAVHAVERLMKELYQRCERMRPTLFRLASDTEDNDEALAEILQANDNLTQVINLYKQLVRGEEVNGDATAGSIPGLSDPTPPSGPSLDGTGWNSFQS

SEQ ID NO: 988755 - protein, 120 aa, Homo sapiens
MAIRMSITSGVNQLIVPPPADVYLSTHQDRRDPWQAERQTNLALGQGFTQTHRQTQGLARTAELHQAARVDAERRRVGRVDHHVGFRHALLDHVRALRHFVTAEQVVVRRDTPAVVRIER

SEQ ID NO: 988756 - protein, 61 aa, Homo sapiens
MAMPHLFSPIGISDLPGVVLGLVVPYAREVGAGEWLGPCEAEPCIDDCTYCIPVLEQRSET

SEQ ID NO: 988757 - protein, 47 aa, Homo sapiens
AGYAGQADCGKIAIMAQNRQGCSELKSHHCTPACGDKCETLVSTKKK

SEQ ID NO: 988758 - protein, 44 aa, Homo sapiens
LYSKMTGSQRIGMFGAQKDDLPAILRNAARRRVLKPGHVLRHWR

SEQ ID NO: 988759 - protein, 52 aa, Homo sapiens
SGSNSTGYGKPSLTAQRYYLFEEVSSDAYTFSRRTSTSLGLERPFALWDGRE

SEQ ID NO: 988760 - protein, 48 aa, Homo sapiens
EDPRRCPLTGQYTHYSLDKKTHKPDYVTDLRALPPPLWATGVKTYDGA

SEQ ID NO: 988761 - protein, 51 aa, Homo sapiens
PDLGARRAGALGVNGVILDYNLLANRYMSGSGGNTASYTLYGTAGVNLGYR

SEQ ID NO: 988762 - protein, 47 aa, Homo sapiens
YCDLLNPAVFELQSGESLARVASEAPLRWCYRPRQHYRTYESLDYVL

SEQ ID NO: 988763 - protein, 84 aa, Homo sapiens
LLEDPRLTAPRREGTVCQQLGRFWMLILVECSRRSRSRLRVAKYSTVGAITPEGNIRLKLVCVPLTLKGKAGIKGQLVGVYFLI

SEQ ID NO: 988764 - protein, 51 aa, Homo sapiens
MYPRAYLDLLAYLDLLAYLTFWHTWTFWHTCDLYALVISALQVTQYKKVQV

SEQ ID NO: 988765 - protein, 147 aa, Homo sapiens
SQCDRLCVAKLPVQVCTCHRNILKVYLTAGAMKKKKKKKPWELGKTGGVLPTGRAQEKVRGCQGGWLQEVPKVGARGIGGLGEAGGAFYHWFFLGPSDVSSLNGAHILFMKMTKPIHNRGMNTPLVVISAFRNKWVLWPSSLMNGRV

SEQ ID NO: 988766 - protein, 36 aa, Homo sapiens
NDGSRWTRMNGGTGSYIMFKLLRSSNLQAEKMVDRE

SEQ ID NO: 988767 - protein, 31 aa, Homo sapiens
MALQHTVWRTLFGSLPTRCDNQGLCRKMHPV

SEQ ID NO: 988768 - protein, 95 aa, Homo sapiens
PYHGHSLTRDEKSRSTKKNERYLSLGKISGEEEWRIGIEIHVDKLKWSLSKSCHSSTTLKKYQNARGCKLKRPHRIYCSHKDLIALAQALWPHIM

SEQ ID NO: 988769 - protein, 33 aa, Homo sapiens
PNVLRHFASFPDSVATAPAPTHLAKHVCSRHIE

SEQ ID NO: 988770 - protein, 34 aa, Homo sapiens
RARYLTALKSYFQYSSELAKDYEIIYTPCHRSHI

SEQ ID NO: 988771 - protein, 47 aa, Homo sapiens
MLFNDDVGTLRDVSRFFQQLGGTHRQIVGLGHARQALALPAHLAVFT

SEQ ID NO: 988772 - protein, 64 aa, Homo sapiens
MKIKRGKKYHKQLESKEVSESMELCAAVEVMEQGVPEKEETPPPVEPEEEEDTEDAGLDDWEAM

SEQ ID NO: 988773 - protein, 35 aa, Homo sapiens
MSVPPSLFIVAGFGLRDRVGDQETLHLGAVDFAQK

SEQ ID NO: 988774 - protein, 52 aa, Homo sapiens
VHMAVETGGRSEVRKEDENGDYTFGQVDNTFLENTPEAVAQAVKTRFELWTG

SEQ ID NO: 988775 - protein, 109 aa, Homo sapiens
GFFPPRRECRGTVLAHGNLDLPGSSDSPASASRVAGITGYAPPTTPGQIFLVFLCKRHGFHTSWARALSSNLLDSHGISPGSLALHKVAGVLQGLEPPAPGPGVYKYFN

SEQ ID NO: 988776 - protein, 57 aa, Homo sapiens
RNDGKPLTRLGAAWAPPHWIRSAADTLLHPEGCKSVVVSATTAIINGQMDAAKASVR

SEQ ID NO: 988777 - protein, 38 aa, Homo sapiens
MAISSACSFGDRFSIVTQADVPAAWCLLYSLTIAVISA

SEQ ID NO: 988778 - protein, 80 aa, Homo sapiens
IRIKPLRTLAWSGSIGEPLPRLGAAMGPASLDLKCSRYPDWIRRGEVSGGVCNNSNQSVVDGERKLSSNQNNHGPHSMQL

SEQ ID NO: 988779 - protein, 39 aa, Homo sapiens
VPRGSNLGNSALQRQPQRREQDEGAAQDQRVHACTVLRR

SEQ ID NO: 988780 - protein, 140 aa, Homo sapiens
HYLDFSGRIHISKATLDCLNGDYYVEEGHGKERNEFLRKHNIETYLIKQPEDSLLSLPEDIVKESVSSSDRRNSGATFTEGSWSPELPFDNIVGKQNVSPLFLLLLGHECMLVCISNPDTSEKTDSSLTFSPMNTIIAND

SEQ ID NO: 988781 - protein, 73 aa, Homo sapiens
TQAHFWNKTPALGQAPWLTPVIPALWEAETGGSRGQEIETILANMVKPRLYYKYKKIEPGVVAGICSPSYSGG

SEQ ID NO: 988782 - protein, 40 aa, Homo sapiens
TQAHFCTHGALLDPGALINAVAICLRCAIVPGVRISASMS

SEQ ID NO: 988783 - protein, 79 aa, Homo sapiens
PVHCASYQPAYLLGSRPRTPGLSHEKGGDPTQSWVTPQLLWRLGSGRLVAQVLQVGSFCGPRVGDAVLGEQTFQPFDLL

SEQ ID NO: 988784 - protein, 46 aa, Homo sapiens
TQAHFWYPIYRRPLLMTSSPKNSPETQTISTLADSLFLLFSPLLNR

SEQ ID NO: 988785 - protein, 38 aa, Homo sapiens
PAVSYLARQHFKKRKIQDLAIRCVQEEHQEEQRGEVTG

SEQ ID NO: 988786 - protein, 130 aa, Homo sapiens
CSYVMPPESPDSEGAALLTPGSPIILTIGSGRSVPPARPGALLCHWPDLVHLGVLTSSDSLKPSSWGQCGISTGHLLSSCLPAGPRNFCSARILCGDSASGRCSFFQFPNLGKYFDPQQASLAYPGGSVF

SEQ ID NO: 988787 - protein, 46 aa, Homo sapiens
MALARELLSTGGILRLRCPVVLTEQHYSGRDGRAHEQDELTEASHF

SEQ ID NO: 988788 - protein, 70 aa, Homo sapiens
EDPAPGALLEERIRSQYHGPEVQDVARGSLKREEFVNTAENQKHEYGGKLPTEMTAAEHSAGTLAEVRLV

SEQ ID NO: 988789 - protein, 37 aa, Homo sapiens
DLYTGYLDLLLPSSTPASIFQYFLHSRTNTTTNREKV

SEQ ID NO: 988790 - protein, 50 aa, Homo sapiens
VDSHLGQLPISKQELSLGCQESPRTGGVAGRRRIRARKQIIGEGGQAKPE

SEQ ID NO: 988791 - protein, 44 aa, Homo sapiens
TRLSRSAPSITAPDVLAIRFSLHCSSVSSSGFGGLSFGSPRSLL

SEQ ID NO: 988792 - protein, 120 aa, Homo sapiens
MPMRVTFIKSSVILDHLLRVSHESITSDTSHMESSPIAAYPSHCTSVLVGSCLCWETNRIGRCSLGCSPIWQPVEVLVLLIVLERYSPPLQLHLEATQVLRYRDLLRLRVRARFRDSSSN

SEQ ID NO: 988793 - protein, 35 aa, Homo sapiens
DRARPGYWTSGIPGLLASWTFWHTWTFSNSLNPSA

SEQ ID NO: 988794 - protein, 87 aa, Homo sapiens
MPDLLRLLDTSVVRELIEDEDSGKSRWSPEEPIGELLMVGRKELICPQYTLASTFLYPREAGPSADSGNILAAVRVRNGIGVARGVL

SEQ ID NO: 988795 - protein, 62 aa, Homo sapiens
SRLSLEHRESNNPTWEQHWALPHWITIAADTLLDPEGCKSVVVSATTAISSGRWRAKAQFEL

SEQ ID NO: 988796 - protein, 68 aa, Homo sapiens
LSLVRNVSEPLPRLGAAMGPASLHLKCSRYPAGSGGVKVSGGVCKNSHQSVVDGELKAQYEIEQTPTT

SEQ ID NO: 988797 - protein, 51 aa, Homo sapiens
MVVPNRHELDTQNISLTLDGQQGGTLFSLPTTTTGYSNIAGYSNTGPGAAT

SEQ ID NO: 988798 - protein, 33 aa, Homo sapiens
YLPEVPKSHMKLVEHFYDQLLLTPHTTKPLRTF

SEQ ID NO: 988799 - protein, 102 aa, Homo sapiens
WSLVSAGSIYEISVEMSADSPRGDLIMVSQVLAQKVVCENPNTSQTMELVPNFQVKVGTSAFPMCPGTLLGTPARLLVGLPRSQASHSPPLGVWSQGPHIHH

SEQ ID NO: 988800 - protein, 51 aa, Homo sapiens
MTLLDGSQLQLYTILTRADHDVPCLCMRTHRTARVTDDLQDCMADKMMHIL

SEQ ID NO: 988801 - protein, 110 aa, Homo sapiens
MCGLPLMCTGTCLLACSPVMLARPPARPGAADWLSLPQVLPLGSPGPGHQLWRLGLELAVSVVSGRGGGGPRLLNLGTGGGTRGSTLLSHPIFRGTGSRERWGPTMTVHL

SEQ ID NO: 988802 - protein, 33 aa, Homo sapiens
TTIIRPALLDVRLRLPDQYHQTKDRNTITFLYF

SEQ ID NO: 988803 - protein, 59 aa, Homo sapiens
MIKTADLKVVGGKFYRDDDRDEKTIQSLQISAIILHPNYMTPSCLIADIAILKLLDKPR

SEQ ID NO: 988804 - protein, 77 aa, Homo sapiens
RSIRGASYIRGIIRGDLPGLQRADHRLAVEIGGVIGQIDEAARQLHAAHAQRAVVEIGLQDGDHVVLEVAERLHQVG

SEQ ID NO: 988805 - protein, 77 aa, Homo sapiens
PVPGHYSLNGHAWSTKEADLSTAIKQVAQERRDFMFIIAADAKAAHQDVIRVMDVAGQLGFVNVNISTKVPTRGFTE

SEQ ID NO: 988806 - protein, 127 aa, Homo sapiens
VVDLCLQGSAQTVPPGVPIPPEQSKRPLGVHVQRGIGTCLQMAMSRYGGFISCPQPSGACEVQLTNSHAQPLLKAAPCLRLVALVPSPRGLTLLGTEAIRSAQPVFLNGLGLPEGSKAEAHSESIVG

SEQ ID NO: 988807 - protein, 73 aa, Homo sapiens
PRIAVPAVCPGRSNTTMCVFSVVSNFLVQTAGDIQNHVAVIPGDKYLNVSFIISLRISRVGNGVEQLATVMGG

SEQ ID NO: 988808 - protein, 49 aa, Homo sapiens
LLRIPVDVLCGSRAPHVLVLLCVGPVGHKQAPMVSGRSHRVLGIKATSE

SEQ ID NO: 988809 - protein, 36 aa, Homo sapiens
VDRGLARTYAALKEIARSRGNGVSNMHEAEEWYRSK

SEQ ID NO: 988810 - protein, 35 aa, Homo sapiens
GYRAVTSLLSVQNKLRYLEQRISIKFCVKLNNATV

SEQ ID NO: 988811 - protein, 54 aa, Homo sapiens
MSRRGSRTSIIHVSAYICPEESGCTRGDPKPSPLVRQGPDPPARIHNPQATVNP

SEQ ID NO: 988812 - protein, 31 aa, Homo sapiens
MVDYRSVGSLLLTILEKQPSFKYQQRCDMSP

SEQ ID NO: 988813 - protein, 95 aa, Homo sapiens
MPEMNIMMPPGISMPDFDLHLKGPRVKWRCGCFSAKRWKVDLKAPEVDIKGPKVDFDAPDVDVHGPDWHLKMPKVTMPKFSMPGFKGEGPEVDVN

SEQ ID NO: 988814 - protein, 66 aa, Homo sapiens
VTRSGSALRLYGIVFASDIEGADFALTPADVWSALAAQTVQDGALAANAAKTWADVNAELPAQRLG

SEQ ID NO: 988815 - protein, 31 aa, Homo sapiens
MGLTDVAKLPGTTKSTPESADARRGCPHKRD

SEQ ID NO: 988816 - protein, 52 aa, Homo sapiens
KAGTVRNVLDQEGTGLDTEVEEGHLPVQTVLIYPPTPNHPPIIHPPIPPTES

SEQ ID NO: 988817 - protein, 61 aa, Homo sapiens
HGKQVLSHIHGGYVYPQGVMEPTTSCLYETASSMPVLEAEVLSAGMNLASVGSCICALSVS

SEQ ID NO: 988818 - protein, 68 aa, Homo sapiens
ARYDALSVGRCIADCIVRSFTWVSALISGCWRESKGHESRFPVHHYFLLCINCLHLSMILLQFLFHRH

SEQ ID NO: 988819 - protein, 41 aa, Homo sapiens
PLHTRIQLWVVGSTCWGGGPSLCCPTLDSNSCPARTSHTKS

SEQ ID NO: 988820 - protein, 84 aa, Homo sapiens
INRALPVNDSGTGVILYESQAPALTEFGGQHGAHVSTELVQGGMHRELVNTLSTMAPVLTSIWEVSTCAHCVDANLSRGGMHRQ

SEQ ID NO: 988821 - protein, 50 aa, Homo sapiens
VPHLSCLLYIVTQFPLDEHVFHIMQLPRYIHRTRHVGRVILSLVKAYEDK

SEQ ID NO: 988822 - protein, 51 aa, Homo sapiens
MPVVRPEATVDSTAWIATYIAGVLKVSNMIWVIFSRLALWVQGGLGQQHGV

SEQ ID NO: 988823 - protein, 40 aa, Homo sapiens
SVGTDALSVGAVVSGGDSPRRWGLCEVSLVDGGSEAEFTL

SEQ ID NO: 988824 - protein, 55 aa, Homo sapiens
RYPLLESFSSYAVDDTALKRSKRLSGFTSILITPSSSMPSSANVLSKAELVQLYV

SEQ ID NO: 988825 - protein, 137 aa, Homo sapiens
MKQQSECASDGGGGADDDTVKVEEAYEKWEKVMALSPMNTSACSPVCSIFERMSHFVSSHNPEAKCNWSPTTPTCMPSAIPIASSSISTSVPSSLHGAVLLGLTSLYPQLGARQPPSIPPSTSSLSTYTTDPPQRER

SEQ ID NO: 988826 - protein, 94 aa, Homo sapiens
MITAHCPIDRKIDFGKTIPEFSKTHLENLTCTSPGRPGHTIRPVRMNNCSRTCPMGALQQTVSGPGSWLSDVCLLGPRCSGDLQMPHRESVGDP

SEQ ID NO: 988827 - protein, 108 aa, Homo sapiens
LSLWGPLRAGSEDVFLYLTRPALPLRTWTSPRLPKEAQAAQHRLVCMPIPRGSRVARGRGRGRAAAAGGQTVQPGGEAGGAVWLGAHALGEGQFPFPTALSATPTERA

SEQ ID NO: 988828 - protein, 94 aa, Homo sapiens
MTIRINALQLSCELRLVISSQITLFFIPSSLAVKLCAIILDERLVLSPSVPLGLCPHISLPQHGGTTTGSETTGSSSTAHNSLHHPVSVEPVTP

SEQ ID NO: 988829 - protein, 70 aa, Homo sapiens
MTPAEHAATVCRPLRKRWVDCFQVSYRKNLRTWYLAKLSGSTVGGVDTSLSDLTEVAQYVSRRTGFLLRK

SEQ ID NO: 988830 - protein, 54 aa, Homo sapiens
TASKRRRGYGEAEDHFACIRTAVPWFSRQIQEHEQESALREQVSGVGWSRRWMQ

SEQ ID NO: 988831 - protein, 69 aa, Homo sapiens
LHPRPLTAHAAERCASAGPKGRVMCAISQDRLTHVQLLFTWNLSPVRATKFSLEYLLLPPRSAPAALDA

SEQ ID NO: 988832 - protein, 49 aa, Homo sapiens
TASNAAITPGEFCRIVSRDGVSLCKPGLVSISWTSVIRRASALPKMLGI

SEQ ID NO: 988833 - protein, 62 aa, Homo sapiens
LNLISLDMISLFNFLSLRHYWMCVLNLVVRPPPVGPHYPWSLYQGRPPSICDSQSGQPLYLL

SEQ ID NO: 988834 - protein, 50 aa, Homo sapiens
EDPIIDTVGDDRPTNTDSCLDDLERVGCAAADRSQITSEAMIAICTIMRT

SEQ ID NO: 988835 - protein, 81 aa, Homo sapiens
ARCAGEEEEERLNGGDMHIKRAPPGRMKRKTNARHNRLKNAPSCCAIATPGYDAYERNTHGAVRMIRSFKHKGLKKFFETG

SEQ ID NO: 988836 - protein, 41 aa, Homo sapiens
HVPASDIQRLLREAPQAIGLAAPDMPVGSPGMDCPAYGGRK

SEQ ID NO: 988837 - protein, 42 aa, Homo sapiens
MNDRLSRLAGALKVSTPRNSLPTNEFQALAITADINDLRHLR

SEQ ID NO: 988838 - protein, 36 aa, Homo sapiens
MWGVLAGWGAKKPGGCKHSYLLQDSVRELGWQSDFW

SEQ ID NO: 988839 - protein, 55 aa, Homo sapiens
MREGPWSSLGAGGPSSRYFSEILPSPRACGLALRIFGGMPQAWKVCGLPESQGAD

SEQ ID NO: 988840 - protein, 78 aa, Homo sapiens
SRPVAVISGCVALAWMWAAVAPNWLSLPATCAFMRISEWRRAQVCRALILRIFRPSTSLVSISVSLARVSTNWPVGEL

SEQ ID NO: 988841 - protein, 144 aa, Homo sapiens
VPRVSPVTGLEPSWGVGGRLRFRTLVIFLGMDRDQSPDLIAHVVSASPDGEGNARENVTEFGAIFPFSSVLGGMALPVFGCELESSSVESQVLVPRWSLELNKEERHWGSRGPDSCGGSCCHAGLPLEESHLSMSCYHTAVHPP

SEQ ID NO: 988842 - protein, 44 aa, Homo sapiens
MSGVWVSSFHSNCSRRMLLPRGSEGRPRHAGNAVSDQLPEVEGT

SEQ ID NO: 988843 - protein, 94 aa, Homo sapiens
ALEDPVLLGMRFGSGWLHVLIDRESQEMKPQRWAWPGVIKRPNARPRSVGPEELCRVLSKEGPMWFGLRGVRRTQIELGKQEGVENANWTGILL

SEQ ID NO: 988844 - protein, 47 aa, Homo sapiens
MDYVMDGMIHVCQPSVGMRRRDWNHTNGVRDFCKRVGVSKSDGIVDV

SEQ ID NO: 988845 - protein, 116 aa, Homo sapiens
PQPLADRHPRQQLSAVSLDLRFTEIGIRQRIEEQRGLLPAGGAFGGNLQLAVAVTGLDALRHPGGDRHLPHRLREVVVKLRIVRRRQIQTERVVGQNADVAAGGQRQGARQRAGYR

SEQ ID NO: 988846 - protein, 47 aa, Homo sapiens
MLLLSHGTFSLRLKVSLILYYTDLTGWSTGPRLGLRLTQRPPTRRGV

SEQ ID NO: 988847 - protein, 56 aa, Homo sapiens
TPLEGNILGTGAKHGTQQRNICPSNVFHSIQATQQSAQVQARIQHHLVQFHPSTRI

SEQ ID NO: 988848 - protein, 63 aa, Homo sapiens
MGSDPRIQCGDWRGGVMCGTRRPESEDRESSLTGEAGSLDVCLPRERGPCLGKRRGPGGVGWQ

SEQ ID NO: 988849 - protein, 105 aa, Homo sapiens
LNPTPRSGETSGNFHPCQKGKGSRHHMAREKPREKRRKCQGLLTTSSLENSRVRTHSSLQEWHQAIHEGCTPIFPTPPTKPHLQHWLSNYNMRLGGAWWAALDAV

SEQ ID NO: 988850 - protein, 144 aa, Homo sapiens
CINAAGYMVVYLKDKSCAITVTDQSCSRDMGEIARKHEYYNQVTQYRGPTDSIDVCLRRVRMIYTSDVDKNRAFDMGGSARCQVEDGSIPVSEEVLSLTGVGRIFPKKIPCLLLNYHWLNHSTLQIPVLITQSRFWDDRTKNLN

SEQ ID NO: 988851 - protein, 33 aa, Homo sapiens
PYCINASRTLRRDDRRALRRSTRAAALDAVGYR

SEQ ID NO: 988852 - protein, 50 aa, Homo sapiens
LDQRRPSLSRKGVLVEIWIFSPAIGGKKAFSLNSLSVTSGVGCSQRRWMQ

SEQ ID NO: 988853 - protein, 33 aa, Homo sapiens
RLTGVDLRYSSRKLWYAIFPTVACRGVGCSRVP

SEQ ID NO: 988854 - protein, 38 aa, Homo sapiens
CDLEDPDCINAAPDRVRSRIGVAALDAVSGVGCSRVPS

SEQ ID NO: 988855 - protein, 74 aa, Homo sapiens
VDLEDPDASNAAYRILHNFIYITQNVDSVWFVQYIHKIFDILLLGGGAEFPSHECGLDLVTPFMSRVWTGNKVT

SEQ ID NO: 988856 - protein, 69 aa, Homo sapiens
TASNVRSGKRGVPFHAVEACSLLFALNLAGAHSLGPRRLYELVTLTEKVCSFTPEASETMNPLGGKNNS

SEQ ID NO: 988857 - protein, 172 aa, Homo sapiens
SDAELTAMAGAVTVVAYGVSVTYTAHCHFGGLFPYFIQNGLWRTYRLVETCLSSLIGRYPDTRRHDVNYILSFGMVRAVISLECALLRIRPWFLADMLSAAGGGNPVQTCPRSARAIIRQIWWERLQWMAAYRNGRTENPYGACPYVVSPHDRLENLGQVCKPVASHEWEAG

SEQ ID NO: 988858 - protein, 79 aa, Homo sapiens
RLGSSEEEEDEEMQWKKGMTLEDPKARVRKTGRGDRKVSDDGVVMTSLVSNVSEEVEKGRAVKNQIAVWDQLLEVKDQT

SEQ ID NO: 988859 - protein, 67 aa, Homo sapiens
LQFLMSDLVCGHGCNMGLGERGGLVRRAQQLLRGEIRDDADASQSSQSACIVAEFSSVQDLLVLEKV

SEQ ID NO: 988860 - protein, 41 aa, Homo sapiens
ERARDACLLTVGSPVDSSKSAARRRRGEAPRGRGWMQSGTE

SEQ ID NO: 988861 - protein, 34 aa, Homo sapiens
MWARRVLNSGTRVIHPPGPPKVGGLRSGANGGLG

SEQ ID NO: 988862 - protein, 39 aa, Homo sapiens
LSAVTLRGSDSSNAAVTVTPLTAFNAADCINAADCIQRC

SEQ ID NO: 988863 - protein, 56 aa, Homo sapiens
TSHGWLLQHRQHPRLETTDTIFRYLSYASYKHLQQTFLVKNSLFKTQRTTSQPWTS

SEQ ID NO: 988864 - protein, 114 aa, Homo sapiens
SHGWLMPVIPALWVAEAGRSLEIRSSRPAWLNMVKPPSLLKIQKISQAWWRTPVVPGTQEAGAGESLEPRGAEAAVSQDRATALQPDDRARLQLKKKTSVVLEKDRHFKTNGIE

SEQ ID NO: 988865 - protein, 58 aa, Homo sapiens
SPHAGCASLLPCDGHQYDGCCFRIIHGDHHLRDVDYRYADCQSLRDCDGCCPVFSIFL

SEQ ID NO: 988866 - protein, 37 aa, Homo sapiens
LTLEDPESEQQKEALETNQELRKALQQLQEELQNKSQ

SEQ ID NO: 988867 - protein, 144 aa, Homo sapiens
SSTETLSLLGSLYSLRQNSIEIRPMNNLPVTSAGSSRAKIHTSLTGNQKLEMIKLSEEGMSKAEISQKLGLLHHLGLVANAKQRFLKVIRSATPVNTGIRRKQNSLADMQKVLVVRKEDQTSHNIPLSQSLIQSKALTLFNYNS

SEQ ID NO: 988868 - protein, 143 aa, Homo sapiens
WHAQASTESDSRGAIYSIPIMEDGGGGISTSQKTQHEAPQDAPENLKHSPWYRARGSQKRQRRHCRQKSNLNINQQKSRQYALKRRRCADAALWSWPSELISSGPVSPFSPRSQQPRRSHSSQALARAVLQPGCSHHFTDGES

SEQ ID NO: 988869 - protein, 57 aa, Homo sapiens
VASRRIPTYVHRLGYQTRCRRRLPSDTGERDDLDTYSDGLYGRVTTTTPQNTCNYTH

SEQ ID NO: 988870 - protein, 82 aa, Homo sapiens
PRLATSPRVGIVHGWLLVHSQSYKEAFCAGENYPGNRVDLANVQELVSWVCHCDDDMVQRLERDFKMSLQLKSSLEQLGCVS

SEQ ID NO: 988871 - protein, 38 aa, Homo sapiens
LVTVLRSHRNNKGEMKGSAITGPVAKECADLWPRNASN

SEQ ID NO: 988872 - protein, 45 aa, Homo sapiens
FDGDSPLISDDAPPVDSMYQSVCLISEERNECVIATAGIMAVSHT

SEQ ID NO: 988873 - protein, 95 aa, Homo sapiens
AGITGVSHCAWPGFTILNAIKNICGSWEEVKISTLTRVKLILALTDDFERFKTSVEEVNYTCSGNSKRVSVELVRRGLSFINHQLAHAIDFSFGI

SEQ ID NO: 988874 - protein, 36 aa, Homo sapiens
SSTETLDIVLCVLDVESGNISVLEGVPENVSPGQAF

SEQ ID NO: 988875 - protein, 54 aa, Homo sapiens
PWLAQLEEFLNQSLPFYFWMNGDRIDSLAENDRAADACVELHAGLFQAGLTLFP

SEQ ID NO: 988876 - protein, 80 aa, Homo sapiens
VSCRYYSPEQPHWVGSQSFQDALRFAFVLTGHTCGLLITRSSSSCTCTPLPMGAWGRLNCYKVPVRCLVNSMQSFLNKAT

SEQ ID NO: 988877 - protein, 145 aa, Homo sapiens
SQIRPWSAPKVGRGDLDIQNAWEAMSWEPGGGHVWEGLAEIWARKLSSGPSALFLVPLGSKGPDALEVYLAGRLSWLWGTPSEGPFPVLEFYGHWCLRWLALDCSSNLWEKTGCLDPVGPYSNLSLFFDMIEAMLCQPPEEATVT

SEQ ID NO: 988878 - protein, 104 aa, Homo sapiens
SISPYRVQYQEGTRFGVVFLDENVLETFESHYSRSLALLKGESKMTEVLAGGDMKLLRGKDDKATVNPRATVNPQATVNPQATVNPYAPVNPQATVNPQAPVNP

SEQ ID NO: 988879 - protein, 115 aa, Homo sapiens
NKEPVKRAHTQFCSHQTKIRVSRNPSQVKTKTKVSSNPSQVKNKNQSARRGTPWVIRPHFHSNGVGKFPRPILSSNSNQNQSANKGTPWVIRPCFHSNGVLQFKDYLTSLDVRLQ

SEQ ID NO: 988880 - protein, 85 aa, Homo sapiens
AGVGIARQRPDFVMLSSWYDYEIWLQRVGGGAPGPLGLLGVRALEHQPEQEQKRKSRDPSLLGSPCQTQSPMSLNFSSSQFACLA

SEQ ID NO: 988881 - protein, 37 aa, Homo sapiens
MPPVASWASSSRRASSVGISSFFMAWKSEMVWESPLR

SEQ ID NO: 988882 - protein, 58 aa, Homo sapiens
WYEIEFGTETGWCTSIVPHWLLGVRPVDQQPQQEHKRKRETLTAGESLPYSVPHHTES

SEQ ID NO: 988883 - protein, 86 aa, Homo sapiens
LKALMDEHNAALRTAGFPNGTLGKRPSGSLAEKTQRSALEATCITPTEHGRSCSTRGTIPTSSANVTQRRHPLAANAPSTRFQQQL

SEQ ID NO: 988884 - protein, 49 aa, Homo sapiens
SGGVHRLDSHRKKQQKSARHCSATYEEAQKKKEDALNETRGISSTKLKE

SEQ ID NO: 988885 - protein, 66 aa, Homo sapiens
SDLVHQSLAFWDGFVNSLITEQKLTNHPRSSTDVQDNSISVKWLAYQDSPDYLVTAVTTHTQTMDH

SEQ ID NO: 988886 - protein, 38 aa, Homo sapiens
DDIHYAIVCGFRSDSPQLLARTTSQFLRLSVIPGKRGI

SEQ ID NO: 988887 - protein, 44 aa, Homo sapiens
MAFHLLFYARLVFRIALSPAAVACTCSPTYLGGSSGAGALYDYG

SEQ ID NO: 988888 - protein, 80 aa, Homo sapiens
MEKRTPHEKEKYQPSYETTILTEVFSMSPVDHSMSSNSHITVASTSSHYAVFLYGEAKVVHRNAPSQTPPPSSSHDNLLT

SEQ ID NO: 988889 - protein, 57 aa, Homo sapiens
KRKSVICAQRSPHTCDGNSCTDTLCTLNSQGAKPEWLKIASIDMNRHKEQHFITIKT

SEQ ID NO: 988890 - protein, 49 aa, Homo sapiens
PEWMERAGLGHVEQAGSGVQEDPDGAQQHRSLGTCETEEVRTKVGTPVP

SEQ ID NO: 988891 - protein, 40 aa, Homo sapiens
MRLWVCQYLRRRIRVQVQGSGSVSVLGGKMWPWYEDLSLS

SEQ ID NO: 988892 - protein, 46 aa, Homo sapiens
MPDTLTSDTYKKWKLTRMDGNWRRGSSAEVAGTYPNTFWMNPQYLI

SEQ ID NO: 988893 - protein, 114 aa, Homo sapiens
MPRLQMVKKMVNVQAGVMASLDMGCLVGNDPEQVQETASYAKPIFSGYIKDTSILTGNSRAVSVTGLLPVYVVASEPCTEQGERSHSRIAYGLPLVLPGVGRLDAFPVTGFFLG

SEQ ID NO: 988894 - protein, 76 aa, Homo sapiens
AGSPGKDAEDREIMFLGTAICEETRLRGPLRTSPPVLQVLPMMRDEQMAISGWGHRCTETYVVSKIRHSDRAYLSD

SEQ ID NO: 988895 - protein, 44 aa, Homo sapiens
VDIHRASPAAKSPSAPLMEQWLSLSLSDTVEKLKDEVLHGDSIS

SEQ ID NO: 988896 - protein, 45 aa, Homo sapiens
LLHRHTRSHLHTAAKHTAHSTNTAHSYTIHAAHTLHTLSTHLHTH

SEQ ID NO: 988897 - protein, 68 aa, Homo sapiens
LSKQVAHSDLMHSNTTCTSIARHPGTLVSTHTVVTSAHTCLHAHAHRYINMHACLHAHKRLLEMLSTH

SEQ ID NO: 988898 - protein, 34 aa, Homo sapiens
MWAPLDVFYSTISISSVILLLSSPTVIEHVKFVF

SEQ ID NO: 988899 - protein, 118 aa, Homo sapiens
MAKPMDHDSSRAHRSLRQERVIECRLYIYSYLLITREDKLVGQGRGGRCSPSMGTAHVTQAGAVVSRGSRWAHPARQPANYSLEPPGDRTPPPTSHTCAEGFLPVGRGVPAPGWILSP

SEQ ID NO: 988900 - protein, 36 aa, Homo sapiens
TERVMAFGVHPRSEPAEPAGPSSPASVTVTVGDEGA

SEQ ID NO: 988901 - protein, 53 aa, Homo sapiens
KGLRPRKRDDGSSILRATVESTPPGTPTPIETRIKSTEHGGPIAGLNYFGRLF

SEQ ID NO: 988902 - protein, 115 aa, Homo sapiens
DCVVKAVKVEERNQDELQRVLKARWVLERMRRKLKLNCVVVANIGVSSTKPQKYNFTDIFESHVCPSLNALLCHPEVTAIQHSVLIIPMSFFIGFLNLEYPWRQLWQLKLNCDGC

SEQ ID NO: 988903 - protein, 141 aa, Homo sapiens
LVKFHLMAFPRMPCALGLESSLHFHSGGRRPRFTQILLNISHFDRCSPRRNSLISSLLPGSCFPNWLHRDGQDPQTTLTVSGVQVDELTCTLHFGLASLGGHVGDDAHDAPATCPGLPCARRLSSADNSCLERAQRQSSRN

SEQ ID NO: 988904 - protein, 89 aa, Homo sapiens
VSSSVPRGPLVRGIMTPVLSLESPYPLSPYRCLVALGGGCDVPLWAAFSAQEIQDDLRVVMWLEGQAWQYRGLMMSPPPTERASVPKLR

SEQ ID NO: 988905 - protein, 39 aa, Homo sapiens
SRGSRVSLVAKKQRERKTLQRKVKRLRSKRKRRRREMGK

SEQ ID NO: 988906 - protein, 153 aa, Homo sapiens
VSCRRRKIFEELTLRQAHACDALPGARRWACLIIIAGGYFRQSLTYLEAYNPVTGPGSWLADLQVPRSGLAGCVVGGLLYAVGGRNNSPDGNTDSSALDCYNPMTNQWSPCAPMSVPRNRIGVGVIDGHIYAVGGSHGCIHHNSVERYEPERD

SEQ ID NO: 988907 - protein, 37 aa, Homo sapiens
AFPLGCQKAQGNGKPRSAASVKPSKKQEEKEKKGKGK

SEQ ID NO: 988908 - protein, 39 aa, Homo sapiens
RIPASHWLPIKQEGKENLVQRKCETTKKQEENGEEGKGK

SEQ ID NO: 988909 - protein, 74 aa, Homo sapiens
MVSPKEALSASTAADFGNMVLMFTSPLRSTKHITTLKPENPKMQPGISQCFPTYFHHSIVTAWNNCAAELVAEE

SEQ ID NO: 988910 - protein, 53 aa, Homo sapiens
SQFRDVMIPTTYPPAAAVCRGCKAKPIACRFFQEVRERSLVPVYALSYLYSSS

SEQ ID NO: 988911 - protein, 37 aa, Homo sapiens
KTLMPKATSDGCLGLMLTLELELDPTEEKKWLHDRRG

SEQ ID NO: 988912 - protein, 113 aa, Homo sapiens
PPPYAVCCRGLVIALFSPTLSHVPVAAGERWSQATVLGSGFTMLPKLECSGAISAYCNLHLPGSSSSPVSAFPSSWDYRRTPSHPANFCIFSRDGDSPYWSDWLQTPDLQVIR

SEQ ID NO: 988913 - protein, 123 aa, Homo sapiens
MNDARRKRKQAGIVSLTPSTKADGGVGTTAQPLSVRKTVKGLDDLDADAMMAGQAVHEEVDYSEKLKFIDDEEEEEVVKDGRPQCWDPRRQWQLSMSSADSADAKRTREEGKDWAEAVGASRN

SEQ ID NO: 988914 - protein, 48 aa, Homo sapiens
EAATGEVQLRVRYSYGEVSMLVEGVRERRCQRVLRRILSEELFVSIHG

SEQ ID NO: 988915 - protein, 61 aa, Homo sapiens
MAVCVPLRQDLQSLHIKEMCPGAMRGWLQLAWGQLLDEGLCVESTRVFLLCIPGKRPSRAP

SEQ ID NO: 988916 - protein, 47 aa, Homo sapiens
MLHGDCQDLQKQHSDPCALNPAHDHGSPEECVRCVLTSLKLETWVPE

SEQ ID NO: 988917 - protein, 53 aa, Homo sapiens
RVRTARKAPTGPGTRLVDVTGKDTVTVSSTSCLKVGHRMDKPANCTHDLYMIM

SEQ ID NO: 988918 - protein, 43 aa, Homo sapiens
ARKDPRTDSMLAVVPGALVVCQHVGLVINQQEILGACISHLTG

SEQ ID NO: 988919 - protein, 33 aa, Homo sapiens
WLQRRVLFAEQDHVQIAFDPAVDLQRRDAEHLA

SEQ ID NO: 988920 - protein, 43 aa, Homo sapiens
MHAQLLQHAVWSPGHSGHWLFWDSPTPSSCSMAVVLRLGLQQF

SEQ ID NO: 988921 - protein, 88 aa, Homo sapiens
SYSSHEQCSYVGEVVRAMDKKKVLVKATSLKVNLSSTAWTKNIDINCCDTTIAGIAAKSMIANTLHNDPVPINGISHLYKRAMLELNA

SEQ ID NO: 988922 - protein, 56 aa, Homo sapiens
MGVGWSSPSSSHYAYNNDRHMHVPLQKQSQVSSSHTGTGRNKSSLSVPHKAAVPHP

SEQ ID NO: 988923 - protein, 84 aa, Homo sapiens
METGGAEGTGDAVLGEKVLEEALLSREHVLELENSKGPSLASLEGEEDKGKSSSSQVVGPVQEEEYVAEKLPSRFIESAHTELA

SEQ ID NO: 988924 - protein, 68 aa, Homo sapiens
VSAERMATICHIQLLWEHRLLFGVSSPTARRSPTPARRGQHNCSESQELEDPSSGLGVSKQDLGPVAM

SEQ ID NO: 988925 - protein, 83 aa, Homo sapiens
VERERDIDFPEFLYHDGQKMKDTDCEEEIREAFRVFDNGWEWLHQRRIAAVHVMTNLGEKLTDDEVDEMIREGDIDGDGQVNY

SEQ ID NO: 988926 - protein, 38 aa, Homo sapiens
GSGERKDGERENMKGGLVEGPVEQVSGRDRPGTCKGAE

SEQ ID NO: 988927 - protein, 59 aa, Homo sapiens
MGRYSFFSFSFLDSCLYHHLSIKFSFPLRMMAVFGTAGARTLTDTTLAPDTFQTDCSDL

SEQ ID NO: 988928 - protein, 38 aa, Homo sapiens
GEVQFIKSNGQMPHRVTGPITDVIVNELGTWLAGRGWL

SEQ ID NO: 988929 - protein, 117 aa, Homo sapiens
WVRYRLEAQSGHPRCSVPAQVQEVIPRWAGVRRGAVAVRGASAPGARALASPGDYRSMTGSGSATTDMRIVCIRFDCFVIFAEEGAVLLAAGQGGGQASLTWTPELRAPPISRPHNG

SEQ ID NO: 988930 - protein, 80 aa, Homo sapiens
HVLDHGICWAVDQIMCVPKHWWCSPCVCGCLEIFCKNSSSRLQESLAITQGPYSIRVSPSTEEQGAEFQVRGGADNQSYT

SEQ ID NO: 988931 - protein, 90 aa, Homo sapiens
IPFPSERMMKFRLYAGTLITGQQIGEVVQVYRKKYVIYIDRVQREKANGTTVHVVHSPLAMVGYQKLKLDKDREKILEGKPNLAKYDGKG

SEQ ID NO: 988932 - protein, 40 aa, Homo sapiens
IKYYSYHHLRKYLVEEDTSSPGSPVSFREKSSATSRPPLS

SEQ ID NO: 988933 - protein, 44 aa, Homo sapiens
WAVVPEQGQEAEGVMRMMGLSSVAALEACFLFFFLFLLIAASFM

SEQ ID NO: 988934 - protein, 111 aa, Homo sapiens
FGLSCPECQTPPDVHRCGCWCFASYWLSSIFLSRLLLAFLSGFDVCSPGNSFAKSSDLVDYVSLHMATFTLAKSHDMSDLGSLYCSLMMGTNVMCWAKTFCYVTPSRWTLK

SEQ ID NO: 988935 - protein, 48 aa, Homo sapiens
LGCRARLRDLMSAGDQCQADSAFWVPSPVSLIRPGYSEPWDDKVSRSH

SEQ ID NO: 988936 - protein, 41 aa, Homo sapiens
LGLCRKCLVGLVQPASATLYDYYIPDAADVLVFYRGTNVRA

SEQ ID NO: 988937 - protein, 99 aa, Homo sapiens
MAILLLHVVLHNWFGLGKLYLSFSILKHCWEKLWFMYVASIAWLRGELKEFTFILRGLISISHSTSQEVKVIVCLPSKRRVWTPTLQDNNIPPEIQLSG

SEQ ID NO: 988938 - protein, 63 aa, Homo sapiens
VCSVCAVSRLCAVCACVCCVLVCRAVCYCAVCACVCVCDAVDAAVCSCVCSMCVSLDTDRPKN

SEQ ID NO: 988939 - protein, 57 aa, Homo sapiens
LLSCNCGGPPSSREVTTNDVRTELRDTSIVDMLHYKPRNSWVSKRSVPRSDLPRLLG

SEQ ID NO: 988940 - protein, 79 aa, Homo sapiens
HHLAIMVNRRVGLSLGHEGIVKIPWVELMPGFIAPPFQDNRERMKRSSRVGTHPQEHVSGTLDAASGCCAHVFGTVTPD

SEQ ID NO: 988941 - protein, 38 aa, Homo sapiens
DRTTNGHDSLNSIHSPQRLFMTHCMLILCAGKVHDRRG

SEQ ID NO: 988942 - protein, 143 aa, Homo sapiens
LKLVIYLKLSGFASKWLYLQINAITVHCECHDLKNYQAPLQAQDQVQGRIFLDLVLDRVRSSSICLVALISAPLLWGYAVLMRFCPSISYVSVLSPPDVMVLPVRVFTKIWIPALTRRTRLQGRLLLDVVVRRSAAIFQLFAC

SEQ ID NO: 988943 - protein, 62 aa, Homo sapiens
MHEVFATHDWPVLALLTRIPMPDFCAPPRGGEGVAQAVASWEGQEASLFPLWSGLWENAMIP

SEQ ID NO: 988944 - protein, 42 aa, Homo sapiens
STGSPHVTWWSPVSREVTIIVCAHLVLDDPSRLYAHYSPQNS

SEQ ID NO: 988945 - protein, 39 aa, Homo sapiens
EDPHKAEDVVRSSLQTCQTLLPATRELLRQAKHEANRGL

SEQ ID NO: 988946 - protein, 42 aa, Homo sapiens
FGAVVTVNACAEEYMRVSGAHASGCTGVPGSSCSLLITSYIR

SEQ ID NO: 988947 - protein, 46 aa, Homo sapiens
LGVVLQSEPVGSGLLRTSQLKDGTQIRPVVYQFVISSQDDETHSWR

SEQ ID NO: 988948 - protein, 64 aa, Homo sapiens
APWQAALGNGCEREAYRQQDRERYWCCHDWGIARTPIVDNPAESQHDGDPSDDVLPRTVRFNEG

SEQ ID NO: 988949 - protein, 101 aa, Homo sapiens
FGLCACGSVVFVFVEPWSSLCARDEMIVVTVLDPWIHFLRSDLLASDVKQPEVEVLECDVGFYDASGFEPGSEDVLARWAGKSAAPIRSRLVQVVFGRVVE

SEQ ID NO: 988950 - protein, 41 aa, Homo sapiens
VSDLTRSPSMPGLQIHEDGPRNILVTSGFIVLNMDSLQLYL

SEQ ID NO: 988951 - protein, 55 aa, Homo sapiens
PWRVETAEITCALNQDAPCPSRMQPKIQKDPSVLAVRENREKVVEALTRSCSSPV

SEQ ID NO: 988952 - protein, 50 aa, Homo sapiens
RSPFILASRTDSARWSGNTSLSSLAGLSSSTFRSRESYHTSLTTGTRWAW

SEQ ID NO: 988953 - protein, 55 aa, Homo sapiens
IRAAQFRMQETIITTMKWYIEWRRGVVHRGYSEALDYFYVQGLVVLGEKNPDMSS

SEQ ID NO: 988954 - protein, 67 aa, Homo sapiens
DPPFHPELGLYPGMSKDSFEVRTKTESAMSNFFYRHNFAMAVSQTYANGHTSLIISYNGLMLSNKKE

SEQ ID NO: 988955 - protein, 84 aa, Homo sapiens
QYVRSSPRRGTWGTGPPYKLTKALQEELLLKTAEDLRSHAWYHGTDPPTGCLKTFCSETGDYPWVRDSRDPALGSHGLPRLEVR

SEQ ID NO: 988956 - protein, 35 aa, Homo sapiens
MGGGWDSSSKWCLSGNRGPGELGPGPHGPPPPPHI

SEQ ID NO: 988957 - protein, 41 aa, Homo sapiens
MCGMIQTCELVQFVQRVMSLDEKQLSHQFPMPDCAFSLQRF

SEQ ID NO: 988958 - protein, 92 aa, Homo sapiens
MILRHLGVSRGEEPENLEVRESADRYTGNDRQMLEVKQLSTIDPKTDDCDAGMWDAETERQKKEGWNRQGMMSEGVANEGFGKIVGSMPDSH

SEQ ID NO: 988959 - protein, 58 aa, Homo sapiens
MANTLAGVQHLGSYQWDFDSYDILRGLRTPVIADLGLPGSGDLFALVCENPLPVQSWT

SEQ ID NO: 988960 - protein, 67 aa, Homo sapiens
SWLKNSKRMTCAGREENMIVPLYQNISNVPLTEDTLVRIWFTGYWLTSIDVGCSEFSSQFVLLPQSL

SEQ ID NO: 988961 - protein, 42 aa, Homo sapiens
MAPFGGHSVEASLQLAFWRRTQPDFPDELDTSFFAREGILHE

SEQ ID NO: 988962 - protein, 77 aa, Homo sapiens
MIVDIPGDSSVSGVFRMRPTNSSRTSFQQIWLPVSCSSSHRNPSLDALVEEEVPMHGMPPIGFYHVQKIAVAVTKSF

SEQ ID NO: 988963 - protein, 89 aa, Homo sapiens
MTIGVPAPIPRLAFPSRYTVELFEQVGRAMAIAALDMAECNPWPRIVLSEHSSLTNLRAWMLKHVRNSRALSSTLNVGVNKKRGLRTPP

SEQ ID NO: 988964 - protein, 53 aa, Homo sapiens
DIFETLQHPRHVSCYPELCYPCTPLAVPHGIVMRLRMTGSTTLCPSKRGMTSP

SEQ ID NO: 988965 - protein, 42 aa, Homo sapiens
FRSLEECIRISLQAPSNRTIREPIANMSFYVHTGSPHIFKTD

SEQ ID NO: 988966 - protein, 42 aa, Homo sapiens
DKSLKIFNPAEIEKYVAEIETSKRRKRKEETKESIMMNQMSQ

SEQ ID NO: 988967 - protein, 45 aa, Homo sapiens
GSLSPRLEYNGVVSAHCNYPPTQVRSRYYPPTAYLTRLSNSRNSS

SEQ ID NO: 988968 - protein, 75 aa, Homo sapiens
MGLSAGQSQLLVSLLLLLTRVQPGTDVAAPEHISYVPQLSNDTLAGRLTLSTFTLEHPLGQFSSHNISDLDTIWL

SEQ ID NO: 988969 - protein, 43 aa, Homo sapiens
AANSWTGTTPAPASGTRSAPGLGWSYQRSAKASLVYCSSWILA

SEQ ID NO: 988970 - protein, 80 aa, Homo sapiens
QALQKLGSSKKAEERAKIISAIDQDVEEKTVFLDGLEEEDYKTKLFQFLKLRKYSIKFTEEKRMDKDVIQKWTFKDQVSM

SEQ ID NO: 988971 - protein, 98 aa, Homo sapiens
RATRIQLQLSGLAVPGARGPQHIDENMAPSGLDSADLPPPSALKKGSKEKQADFLDKQMSRDEQRARAMKIPFTNDKIINLPVEEFNELLSRYQLSEA

SEQ ID NO: 988972 - protein, 34 aa, Homo sapiens
MKAAGSTRSVDQEHDIGAALDTTQYSKHPPQLVV

SEQ ID NO: 988973 - protein, 48 aa, Homo sapiens
YDESVLTFLICVSSAVQFTVVAKRLVPCQVTRGRIKGSLESRGTSPPL

SEQ ID NO: 988974 - protein, 42 aa, Homo sapiens
SSEHVSTFSTRLVESPRGGPGGAVRTLLRCLGPLDAFSRPST

SEQ ID NO: 988975 - protein, 43 aa, Homo sapiens
MAVRREGTQGKKGKADAGKEGNNPAENGDAKTDQAQKAVGLVG

SEQ ID NO: 988976 - protein, 34 aa, Homo sapiens
DIVRRLRDSRPNAHAPGGNKKRPAKTAGPFGYEA

SEQ ID NO: 988977 - protein, 161 aa, Homo sapiens
WAVSAVPHCSMSSTPRVKGPFVTWSGGYGTFCYATALNESLDNNTLIPLDEELATESKTHRAYLNYKVCLDRGVPVIKHLLYHFMNRRGDYDDPKVCANEFKEFVEKLEEKFSSALRNSNLEIPDTLQELFARYRVLAIGDEKDQTRKEYELNSVDDIHFL

SEQ ID NO: 988978 - protein, 34 aa, Homo sapiens
MLRFIIKTPHDHHRRPKSSIGMAKGVNDAGTPGS

SEQ ID NO: 988979 - protein, 64 aa, Homo sapiens
DVFPPAQPAGLGGYWQLTLTWVSLFLLEYDRGCRGVLMASDNSVHYFRDVSKRRLVWVVSETIA

SEQ ID NO: 988980 - protein, 40 aa, Homo sapiens
LVRFGLSCYVAQAVRTPGLMGTSVSASALATQACVGTTAK

SEQ ID NO: 988981 - protein, 39 aa, Homo sapiens
SSVRQRLASVMAWQSIHPGHFWLQDVAAVGLVGDCRASR

SEQ ID NO: 988982 - protein, 119 aa, Homo sapiens
RLGCRDAHSIIGAVLCCNQCEWYFCAREVLETAQDPESAPCWHLRRTWGWSCSWSPGLRSDLVTVSTTKPWMFREGACVPSGHASDQVTLCLELVCPRCAWGPPYLIGYEVFCQWAMEV

SEQ ID NO: 988983 - protein, 41 aa, Homo sapiens
RWADSTYQDLTTGGKANKESSKGLFYSSLPPDGTAPESTTS

SEQ ID NO: 988984 - protein, 194 aa, Homo sapiens
ARVCEESTGAERAGLLFRLRGNLQRHVAEELVNMIQTQRAYEINSKAVIDLRSDAAKADATVICHLRARLAAPVILFRETKAIPVVTTYSMAILPRQGQRWLAGMVMLTLSGCAYIPHKPLVDGATTAQPAPASAPMPNGSIFQTVQPMNYGYQPLFEDRRPRNVGDTLTIVLQENVSASKSSSKGRRKGPASS

SEQ ID NO: 988985 - protein, 74 aa, Homo sapiens
HSPEKAEASSDFIISSNIIPRIIILTGCQFMHNPIVALLCVIIYYLKLAPWEAENDGCSRDCTITLHVRTFYCE

SEQ ID NO: 988986 - protein, 125 aa, Homo sapiens
MAILRVSVVNLAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSLFAIGSQL

SEQ ID NO: 988987 - protein, 45 aa, Homo sapiens
NEPVPLNLSSALLSAFKHVQQKFSTLLGPPTLCPAPLLGLRTTAQ

SEQ ID NO: 988988 - protein, 36 aa, Homo sapiens
FRRFSGRGAGRCMLVPSGPLLVTSVTVLLRDEAEIA

SEQ ID NO: 988989 - protein, 61 aa, Homo sapiens
SHRLHLDYVQTLHGTAQKAARTKHTEAENFTMTNRCVPDEGARTWTRPKCSALPAQTYSVT

SEQ ID NO: 988990 - protein, 76 aa, Homo sapiens
VDDGLTVLGGIAGGCWPQLWVQRGQAQADCPVQLEGTLVKLEEEAIGMDTRHTKSKWGHTRNTRAFPHTNAHEHAN

SEQ ID NO: 988991 - protein, 84 aa, Homo sapiens
VGTLHSALSAYLPRRLRQASHRNFQPEVLQTQVHGCPVPTVPRWSPAGGLSHRSRPWPSTIRPNPGWAHLCQVFLTRQTLATCF

SEQ ID NO: 988992 - protein, 33 aa, Homo sapiens
AKHVGTVGKRGVAEQHGTGMAFHHGKEPMSSSL

SEQ ID NO: 988993 - protein, 50 aa, Homo sapiens
VASRRLPPPSYTAGETASYDRVTHRRLGLNGDPRLSTDYVLYDLTTLVTR

SEQ ID NO: 988994 - protein, 93 aa, Homo sapiens
MADTLHRYMLASRFSECKLHDIVGFPLVLMPAGAPRNHSHRLVAAFVSDSQQSLSAPTCGFSRSQAFPKQAGASLGVPFLGACAETGYMSRIG

SEQ ID NO: 988995 - protein, 114 aa, Homo sapiens
PPSYMHFSTGPDSRFHLSKSFSEMFYPCTHPLSRLNIYPLAKHSLNTYHMPGPMPGTRDKRDTLSLSPRNRWYGGGKKTRWCCHSVRMAPHNALVTVLSQQSQEQEEIPSTQGV

SEQ ID NO: 988996 - protein, 44 aa, Homo sapiens
PPPIMHKKKAKSSIEKMGPTDLNIVYKTDIPVVTETHKSRENAQ

SEQ ID NO: 988997 - protein, 44 aa, Homo sapiens
MSQHSLMLGGRLVFTKVHVLVPLAVQVPSTREHRADLQISLSWN

SEQ ID NO: 988998 - protein, 65 aa, Homo sapiens
PPPYVEAQSLQGSSWKMADSFLMTTFRRSRTCTCVLRMRGGLQIFVNSLTGKTVISVGLRPCDIS

SEQ ID NO: 988999 - protein, 49 aa, Homo sapiens
MSHAFIDALEVDVVSPSVRVLCLSLYKFRRHVSTCADLQISVKRGAVVD

SEQ ID NO: 989000 - protein, 154 aa, Homo sapiens
FGSTLPLGSTLNHAHSPYVSELYLDSRHYLVSRLYLCLSRSTLSLSQQGKSETYWTQRAKLQRDNKVESLFNVLITADIQDNTEPAFSILSDQFNKDVHIASTPQAEILKLKNGIDKLEECVTCFTSRINQAEEGISELEDWIFRNAVRPGRAE

SEQ ID NO: 989001 - protein, 89 aa, Homo sapiens
SSTETLSVILSWLESVKEAITRDRENKAPGEEASVQIQEEEETLQDEEVRDALTDNYIPSVSEDWRDPKIEALNGNCSDTEIHESLRRT

SEQ ID NO: 989002 - protein, 187 aa, Homo sapiens
WHCTERDASNCSTDKLQNTVLGMRSVQNEEGKCEVTEVSKLDGEASINNRKGKLIFFYEWSVKLNWTGTSKSGVQYKGHVEIPNLSDENSVDEVEISVSLAKDEPDTNLVALMKEEGVKLLREAMIYISTLKTEFTQGMILPTMNGESVDPVQPALKTEERKAKACSSKNPARPVGVKIPTCKITLK

SEQ ID NO: 989003 - protein, 76 aa, Homo sapiens
DAVQELPLLQGDTDPFVDHLQPVKQHREQAGVGLRVLQLLVDQLIHLESTLGVDVDHDKPPAQLQVMLITHHLEEV

SEQ ID NO: 989004 - protein, 34 aa, Homo sapiens
MSCLAEAQSLRMKRSPASTLEVTAIAFRATHLLI

SEQ ID NO: 989005 - protein, 126 aa, Homo sapiens
SRGSLQQTQHLVQNQCGLNISHLNGRTYYYDTETKQLYLGRNQMIFKDLLSNSYLNAPGRNTTQILESLTIIILKLGESRLGQTLRIEDLEGCQNTIVAGSLITNINLHAMITAVESSPPEECTIT

SEQ ID NO: 989006 - protein, 127 aa, Homo sapiens
CSRHSIIIQELVERMPHFSPLEAEYLVMLTGPHSMSVELLHSLFDLVPVGFNIYYEHKCLVVLALLHGTLCGRRQLDDNMVFKLASPGGALLRIFGLPLECSVLGRWKVGDVWIFFLHRLWTPFNAV

SEQ ID NO: 989007 - protein, 56 aa, Homo sapiens
MCISSVSRGIIAGLHRAVGGIQVISEDKNPDYRKRVSVPLTNSLFKHDPAAWDAGQ

SEQ ID NO: 989008 - protein, 99 aa, Homo sapiens
SRIPWQQTQHYWIFGTVCILFIVDTFSIIRGLHSVMYHYASLPDCPLSCESHKCFRIGSHVLYDTLVLHTLINSAFNDYSSCNDDVIYWFLSLQLSFAP

SEQ ID NO: 989009 - protein, 38 aa, Homo sapiens
AFSHWGKQVKQCELFIHSQPVLWPVPLCALVCLALLHI

SEQ ID NO: 989010 - protein, 31 aa, Homo sapiens
MVIFTCHNLLESLDGLLQEYQLPHITCEGPQ

SEQ ID NO: 989011 - protein, 37 aa, Homo sapiens
QCSDVVQSHPASASPTARSPPTDAYKAHGVHGCPEIV

SEQ ID NO: 989012 - protein, 106 aa, Homo sapiens
MERPYLYWKCKISQASWHMPVVPAAREAEAGESLEPGRWRLWRAGIVPLHSSLGNKSETLFQKKKGKKGIWEHLLSASVKATQFCRIKHVREIKVLLPKERFRSCF

SEQ ID NO: 989013 - protein, 130 aa, Homo sapiens
QTLAVLLKLKTQFERYYPLPELLITPQKDRSRRVKGTASGANLAVLVPRTVAEAILLGSTGCLSDLPRFRSPPRILPTGLPPGTAPPVWRVLFLVLWARRCFDGRSSLEPVRPQCGFETLSVFSLLSGIG

SEQ ID NO: 989014 - protein, 68 aa, Homo sapiens
DALALVRACTQQEVNLNVSLQLPSRSSKITTVSIGILPASCDSDETTEHEGFTCRQDDQKRPRHLVRW

SEQ ID NO: 989015 - protein, 69 aa, Homo sapiens
VIPGYHYKWIHYTSDVANPVRIKYMQRWQDTLRRDPTMRDIINSTRSILYPTIYTISWILLSSPRRQAL

SEQ ID NO: 989016 - protein, 68 aa, Homo sapiens
HTLSNPDLTRMRISSCNHNPENTSLILILRLLINQHYKLYPDIFPLYVILLSVIEYLSIPQVLGENFL

SEQ ID NO: 989017 - protein, 31 aa, Homo sapiens
MPGDTKNQTTDSGFGKVTLQDACLVPLTSPE

SEQ ID NO: 989018 - protein, 79 aa, Homo sapiens
CYDCGKITSGDTVMTIDLLALSNTVMTYVIARDDVSPFIQYKTSVGIGGILAQSNLIYNLEQHLGHNLYTTLHFQPPNF

SEQ ID NO: 989019 - protein, 121 aa, Homo sapiens
NIYTIDELSFTQWKIWHCKTMIQEQVISIEDSYVNSQEWTLSRSDTESLKCVHSGEPVIARSQAMVQRYLTGTYVQEESLKGGRFKKEIVVNGQSYLLLIRDDGGPPEAPVCCLGGCTNPE

SEQ ID NO: 989020 - protein, 35 aa, Homo sapiens
MRKSSVVVVARGSQVETGGTNYQLLAGIPRAHLNV

SEQ ID NO: 989021 - protein, 85 aa, Homo sapiens
MGAVDAGSLGLRDTPVRVGRGLHAGKSLHWNYKVEIRTQMNHRTVCLVLNSTAHYILGNETPSYLYVQHLDCRNEGKVPSLALVG

SEQ ID NO: 989022 - protein, 45 aa, Homo sapiens
VIDLEYTLERYRARRFRTSSDKEKEEVDRGKKEPGSPEEAKKPDS

SEQ ID NO: 989023 - protein, 105 aa, Homo sapiens
YGNRENISCRVLHRTGKNGQNAIQAGADRLQRPEEERMNCSPTSQIDNIGAAEHGMPLTTPSSTAKHNECILDYYETHWVEGNFWAKFIYGSEHTGKWHKSLCSC

SEQ ID NO: 989024 - protein, 172 aa, Homo sapiens
GISGDSQFPPSPANNSNPVKDTDAVTFTCEPEDAEHNLPVVEVNGQSLPVSPRLQLSNGNRTLTLLSVTRTDVGPYECEIQNPASANFSDPVTLNVLYGPDAPTISPSDTYYHAGVNLNLSCHAASNPPSQYSWSDNGTYQQYTQKLFIPNITTKNSGSYACHNNNSATGRN

SEQ ID NO: 989025 - protein, 88 aa, Homo sapiens
RYHKHVMVWQTVTGVPFLYLLTGKSCRPGPLPNPPARAVEPVATQPLPGQSLQEQLKASLPLLLQWNCPCYPQTDEGANTLIYTFNKL

SEQ ID NO: 989026 - protein, 39 aa, Homo sapiens
NGGELRDREKGTEARKDSRSRPIENQGRGLEGEYEDKIP

SEQ ID NO: 989027 - protein, 50 aa, Homo sapiens
CDRTAEAAKKKTEDALNETRKSDTQLKELSEESNETMMALSEERKPCLKQ

SEQ ID NO: 989028 - protein, 53 aa, Homo sapiens
GSPTEDMDPGRRKIYTLLQGSFEAQRELTGRRRNRDAFRGTAPSVATNTIPGR

SEQ ID NO: 989029 - protein, 85 aa, Homo sapiens
MAWKLRGSYGEMGIKLRTMRYLLKEEMRPPLGQAEGQVVVAILLLPPEEPVLEELDYDAGRAHEVSLHDIQHVRLLPNDLHSSWA

SEQ ID NO: 989030 - protein, 76 aa, Homo sapiens
ICVCCALVVQVASRGHGWALPHRGGPDVMRCVLWTGTTAHVLVRPVSLQVSVTLPCGLSFVFISLAKESMAIAKAE

SEQ ID NO: 989031 - protein, 118 aa, Homo sapiens
MGSSSHCHGSGDAGSRHSTPPGRLAPSVEHVVTVDLHSLKGPQPVKLKLHLHIATAEAVVAPSHYCPMPVSYVKHLTLPKVIQPHHTICQLAQTPILQSAHGMSVMVESLRYTASDKN

SEQ ID NO: 989032 - protein, 84 aa, Homo sapiens
SSHRELVVILTASLHANSYCISMLRDTPTSTTTVYNCPAIRTVTLYGLKRGGNPLWRRIAPSSFLSTLMNNPPLVSPYTPSNSK

SEQ ID NO: 989033 - protein, 35 aa, Homo sapiens
YVRISGHMRSAGESLLTSSQQNLSGPILEFIATCF

SEQ ID NO: 989034 - protein, 39 aa, Homo sapiens
MGTGPRRLTLYTGDDRTYFDRCYYGRYVTVTVRTDDVTT

SEQ ID NO: 989035 - protein, 37 aa, Homo sapiens
RNASGHARNPALLEDEAADGLSSGVQDKSVQHSKSLS

SEQ ID NO: 989036 - protein, 49 aa, Homo sapiens
GGSSSGDSRPRVEGEDALPHAGRMSRMARRLPPRTAKAERWLNTHGMTD

SEQ ID NO: 989037 - protein, 93 aa, Homo sapiens
RRERERENRATDDRNKTDSQKYLNSTRWSVRPVEWKCRHLSKLNCCPCAHRCYFRRGCKDCFVNDYRALHVVSAGPHRKQECLGNRHANYRSH

SEQ ID NO: 989038 - protein, 56 aa, Homo sapiens
LFLRLFVGLLLTWESGQFLREQVFMGGGAVIPSDAQPQIVQTGSFIWRRADRLQDA

SEQ ID NO: 989039 - protein, 84 aa, Homo sapiens
WRAYSLPPPAGSFPTAMEQCATLMHVPGNARADELLVSSEAFVLLDGHELTRVGPKAAHVLRKPIFGRYKPDTLAVAVENGTGT

SEQ ID NO: 989040 - protein, 70 aa, Homo sapiens
VTAPDIIYMIRRPYQRERSYRRLQQDAFLAIDAILTTEEVIKELGQIAGRPTVLMKMLKTKKLDEDDVAR

SEQ ID NO: 989041 - protein, 85 aa, Homo sapiens
NASGRKSCRANTDGRGALQAERAQGTWTNLTYETNTTLDPARNPHSAWTDYDCLAADHPGTCEGQNSIAKLSCGPLGQICVCEGP

SEQ ID NO: 989042 - protein, 64 aa, Homo sapiens
GTKEAMTTKEAMDIHFHSPAFQHPPTEFIEKATIDRTVCREIRHISTGCLRMKDQCDKRREIWV

SEQ ID NO: 989043 - protein, 30 aa, Homo sapiens
MQRCAQFIQPRWRRADASSSSAVEYEAQGR

SEQ ID NO: 989044 - protein, 79 aa, Homo sapiens
ESSSLLPAAIVIACRISTFGIILHNATRMLFLIEGLVISLCGWKLLSRAITSPRQHISLTYMMLYELDSNYLASLSCHC

SEQ ID NO: 989045 - protein, 71 aa, Homo sapiens
EEHGYCCSMHSSRTNAVQRFRLGAMLMQSFHDIIMDSLDATCKGLMKSVFRFIRHELVREVTDLTLAYSRD

SEQ ID NO: 989046 - protein, 89 aa, Homo sapiens
MTQHSGSQRSQEAPWFPAFLCSYWHHNLCIIWAKRVYLSGSTDEILCPASKAARAKLLPSLKHAGCLAPGAKQRPLLSFTAQPPGLQTP

SEQ ID NO: 989047 - protein, 64 aa, Homo sapiens
DPRRHGVCRIVARGEERCGAGKVARPGERRGTALAGKHRPAQQRAEAQAYGGCKEPTEPMRAAA

SEQ ID NO: 989048 - protein, 42 aa, Homo sapiens
PCYQLPESHWSGQEDTPRGQEHNQAVLQEVVNSKSYLLVSQG

SEQ ID NO: 989049 - protein, 143 aa, Homo sapiens
HTEKQVLPSEWENPRRHILHSRTVCHALRSSIHLVGYPRSSRRVAGQHDERAGCQPGSAGHQSLWVPQKLLASGVQSQLHRRWSPRLSGVLCLTTVFTSIIISTPWEPGELERPSWFDKDLPFGQDGDANNDPESLAASYMQG

SEQ ID NO: 989050 - protein, 59 aa, Homo sapiens
MTNSTRMHPLLCLSSIRVACTNVDSFLTNMSPLSAPTVSPESSSVGVTNVIITNKTLDC

SEQ ID NO: 989051 - protein, 105 aa, Homo sapiens
TSLCKLLMDRHQTCTSSSLSPTKIGPLQSKLFLQLKVATQAASTGENAHKCPFSMPVPFLATVSPMYPCWCAQLWGGNSCIALKRGFPTGPASSETSSGPCLGYS

SEQ ID NO: 989052 - protein, 70 aa, Homo sapiens
EKSAEEAEGEALQTDRLVPRPESLARRDRGSCVIRASFSGYTSDTLFILVKIWLISMNVLDLVSGTIKKM

SEQ ID NO: 989053 - protein, 81 aa, Homo sapiens
GSVKPARSYRSAEQSNELNQVVRFQPITQHTMPAASSRRETPRFAPAATAYRLLTVERQRRTNNVTAPDEPAEPAFGWSAY

SEQ ID NO: 989054 - protein, 106 aa, Homo sapiens
ARRGWAYTAEPYGFSSPAGSEKRVPLRLEVAEIQLGPQTSISVGKGLWLQTHAQVAVLIATLIPAPEGTFASAWLLVVLGHVRQVHLQNEFACFSCHHTHLTFDAP

SEQ ID NO: 989055 - protein, 104 aa, Homo sapiens
RERDIRERHKWAHRHTQTHTHTPQTQTHIQQVTPSPRQPVKLLGSALRDYDPPVREQPTGTRADLSWTSQGHHFWGDSRAHRARTPEAGILRCLPGDPSEVSSY

SEQ ID NO: 989056 - protein, 64 aa, Homo sapiens
GSDLEDPIQDGSSISIRAKNTIVATGLRAHLLELHVLPTPVTSDGTAMITRAGLPCQDLEFVQF

SEQ ID NO: 989057 - protein, 36 aa, Homo sapiens
LRIPYPVVLAGLPSWRAAVRAVFQRIRGTRMPSCPN

SEQ ID NO: 989058 - protein, 62 aa, Homo sapiens
NRILKSPLVHSILNILSHLHALHQRQAHGGFPFSDTTQAGVYGVASSKVMTASTPMRMANIL

SEQ ID NO: 989059 - protein, 39 aa, Homo sapiens
SNRDSFVEKGQRLRSEPTCPGHWGEVGALSSGIRLSGFQ

SEQ ID NO: 989060 - protein, 65 aa, Homo sapiens
SPGRFAQGNHLRNNKGTPDPRYTLRPKRFEFLEENLRQQALKPLGLRTLPTPNSGRKTPYGDEGM

SEQ ID NO: 989061 - protein, 74 aa, Homo sapiens
VLRCDWTVTDSDWNGDWTRRTDSDWTRRSGSDETVTGSDRQQQRVEDSDEQQQTVEGSDGQWRTVGDIFLPGCS

SEQ ID NO: 989062 - protein, 57 aa, Homo sapiens
YQNFHVRDLCSSSFGAAPLSSWGGRSFPIPNSTWRSAQQWHPLLRLPLLPLSHAAVK

SEQ ID NO: 989063 - protein, 71 aa, Homo sapiens
GFIDASKAQLYGEGNDAQDLVASQTLNFVLSLQTLLAWKSPPDESCVVPQTFMRALYYPKAGIPIHYNYNV

SEQ ID NO: 989064 - protein, 76 aa, Homo sapiens
VIGCHGQDSHLSGQGHIPSLQQGKARGARSSFTEPRCQPVRDMVRGLPIKKAKSWLRATPEHAVWILGASINTGYR

SEQ ID NO: 989065 - protein, 58 aa, Homo sapiens
MACKFRGSYGEKDIKLRTMRDLRKKKEASGGQAEGQVEVGILGLPPEEPVLEELVYDA

SEQ ID NO: 989066 - protein, 109 aa, Homo sapiens
QLGFLCGWKEVIHPSLICGWKEVIHPSLICGRKEGIRPFVICDRKESSTRPSSASKEVIRPSLICVRKEDIRPFLICVLKEVIRPFLICVWREVIRPFLICARRKSFTR

SEQ ID NO: 989067 - protein, 77 aa, Homo sapiens
ILRLSHSKSQDDIGGRHKIQVIKTLLIKHVAVKKLAKTHQNQDGDESDLWSSSLLTPTSAMTVYKCHGNVRKLPYMV

SEQ ID NO: 989068 - protein, 61 aa, Homo sapiens
ATYDGKQKSREVLLQQVEVHPIQTELACSLMEFHSCQDTAEEQRSHSRKAGVKSLAPHGET

SEQ ID NO: 989069 - protein, 38 aa, Homo sapiens
GALGQAALDPRDLPVSDSQSAGIIGMSHMPVRPGYGGI

SEQ ID NO: 989070 - protein, 104 aa, Homo sapiens
MRKDCSFPSGLSSSPPFVDLGIAAKAMHPAGLRKPQCLQPCLRAADSLIFHHLTCLLRYLLTGLECKFQRLLLKIPQVKQARCLDLLLSLTCNILFRGSEHLLG

SEQ ID NO: 989071 - protein, 55 aa, Homo sapiens
MLREFWVRSLTDGGHTISRRRPSESSSRVDIDANWKAICDAFIETYHIPVIHAET

SEQ ID NO: 989072 - protein, 107 aa, Homo sapiens
RVKAVMSRDYVTACQPGRQRQTLSQKTNQKQKQKKNYGVIACFKISSLGRVRWLTSVIPALWEAEAGSQSCSELRSHYCTPIFVTKRDPVSKRMCLFPGVSLFLTCQ

SEQ ID NO: 989073 - protein, 96 aa, Homo sapiens
RLLWLLLLLPGVLGSLQAPFKPGLGSIHGMYLTWKRCHWLQESLQLPGAHLVLRDLPTELLLLTLLGFTHLIVANTHSGHAPPASPSNAVDELLPA

SEQ ID NO: 989074 - protein, 67 aa, Homo sapiens
MRDHLSRAYSMIDELCQDRIFTRELYDTYHYLPLSLPNRRPQFFFPKYRIARSLMPFSPNERMKLHA

SEQ ID NO: 989075 - protein, 75 aa, Homo sapiens
MARKFRGSYGEKGIKLLGDAALGKDEVRPPVGQAEGHVVLGILGLPAEEPALKELVYDAGRAAVVVLHDIQRWDD

SEQ ID NO: 989076 - protein, 43 aa, Homo sapiens
RENRTEADPPQGGGWRRMETMPTSGMRQILESFHVNLQKSAGR

SEQ ID NO: 989077 - protein, 68 aa, Homo sapiens
YALQELVPMISAKQLCVLVPIIIQLSSSECLLPIIISRAALSVLVPIIVSRGSSDVSQLPIIISRGST

SEQ ID NO: 989078 - protein, 40 aa, Homo sapiens
CENRTEAVTPLMVPDTRWLSSPVGVTVSLRVLTQHLAYAF

SEQ ID NO: 989079 - protein, 133 aa, Homo sapiens
HKRVLVLVSEVHRVKLSASWCPDMRACEALLRSVCLTCARVLSSTACWLCDMHRVKALVGGGCLILPVDVLRVQVSDMHRVNLYWVLGDWICNRDEALCILDGRKCYRVKGRVWIPGVLKCSVLRLSAFWGLK

SEQ ID NO: 989080 - protein, 63 aa, Homo sapiens
GITMSVKQLSGQVHQTTQREEKGQRGKRFQKQRLIWVCFSSPTSPTEYFESPFTISDGHRDPR

SEQ ID NO: 989081 - protein, 49 aa, Homo sapiens
SSNQLLCISYSFLGLIFQQSEMARDFTPEPVVAAIWRRGGWKAGHHGHR

SEQ ID NO: 989082 - protein, 35 aa, Homo sapiens
QQKNSLVVLHMSALIVTLVQEGPNEINNPVHNPSV

SEQ ID NO: 989083 - protein, 89 aa, Homo sapiens
DLEDPVLMNGELFYDRGSSVCRPTCAACAIPDIVILEDHDVRLRPAVYDAPSPGPGTRIRPAGVTWNVRELKAVIFGDHAPTAAVYKER

SEQ ID NO: 989084 - protein, 46 aa, Homo sapiens
DSPDHDKITTSNCCGHIYYQLYLLFTYTSFSYLASHLTYVGDKVEP

SEQ ID NO: 989085 - protein, 71 aa, Homo sapiens
LRTPHMCHIHSHWESYGDGPGAVAHTCNPSTLRAKTSGSRGQEIETILVNTVKPHLYQKYKKLAGRGSTRL

SEQ ID NO: 989086 - protein, 50 aa, Homo sapiens
VVRLDADNDMATIEKLTKVYKSRKDGRILAVDRLWLGVRPGEMLRGSWSV

SEQ ID NO: 989087 - protein, 165 aa, Homo sapiens
SVCRMSECLRRGGGLDVVQFVCKDDRHPLLDEGGLVLNGKLALPLLALENHGNDASNEQDGCDHHGRNDCVQVDIILLLFSGSLSGTSVGGASEGTLLGGTTGINCRCRQVPEPVTVMLVALKSGSRALEKAGRGYTIILSDPAAQPSDLLLGAEPKGQCVVAHP

SEQ ID NO: 989088 - protein, 68 aa, Homo sapiens
MVAGPVSCWKLGSSSSSSDCFPDNQCLPASLSSCQSSFPRHLSDTHEKVLGGDRVTPSQSHVDVPPHH

SEQ ID NO: 989089 - protein, 144 aa, Homo sapiens
VDEVIISKEYVCRMKLRFQHSDNVFDLAAERERFPVTILDPEDAERADSGRVTAVAVNEDEEDSQDAEEEEEADEEDDQEDDEGEGGDEDDEKDGSEMELDEDYPDMKLLPMNRFERIERKNALIIEYGQTMSSRETDIPPSTK

SEQ ID NO: 989090 - protein, 59 aa, Homo sapiens
MARKIRPSYGEKVIKLLYDAGLGKEEVRPTVSQAEGQVVIGILQLPSEEPVLEELVYDA

SEQ ID NO: 989091 - protein, 88 aa, Homo sapiens
HGEHHFRALSPCRPSVISTTQVQQRFLRVALSVLLDITDRDSPHLLLKSDLIINMCTSLRQTMTLIRTLSRVPLPFMESYRRSAYRCL

SEQ ID NO: 989092 - protein, 59 aa, Homo sapiens
TERKGVTDLAEEEAVAPGTPTMGATKTADEMAFFDGKTTRGVYNFCAQDVPSDQKRVDR

SEQ ID NO: 989093 - protein, 58 aa, Homo sapiens
CDAPLCTIASYCVRISFRAAGEVCLGHVKLHMDLLTRQLLLEYPNLLLVDLPEEPDIL

SEQ ID NO: 989094 - protein, 54 aa, Homo sapiens
EVVAGGVCEALMPGDGRKRSRGELVVVAGCARLRERQVELSEYVWAPPGHGAPP

SEQ ID NO: 989095 - protein, 73 aa, Homo sapiens
VGYRHVLIPASWAGHAPQTGYLSGWVHSSDLRLTWLVKESLITQLGWPMAQTQVEQPTLGQQDAAAHTSSTDT

SEQ ID NO: 989096 - protein, 84 aa, Homo sapiens
KGSDAGDTVMGTYRAQCIESMTRLVVKERNRNKLTRESGNDFPIPAVPPGTDPETEKLIREKDEELRRMQEMLHNIQKQMKENY

SEQ ID NO: 989097 - protein, 69 aa, Homo sapiens
VTQKQLLQCWLWRLTHIIACAMRVPHGRRSASVQEVAAPVSYDCATVFQPGPQSKTPSLHNTMLGVPSS

SEQ ID NO: 989098 - protein, 73 aa, Homo sapiens
TGPRPKKHRKECGNRCCPLATARKPGGLEKSSAGAGELKRKWAKKGLTFLRHNKDTEKLKQREEGLRKIYTDQ

SEQ ID NO: 989099 - protein, 67 aa, Homo sapiens
LHLFCDLLYGLPGVQVAGGFDSCSSIYGLLHILARVPQQHEAIKYFQGYQPKIEEYDTGIMTGVLAL

SEQ ID NO: 989100 - protein, 78 aa, Homo sapiens
EGQEEPPLNHQGAARTEVNLRKGTWDKCNFLARQIREHREPATCDEEEDEEQFEVNHDMQPAQEMPMYMRIRRLERRP

SEQ ID NO: 989101 - protein, 101 aa, Homo sapiens
QRHHREGNGIIQLPGHHSEGNGIIQLPGHHSEGNGIIQLPGHHSEGHGIIQLPGHHSEGNGIIQLPGHHSEGNGIIRLPVHTVRAMGDGVFTASAKVSRSS

SEQ ID NO: 989102 - protein, 142 aa, Homo sapiens
MASDTLVPVLLRAPHQPQCLFPEMPGGNRLSEGGWCGNPGSPSPRRLKYMEEKVQDRITMCRPRVGSGPCLLHLRLMTSLLKRSDIKCTPWIVALTATGKSQTGVKSSVTCDRWLPVPNPMTLPSTPRPLCSPVSSEPQSIP

SEQ ID NO: 989103 - protein, 49 aa, Homo sapiens
CDRPCGIFLNVKDVLASRVTTTLNLNARIQVNEKEQWKEGEGVQLGLEG

SEQ ID NO: 989104 - protein, 82 aa, Homo sapiens
LTALLTLAGFQDHYLNDANASALKCYYPITGAHRNKSYNSKKRSMEKFLNPEIPYGKGSGESVWLIFKNSTALKNKHLSLTC

SEQ ID NO: 989105 - protein, 105 aa, Homo sapiens
LKLLARVDLATSASQECWDNRREPAYPGHSVYSFALSFTRCLQCGWRGATDESSGSFLRSILRMCSALSRDAPYTWLCKSQAELGVANEHREMQGQLWRVMPGIP

SEQ ID NO: 989106 - protein, 32 aa, Homo sapiens
MIFLLYAGYVKTQQMKHFSWHIHIPIMVYLFS

SEQ ID NO: 989107 - protein, 89 aa, Homo sapiens
MWLKRISVKNCVIYSAIHAAHCSAGPVRDDLSNWQATIMRASVYSAYQGWSASLFSALDFAAADYPFKPPKTCVSQQKLDHPKINSDGS

SEQ ID NO: 989108 - protein, 82 aa, Homo sapiens
IRYPIKSSLRDEGWGLIYGPLRQWFIHCGIALVDGPHNSRYLSAPIPVSQRTWAMSMRKIVREWSSHVCDIDLFYGQSLVIR

SEQ ID NO: 989109 - protein, 31 aa, Homo sapiens
MPTSGLIPLQAFLDADILKDGSWAEADANIG

SEQ ID NO: 989110 - protein, 44 aa, Homo sapiens
MKSCHTYAHTHMHRYAAWAHSISMPKYARTRTETCQNIQGHAVL

SEQ ID NO: 989111 - protein, 33 aa, Homo sapiens
DHDVLSISHPSSSGFLASVLSVYAQGLSQFLKA

SEQ ID NO: 989112 - protein, 45 aa, Homo sapiens
TPPPTYARRRTFDVPLPISDRTTRDSSRTTRDSSPDTRDSSGYRR

SEQ ID NO: 989113 - protein, 139 aa, Homo sapiens
LVSDGSLYDVAPVVTGGVCKVTESMASAALPLGLQRLHVSAVTLTNAASTPWRNGAKCVEQPDGYECLLCRGLMRARLCDRNVDDCSPVPCHHVSLRVMALPVSHVSCAPGYMCTCCESQVDECRIQCLPSWRQMPIIG

SEQ ID NO: 989114 - protein, 56 aa, Homo sapiens
MMVWTDSGGPSGSLRRQCGRGLAAVDWSRTCPCRSCIGHDRVTHVAPAHQFASRSF

SEQ ID NO: 989115 - protein, 71 aa, Homo sapiens
MSLAPWRSRAFLSVASLLVHVCHAVLAVVGDVLVSASVDIRRMKVSWIATSAGSEPWPPYSNWNPSVMLSP

SEQ ID NO: 989116 - protein, 71 aa, Homo sapiens
TWMPIKVFCNDGDLVRPACSRTQPIVGQKNCYISENPLDKRRFWFGESMSDGFQFLSMADSDSILPMCASI

SEQ ID NO: 989117 - protein, 90 aa, Homo sapiens
MTESMASADTCPSGFSGSTCQLYCCDECASTPWRNGAKCVDQLDGYECRCAAGFCGHSLCDRYVDYCSPIPCHLCVSACLALPVSHVSCA

SEQ ID NO: 989118 - protein, 33 aa, Homo sapiens
MGQLDIEHGPVYSVQVGRAISFLECSARSSSSP

SEQ ID NO: 989119 - protein, 69 aa, Homo sapiens
SSRIPQSVSTRLRLSTMVEIILDEGGSWSIVTDVLARMGNWTHDTAINATVTAFTVELYATYYSTEGST

SEQ ID NO: 989120 - protein, 42 aa, Homo sapiens
LSWTNCDIINNECESNPLCRTAEPAIDMNSGYVVHLAGEGFM

SEQ ID NO: 989121 - protein, 142 aa, Homo sapiens
DCSTRVVRDIALSLISLIAGIGTMMEDGFGETGGLAISHLSDLVAGRKDGFSRRWNGCPPLAHADLWAAFPRAEIPPYLLLAHSFPDLCLFLYDLSFHSQFSLGGQLSCLGCVFIVCLFRRHVRSKLLIFCYSDTSFLCAFQ

SEQ ID NO: 989122 - protein, 101 aa, Homo sapiens
DCRQVEHEEKISNRSLRECQQLCKSGDVMETWFRGFVVVALSVITMHEALTRVAWLSLLRPLGVDFHAPPLFRPLCWSLRRVDAGLMYSVGWRPRTKDASP

SEQ ID NO: 989123 - protein, 89 aa, Homo sapiens
SPVPPQSLSSSLSLLLESTWGARVHTVLNSPACPAHSGLFQEILRGAQKCTHEPLNSWSHSGICRQAGSVPRCVYVAVNRYDSNEVQIP

SEQ ID NO: 989124 - protein, 44 aa, Homo sapiens
MPFRCGPSTIRDKSPNSPPPDISSRLLAFTPSQIGGFFFILRGG

SEQ ID NO: 989125 - protein, 75 aa, Homo sapiens
GGEESKRCRLPISIGEMSLVLAWSDDPGLLVYLSPVSKEQRGQAIDLPMKGPQSQCHSTPCHAHQFEESPTTGFV

SEQ ID NO: 989126 - protein, 65 aa, Homo sapiens
SDSGVQWRDIHHNLCLRFKRFSCLRLTRSSWDYRRPPPHLADFFVFSSDEVSPCWPGWSPTPDLR

SEQ ID NO: 989127 - protein, 60 aa, Homo sapiens
MGTVPDEVWSILRTALVVGRLTVGTLNTTLERGDTVKEKLCMMLGYTKTLQSMGFTGVLI

SEQ ID NO: 989128 - protein, 51 aa, Homo sapiens
MALEAVMARASENSGNQGRIRSSIVTVANELTSTRILVLRAACCKQATAID

SEQ ID NO: 989129 - protein, 109 aa, Homo sapiens
NELSNPVRKNEVYFYEVREGQEKKGKEAWMSTVLSDAHVLLLVYSQLCSLHGSDQQKRKGAEATAKRKSKGGGINVEGRLCTSPLKTHVRLGGTLREKERDLTHRKGQF

SEQ ID NO: 989130 - protein, 100 aa, Homo sapiens
SYSSDPFLNGRAYIRGGRDNDSGLGKEVLQCHQNSRRISYSNENEMDTGQKRRTNNHEHQSPTDTVSQNFLRMYYPENKQYDYKEHIGNHERNMIPPLQL

SEQ ID NO: 989131 - protein, 100 aa, Homo sapiens
LPGGYGITVTKPTHEYRPVARLSLNYLLLGTDVVIAIFIIVAISFVPGQLSLSILVGQEVQQGQAPSSLVQGLQSHHLLAGELRLGHAQIAGPRYLVCHH

SEQ ID NO: 989132 - protein, 68 aa, Homo sapiens
AFVLCSGQPGQYVGELQEDSAVPVERIPVLSPGRLKIGLPEGPRGVADVETQVRVSPCGREGCNRPRE

SEQ ID NO: 989133 - protein, 77 aa, Homo sapiens
VLYNITIYAAEENQESTPVVIQQETTGTLRLDTVPSPSDLQFVAVTDVKVTIMRTPPESAETGYRVEVIPVNLPSEH

SEQ ID NO: 989134 - protein, 45 aa, Homo sapiens
AAAYLLSPEPPGAMAGGRCGSRCCFCTISEDDAARRAPPLTPAAP

SEQ ID NO: 989135 - protein, 118 aa, Homo sapiens
LDRKREQQAEPTRFPENRGGGLKALTRGLELTDLSAACCPYTALVGLVGETPASPGTECGGGPWLFLTKAWAAFLGGGEPTHWSGAGAGPITLTSYVAVAELSTEYTWATRLRCSKKR

SEQ ID NO: 989136 - protein, 34 aa, Homo sapiens
LVMPPMLPPGYFGQATGLAAGLIMPIGTTWLEGH

SEQ ID NO: 989137 - protein, 39 aa, Homo sapiens
MSRLMSKGNPEPNCIHIMGCYIQGNPNGEKLFQNLRTLM

SEQ ID NO: 989138 - protein, 100 aa, Homo sapiens
MWTTPIGPILKIPGLNSPIPESCSLGHHAAGWSTPPVDETGKPLYEDVFETNAAEFQTKTEEEEIDRTPWGELEPSDEESSEEEEEGESDEDKPDETGFT

SEQ ID NO: 989139 - protein, 71 aa, Homo sapiens
QLERRPLSRLPLGQAQTSTHPARATALDEQAVPCAPLAQRQPDGSLLSICNLHHSECKCLPDALPVRGPLL

SEQ ID NO: 989140 - protein, 80 aa, Homo sapiens
MKQRLSIAAISIKAFTRQILQSLVVRSGCKSLHRPQRIDDILCFSKVDFVQRTSDGIFHDLYQASDVGYLWAAVTHRFIL

SEQ ID NO: 989141 - protein, 68 aa, Homo sapiens
DLLTQCAKAEKWHLFSHSVHANLASWPYTATKEPASYNLVGPASAGLPLLWKMATADTATTSIYEAIS

SEQ ID NO: 989142 - protein, 89 aa, Homo sapiens
HADNSTSTDIRVIREVYGELCYLEHHLRRFDMDIPGNGPESTDNKESGSSTSSRYVLPPYQTEMLSGDLLVPSTRAVTLTTPSPMQRKL

SEQ ID NO: 989143 - protein, 86 aa, Homo sapiens
TGPCARPQHFDSMLIRHPGDRGGARSLDRLSWRHSGTDGEPMSASQEMESYPWRCSGLCTVPEVMSPRSGDRPSYTDVRRHDRCWK

SEQ ID NO: 989144 - protein, 87 aa, Homo sapiens
VGVSTGIPCSTQQQARGCSRRHWCTLVRAFTDSFINAMSLCNHCCPHRKNGQISMFHRHLCSDPTNGRGQWSLSVACRDPLTIFFGI

SEQ ID NO: 989145 - protein, 98 aa, Homo sapiens
RNPGFSPPPECDCFPQHGMDLLAETHKCDRSSSATSFHINQIMELGQQPYPAFGPVSSPPNAMMSSRMGPSQNPMYAGPAGCIHLSFLRNEWLAITYF

SEQ ID NO: 989146 - protein, 52 aa, Homo sapiens
GEEGLCTRRHWRTLTRLWALGGALGTWAAAFTEEKRRLARGRTEASGGQAPC

SEQ ID NO: 989147 - protein, 78 aa, Homo sapiens
QRHQGGPQHEEEAYRNKVHVMEKGSSLFHDKRRLTHITAEVLQTQTESSAPPQEVARIGEAHLVALSQSDSPHLSFLI

SEQ ID NO: 989148 - protein, 40 aa, Homo sapiens
MASPCSPADVYMGLASDSCAVSVQTANFDLGDHSSISHRP

SEQ ID NO: 989149 - protein, 92 aa, Homo sapiens
PSRFSRLQSHAVSLNDDTILVYLWNSGLDSSDMSYLRAYVSNGCCRPTSGSEWLHDTQWVHHTIHQSLYDPNNASCGPRMGPRETPDRLSAQ

SEQ ID NO: 989150 - protein, 104 aa, Homo sapiens
LRGYPGRPSPAATVFSQYLTSSWELVLVGTFRIQRAGNERTLFLFDKLLLITNNRDDTFTYDAHILFGNLMLLEVIPIEPLWLQRLLLQVVPSLQCTVQALSRL

SEQ ID NO: 989151 - protein, 94 aa, Homo sapiens
FNDYSMNDIHSGERLSCARVTARKAGLTKRSLTLVKAFELPPGDKGELLKALEHMNDLDRLPVCKRSSVTMSEPVEVNQAGSRLKSRPVEVILP

SEQ ID NO: 989152 - protein, 129 aa, Homo sapiens
MHADHPLKLTLTLLTPRCCQQRNPQLTPASLTYGLSTGNGPPHSRMSPGSPTPPSGTEVTLAEVPLLDYGGSGATVCQQAKAVPPFSTLMSCLMPPATFCDPEEVEGEPLVAPQTPTLPSAPEELEQEL

SEQ ID NO: 989153 - protein, 87 aa, Homo sapiens
SYPPTDSLGRPPTLAASATSFPAATAYYLPVHSFSCFALSLASAFSNFFAFTGLNGPNTSTSLSRVGSERNPKREHFEKLWREYRAR

SEQ ID NO: 989154 - protein, 78 aa, Homo sapiens
VSTGSPCATSFSSLQPCDVCNEPYFPHQTLKRSTSPLASGFLRGGQGLFRSFYPQFFTRPSRATAHVSFVSVLPTELD

SEQ ID NO: 989155 - protein, 58 aa, Homo sapiens
AKRAVSPSYQSNTGFRESRSAAVFLDSLNPLLCSSLGQLSITASPQDFKNNLNAQSKA

SEQ ID NO: 989156 - protein, 75 aa, Homo sapiens
IEDYQRLIAKVTEAKGPNPSESPEKDEKQDYKASVFNRPLSKYPQLGKRREINPSLLPPEFPSFQEAPIQAKTER

SEQ ID NO: 989157 - protein, 151 aa, Homo sapiens
PPTIFSGRHIFSRPPQSSQIIRLTALAGSAVSPAATSVISYVTFMDLTACPCTGPQEMSARAFPASHEEISVQEPYPLQMRKLGQKAVGPIAAACRWSRLDSISLCLICHLAVLLPTRPSPRTLGAPRVPLAARLKTGRVRPSDVWMPHAE

SEQ ID NO: 989158 - protein, 42 aa, Homo sapiens
MCGQSVRGVFWCLKSARPGWWCEFLWLRGRAHISSGPVTLID

SEQ ID NO: 989159 - protein, 72 aa, Homo sapiens
FCAPEGSISPSAPRPGSVRERSMHSPGAVVAPGLVRLLLRGGAGVCDARPRGGRAVLQPRVLPGQPPLSLTG

SEQ ID NO: 989160 - protein, 30 aa, Homo sapiens
MQLKPVPGKLSLQSICGQVFWNMLWETWLY

SEQ ID NO: 989161 - protein, 68 aa, Homo sapiens
SALMMHGETGKHGEAGFAIVSLQSTSLHAVEPLSYSTEDFCPAIDDDQTAIPCMLQDVEVHIVLLPPL

SEQ ID NO: 989162 - protein, 32 aa, Homo sapiens
MRGNPASKYDSVFPSSVSSLDAVDKHTLVADV

SEQ ID NO: 989163 - protein, 90 aa, Homo sapiens
ALVQVTSDTLAVRDTGRHASELPCQLSDELAHSLGSASRGRDDVLESPAGHHCHMFPVMGPLHTSIWCGQCIGLGTCVSMQSPSHLSVAQ

SEQ ID NO: 989164 - protein, 63 aa, Homo sapiens
MTTAYKIIMQCLLAPPNVLQHPLANGHSLTHFWYLWTGLTDHMSTATHLPPSKTVDCAPPGET

SEQ ID NO: 989165 - protein, 75 aa, Homo sapiens
GYHTLKHSLYNRQVKGVMGTGYCIDEYSFVDNVFLYLSGSYTLNPEESVCIMLLTSSPLLHGCRYQHHYLTLALG

SEQ ID NO: 989166 - protein, 66 aa, Homo sapiens
LRNSSDSADVDVGSSQQKEMMRTGMKIARGVLPPSSDVSAAASATSKACSRTVLINFTHGQEPVPV

SEQ ID NO: 989167 - protein, 103 aa, Homo sapiens
MFPSPTMTSGLRDKRSIYLMFLPCFPQTCARSRSAWSSWSGRSMRGRSVSARSNSATLQLEAGEATGIAVCDVYNGRQRRRGGNVPLRGDRLFYGNLVNGTTT

SEQ ID NO: 989168 - protein, 34 aa, Homo sapiens
GCDSCFGPVCGAGQWDKCIETATKQNYKILHKYV

SEQ ID NO: 989169 - protein, 45 aa, Homo sapiens
TDLKCSLPSASNRTVIPSPVEDSGDHPLRRFLGVPKPDKIPTQYS

SEQ ID NO: 989170 - protein, 122 aa, Homo sapiens
QCLGLHGMSQPHLVQVHFFILTCPTFPLDIQRLEPWHLDTLGKRFSCQCAEGRYFFILVPDKDFAELPIQHLWDMEYAYSNFIRKRGFQAEGQQDVEQLVQCQAGDHVDLLKRSHAIGKHGE

SEQ ID NO: 989171 - protein, 54 aa, Homo sapiens
ISEACPPGETLERGVGRTVWRKGSEHFESITAVPKRRAVSAIFLGVHGLHSVKQ

SEQ ID NO: 989172 - protein, 94 aa, Homo sapiens
TASSGEKQQKNENATRTLGTIRVKICPGKTEYSFLGLCYGRLSESIFPVGGMDFTGSNGDPSSPDSLHYLSPTGVNEYLMALWSVGSVVQDYDS

SEQ ID NO: 989173 - protein, 86 aa, Homo sapiens
RLYRIPVAPCFPHSLQWSGTVRSHYGLPRSMSSQLCAESFEPGWPGCSSSCPYAAVTIPSVYSALALMPSALVAAPPCVRMFYFIF

SEQ ID NO: 989174 - protein, 34 aa, Homo sapiens
MPRSCAPAWRRAPGLFPRRLVALEIRPNDGVRLL

SEQ ID NO: 989175 - protein, 60 aa, Homo sapiens
RIPALSPMFPTHGLPEKKMGIMASDTAESVTLTRVRSSLIRDTLRGVMVRGDGLSMGCPV

SEQ ID NO: 989176 - protein, 44 aa, Homo sapiens
SIEAGNTGNMYKIEPVLRIITICTNQTYDEGQFVLSIKVTDQRI

SEQ ID NO: 989177 - protein, 65 aa, Homo sapiens
TFTLSSSYYLDILHIGYDLLIFPRTSFQSADPGQLPAASASFQCSIKLLPAAAGISSFPELCCHR

SEQ ID NO: 989178 - protein, 89 aa, Homo sapiens
MLSWFIPITNANSGMLTIYATPERSSCFNFLEGHVAFSHPSIEPLQVCDALRCSWLNARLLLAQRVPTLRRQARVTRVNPIRDGDRGLQ

SEQ ID NO: 989179 - protein, 104 aa, Homo sapiens
RCIMFPPRQSLASAQAGVQRPNLNCSLKPPSPRFKQVLLHSSTIHMKIRWDYRCAPQSPANFCIFPLRHGLSAYVRARLVSNFWPQAIQIHLPRPPKVLGLQRV

SEQ ID NO: 989180 - protein, 56 aa, Homo sapiens
GSASCRSMLMGHRFCASLNAAVCAATPVYPAPHARSIVRSAPKTIPSADSSHRPEG

SEQ ID NO: 989181 - protein, 60 aa, Homo sapiens
MWRPVAASGAYGAQEWSPVPLLCIFLGKVWVVTLYSEQVQRKRQRLTEGGMDGYYVSIVS

SEQ ID NO: 989182 - protein, 76 aa, Homo sapiens
MEGVYRKQTGPTSNAEFLVWGTNVQGGPLSHDVAERGGLVWVFVIQITCLCPRTPDVYSVQAIAQLTLVGDSGVLP

SEQ ID NO: 989183 - protein, 54 aa, Homo sapiens
TRDTVVYPADVVLFEAQLLVFYIAVIRDMFHLRLFVGTDSGVRLSRRRSPGRAL

SEQ ID NO: 989184 - protein, 51 aa, Homo sapiens
QSCAVGIIADADDIDLASGLVQHPVGPHCEMSRPFWENVVTGAGTFLSLSD

SEQ ID NO: 989185 - protein, 146 aa, Homo sapiens
TTVSTGLKKTMFQYWRSDMIIPRYPGQSFNSGVLRLYPYVILQFRVIGIQRGWEDNTSLPFRGSTVTSVEHPPSPTPGDVKGEGTRKNNMEITWTPMNATSAFGPNLRYIVKWRRRETREAWNNVTVWGSRYVVGQTPVYVPYEIR

SEQ ID NO: 989186 - protein, 59 aa, Homo sapiens
MSGAGSCICPCFCALLSYVACWTFLRGWEKVMVVPEESSPSFHTISSAFSSEVTPHQYG

SEQ ID NO: 989187 - protein, 37 aa, Homo sapiens
MTSPCVNGGVCNDRVNGFRLTPGPPRGFSELHVSAVT

SEQ ID NO: 989188 - protein, 41 aa, Homo sapiens
PELFDRVGLPDSLKLPSGHCATPSGVVNSLRLTVAGRITLS

SEQ ID NO: 989189 - protein, 54 aa, Homo sapiens
LIQDTQTVRPELGCRTRKLPMGTELFLPAAGELLAISLSQARITYSPLTHYPIS

SEQ ID NO: 989190 - protein, 105 aa, Homo sapiens
MRVLIERAHAITVQYCCGLREVTAKSISVCGQIPGKGLHVPQHLRLASAQGSSLLPHSKVESLEKSLSTVLNVTDRNLVVISLASVCRMMGIIKLAFVPLHDSVY

SEQ ID NO: 989191 - protein, 128 aa, Homo sapiens
YRAAQGSGLLLVPASHGVPPLPAMGAEEREVNEGLALSPCLTGGTSPTAMAVLRHGGEEELALSTCLAWECQAPAMGVLSSHGGKRGRLSVPASRGVPLPAVMGVLNSQGAQKGLALSPRLVWSAPPP

SEQ ID NO: 989192 - protein, 35 aa, Homo sapiens
TDPQICRQVDRRATHSSRPVIPASESTGGQLSTTL

SEQ ID NO: 989193 - protein, 54 aa, Homo sapiens
TILPSSAHTHPVKATSVPSSICALYVLAIFTPKARGQVASRSQESTQVCQAHSL

SEQ ID NO: 989194 - protein, 107 aa, Homo sapiens
DCRQVGCMCNDFLYFCINSEFSEMLFLAEKIFKIISGMEEVRPVRLVGCPIHPTLGIGINVYEDSDLQQCPGWLRAYLARMFAPAPTHDTPIIVEKFRVLQDARGHV

SEQ ID NO: 989195 - protein, 118 aa, Homo sapiens
PRLSTGCKNVCYDHLFPVSHIRLWALQLDLLSPPSALLVAMHVGLLQCTKPLASSGDERRVNDFYDFEDIPYMPSYGSDRGVACVCAFTSGIFFRIIFAAVFMYIFYFLYSGFHLPWV

SEQ ID NO: 989196 - protein, 46 aa, Homo sapiens
MRSTCHMSQGWYNLYETYWEVYLMSKLRKPDGAGIVHAARTQLRFL

SEQ ID NO: 989197 - protein, 47 aa, Homo sapiens
DGVIECGELRGQRGHLCSQPGPMSLRGLLQLFLGLAEGGDGALQVSD

SEQ ID NO: 989198 - protein, 125 aa, Homo sapiens
QQHTAPRPYDSWMSILVPKRVHVILPKFTAVAQTDLKEPLNVLGITDMCDSSQANFAQIHKVRKPPCFSYLAKSKTLKSVKMEPKLLQQTTAHGTNQSLPGFWLPWFTLNHSHRWQHLSRSGISK

SEQ ID NO: 989199 - protein, 123 aa, Homo sapiens
IPSQQTQQQQRRFRLRMMYLCVKELSVTIILKNVLWICATFRASDSIFFPTALRLYRMNELDGRSRLPAGTLVHLGLLSLNLFPWKFCLALLFGYRFFSWTQLSGITELLPTRVSFGYRCSAV

SEQ ID NO: 989200 - protein, 70 aa, Homo sapiens
AGQTQQATLRPGMRATHVLETTWCPCRMGRSSPEPGHFHEFEGLLSSRLSSISTPVCGALEKDVLSPPWA

SEQ ID NO: 989201 - protein, 69 aa, Homo sapiens
FGRHSTAHMRGPLLSPYAEWQCTVCVMRMSLDVTVGVLEPSDLSSGSWERDQYAVTCVRFQIYKPGPIT

SEQ ID NO: 989202 - protein, 125 aa, Homo sapiens
LQDPHSAPSSTEEGTGQQTCGTPAPLPISALGGLVRPPVRYDEFLPSCIIRPPACDASWIYSFRLLPSLRAAPGSCSTSAAASDHLPTLSAITLSTLSSLRLIMASSLNLLRGTHQAVRYHELGF

SEQ ID NO: 989203 - protein, 52 aa, Homo sapiens
GYRQAENGKLSSMEIPSPSSRSEIPPKSSGAMLALEYVAESYWRLHRHGVNG

SEQ ID NO: 989204 - protein, 69 aa, Homo sapiens
ITPGRFVLQIWPRSAEHPILPLGCKSCHPNIVLEKLSAFLHKSAASLQLLIVVHQSHIHSWFGLLSGIL

SEQ ID NO: 989205 - protein, 55 aa, Homo sapiens
GPAYWAYAFSVTLTKLTDTNISDAQEDRNRLNYPARHHPRSSIVLSAIAYGIRLA

SEQ ID NO: 989206 - protein, 144 aa, Homo sapiens
RHTHLQQQRMGGWGSGAPGWALTRAVLQTLGVIPSPPPLPSLSLPVCIKGLDVWSLNDPARQSDSGLPDTQSPFTPTVHTQRHLLTHTQIYLHTRSPFTATVHTHRHLLTHIYPHTCSPFTPTLHTHTDTYSVMLTHTHTIYTY

SEQ ID NO: 989207 - protein, 76 aa, Homo sapiens
MTVARTPRSVRMPQFAPYASIFSVRSTSFLHMPQSFLHMPQFPPYARQFPPYAPVSSITPRYPPYTPQFPPYAQVE

SEQ ID NO: 989208 - protein, 34 aa, Homo sapiens
KYFFGGRTFSSKKPSLTSIPRWEVSGHHKGGPGV

SEQ ID NO: 989209 - protein, 34 aa, Homo sapiens
HTDLAKVLAQKQPKFNVKPFHELFPTRSVPALEY

SEQ ID NO: 989210 - protein, 69 aa, Homo sapiens
NRTAFAADPFMIRERPHYGVNKFNSNVLLNKHLAEMLEASEGQAPGWFTEASAKVEKNLGLCKAGVYGL

SEQ ID NO: 989211 - protein, 50 aa, Homo sapiens
RTVDYSFRMQDRDVRMTSFRMQMKDVRMTSFQMQMRDVRMTSFQMQMRDG

SEQ ID NO: 989212 - protein, 81 aa, Homo sapiens
DEAPSRDRNPGPVHAPALDAGGRTDRWTDTSTGYEGAASERREDLGIVEKESKDSRGSGGRGRNRDRIVLQEGALLAPYAY

SEQ ID NO: 989213 - protein, 63 aa, Homo sapiens
SERGAKNQMYDDYYYYGPPHMPPPTRGRGRAGRGGYGYPTDYYGYEDYYDYYGYDYHNYRGGY

SEQ ID NO: 989214 - protein, 59 aa, Homo sapiens
EREREDRNICVVHGTDPFYATQTEGDRGMNASLAALLMGRLCEAADRNECLVKREAGMC

SEQ ID NO: 989215 - protein, 58 aa, Homo sapiens
RESEEQIAEVKEAFSMCDKDGHGTITTKELTTEMRSLGQNPSEAELQDMINEVHAYGN

SEQ ID NO: 989216 - protein, 38 aa, Homo sapiens
GTKEGDGAEQGLPEHSEPLEDRDSCTSSSSATSPASAS

SEQ ID NO: 989217 - protein, 58 aa, Homo sapiens
MRQMFANKVKETELLLTHKERELHDAFEHLTRAHQEEKRTVEEKRRQLEEETNAFNRL

SEQ ID NO: 989218 - protein, 66 aa, Homo sapiens
HNRPTLLLFCQVVRASTSWVSIKGLYASRKLMPWRSKMRMSIWRQDVACLGQPGAWAGSHRRLMDK

SEQ ID NO: 989219 - protein, 49 aa, Homo sapiens
MVLKMENPPSLARSHLDWMQSMAPCTRRADTAMTADDTEAPAMTLAPGH

SEQ ID NO: 989220 - protein, 76 aa, Homo sapiens
RNGGGSMNALTAFESLLLFEGKKITINKDTKLPNACLFTINKEDHTLLNIIQSQLLKDPDVLYVVYKDTHPLEHMI

SEQ ID NO: 989221 - protein, 62 aa, Homo sapiens
RTHLCQLIEAGATAFRVFCAPLDCLIESLENRCNELSCRGLERPDSAPVASGSSAEKPDAPQ

SEQ ID NO: 989222 - protein, 60 aa, Homo sapiens
KDVHTQLTLHVGTYCAHAHTHLHNMQKASTVGSTLTREDIENTLENLTMSSYTICLYTKT

SEQ ID NO: 989223 - protein, 53 aa, Homo sapiens
SDLLTWRCPFPNTHKATVILTSQTLSEDMKASELSCPVIILVFIALSSIRPGQ

SEQ ID NO: 989224 - protein, 44 aa, Homo sapiens
DYSQPSSARLSIFSLSSRCLRLLLGAIIFITTIIIIKPPGHNPI

SEQ ID NO: 989225 - protein, 59 aa, Homo sapiens
GRYLLTGRMPISVTLTKLTNIYHLRRSGNRKRLKLSVPAIILVLIGLPSATPPVCWVIR

SEQ ID NO: 989226 - protein, 80 aa, Homo sapiens
MLINPPHCENSPLTRDSSLKTKTDKSLVTVEVAQNKEHCVYFGGDPFLLVNHWANIYLFIETEFSHRQAGAQWATRSQKL

SEQ ID NO: 989227 - protein, 104 aa, Homo sapiens
TCILGVWGQDGRQCVAQKFLSIHHQCCSLMWCFRCEWSRTLAQCFVPGQSLGNATAGRFLTEKVLAYPCVLALDSGPVRGERPIPPVEWVPYHQTGHSQNWRPL

SEQ ID NO: 989228 - protein, 38 aa, Homo sapiens
MNWHTANLIYFIQKDNSLLCFFHIIIGIWEAREVYRDS

SEQ ID NO: 989229 - protein, 33 aa, Homo sapiens
MLLVALFTRKARDEMENVAHVSSLRKRGYRTLD

SEQ ID NO: 989230 - protein, 61 aa, Homo sapiens
PGPYSGIFLQSRPATARRSRCVYPDRSSVCPLPSCARFYRLQCLRVRSGLLSGFRLFHVMI

SEQ ID NO: 989231 - protein, 71 aa, Homo sapiens
MRPPVRGSGHYLWYSSSVDLGPTYPGINSEADTRQSHPQKGPSTEAASADRLHSWTRVGLLPRELQIAPHP

SEQ ID NO: 989232 - protein, 85 aa, Homo sapiens
SRTQALTEEDAQIAIMQQHIDRLPLLNEKQCGQPTGAQGSLRSCVTRMRALPCGCFKPLSSARTCKTEKSQIDRKINQLSDEVSV

SEQ ID NO: 989233 - protein, 36 aa, Homo sapiens
FLLMRCLYTSSLLKPQLLDPVSPSFVISDVPLITPA

SEQ ID NO: 989234 - protein, 53 aa, Homo sapiens
FLALEFMERYNWNRRLRSKGMRERFFLALGFVERYNWNRRLRSKGMRERFFLA

SEQ ID NO: 989235 - protein, 74 aa, Homo sapiens
SIAVVSIPRQLPVSHSEAGVQGLSAEDDSELGSHCVAQTGLELLASGDPLASASQNAEMIETESDCVTQAGLQL

SEQ ID NO: 989236 - protein, 72 aa, Homo sapiens
RARTRIRRWDYRHPPSYLANFCLDGISPFGQASLKLLTSGDPPASASKSAGITGVSHCTQPVTVLLITSISL

SEQ ID NO: 989237 - protein, 130 aa, Homo sapiens
SVSGSHSGIKATFSALMFSTFSEEDNYESVHESFWEQQKRQCQGLGGRFPSLLSPVHLGLRQYLHTSDLGTQLEGPPDRRRKATGRNPGTGCRCCSWGLALSSFHRGPWFKASSRTKVLVLLSPQLATSS

SEQ ID NO: 989238 - protein, 131 aa, Homo sapiens
ARTLWGCLSLTREQVHTACHTHTHTHTHTHTHTHSEVLTSPQPRARIYLCAHDTHTLYGTHTHTPSHMEHTTLRHVHPHISHIGSLLYRDTVISCVHTDIGFRCRTHIETCTLETQRKRKISHTLSLTSHS

SEQ ID NO: 989239 - protein, 122 aa, Homo sapiens
FRQKTKTTPANTANPVSTKYTKKQPDMVGGCPQSQPPGRPRQENGTNPGGRTCSEPKPHHCTLHSSLGDESETPSQKKKKAYPPKASSRGFSHINRQTQEKELFPLGLLMGLNKTCQKPGRH

SEQ ID NO: 989240 - protein, 88 aa, Homo sapiens
PKRLQEAYNKHYQPSWAPFSRCNQIFTEGELMDLHASTILTCRLLAIYDDRANAADAKHSTLSIRLNIFQKADSLHRTVSDSAAYYSS

SEQ ID NO: 989241 - protein, 35 aa, Homo sapiens
SRSAATELALNSSELRSSECIAESTTDGAAFIPAG

SEQ ID NO: 989242 - protein, 105 aa, Homo sapiens
MEWNGVEWSAVEWNGMEWNGMKWNGMEWNSEMKCKLRFCHYTPDCVTERHPVECEEWNGMEWNGMEWNGVEWSGMEWRGNERNGMEWNGVERSGVKWNGMRWNRM

SEQ ID NO: 989243 - protein, 34 aa, Homo sapiens
RGGSKAGGGYDFYDVILRKGADCCEQSVDSAYSI

SEQ ID NO: 989244 - protein, 86 aa, Homo sapiens
MAITEKAMGPCMVDYACNLSTSEGQGRRIARGQEFKTSLGNTVDLIATKNKNISQVWRRVPVVPATQEVKAGGLLEAQEFKTAVSY

SEQ ID NO: 989245 - protein, 119 aa, Homo sapiens
ENPAGITRESACHVDSDFYKPPLQAGSWLPRALLSIPPACSDTATPAPAGPPRLTGIEDGLERLDVRGHARYPVDANLLDTPLLHLLHTLPDDVGHLGALPPGVEREDGRRAAPTTALP

SEQ ID NO: 989246 - protein, 143 aa, Homo sapiens
LTPRGSLSAQIPGSLWLQTEFHHVVSHVMSKPQVIIMALPVIECSLKRLEERPMTFVLETPESRFITTMLRLPLWLQGHFFHSFIYNRCSICCVPDAILGSRETRQSPCFPRHPHSRKDCYQPGVVAHACNPSTLGGRGGRIT

SEQ ID NO: 989247 - protein, 97 aa, Homo sapiens
ANRNFLDQGYTYRCAYILSIYTMYIFIKPQNLPDREISDRCPLTELKEDVASKITEPILRHQSSNQIASNPVLQSSLESPGGALDTIDPCRTLPGIR

SEQ ID NO: 989248 - protein, 63 aa, Homo sapiens
RCLSTTPGVTRCHTVGPWDRSSDVFPGPTVCGVCVSVPGPGTVPHLGLHTPPDDGPLGGYRRS

SEQ ID NO: 989249 - protein, 94 aa, Homo sapiens
RNSGHGITGMCYHIWLIFVFLVETGFRQVGQAGLKLLTSGDPPTLASQSAGITGVSHCTRPYSLLFLIYLFCNDVSDLFFFWELNFSLKPIRGF

SEQ ID NO: 989250 - protein, 51 aa, Homo sapiens
VAREAQQVVTPLMVADTRWLRSPYGGGGQLQGAEADVILGLVINGVGFICV

SEQ ID NO: 989251 - protein, 82 aa, Homo sapiens
DPFGVGGGALANWTAVVGCTAQFRCGLWEAEAEEAARDGAEDEEAGRLVMLTRPLTKLKRGSGHKGVATCWVQAPGKSGQYR

SEQ ID NO: 989252 - protein, 90 aa, Homo sapiens
FKASRVLERRIVPHQLRGGAGQLSFNNWTRSTEHQSWPVRRRSTDHPELGQGLNNGDRSPPVPASGLECGYRTKGLLVLQPLYSCMPCGH

SEQ ID NO: 989253 - protein, 162 aa, Homo sapiens
ILRQSGRTLDAGGGCSELYLHHCTPAVHRVRLSLKNNKQQKKKMKIKMGPQDVAGWVCGGSAAKGECYGKATHRKTKEALVDASDTSPKVVTESEQWIFKPGRLAESQSSSYKNLRTTGLAWSLRLSRPHTCPYTVAPIVARECGHCVCVMLAYPILGPIQM

SEQ ID NO: 989254 - protein, 33 aa, Homo sapiens
MLHVLGRCRKNLDPCSLWVVHKAQHGPEPQEYP

SEQ ID NO: 989255 - protein, 49 aa, Homo sapiens
MVSKHDLVSFFSRVALGGSGGASVSSTGVAPRGANTPAHWKKGVVPRIF

SEQ ID NO: 989256 - protein, 81 aa, Homo sapiens
SSGGGRCANATYIKSTMTYHATFVAKPFGSARLEVAGLLAGELLQERTFRGVQHYKADCILSNTDHLPLMRPAPTLDGTLT

SEQ ID NO: 989257 - protein, 78 aa, Homo sapiens
MHDGVGKPLGSFATPVQGSSHGRLAVSAPVLPPMLPMDEPNVPRARGLVDPADTAPLTREYREWSSPGTHEFILSSTF

SEQ ID NO: 989258 - protein, 84 aa, Homo sapiens
QLRLDTVTMRAVRRHLVPQHSAPGRGAACQWLSDDGYWTDYDACVCDYLEQQVASDNQLARLSLLGYIYTVNYTTHTADQQDYQ

SEQ ID NO: 989259 - protein, 105 aa, Homo sapiens
MEDSQRDDRTLLLVPPSDDDHAVGDIGGDMVISAVDADIKHRRTVALQHLLTAALVARSTSEKRTRQRSHCQTPRRPPGGRHEAAKMLRTGCELCLGKLSPALRA

SEQ ID NO: 989260 - protein, 74 aa, Homo sapiens
ELVRTVGIRLINLYTALRRSVALADAMDALPCALSVTVIKFNEARVSGGSYYDFLRLPNASDLISDAHDSLNEI

SEQ ID NO: 989261 - protein, 79 aa, Homo sapiens
DQLLQHRLFTREPQDTYHYLPLSLPHRRPHFFFAKFRIARSLTPFSPYEPLNFHAMFQPLLEMIHEAQQAIDIHLHSPA

SEQ ID NO: 989262 - protein, 67 aa, Homo sapiens
DLGAVHTRAEGPGPQYWRGPGLKTWAERPCPPIECEHDRKQSSRPGLRGSGGRQAAQDPVHPLMGRG

SEQ ID NO: 989263 - protein, 33 aa, Homo sapiens
HAGCQEVLERPEPPPGLRKIRDQEGRRRSLCCL

SEQ ID NO: 989264 - protein, 46 aa, Homo sapiens
YDCLVLYTLKRVRHHCARAARVMHDVFQHILFAQQSHAMYRYLRVR

SEQ ID NO: 989265 - protein, 65 aa, Homo sapiens
GTEGRQQDGLPDREQALRCPDPVAGALRGLPQGAGELENTLGAQAEAASVGAKEEEATEGGLVRS

SEQ ID NO: 989266 - protein, 91 aa, Homo sapiens
NNESLKLLKTAIGKAGYTDKVDIDKDAASSEFFMAEKDDLDCKTPEDPSRYTSPDQLDDLYKAFMKDYPAISIEDTFDQNDCGASQKFTAS

SEQ ID NO: 989267 - protein, 71 aa, Homo sapiens
ANAALKEKIRLQRNTHYEEVRRLHERLPREEVHVKLDKARPHLTARIHERPTRPEQRTDNSRAAPADFYSV

SEQ ID NO: 989268 - protein, 47 aa, Homo sapiens
NRDAFASPAPEVCGSLQVWGLSSLHQLPYAVVLIQVISSRSLSIMSS

SEQ ID NO: 989269 - protein, 81 aa, Homo sapiens
DSVIVVLIGGELTQITLRAVTENIKVLFPTEIHSGVLEVIFSVPPILTCLPPPRVLWGPQGESQVEDQTETRLLVSHDVSA

SEQ ID NO: 989270 - protein, 34 aa, Homo sapiens
NPTPFAEWRTLYPSPPGLVAGCLLLWGLWSDPFG

SEQ ID NO: 989271 - protein, 98 aa, Homo sapiens
MDPRLTAYVCTCRILCVHVRNDKSVGVSECADLECSILLCNESKRVCRRVAGHLSVHVTVLDITGRALTGTLRAYVCACECVMGVSGRVCVLCIRPGK

SEQ ID NO: 989272 - protein, 36 aa, Homo sapiens
SPERQTCWEPEDSPILVLRCDSHSLQFAAAPKVVPV

SEQ ID NO: 989273 - protein, 70 aa, Homo sapiens
LVFPLYANLIFKAKNSSDSVALGIAIDESGDIRTDMQSASNKTTACTPLLTTGATLTTDNNQVQYRIGTL

SEQ ID NO: 989274 - protein, 39 aa, Homo sapiens
RSTLQKSKAENSMSHQQTVNIMPHTSSPILNCSQRRSRR

SEQ ID NO: 989275 - protein, 51 aa, Homo sapiens
TLEIPLFSNIFVIKREFEFMTHNMNLTDSDIKLCEKKTRFEVVGAEEVGGE

SEQ ID NO: 989276 - protein, 95 aa, Homo sapiens
MMKSLPVEKVIKSVGWYNSYLFHPIAACQNFPVESDWDEDPDLFLERLVSLTFGSPSRYQLDYINKLTNVDDSTCHWGPRLTEEHFGRGLKDTDK

SEQ ID NO: 989277 - protein, 61 aa, Homo sapiens
MWPQTVVTILSATSAAGSLPLQLRSKCVTRIDAPKSHLEFCFLWGSSHDLLSFGGPPPKES

SEQ ID NO: 989278 - protein, 132 aa, Homo sapiens
MFKPNVRNLRTLKKKLEELLTRIVSLEKNINDLIKSKKQHKNFVKHTQVSVAKSMKQKKVYQQIEDQLNKIKHEDKISRKNNEEEQQRIQEIWDYVKRPNLRLIGVPESDGENGTKLENTLQDIIQENFLNL

SEQ ID NO: 989279 - protein, 178 aa, Homo sapiens
NIKNNFALIYELPEESLDFGYPENCQTGALKTFITQQWIMSQHQTKEEQSQMTSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRY

SEQ ID NO: 989280 - protein, 43 aa, Homo sapiens
MGKHFGTPVETPARVSHGTPVPLSQSTGHAVLASGLSKPRIKR

SEQ ID NO: 989281 - protein, 37 aa, Homo sapiens
MSAWHVVSTSITISISASHIAISTTICIISNCTASAA

SEQ ID NO: 989282 - protein, 79 aa, Homo sapiens
MVFSSIRSFKDFFAWVILVIHSSNLFSRFLTSLPWVQTSSFSSEKFDCLKPSSLSSSKSLSVQLSSVGEELDGHRDPRV

SEQ ID NO: 989283 - protein, 34 aa, Homo sapiens
KCNDQYQNGSKLCNHPDTCCVSEGFGGIDKHRVP

SEQ ID NO: 989284 - protein, 43 aa, Homo sapiens
MQERDFRCLCVSTQMALVIIMPHRVIDKEGRLYVLCQGVENDV

SEQ ID NO: 989285 - protein, 114 aa, Homo sapiens
NEIHTHKQSLWYVSLLQARRNTSLLGVSGFTYSGHTMINRVRQYVALCIRLLSLSLFSSFIHVVYVLMVHSFLLPNNIPLYGFTIFCLSIHQLMNIFVVSIVSTIMNNVAMNIL

SEQ ID NO: 989286 - protein, 41 aa, Homo sapiens
AYCGVGVNSVEMMDKERNKDKMPEDVTFSPQDETQTANHTP

SEQ ID NO: 989287 - protein, 40 aa, Homo sapiens
MAVIHLFLFALPFLRILYITDEVNDPSLTIKSIGHMVLNT

SEQ ID NO: 989288 - protein, 92 aa, Homo sapiens
FGVLRPTGGRLFCDCPWRFGLCSHESPGYAGASWERVVIGSSLRGLALPFPLPKVFIFADPDDWPNRISYPSPKGLPTLQGLSGSEEAGQSL

SEQ ID NO: 989289 - protein, 84 aa, Homo sapiens
MLSPATLPRMNILVQTHSCTFKPTIVPSEELHSIASWMQFRLDFTFLSVTFDCERQVTIYTRVLENILVSYFVPTGSEYQLPTK

SEQ ID NO: 989290 - protein, 45 aa, Homo sapiens
KIPVPGLVGRRKRHCSLRPADGLLTGVGAVWTEALVSEARYGLDA

SEQ ID NO: 989291 - protein, 103 aa, Homo sapiens
VIDATYTWEKIFATYSSDKGLISRIYNELKQIYKKKTNNPIKKWAKDMNRHFSKEDMYAAKKHMKECSPSLAIREMQIKTTMRYHLIVASINTGVYTKVASIN

SEQ ID NO: 989292 - protein, 40 aa, Homo sapiens
IYRIPIMRVPGGITRKILCRLGGVKAKVPYLLDISIYRHI

SEQ ID NO: 989293 - protein, 76 aa, Homo sapiens
GFWKVVAYWNERLTKQFVVFLRQVSQLPTLGIFHGYQLGTEPSTELNNLQVWFLIRLFGNPTGHSTLSILAISDFF

SEQ ID NO: 989294 - protein, 114 aa, Homo sapiens
LRRHGGPFRHRAAQVPDDHLLKEQHLASLHQALWVLTTHLTTLSQVGRQSTNYTNQPRKTTVLDYTNVPCETSPSQHYSQWDTSPLTILTSPGERPIKYTNQPIINQAIIDTNY

SEQ ID NO: 989295 - protein, 48 aa, Homo sapiens
DPPGVLEETDGGQVLADDEGGVTGAPALPPPSSLMSFSSVGGIRAYFT

SEQ ID NO: 989296 - protein, 39 aa, Homo sapiens
MQLGINLSKGVLGGVLIFRDYLILLKVFSIYTVGIDKHG

SEQ ID NO: 989297 - protein, 50 aa, Homo sapiens
DKGKGGCWENLRRRYPQQQETILQVLPFLSPPMSQFRKLLSLSTLPLLAH

SEQ ID NO: 989298 - protein, 36 aa, Homo sapiens
VSLQAHLPLIRSSSCQLGLLNCPGVGQAPSSFSRLR

SEQ ID NO: 989299 - protein, 84 aa, Homo sapiens
MIHNISLRNFLLFPVFGSQASHLGRVGSAPPSHPPSSVVDDSSHIQPRHSSRVAFISSLLQGSTRPLVESPPGCTGTVPLASCH

SEQ ID NO: 989300 - protein, 51 aa, Homo sapiens
PTDWVLRSGAFTDDFQALRGQRLRPVSKELDPFETVELCQLLLEWPGWGCC

SEQ ID NO: 989301 - protein, 75 aa, Homo sapiens
SDESALEWINSRLELIMKSGKYVLGYKQTLKMIREGKVMLFILAINCPALRKSELEYYAMLCKTGVHHYSGIDKY

SEQ ID NO: 989302 - protein, 101 aa, Homo sapiens
YEMERVGFSKIRLELSGEGCSPGSRMSEKILRALGEAVPSGLVGTNPGKCGGSRGGVGPLPPGSQAAPGQDWAEGATAASTLILETHRRCLGFGMHATIFS

SEQ ID NO: 989303 - protein, 117 aa, Homo sapiens
HRLTGPTSPTLGERGSERYTAEDFELTQSTRVKLSKSLAVCQVAFIVRRDNGSIEVGFRGASGERKEYFFAPALDLIPTYSTLLSAGAKLGGLRYYIDTQFASVLSFQPPLAIYIQL

SEQ ID NO: 989304 - protein, 82 aa, Homo sapiens
MHTTALEASRALTEELPRHLAARHLIEKSVRKIVSLLGRAPRLRWSSTCPREPRSRGTAANQERPCLHFRNHLLGDSVALLY

SEQ ID NO: 989305 - protein, 58 aa, Homo sapiens
SVLGSKVLGLQIEPLHPAKIHLDEGFMEDERYELGLGWSSLHTLYDVSDGPGMEFLYL

SEQ ID NO: 989306 - protein, 62 aa, Homo sapiens
LTREMKASDADHGTRRGRTQNPTQRNGSGANNTTHNLSLTWTHRAEAPETRVLPHPSAWWLC

SEQ ID NO: 989307 - protein, 55 aa, Homo sapiens
HRAGDSYLTVLISLTDTQTYLSRPLCQAAIFSKALTLCFTTIGHFFGHNSTTGSS

SEQ ID NO: 989308 - protein, 76 aa, Homo sapiens
MEDVYGTEAVVVHITTLKKCRNETEKHSESYKFLGSCFNVYSTKGRGKYTKYVECISIIFIWYELSSAGEEVLGYY

SEQ ID NO: 989309 - protein, 37 aa, Homo sapiens
FDGDSHVPASSAARAREASLPTDVSQSRMESLSLAPA

SEQ ID NO: 989310 - protein, 42 aa, Homo sapiens
EPPLSPPPEASPFSPLEETPLFPPDESPPSPALETPISRPPE

SEQ ID NO: 989311 - protein, 60 aa, Homo sapiens
WPAAEMAKGSFKYAPNFFGHAADQQRGVTIDTSVGKYETSKHYDTLIDAPVYIHVITNYA

SEQ ID NO: 989312 - protein, 73 aa, Homo sapiens
EFELEESYNGRFILGTIMNTIRVVTLQLLNQQEQEKEESSSEEEEEKAEERLRRPSQEQSVSASSGQTQARLN

SEQ ID NO: 989313 - protein, 119 aa, Homo sapiens
FDGDSLSHTVLRHTHNDTHTFQRHYTYPHPIQLLTLTNSQAKYIHTHRHTHHSHTHTHTHTHTHTPNTAPLLQHTHTPNTAPLSQPHADTSTLSYIIIRIHPIKTMEIHWMMIYESLRR

SEQ ID NO: 989314 - protein, 73 aa, Homo sapiens
PVLWEHNNCGVARHKPLYEAGYRRPARLGLLRMSDSSPNVLSSSRRLSPTKSNNLLSLLPALVIVIVVRGGSS

SEQ ID NO: 989315 - protein, 121 aa, Homo sapiens
PGAHQYTQSHSTVRPGARQYTQSHSTGRPGARQYTQSHSTGRPGARQYTQSHSTGRPGASQYTQSHSTGRPGARQYTQSHSTGRPGARQYTQSHSTGRPGARQYTQSHSTGRPCTRQYTQS

SEQ ID NO: 989316 - protein, 82 aa, Homo sapiens
FDGDSLNPITNDLERGSSYFINKRRGSIIQQYDRSAVDDHSEQKTLGALLGLCFEAPGCPGISGTLLGYHGLRLLDILQMTS

SEQ ID NO: 989317 - protein, 83 aa, Homo sapiens
MSISDDFENRILLNCPYCTLNADRKTLETHIKIFHAPNASAPSSSVSTRRAIINEELLKPKQSDSESKLFITVRRALTEILFM

SEQ ID NO: 989318 - protein, 75 aa, Homo sapiens
SRIPDMASCNRLRNTQLTRFAEDSTQPATLSYQNESLVPCPEAGSSVPYSALLEALLNPQLLTAADSLSSYPEML

SEQ ID NO: 989319 - protein, 55 aa, Homo sapiens
GPTMRGEDTGEALIVLGLLHSPPFLQELGAHGASTTSHVAPVEGSRQLHLYPGNV

SEQ ID NO: 989320 - protein, 37 aa, Homo sapiens
ARLLHVVALGGLVNLGMELMLGAGSRAVLAVRLRSSH

SEQ ID NO: 989321 - protein, 91 aa, Homo sapiens
LHRMSGTYVQDFSLTMLAKWRWLPAGVSVPYHTDPSLGLLVCSHDMAVGSPTVSDPREKGKTTTSLMAYPQKPHTIFLITHRSVSPKVEGA

SEQ ID NO: 989322 - protein, 70 aa, Homo sapiens
GTALQGAPSCLEQDFRKRSIVTGDRCMVLHILAEKFSCDDLARRGHSFWSMELHTVCQYDAQDFTVDTAD

SEQ ID NO: 989323 - protein, 84 aa, Homo sapiens
MLNKSGRHYGLAALLAEPFATKEGSTLCTEEVFRAPRPVKGWHHFIQDGAAAVVAALEKEVVVDLFTVGLAIPLEEVPESDLLL

SEQ ID NO: 989324 - protein, 93 aa, Homo sapiens
LSRSPTDDHEQTEHYSSIESGDTDLVFTASLHLNELSCSREYFFMTLRNQPMSLSLYRQFCEHQELQTLNDLYNQDDNHQELCSFHIRASYAA

SEQ ID NO: 989325 - protein, 47 aa, Homo sapiens
AYLLFSSDEELQICPMARSSSYGNDAVPGVRRRCSSLTFLGYGILTA

SEQ ID NO: 989326 - protein, 47 aa, Homo sapiens
HRWSDMSVISLKALIRGSVVLRVRERDRGRGGRRKKRKEEQEEKVHA

SEQ ID NO: 989327 - protein, 36 aa, Homo sapiens
MGHKKNAIKTQQGVPFSHKWEGNSLKGRKPGPEGIV

SEQ ID NO: 989328 - protein, 73 aa, Homo sapiens
SICAGSTLKRCPIMGVPGIERIIVKSIGADVNKMTQYITELSEMVAHIQRTVSEAQYELTILCMVVSHIKSIT

SEQ ID NO: 989329 - protein, 67 aa, Homo sapiens
SVIDGTLLRLVVLVDGGEVMDRRPRLTWLMLCSWDSPGPPGTKLGPECCCNMESVILSPVSVTFQYP

SEQ ID NO: 989330 - protein, 62 aa, Homo sapiens
MAVLEDVFSTLIVKGDSMGLTNRNLLHVLPVQYFILSLDESSSCLRTTFFNPPLSILYVIDV

SEQ ID NO: 989331 - protein, 92 aa, Homo sapiens
PITATVPVEVSRKIPNIYETVAENTLQVIRKKHREEEMWILLLHLRGHLSPAPPKMSCCPPERALHVTIVPGPSLQAPYSAQSLSPLWILHS

SEQ ID NO: 989332 - protein, 33 aa, Homo sapiens
MASHCEASSPHGNKRHVFHFGTVSPQTSQAGVA

SEQ ID NO: 989333 - protein, 42 aa, Homo sapiens
MLCRATKLERRWDAGYWYREVPAASRPCLDPRHIGVVWSRDW

SEQ ID NO: 989334 - protein, 135 aa, Homo sapiens
HFWPYDETFDFSALALLLHDPDAEHTGSCCLGQENLTTFWSWGLIEGLMKMMIIALDRAPSWCQKFRPEDIRGLSCWVSRDSPCKLPGDFFYVFPLYAACEDADRRQCIRNTEVGFCYSQDLLLLMSPVVYPDYF

SEQ ID NO: 989335 - protein, 97 aa, Homo sapiens
RHSLSACYYPDLTLVCICAYNKELSKERDALRLEFIQEQFIPFSTASGHNRSNEDLKQDKSELDEKLQVLVTEMLWWPEKLCAAGEAVSARRRCGTS

SEQ ID NO: 989336 - protein, 95 aa, Homo sapiens
PQASPPITHLGAHIGAVGLLRHQERVTQNELLKHVTVKIFEVVTSRWTAVLGTAFVRRRQSMEKLVEKLLVLVNLFNAQLKAFRDEEKARVAVVD

SEQ ID NO: 989337 - protein, 78 aa, Homo sapiens
PHSFFNKSSPRTFLRPSPEDEAIYGPNTKMVRFNEGRQRGPPGVAGGNDVGDIVLLAFNDRDPRAEQDEAVQERRPEF

SEQ ID NO: 989338 - protein, 71 aa, Homo sapiens
RHSFSGLWIPSIAEILATDVSVDEMRKGLQAPRLMFNYATWKHKEMLFSRCPSKLYSEPVYQQQQAKGRVC

SEQ ID NO: 989339 - protein, 137 aa, Homo sapiens
GAQLLPSLLCPWSACCPRLRQVSGLPDGTHPAPTLLLPNTSLTPKGQSGGAWSAACVRMRRKESKGSEGRGAPTTSPSTSLIPVVMETVARDGGSLGVSGNCAFDFPQAAGGQVRLRQEREGPQTMLPWAEACFVLG

SEQ ID NO: 989340 - protein, 49 aa, Homo sapiens
MCRSSLGCLVSDSLMLSPGCSGCPDYLAEQAGWRSGTSYLIKLWRAAYR

SEQ ID NO: 989341 - protein, 120 aa, Homo sapiens
GRHSFSAGVVSHFGRILKVLRCSNATSALLAWPPSLRAVTAARTSPLLEAEQEVTRGCAHTEGAGAAGAEKDVASKIWKLIFARIESLLGSHISRAPGSWLTGSSRLLDTQYSWVVPLRA

SEQ ID NO: 989342 - protein, 72 aa, Homo sapiens
MTHEAVHSTVLASILDASYASVRLLPAPVSYYFDRDDVVLKNVSHILSSPISLREREQAEKLRSFCAAGVPS

SEQ ID NO: 989343 - protein, 30 aa, Homo sapiens
MGRRREVPKPHIVQISQRLVQLVRIFVQLR

SEQ ID NO: 989344 - protein, 65 aa, Homo sapiens
MESGAVPPSGEQHVKAHRRPQCSPGPWDSHAERRRSFMCQSRLLSRDCGSARGVPYRCIEAERHI

SEQ ID NO: 989345 - protein, 49 aa, Homo sapiens
GHSFLGCTWFSRRPRVGVHVVRPSRRAQPVSRRSTVVKVGDGAGSGRPA

SEQ ID NO: 989346 - protein, 149 aa, Homo sapiens
SRDPRRTASQLCVFRRKDINTTDQQYHCASDMGSGMNRSTIVNYQMVKTKEAGMQPELQIRGVGFDRTLGGLSDVSSGFENVLSGLLNEQRQWSESLGWCWGNPACPGQAVCVEACVGFPGVLWAYADRVGHIEGLMGDVDFKAPVPGV

SEQ ID NO: 989347 - protein, 51 aa, Homo sapiens
DYSAIYKVLPALKKLASQNDVYLLHILYALAKLCFFFYILFVENGILALCS

SEQ ID NO: 989348 - protein, 48 aa, Homo sapiens
MVLSLGPQNLFSVRQSLALLPRLECRGVIIAHCSLQFLGPSYLLSSAS

SEQ ID NO: 989349 - protein, 71 aa, Homo sapiens
SLVTLGAWDGHFMRSSWEMYKYGHTDSFMTEASVCLKNMEHVIYEATHGYKLNATNELNLPLEYHVTICET

SEQ ID NO: 989350 - protein, 102 aa, Homo sapiens
MPELVTFNAGTCLYPVYRKMKDPSFQVLVNPYSPSATSNQPSLIGLPFSLPPQARNTSYTFSSLSEDVSYPSSSSSLKPPLLFQKLQSLCVSSKNRLDCCSL

SEQ ID NO: 989351 - protein, 55 aa, Homo sapiens
MWPGCFSIILMAYSYLVIRLIAWSVTSGMKLRSPQHTLLCSVVDRFQYLAARELV

SEQ ID NO: 989352 - protein, 56 aa, Homo sapiens
MYKYIVIEPTRIGDETVRWITVWHNACTRLAVLAVAPACLFNPFALLLGILPYYIF

SEQ ID NO: 989353 - protein, 31 aa, Homo sapiens
MQDRRYLTAKPFTAKQLRRFRTPSETTADSY

SEQ ID NO: 989354 - protein, 41 aa, Homo sapiens
STDDVNDAIRRLRYTEKTVLSATFTFYNILLTPLIDSYQYP

SEQ ID NO: 989355 - protein, 34 aa, Homo sapiens
TSIYTHLAYQGLIGSFTGIHFTGEGLHLSNRYSV

SEQ ID NO: 989356 - protein, 60 aa, Homo sapiens
VGYCTYTVSSSRGYSPDTRRHTEQDARPGVTLSMEEVGSARGERMVARDTESLVLGTEAY

SEQ ID NO: 989357 - protein, 44 aa, Homo sapiens
GKLGYVDTRGRALNHASMEELGQLSFNTDTALMTTHELCQWRTL

SEQ ID NO: 989358 - protein, 52 aa, Homo sapiens
VQHRAPCVEDMVNNNLKYADDEIYCGKTKDIVKGLRSVQTLADESKQEALKN

SEQ ID NO: 989359 - protein, 67 aa, Homo sapiens
IPKSTCQTAARSTSNGGITHMPLHGTHTHNMKDTCWLQGHKTAAGYKSNTAQNLHWGREGQTGVGRA

SEQ ID NO: 989360 - protein, 51 aa, Homo sapiens
MGTKQRALGSGMYTITGSPVSVALAQYLITACLETAKSTSRGTPSSAPADL

SEQ ID NO: 989361 - protein, 95 aa, Homo sapiens
IRSLRRRGYARVTRSVYGKHRPPAEEPAPHLELQEENFLGCSVQRACDCFARKDKPWEEVEFRTRPRAHCFCCGSQDRKSQNNASGGSCSQASCP

SEQ ID NO: 989362 - protein, 61 aa, Homo sapiens
RFVCHALRGLSTVPQDELSPQRESDVQVTGPVSGPNFASLSPLWILTLTLDSSAHGKNRIA

SEQ ID NO: 989363 - protein, 81 aa, Homo sapiens
YGSWCVMHYGALSQLPQDELQPARESSARHQVIRPQPPGPQIRPDSPALDPALYHSNLLLMGRPELILIKHTTGFPELEIR

SEQ ID NO: 989364 - protein, 48 aa, Homo sapiens
FENLRPFALVDTYHDVIVEELALSMRILRVIRNDITINHRAQAQLVPG

SEQ ID NO: 989365 - protein, 69 aa, Homo sapiens
MRFVVSCTTRHLVSSPKMSCSPRESSDVTSNQAQLQAPIASSPALDTALYHSTLLLMGRTELLLIEHTT

SEQ ID NO: 989366 - protein, 84 aa, Homo sapiens
YGIADSSGKNNDKRDLQYVARGNHRGQNSSHYKAEEEREEVPHRKRGEEDHARSSLGIGLRLPLVLGDTHLLNHALHHLNVGLG

SEQ ID NO: 989367 - protein, 133 aa, Homo sapiens
MQALCQTCRERRSPDPHRWRRGCFWNTPSASLDYLWYKSYLLCSHFHPPQNQEAQSPDPTHLWGPGTGFLSPFCSLHVIQSNFTFFSLSLRQNLALSPRLECSGAILAHCNLRFWVQGFSSLSLLSSWDYMHA

SEQ ID NO: 989368 - protein, 133 aa, Homo sapiens
LRKNDLPVAREDGHGGFPGGNPSRLLGCSTGHCLLDKRDAPRRFAVLGAPFLWLEGTVWSLWAKSPHKLSDRQVLGSQESQGIDSKAGKRQSSGPSTVQEFPYGVLGVSDSKALLLNTSEWNLVEPWKRNKSV

SEQ ID NO: 989369 - protein, 67 aa, Homo sapiens
YRTAGQVKEEALCSSEQSEKGGGGGVEVVCVSYWSEGTKLCLLMFVSCNSDRSITTDLLLGSYLTDA

SEQ ID NO: 989370 - protein, 37 aa, Homo sapiens
MTATLLWGVKIHTKIHMGTQLDFRHSRGLLQRQRSNI

SEQ ID NO: 989371 - protein, 68 aa, Homo sapiens
MKYTWQPVFTLHLVYTDPLYALISYPLRFYHTDKENETNGTGTLSSLSSRVSDGNNKKAPNKKDTIRI

SEQ ID NO: 989372 - protein, 66 aa, Homo sapiens
MHVDNTDPTLMHGHTAMRKHMPTHAWCRKLITQILTHSCTSTHMHGPTLTHPYAREQTHAHTHTHT

SEQ ID NO: 989373 - protein, 61 aa, Homo sapiens
MIKSCVPQVLGRSDSLNGKNPADVIKADVLRKFLAVLQQSYLIEADVHFCWCIFKVKSLLC

SEQ ID NO: 989374 - protein, 58 aa, Homo sapiens
WIPHCGSAPKRRMLIVVVSKKLQITVSLRGGMLEVEGESDFTAEPVAPSTDCVVCNCV

SEQ ID NO: 989375 - protein, 91 aa, Homo sapiens
AANALLSVGFKYVLLHMWNNSQELATRRVCWVQAGLSHAHPCTDHITANCTGGVVAPRLPLTPLRTRLCSHVRPRRPRVCHAGTTFGDGDS

SEQ ID NO: 989376 - protein, 33 aa, Homo sapiens
MEKPYLHYKYKISRAWWHMPVIPVTGEAVPAGG

SEQ ID NO: 989377 - protein, 75 aa, Homo sapiens
MCIALQRMAQSKTPSHNKKIPPSDLTCGNSVQTAVTEDHKWGGFTFLHNTFFSLIVSGGGKVHYRLRANVLPLAV

SEQ ID NO: 989378 - protein, 74 aa, Homo sapiens
SYRLCEVTWRPALAENRSDRNAVCPGTPRSLAFWLAAMRQSGAPREPRGSRLQTETTKLPGQPSHAEIAEVTPR

SEQ ID NO: 989379 - protein, 56 aa, Homo sapiens
AQVPWSESLQTLMILVEAVVAEKTGACDFGLEGAAPNVVGPRTYGDEVAARCHGGI

SEQ ID NO: 989380 - protein, 40 aa, Homo sapiens
GYDHRQNLKLYVGLRTSAHGDIKVDLDWPKNRGSERGNRQ

SEQ ID NO: 989381 - protein, 36 aa, Homo sapiens
MAQRLASLSIRRRDDLHAGRLSSCRRTHAVLFIAYD

SEQ ID NO: 989382 - protein, 79 aa, Homo sapiens
MPTLEGDSTMVTSPLAISSQPRLPHRWCPCILPTRQEPLKSPQVLGSSLSVRSPTDSPSSLKSPSMAVPSPELEEPHLK

SEQ ID NO: 989383 - protein, 49 aa, Homo sapiens
MPYIYFITGTHRHTAPTEPHEEDTVTASTLLPSWPSAEPGAEAACRILC

SEQ ID NO: 989384 - protein, 62 aa, Homo sapiens
QEHFCSSMSMQSRVLECMDPGRGEAGLEFGGLDAWALVTMVDVQQSLSWGGCSFILGGELGL

SEQ ID NO: 989385 - protein, 84 aa, Homo sapiens
PFFGSSFLPLPGHLFAIEKDIHAYTSLRGSQPAYEGQPLTHHRGSPHAASPRLISPPGFCPRGESCQGSLRNLNSLTLVDLREM

SEQ ID NO: 989386 - protein, 41 aa, Homo sapiens
LSPLLRWRVPRRLLNRRRRCRRQDHLGKVSLMMGLQTLSSC

SEQ ID NO: 989387 - protein, 68 aa, Homo sapiens
SLGHLQPGPTRTAHGPASPAPPVSRLPVGCPCGRHCDLAAGLQKGSQTGRQRTSEGDQLIRKKTHRRV

SEQ ID NO: 989388 - protein, 136 aa, Homo sapiens
SRASRYALRLPPLDLERIAVCKLPILILSCELRYSSPFSSGRSESTQHQEMQFLRAAKSGKHRHLTLLIKEQTERGANTEILSAHRTKNTMASCKAHNARGVGSEDGERHRTEPRLLGIMHFREVLHDEPSDSKTE

SEQ ID NO: 989389 - protein, 69 aa, Homo sapiens
PWTMEHSGDFFDGTSAFMLTQMGYRRSAGLNCSFLLETRLFNTRVSILIAGVKNRDKYLLRLLYLQIKD

SEQ ID NO: 989390 - protein, 129 aa, Homo sapiens
ASRVCRDGRSPQGSPSSSGSECDLFYPSRPPPSRQQTSFPMQLQSSSLAISDQYWQSGSRIGKVARVLVNGKVYEAQVVVLRGDCGISMSKTKRNQGIQAQSLFLLREKLGTTLLSLQFKMKRWRQMWH

SEQ ID NO: 989391 - protein, 45 aa, Homo sapiens
PLITATDEAEAEKFFETERQSLQRVKIMPLQDSLVIMSKTPKQQG

SEQ ID NO: 989392 - protein, 34 aa, Homo sapiens
YRLHSFSDPSLLGTPTDQDICFRYYSFQFQNFYF

SEQ ID NO: 989393 - protein, 59 aa, Homo sapiens
PDQCDKCREILSVDCSTNNPSQAKLRRELDESLQAAERLTRKYNELAKVLPEEDAQHLL

SEQ ID NO: 989394 - protein, 96 aa, Homo sapiens
FCTSSPGAGTRQLPKAVPTGTECSDDFEERDPDLRDGLENMLPAPSGSGHCSARLRPTSCGDCGAQPSAAECEAFMVSGTESEECFLTCHKRCLET

SEQ ID NO: 989395 - protein, 44 aa, Homo sapiens
MAGVTMLGFSKVAFQVDVVVLRGLSTAARTFSVTILVALQVMVP

SEQ ID NO: 989396 - protein, 134 aa, Homo sapiens
MKLFLLKLCLFYLVSVIEKSGYNCAGTDFAVESFWFIYRRNCGIHIEHRLHGFGLELHLHLIPLGKAKISCHGAAKAFFRAAQLLRAAQVLRAVTDSRAAQVLEQSPNIFYIRRSRPPAKSCHRFSGRHSFSGA

SEQ ID NO: 989397 - protein, 68 aa, Homo sapiens
SLSTPRQLEGGWKPVVPGDGDAVCGDDLLAALLISGHQTLSLALDFLYTMEPHIRRPVVCMLSDTTSV

SEQ ID NO: 989398 - protein, 55 aa, Homo sapiens
DCRRLEVEMKVLVGLVPFEGCEEESVPCLSSSFWRFAGNPWRGGAESQSLPSSSY

SEQ ID NO: 989399 - protein, 40 aa, Homo sapiens
HIDPHTHMHKYTPMHKDPHTHAQIHTHACTQTGIELNPHT

SEQ ID NO: 989400 - protein, 75 aa, Homo sapiens
LKDKRDLAWYRAEERDLLRLAEMRDFFIYGLEWDLLFFERDGMCLSALKMSQICLFFEEVLERELPRITKLVLRD

SEQ ID NO: 989401 - protein, 84 aa, Homo sapiens
MCATKHTPSPGPLLPWLHSSADERSRSPPLTRRAAAPEVTPAAVEAEAPRELQQHASELTLVFPEQGGGQLEDTIRGKPHHRLA

SEQ ID NO: 989402 - protein, 84 aa, Homo sapiens
MVPAIFRTSSGSAWRREYTSSAGDIPAAQQKPVRIPLRARRTRRALTVSEYCRDTMTRSTRIRNGSMTRRAAWIYTYTADTHCK

SEQ ID NO: 989403 - protein, 77 aa, Homo sapiens
AQQRTQVALDMANAYRGQEEQANQELDELIQRVKDFLNLSLPRVPGHVHGPFATLPVACISLASYVEPEGLHWVRSL

SEQ ID NO: 989404 - protein, 37 aa, Homo sapiens
TVDPARYINHSCASNCVAEVVTFDTEDKIIIISSRRK

SEQ ID NO: 989405 - protein, 56 aa, Homo sapiens
RSLLSLVKTSGEIGLILTSYWALEQQEGALQRCRDLALEEELGTEPTEGARMAVLL

SEQ ID NO: 989406 - protein, 74 aa, Homo sapiens
GSRSFTECPCYKEEQYIAEIKLYIPDKTHGIASDSVTQVKTVQGIQPALHTPQKFTDFRFVTSRSDTWRLVNPP

SEQ ID NO: 989407 - protein, 45 aa, Homo sapiens
PLYPSNHLMFLLVHLLALGKEVLSEGGEKCGFLRRAKGRCGAHLL

SEQ ID NO: 989408 - protein, 54 aa, Homo sapiens
VEDPREQDMQAPHSPPSHLYTWGLRNRQLAALILAPDLGKASCHNTCPYRQSVL

SEQ ID NO: 989409 - protein, 99 aa, Homo sapiens
QGKRQDAPSSAHLPDPNTISYLFLLEHQNRVAEKEPISKMPLHNQATARGPTPQRPSEVESKAHLTSAADICSHDVMAQDQVLLYYLQHPPITFAELKR

SEQ ID NO: 989410 - protein, 85 aa, Homo sapiens
FPVLLKAFSPRIYRLSGEPRISPGAALQLMLAVRDPHKAHFLFCHRSPALLLEPRVGVSGRWSGSLEEKHATVPLTTSEDGSALE

SEQ ID NO: 989411 - protein, 63 aa, Homo sapiens
SRTPSAAVFCSPGDRASTAFTGSELQPIAVASLLSCFLPSETSDFRVLFMISSRRFLRSCRSC

SEQ ID NO: 989412 - protein, 101 aa, Homo sapiens
KTCRGWSGGPQQSVSQTSMDVAANLHHGRVTGRSLERLKDGRGGIALDAITGGDDMQHTAPHLLTSRSSTQCDRELRTGATYQLQSTPDLSHRMTNLRTMS

SEQ ID NO: 989413 - protein, 80 aa, Homo sapiens
LSLQNNKTNYRWVCKTLQILNIMCGSRTTGRRLLDSCINWPNSSLMMSSSRTLINSSQPLCELTKPCMGTHESNGLDIIT

SEQ ID NO: 989414 - protein, 48 aa, Homo sapiens
MAGVAAVLRWLELTNPLVPKRPRRAEGTFREGIWYWRGFRLPMPPLTE

SEQ ID NO: 989415 - protein, 137 aa, Homo sapiens
MWSGVKKSNAAFTELVSISVWLAVLRRRLTNSKINAGAPSTKPKLGDSIIEAPAVLMWRDIVLSVSRGPVTPSLCEPVSLARERIFLLTINGDINTIVLLVLRLKTVDDPYAYLNLSRIRDTQYWAIAGPMFPEALH

SEQ ID NO: 989416 - protein, 86 aa, Homo sapiens
RKLLVINSTQAPFCGLLVTQRLHAPLSSALHSAPQAAGKSPLQLLTAGSRSFSSLQTPSLEPDTVTITRETEAGPGVVVHLCDPST

SEQ ID NO: 989417 - protein, 72 aa, Homo sapiens
FELEIRALSAGGQELSRLPLVSILPPSLMSAHALSACQARPTPKEVLCGPSSSAGPGSGGSSGEIRNGAGWA

SEQ ID NO: 989418 - protein, 32 aa, Homo sapiens
SGGNSNNSNTSSIHQQQQQQQAAPPQPQPQKA

SEQ ID NO: 989419 - protein, 40 aa, Homo sapiens
MSETGAFAETSNSRQGLPRRGSFVKSGPRLIFGGVSLMDL

SEQ ID NO: 989420 - protein, 115 aa, Homo sapiens
SWQKYALFEAVTGKGWDCVGQQVQPWRWIPSSGTARQNNIPFLPWQYPANLPAMNLPHRHPVSSHDNSALHYPPPGSKPFCSLFQKAQASTDTTGQQTKSESQSLPDQQRPLRNS

SEQ ID NO: 989421 - protein, 80 aa, Homo sapiens
LIAETFVLWFLSITGATSCFVGLAVGRRVPLVLLCRPFGVGLSLFYYTSVHGVTLLKTMWLDTLTWWLCRSERGRPREAV

SEQ ID NO: 989422 - protein, 129 aa, Homo sapiens
AGALKACGMAGVGREQCGAALPAPLLGPDLDMCADICRISLILLSWCPITQAIKSLGAKNSCELDWVTGSSPGNKLGVAKGTAWIEKHVEHGDLQLGSQAPNTRPWNRERPWYGREEEKVPREEARMEG

SEQ ID NO: 989423 - protein, 69 aa, Homo sapiens
GGRCGTKHCLRDSTSNDDSGSSFTVVSGSHFVVTVTFDFTSLLGGDLRRLLMRSLAVGLNRGGPRPAQY

SEQ ID NO: 989424 - protein, 44 aa, Homo sapiens
SVWLTVYAHACMCPHLPVPVSVCTCISVSLHHVCAWYSPRCGSV

SEQ ID NO: 989425 - protein, 80 aa, Homo sapiens
IGEEKILPTSETKQCTILDTYPGASEADEQEKLYLLLGLLLWNLMQQELVRLSEFTTASTLSLDNKCDVDLSLTTQDTEH

SEQ ID NO: 989426 - protein, 122 aa, Homo sapiens
TTCTHSAGSHDEHRYTHTHMHTHNEHGYTHTEHPHAHTCRYTRMSTVYTQTPTCTHIDEHGYTHAHPHAHTCTDTQISKSTHTTTCSSVCVHVCVCVCNRARLCTCTCVHMDVCVYPCQSRE

SEQ ID NO: 989427 - protein, 117 aa, Homo sapiens
SSAQRAECTLLRLWNQMTARTLPASSSGLEETQHYQTQALLYQHQASQTQPPCTSVGRVFATDRDSGPNVRLTFSLQHLSDDSQGLSASIPLTGEVTTLQTLDRELHSSYHLLVQVQ

SEQ ID NO: 989428 - protein, 36 aa, Homo sapiens
VVILYASPQLHTHNTQHTHDTQHTHEHSTHTSIQHT

SEQ ID NO: 989429 - protein, 89 aa, Homo sapiens
PEAPRRQTALRAETGPLHSSLGDRGTLHLSTTDQNSTDSHILNAWSSTLEYFQKRLHIEDLRIEKLLTYKREHLQGCHHTQDYSERESI

SEQ ID NO: 989430 - protein, 49 aa, Homo sapiens
VCVLMYPCSSVLCMWVCVYLLHTHAGTHTQTRMHTHAGTDTDEHGYTRT

SEQ ID NO: 989431 - protein, 71 aa, Homo sapiens
MRKQKADEKWNEEGRGMSRPREHQMSMRSKSLGQAGTDWNEDPAATHHLTVSHTYGPCTRACSTLGFGPLI

SEQ ID NO: 989432 - protein, 131 aa, Homo sapiens
RLTPSSPPTSSASAPLPPPFYAPLLEVVVPAGYFSESSPPFPLSLHQPSFCFCHSIETALVQVTSDLLLAHPKGLSPGLTSSISQQRLHSRALAPPCNAVFLWSPGLHTGLASSYPDGSSFSGSFAGSSSS

SEQ ID NO: 989433 - protein, 74 aa, Homo sapiens
AHVRVGEGDAAQLQLLGRSGLPASVPIQPLFWGLCAYHPVGYCGGRAAMLHKIASSCQHHSPQSSVHWRSAGVT

SEQ ID NO: 989434 - protein, 48 aa, Homo sapiens
DGLVDASGLRTKHGAGYNKKLCLSSGEIIKVTEAMTMMFEVQRPGGGF

SEQ ID NO: 989435 - protein, 61 aa, Homo sapiens
RTSGPETPEMCDVKHLPALGHSQLNVTRTSLLDRLCEQIIFSEAAAAVCFRYQPSEVDLNC

SEQ ID NO: 989436 - protein, 33 aa, Homo sapiens
MTECSDVTEDETYASVCALASYEDPGGSIIGGS

SEQ ID NO: 989437 - protein, 63 aa, Homo sapiens
NVRHETWRSTSKAVGSSMVQLLTCAAQGDEHYTGVAAREMGQALKTLSQAVRGVDALTTDPAV

SEQ ID NO: 989438 - protein, 47 aa, Homo sapiens
MSLLTSHVTLHADAITAEGAQIIPAARRCLYASVLTAQLTPHGAHLP

SEQ ID NO: 989439 - protein, 49 aa, Homo sapiens
EQVVGGIYGVMNRKRVHVFEESQVAGTPMLVVKAYLLVNESFGFTGYLR

SEQ ID NO: 989440 - protein, 69 aa, Homo sapiens
HAPRDQISIQKSRRHDQVQWLMRIIPALWEAKVGRITGGQEFDDQLGHMVKPRLYKKVQKLARCGGVHL

SEQ ID NO: 989441 - protein, 85 aa, Homo sapiens
YSHSAYSCNKYRRVKRQTKVRLAESAPKGLLLWEHGLSCRVKLSYVAYGPGVPQRDRASQLKRQHGSSVVCRQANLGDWRSSRAP

SEQ ID NO: 989442 - protein, 131 aa, Homo sapiens
RYTGSVWETFLLVNITPHLHLNAHPTLHSYVSCIPAATHTRTHSTQHNTAHTRAQHTHEHTAHTQTHSTHSTHMSTHAHTQRAHAQHTLTHAHTCTQTARDTHCTHMHTPHTRKPTAHTKRTAHTHTQHTH

SEQ ID NO: 989443 - protein, 105 aa, Homo sapiens
MSYVHKYTCPQTCTHVHTSHIHKHAHACTHIHLRKHAHMHVHTYTHLHTYTSTNMHTHMYTHTPPQTCIHARAHTPPQTCTHMHTRPQMCMHVHTYTSTNMGDPL

SEQ ID NO: 989444 - protein, 52 aa, Homo sapiens
PCSCYDTYNPYILHLNSHPKKHSYLYASPQLQTHNTQHTHAHTAHTRKHSTR

SEQ ID NO: 989445 - protein, 103 aa, Homo sapiens
TPQYLTSQCPILGKHSYFMHPRSYTRTTHSTRMNTAHTRAQHTHEHTAHTQTHSTHRTQMSTQHTHGAHSTHTHTHPHTAHKRTEHTSTHMHTQHTRKRTAHT

SEQ ID NO: 989446 - protein, 57 aa, Homo sapiens
LFRHKKHSYFMHPRSYTQTDTQHTHNTADTRAQHTHEHTAHTQTHSTHSTQMSTQHT

SEQ ID NO: 989447 - protein, 52 aa, Homo sapiens
FTLNPKSYISIPILQKHSYVYASPQYTHRTHSTRMNTAHTRAQHTHEHTAHT

SEQ ID NO: 989448 - protein, 79 aa, Homo sapiens
RGTKECQRHQGGQRHQGGRDPCLLAASGPQAEPQSPSLEAHAEAHNTQNRAQPCGQRERDVAVQIERHGNVRLGSSTHL

SEQ ID NO: 989449 - protein, 76 aa, Homo sapiens
EKDEKSESDDEKREHDEDAKKDFVKMEKSGVTHAADVRNQTEHQPYYTSSPNRTVKEWHQTIHCHEQDHTAVPTDQ

SEQ ID NO: 989450 - protein, 95 aa, Homo sapiens
ARRDGESAPLPAPGDGEERHRLRVAAAASLHRDQSSCCSCAQAQPMLCGHAPSMHLAIQWRLLQGHEHRAQAVHIFALIAELEGEVNRWTTFSDS

SEQ ID NO: 989451 - protein, 95 aa, Homo sapiens
RGTKERLPLFQALKELPIQSSDLHSTQAAILISVFFSVHLLGTPGLRLCWDLHLQRLLAFVVKSLLILPQSPLTITCTKAPGFPSCKPPSLVLWG

SEQ ID NO: 989452 - protein, 57 aa, Homo sapiens
PEAPSRSDEHSPKWLSSPPVNIVLTTFSPESAAHLDLGCPSVTLHVRLTVPSSLEPL

SEQ ID NO: 989453 - protein, 36 aa, Homo sapiens
KSASSEVAPAAGEQEPGLTGALESWTEPTSTRDTRT

SEQ ID NO: 989454 - protein, 40 aa, Homo sapiens
VRRRLSRIRRIAAGLYVSWQSPIRIRGLASRQYTCRRNCI

SEQ ID NO: 989455 - protein, 60 aa, Homo sapiens
PPTFRHAYYRGLHRLTNDTVTRNTPDTRDPTAKTPQLLDRRRTILTGHCTDEHPMMTTTY

SEQ ID NO: 989456 - protein, 133 aa, Homo sapiens
SSTETLGLCHARREKIKVSSILAVSITASCQEKQVRSGKGLSTENKEEWDRKAEDAWRDYEKAMKDYEGGRGESSMRDPSKKMTRVEVKLAKKSTPSRGSSSKVVLEAAMRELQEPRVRVYVMRALRESLRRT

SEQ ID NO: 989457 - protein, 90 aa, Homo sapiens
VRRRLSSCNSKVGRGETAENLQEEKERKLECVPLNLPLMTLKVSRSSSNYLMCSRVERRFPFSPSLTVIHEFLFSLGGKARKVSDWRGVT

SEQ ID NO: 989458 - protein, 37 aa, Homo sapiens
MWAQGDREPLKKQNSLSKSCFLMLEPPQLLESLRRTG

SEQ ID NO: 989459 - protein, 83 aa, Homo sapiens
AGITGVSHCAWPGFTILNAIKNICGSWEEVKISTLTRVKLILALTDDFERFKTSVEEVNYTCSGNRQRVSGELVRRRLSFINH

SEQ ID NO: 989460 - protein, 62 aa, Homo sapiens
MDIYRASDPLPWPLLYLLHHGSLIYVGQYVCMLLDTYTRCETAGRARRLTQCLYSYSLKLPL

SEQ ID NO: 989461 - protein, 46 aa, Homo sapiens
RTGHARDRTFQKWSAVVAPSGEEPRYTCLVQHEGLPTPLTLRWKPY

SEQ ID NO: 989462 - protein, 85 aa, Homo sapiens
STQRNSCVFLQSDITIVLYPWNASPCSWKTFDYATSITMAQASDGLYSMQVPWQLTSLPWSLTFRQEETIIIIRLIEQARHASYG

SEQ ID NO: 989463 - protein, 83 aa, Homo sapiens
MALNWKQVRVDYRGSVSDVPDFDLSSELYEHAMALSEDEDMRACYERSNEYQLIDCAQDFLDKTDALKQADYVPSDQHLRRYR

SEQ ID NO: 989464 - protein, 73 aa, Homo sapiens
MSSALDEHGHSPMAGPSDDIVVSLLYERKPTSRDLILEHYRYSRLTRRYMLSPAIHHDNPYSLGLYRLSRQRQ

SEQ ID NO: 989465 - protein, 119 aa, Homo sapiens
RAQDTQAPNLMPPPFLDDADGNPHPSRYQRLGSARENCMQEHLMPYKGATSPGLNQVLSQARNHEISPLDSMIQRLQQEQDLRRSGEAVISNTSRLSRGSIKFYLRGSFTTKRMTKTLW

SEQ ID NO: 989466 - protein, 74 aa, Homo sapiens
EQDKQVDQRRGLDPGRKKTLYVTLAIARPPASCQLLPTNAKGIATNTCMRAFALQPKILAMMHPAIPALGSKGK

SEQ ID NO: 989467 - protein, 38 aa, Homo sapiens
ENSSNEEETSSEGNMRVHAVDSCMSFQCKRGHSMHPHV

SEQ ID NO: 989468 - protein, 73 aa, Homo sapiens
NRTSRVLFRMSDVMPPEKKRTIATILLEISKGVVLVTNIKPKSSSLIPSHGLCSDERAVEQTESRFLNSGEVT

SEQ ID NO: 989469 - protein, 36 aa, Homo sapiens
GYQWKMLNTFALLVLNEQFNWVSVLSYLTQGEDQYY
